US008362230B2

(12) United States Patent
Plasterk et al.

(10) Patent No.: US 8,362,230 B2
(45) Date of Patent: Jan. 29, 2013

(54) NUCLEIC ACID MOLECULES AND COLLECTIONS THEREOF, THEIR APPLICATION AND MODIFICATION

(75) Inventors: Ronald H. A. Plasterk, Bussum (NL); Eugene Berezikov, Vleuten (NL); Edwin P. J. G. Cuppen, Bilthoven (NL)

(73) Assignee: Koninklijke Nederlandse Akademie van Wetenschappen, Amsterdam (NL)

(*) Notice: Subject to any disclaimer, the term of this patent is extended or adjusted under 35 U.S.C. 154(b) by 0 days.

(21) Appl. No.: 12/087,649

(22) PCT Filed: Jan. 10, 2007
(Under 37 CFR 1.47)

(86) PCT No.: PCT/NL2007/000012
§ 371 (c)(1),
(2), (4) Date: Jul. 23, 2009

(87) PCT Pub. No.: WO2007/081204
PCT Pub. Date: Jul. 19, 2007

(65) Prior Publication Data
US 2010/0035760 A1     Feb. 11, 2010

(30) Foreign Application Priority Data

Jan. 10, 2006  (WO) ............... PCT/NL2006/000010
Sep. 29, 2006  (WO) ............... PCT/NL2006/000491

(51) Int. Cl.
*C07H 21/04*      (2006.01)
(52) U.S. Cl. ..................................... 536/24.5
(58) Field of Classification Search ............... 536/24.5
See application file for complete search history.

(56) References Cited

U.S. PATENT DOCUMENTS

| | | | | |
|---|---|---|---|---|
| 5,989,885 A | * | 11/1999 | Teng et al. ................. | 435/194 |
| 2007/0161031 A1 | * | 7/2007 | Trinklein et al. ........... | 435/6 |
| 2010/0273255 A1 | * | 10/2010 | Tuschl et al. ............... | 435/325 |

FOREIGN PATENT DOCUMENTS

| | | |
|---|---|---|
| WO | WO 2007/081196 A1 | 7/2007 |
| WO | WO 2007/081204 A2 | 7/2007 |

OTHER PUBLICATIONS

Griffiths-Jones Nucleic Acids Res. Jan. 1, 2004;32(Database issue):D109-11.*
Krutzfeldt et al. (2006) Nature Genetics 38:514-519.*
Esau et al. Advanced Drug Delivery Reviews 59, 2007, 101-114.*
Chan et al., MicroRNA-21 is an antiapoptotic factor in human glioblastoma cells, Cancer Research, Jul. 15, 2005, Cancer Research, pp. 6029-6033, vol. 65, No. 14.
Ciafre et al., Extensive modulation of a set of microRNAs in primary glioblastoma, Biochemical and Biophysical Research Communications, 2005, pp. 1351-1358, vol. 334.
Lu et al., MicroRNA expression profiles classify human cancers, Nature, Jun. 2005, pp. 834-838, vol. 435.
Nelson et al., RAKE and LNA-ISH reveal microRNA expression and localization in archival human brain, RNA, (retrieved on Nov. 2, 2007) <http://www.majournal.org/cgl/content/abstract/12/2/187>.
Nelson et al., Microarray-based, high-throughput gene expression profiling of microRNAs, Nature Methods, Nov. 2004, pp. 155-161, vol. 1, No. 2.
Bottoni et al., miR-15a and miR-16-1 down regulation in pituitary adenomas, Journal of Cellular Physiology, 2005, pp. 280-285, vol. 204.
Eis et al., Accumulation of miR-155 and BIC RNA in human B cell lymphomas, Proceedings of the National Academy of Sciences USA, Mar. 8, 2005, pp. 3627-3632, vol. 102, No. 10.
He et al., A microRNA polycistron as a potential human oncogene, Nature, Jun. 9, 2005, pp. 828-833, vol. 435.
Benard et al., Micro-RNA et oncogenese, Bulletin Du Cancer, 2005, pp. 757-762, vol. 92, No. 9.
Calin et al., Human microRNA genes are frequently located at fragile sites and genomic regions involved in cancers, Proceedings of the National Academy of Sciences USA, Mar. 2, 2004, vol. 101, No. 9, pp. 2999-3004.
Suh et al., Human embryonic stem cells express a unique set of microRNAs Developmental Biology, Academic Press, May 6, 2004, pp. 488-498, vol. 270, No, 2, New York, NY, US.
Babak et al., Probing microRNAs with microarrays: Tissue specificity and functional inference, RNA, Nov. 2004, pp. 1813-1819, vol. 10, No. 11, Cold Springs Harbor Laboratory Press, Woodbury, NY, US.
Lim et al., Microarray analysis shows that some microRNAs downregulate large numbers of target mRNAs, Nature, Feb. 17, 2005, pp. 769-773, vol. 433, No. 7027.
PCT International Search Report, PCT/NL2007/000012, Feb. 1, 2008.
Ciafre et al., Extensive modulation of a set of microRNAs in primary glioblastoma, Biochemical and Biophysical Research Communications, Sep. 9, 2005, pp. 1351-1358, vol. 334, No. 4., Academic Press Inc., Orlando, FL, US.
Babak Tomas et al., Probing microRNAs with microarrays: Tissue specificity and functional inference, RNA, Nov. 2004, pp. 1813-1819, vol. 10, No. 11, Cold Spring Harbor.
Lim et al., Microarray analysis shows that some microRNAs downregulate large numbers of target mRNAs, Nature, Feb. 17, 2005, pp. 769-773, vol. 433, No. 7027, Nature Publishing Group, London, GB.

(Continued)

*Primary Examiner* — Brian Whiteman
(74) *Attorney, Agent, or Firm* — Kathleen Williams; Amy DeCloux; Edwards Wildman Palmer LLP

(57) ABSTRACT

The invention provides a method for characterising a sample comprising nucleic acid derived from a cell. The method comprises determining whether a sample comprises at least a minimal sequence of at least one new microRNA (miRNA) according to the invention or a mammalian ortholog thereof and characterizing the sample on the basis of the presence or absence of the miRNA. The invention further provides nucleic acid molecules and collections thereof and their use in therapeutic and diagnostic applications. The invention furthermore provides a method for identifying a miRNA molecule or a precursor molecule thereof.

14 Claims, 559 Drawing Sheets

OTHER PUBLICATIONS

Database Biosis [Online] Biosciences Information Service, Philadelphia, PA, US, Nov. 2005, Lechman et al., MicroRNA expression profiling in sorted AML subpopulations: A possible role for miR-155/BIC in stem cell maintenance and leukemogenesis.

PCT International Search Report, PCT/NL2006/000010, dated Dec. 29, 2006.

Berezikov et al., Genome Res. 2006 16: 1289-1298.

European Search report EP1 1181833 (Jun. 29, 2012).

Griffiths-Jones S. et al.: "miRBase:microRNA sequences, targets and gene nomenclature", Nucleic Acids Research, Oxford University Press, GB, vol. 34, No. suppl. 1, Jan. 1, 2006, pp. D140-D144.

Konno, H. et al (2005) Mus musculus 16 days neonate thymus cDNA, RIKEN full-length enriched library, clone:A130012F16, 3' end partial sequence, similar to ddbj:AJ131777 Mus musculus mRNA for src-like adaptor protein, EMBL Bank : BB153256.

Suh Mi-Ra et al:"Human embryonic stem cells express a unique set of microRNAs", Developmental Biology, vol. 270, No. 2, Jun. 15, 2004, pp. 488-498.

Ciafre et al. Extensive modulation of a set of microRNAs in primary glioblastome, Biochemical and Biophysical Research Communications, Academic Press Inc. Orlando, FL, US, vol. 334, No. 4, Sep. 9, 2005, pp. 1351-1358.

Babak T., et al. "Probing microRNAs with microarrays: Tissue specificity and functional inference", RNA (Cold Spring Harbor), vol. 10, No. 11, Nov. 2004, pp. 1813-1819.

Lim L.P. et al.: "Microarray analysis shows that some microRNAs downregulate large numbers of target mRNAs", Nature, Nature Publishing Group, London, GB, vol. 433, No. 7027, Feb. 17, 2005, pp. 769-773.

Lechman E.R. et al.: "Micro RNA expression profiling in sorted AML subpopulations: A possible role for miR-155/BIC in stem cell maintenance and leukemogenesis", * abstract * Blood, vol. 106, No. 11,Part1, Nov. 2005, p. 140A, 47th Annual Meeting of the American-Society-of-hematology; Atlanta, GA, USA; Dec. 10-13, 2005.

* cited by examiner

FIG. 1B

FIG 1B Con't.

FIG. 1B Con't.

FIG 1B Con't.

FIG 1B Con't.

FIG. 1B Con't.

FIG. 1B Con't.

FIG. 1B Cont'd.

FIG. 1B Con't.

FIG 1B Con't.

FIG 1B Con't.

FIG 1B Con't.

FIG. 1B Con't.

FIG. 1B Cont.

FIG. 1B Con't.

FIG. 1B Con't.

FIG. 1B Con't.

FIG 1B Con't.

FIG. 1B Con't.

FIG 1B Con't.

FIG. 1B Con't.

FIG. 1B Cont'.

FIG. 1B Con't.

FIG. 1B Con't.

FIG 1B Con't.

FIG 1B Con't.

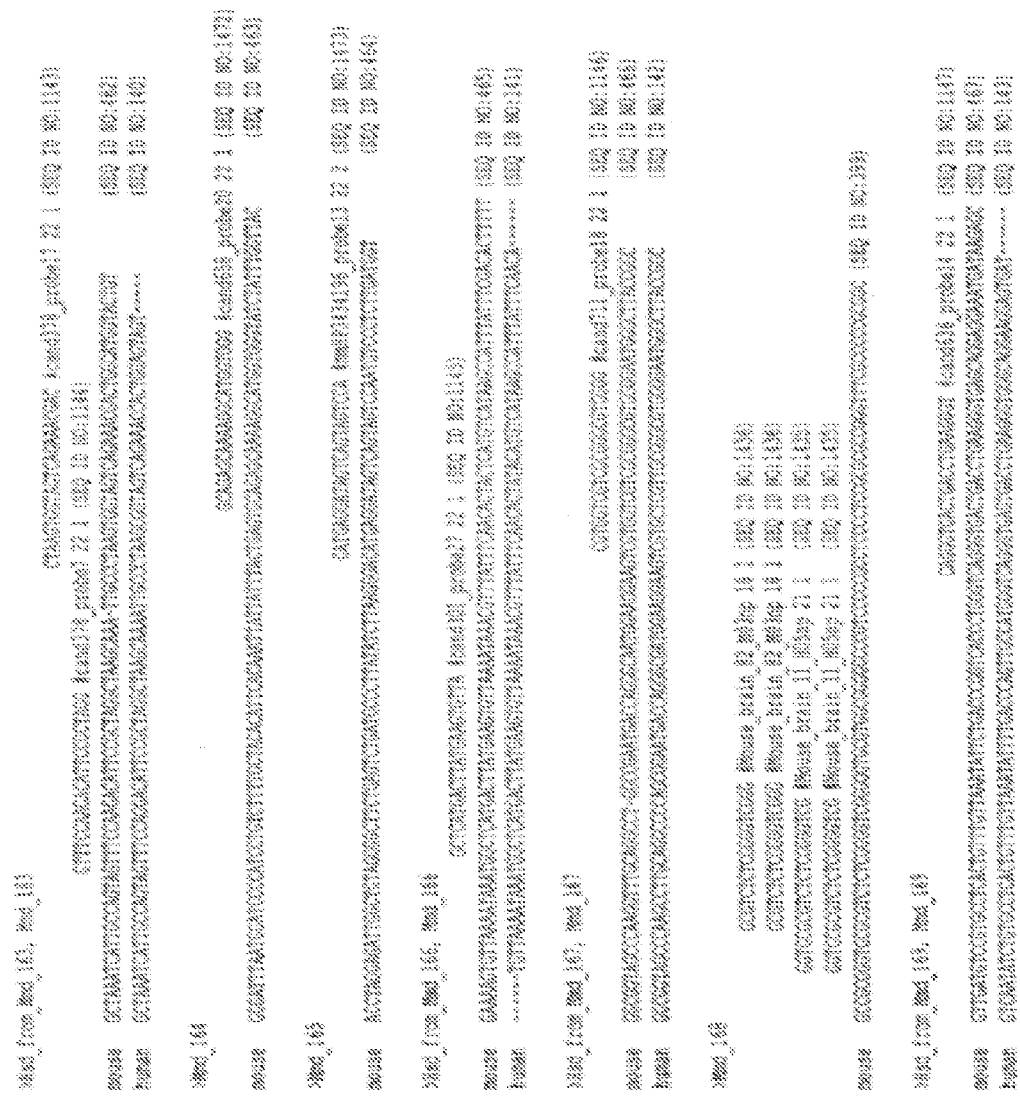

FIG 1B Con't.

FIG. 1B Con't.

FIG. 1B Con't.

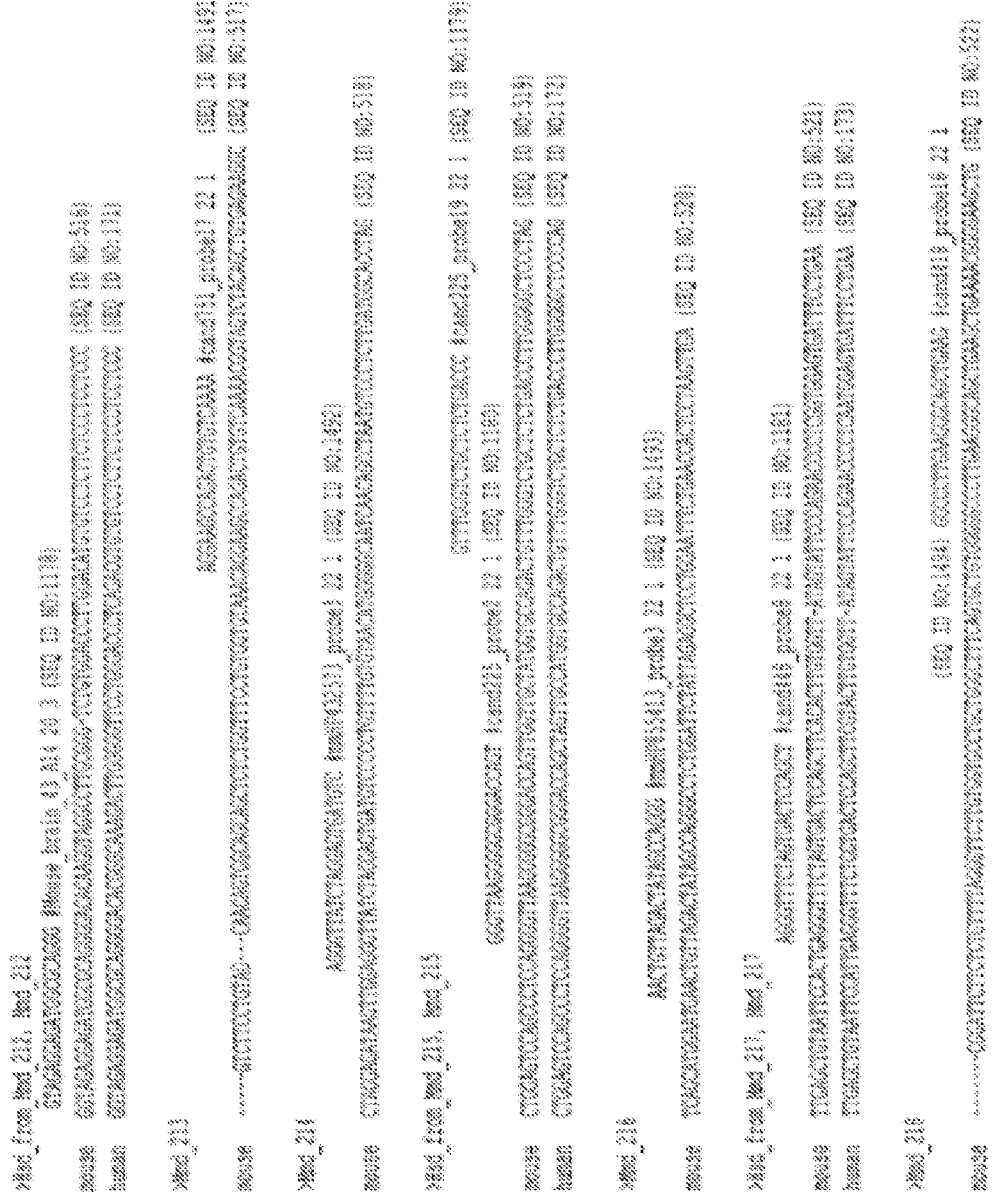
FIG. 1B Con't.

FIG. 1B Con't.

FIG. 1B Con't.

FIG. 1B Con't.

FIG. 1B Con't.

FIG 1B Con't.

FIG. 1B Con't.

FIG. 1B Con't.

FIG 1B Con't.

FIG. 1B Con't.

FIG. 1B Con't.

FIG 1B Con't.

FIG. 1B Con't.

FIG. 1B Con't.

FIG. 1B Con't.

FIG. 1B Con't.

FIG. 1B Con't.

FIG. 1B Con't.

FIG. 1B Con't.

FIG. 1B Cont.

FIG. 1B Con't.

FIG. 1B Cont'.

FIG. 1B Con't.

FIG. 1B Con't.

FIG. 1B Con't.

FIG. 1B Cont.

FIG. 1B Con't.

FIG. 1B Con't.

FIG. 1B Con't.

FIG. 1B Con't.

FIG. 1B Con't.

FIG. 1B Cont.

FIG. 1B Con't.

FIG. 1B Con't.

FIG. 1B Cont.

FIG 1B Con't.

FIG. 1B Cont.

FIG 1B Con't.

FIG. 1C Con't.

FIG 1C Con't.

FIG 1C Con't.

FIG 1C Con't.

FIG 1C Con't.

FIG 1C Con't.

FIG 1C Con't.

FIG. 1C Con't.

FIG. 1C Con't.

FIG. 1C Con't.

FIG. 1C Con't.

FIG. 1C Con't.

FIG 1C Con't.

FIG. 1C Con't.

FIG 1C Con't.

FIG. 1C Con't.

FIG. 1C Cont.

FIG. 1C Con't.

FIG. 1C Con't.

FIG. 1C Con't.

FIG. 1C Cont.

FIG 1C Con't.

FIG. 1C Con't.

FIG. 1C Cont.

FIG. 1C Con't.

FIG 1C Com't.

FIG. 1C Cont'd.

FIG. 1C Con't.

FIG. 1C Con't.

FIG. 1C Con't.

FIG. 1C Con't.

FIG. 1C Con't.

FIG 1C Con't.

FIG. 1C Con't.

FIG. 1C Con't.

FIG. 1C Con't.

FIG. 1C Cont.

FIG 1C Con't.

FIG. 1C Con't.

FIG. 1C Con't.

FIG. 1C Con't.

FIG 1C Con't.

FIG. 1C Cont'l.

FIG. 1C Con't.

FIG. 1C Con't.

FIG. 1C Cont.

FIG. 1C Con't.

FIG. 1C Cont.

FIG. 1C Con't.

FIG. 1C Con't.

FIG. 1C Cont.

FIG. 1C Con't.

FIG 1C Con't.

FIG 1C. Con't.

FIG. 1C Con't.

FIG. 1C Cont.

FIG. 1C Con't.

FIG. 1C Con't.

FIG. 1C Con't.

FIG 1C Con't.

FIG. 1C Con't.

FIG. 1C Con't.

FIG. 1C Con't.

FIG. 1C Con't.

FIG 1C Cont.

FIG 1C Con't.

FIG 1C Con't.

FIG. 1C Cont'l.

FIG 1C Con't.

FIG. 1C Con't.

FIG 1C Con't.

FIG. 1C Con't.

FIG 1C Con't.

FIG. 1C Con't.

FIG 1C Con't.

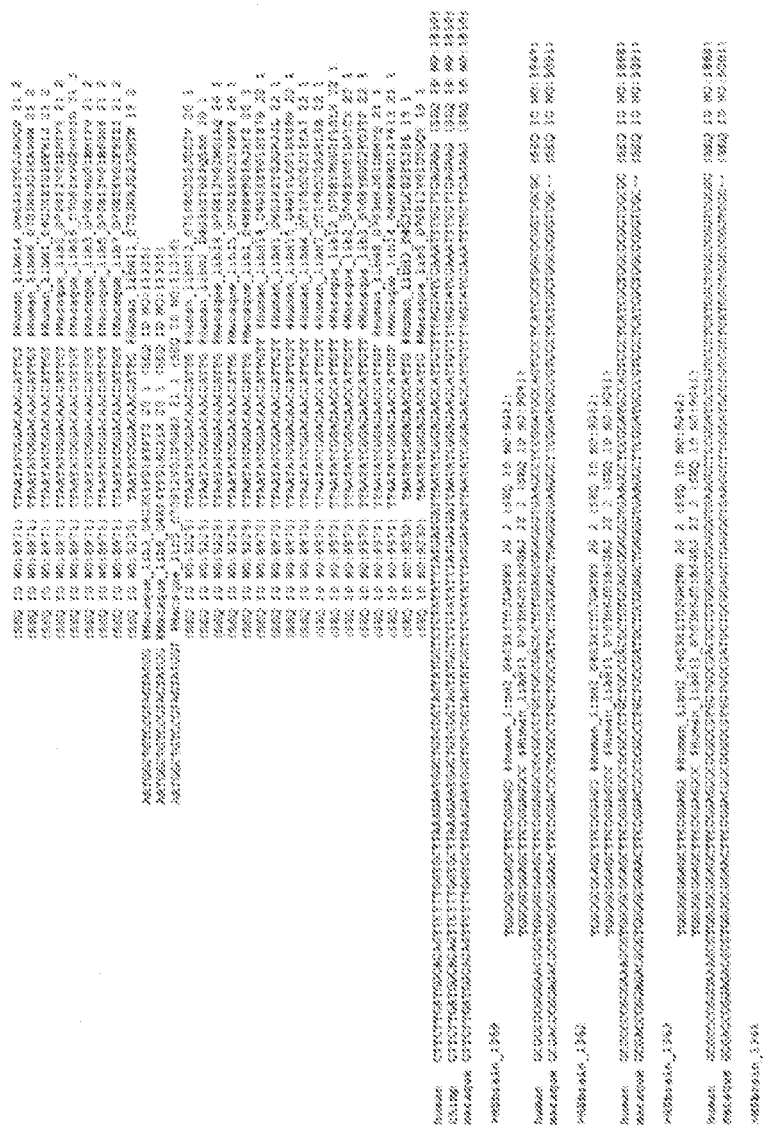
FIG. 1C Con't.

FIG. 1C Con't.

FIG 1C Con't.

FIG. 1C Cont.

FIG 1C Con't.

FIG. 1C Cont'l

FIG. 1C Con't.

FIG 1C Cont'd

FIG. 1C Con't.

FIG. 1C Con't.

FIG. 1C Cont'd.

FIG 1C Con't.

FIG. 1C Cont.

FIG 1C Con't.

FIG 1C Con't.

FIG. 1C Cont.

FIG. 1C Con't.

FIG. 1C Cont'l.

FIG 1C Con't.

FIG. 1C Con't.

FIG 1C Cont.

FIG. 1C Con't.

FIG. 1C Con't.

FIG 1C Con't.

FIG. 1C Con't.

FIG 1C Con't.

FIG 1C Con't.

FIG 1C Con't.

FIG. 1C Con't.

FIG. 1C Con't.

FIG. 1C Cont.

FIG 1C Con't.

FIG. 1C Con't.

FIG. 1C Con't.

FIG 1C Con't.

FIG 1C Cont.

FIG 1C Con't.

FIG 1C Con't.

FIG. 1C Con't.

FIG. 1C Con't.

FIG. 1C Con't.

FIG 1C Con't.

FIG 1C Con't.

FIG 1C Con't.

FIG 1C Con't.

FIG. 1C Con't.

FIG. 1C Con't.

FIG 1C Con't.

FIG. 1C Cont.

FIG. 1C Con't.

FIG. 1C Con't.

FIG. 1C Con't.

FIG. 1C Con't.

FIG 1C Cont.

FIG. 1C Con't.

FIG. 1C Con't.

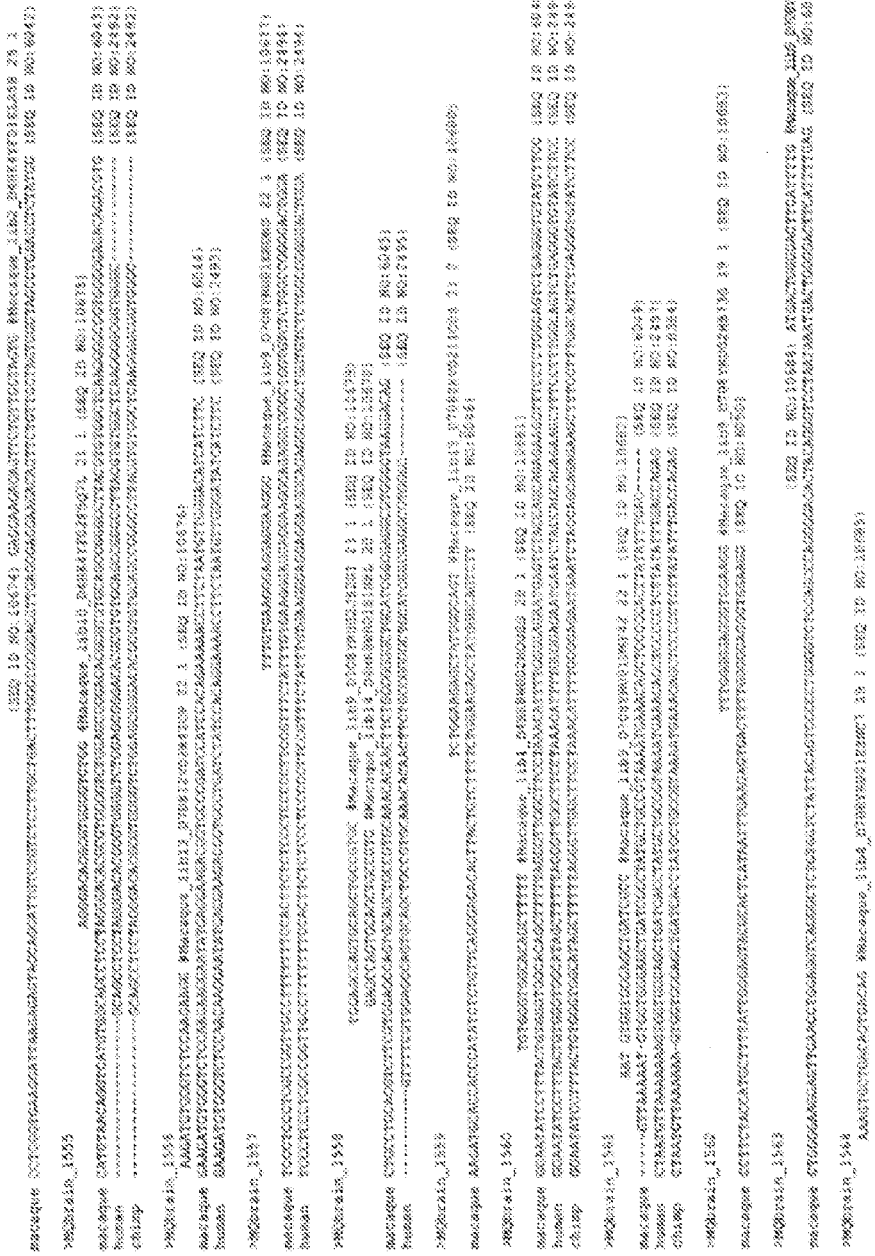

FIG 1C Con't.

FIG. 1C Con't.

FIG. 1C Con't.

FIG. 1C Con't.

FIG 1C Con't.

FIG 1C Cont.

FIG. 1C Con't.

FIG. 1C Con't.

FIG. 1C Cont.

FIG. 1C Con't.

FIG 1C Con't.

FIG. 1C Con't.

FIG 1C Con't.

FIG. 1C Cont'.

FIG. 1C Con't.

FIG. 1C Con't.

Modified RAKE microarray results. Hybridization results for a single positive tissue (mouse 8.5 dpc embryo, 16.5 dpc embryo, brain or embryonic stem (ES) cells) for all probes in a tiling path are shown for every novel miRNA. Hairpin sequences are shown where numbers indicate the most 3' end of the respective probe on the RAKE microarray. The small images show the raw results for the respective probes. Annotation (cand*** probe%%) refers to the positive probe and matches experimental evidence annotation for mature miRNAs in FIG. 1.

FIG 2 Con't.

Mmd_2
cand350 probe20  1 2 3 4 5 6 7 8 9 10 11 12 13 14 15 16 17 18 19 20 21 22   (SEQ ID NO:501)
GAAGAAATCCTACTCGGGTGGATATAATACAACCTGCTAAGTGTTCTAGCACTTAGCAGGTTGTATTATCATTGTCCGAGGTTATGGCTCTCGTC
...((...((..((((((...((((((((((((....))))))))))))..)))))..))...)))...

Mmd_3
cand234 probe26  23 24 25 26 27 28 29 30 31 32 33 34 35 36 37 38 39 40 41 42 43 44   (SEQ ID NO:606)
TTGGCAGACTGGGAAATCTCTGCAGGCAAATGTGATGTCACTGAAGAAACCACACACTTACCTGTAGAGAATTCTTCAGTCTGACAA
.(((.((((((..(((.((((...((......)).))..)).)))))))))-))))))).))

Mmd_5
cand210 probe14  1 2 3 4 5 6 7 8 9 10 11 12 13 14 15 16 17 18 19 20 21 22   (SEQ ID NO:820)
GACGTACGGTGCTTAATGAGAAGTTGCCCGCGTGTTTTCCCTTTATATGTGACGAAACATTCGCGGTGCACTTCTTTTTCAGCATCCTATTCTACGTT
(((((((.(((((((.((.(((((((((((((((((((......))))).)))))..))))..)))))))))))).)).)))))).....))))))

Mmd_6
cand347 probe29  23 24 25 26 27 28 29 30 31 32 33 34 35 36 37 38 39 40 41 42 43 44   (SEQ ID NO:861)
AGATTTGCTTTTTCTCTTCCATGCCTTGAGTGTAGGACCGTTGACATCTTAATTACCCTCCCACACCCAAGGCTTGCAGGAGACCAAGCCTTCT
(((...(((.(((((((.((((((.(((((..((......))..)).)))).))))))).)))))))))).)))

Mmd_7
cand355 probe41  23 24 25 26 27 28 29 30 31 32 33 34 35 36 37 38 39 40 41 42 43 44   (SEQ ID NO:872)
GCTATGTACTGCACAACCCTAGGAGGGGGTGCCATTCACATAGAGTATAATTGAATGGCGCCACTAGGGTTGTGCAGTGTACAGC
(((.((((((((((((((((....((((((((((..((......)).)))))))))))))))))))))))).-)))

Mmd_9
cand212 probe16  1 2 3 4 5 6 7 8 9 10 11 12 13 14 15 16 17 18 19 20 21 22   (SEQ ID NO:894)
GAGCCTTGGTACTTGGAGAGTGGTTATCCCTGTCCTCTTCCCTTCACTCATGCCGAATCGTACAGGGTCATCCACTTTTTCAGTATCAAGTGCGC
..((((((((..((((((((..(((((((((((......)))).))).)))))...))..)))))))))..))..

Mmd_11
cand254 probe17  1 2 3 4 5 6 7 8 9 10 11 12 13 14 15 16 17 18 19 20 21 22   (SEQ ID NO:403)
GTGCTCTTGTGGCCCATGAAATCAAGCTTGGGTGAGACCTGGTGCAGAACAGGAAGGCGACCCATACTTGGTTTCAGTGCTGCAAGAATGACTGCAT
(((((((((...((.((((((((.((((...(((........))))...)))).)))))))).))...))))))....))))

Mmd_13
cand43 probe5  1 2 3 4 5 6 7 8 9 10 11 12 13 14 15 16 17 18 19 20 21 22   (SEQ ID NO:425)
TGGCAGGCCAGGAAGAGGAGGAAGCCCTGGAGGGGCTGGAGGTGATGGATGTTTTCCTCCGGTTCTCAGGGCTCCACTCCTTTCGAGCCGTAGAGCCA
.(((((((..((((((..((((((.(((((((((((((((......))))))))))))))))))))))).))))))...)))).))

Mmd_14
cand972 probe5  1 2 3 4 5 6 7 8 9 10 11 12 13 14 15 16 17 18 19 20 21 22   (SEQ ID NO:436)
GGATCTCAGACGTCTCGGGGATCATCATGTCACGAGATACCACTGTGCCCTTGTGACAGATTGATAACTGAAAGGTCTGGGAGCC
((((((((((.(.(((...(((((((((..(((......)))..)))))))))...)))))).)))))))).))

Mmd_15
cand371 probe3  1 2 3 4 5 6 7 8 9 10 11 12 13 14 15 16 17 18 19 20 21 22   (SEQ ID NO:447)
TGGGGACTGCCCTCAAGGAGCTTACAATCTAGCTGGGGGTAGATGACTTGCACTTGAACACAACTAGACTGTGAGCTTCTAGACGGCAGGGGCCTTA
((((...((((((.((((((((.((((.(.(..(((....)).).)..).)))).)))))))).)))))).))))))

Mmd_16
cand213 probe4  1 2 3 4 5 6 7 8 9 10 11 12 13 14 15 16 17 18 19 20 21 22   (SEQ ID NO:458)
GCTACTGTTTCATACTTGAGGAGAAAATTATCCTTGGTGTGTTGGCTCTTTTGGATGAATCATACAAGGATAATTTCTTTTTGACTATCAAATACTGC
(((...((((((..(((((((.(((..((((....)))).)))))))))).))))))...))..

Mmd_17
cand216 probe21  1 2 3 4 5 6 7 8 9 10 11 12 13 14 15 16 17 18 19 20 21 22   (SEQ ID NO:468)
GGTAAGTGTGCCTCGGGTGAGCATGCACTTAATGTAGGTGTATGTCACTCGGCTCGGCCCACTACC
((((.((((.(((((((((((......)))))))))))))))))))))

FIG 2 Cm't.

```
Mmd_19                        23 24 25 26 27 28 29 30 31 32 33 34 35 36 37 38 39 40 41 42 43 44    (SEQ ID NO:490)
cand623 probe27
GGGCCCCCGCAACTGCTGCTACCGCCGGCCCCCCGAGCTTTGAGGTTTCCACCCATGGCCGGGCCTCCTCCGGGCCGGCAGCAGCCGCCGAACAGCTC
((((...(.(((((....(((((((((((((...((((((((...))))))))...))))))))))))))).))...))))

Mmd_20                        1  2  3  4  5  6  7  8  9 10 11 12 13 14 15 16 17 18 19 20 21 22    (SEQ ID NO:502)
cand601 probe3
GGTGAGTCTCCTCAGGTGCTCATGTGGGAGAGATTAGCCTGTGTTTATAAGCTGGTCTGTTCATTAAGCGCCTGCTGGAGTGGAACC
(((....(((((..((((((...(((((((..((((((((....)))))))))))))))...)))))....)))....)))

Mmd_21                        1  2  3  4  5  6  7  8  9 10 11 12 13 14 15 16 17 18 19 20 21 22    (SEQ ID NO:513)
mmHP633267 probe20
GTGTGTCTCATTTCTGAGCCTTTATATACCCTCCCATGTTGAGAATTGAGCAATGCTGTGGTGGGAGGTTAAGGATGAAGGCCTCAGGAGGCTAAAGC
....(((((....((((((....((..((((((((((...((.(((....)))..)).))...)))))))))).))...))))))

Mmd_22                        1  2  3  4  5  6  7  8  9 10 11 12 13 14 15 16 17 18 19 20 21 22    (SEQ ID NO:524)
cand472 probe7
GTATTTGAGGTTAGGAAGGCGTGATAATGAGGCTGTGAAGATTCATGGCCTCTTTTCTATGGCTTAATTTAGGCTCTATATCAAATAT
(((((((((((....((((..(((((((((((....))))))))))).)).....)))))...)))))).....)))))))

Mmd_23                        1  2  3  4  5  6  7  8  9 10 11 12 13 14 15 16 17 18 19 20 21 22    (SEQ ID NO:533)
cand644 probe15
CATTCTTTCAGTGTTGAAACAATCTCTACTGAACCAAGCTCCAAAGCGAGTTCACTGGAGTTTGTTTCAGTATTGCAGGAGTG
(((((((....((((((.(((((((.((.(....((((...))))..))))))))))))..)))))).)))))))

Mmd_24                        23 24 25 26 27 28 29 30 31 32 33 34 35 36 37 38 39 40 41 42 43 44    (SEQ ID NO:544)
cand174 probe40
TTCTCAACAGTGATGTGATATGTGATTTCCCCTTCCAAGCCATGGTGCAGTTTCATCGGCACCATGGCCAAGAGGGCTCCATCTTGGTAAGAGAA
.((((.((((...((((((....))))))...)))))))).....

Mmd_26                        1  2  3  4  5  6  7  8  9 10 11 12 13 14 15 16 17 18 19 20 21 22    (SEQ ID NO:199)
cand65 probe6
CTCTCCTTCACCTTTCTTTTAGCAAAGATGAGGATTCTACCTTCAACATACATTGTTGGTCTTGTCTTCTGTTTTGTTAGGAGGGACAGCAGTG
..(((((.....(..(((((((((((((((((........(((((....))))).....)))))).))))))))))....)...)))).

Mmd_27                        1  2  3  4  5  6  7  8  9 10 11 12 13 14 15 16 17 18 19 20 21 22    (SEQ ID NO:573)
mmHP744986 probe7
GGGGAATTTCTGGCCACAATTTGTAACACTAAAAGGCTCCCAAAGGGAGGGGGTGCAAAATGATACAAATTGGGTACAAAGGATAGCCACT
...(((((((..((.(((((((((((((..((((........)))).))))))))))))).))..))))))).....))...

Mmd_28                        1  2  3  4  5  6  7  8  9 10 11 12 13 14 15 16 17 18 19 20 21 22    (SEQ ID NO:584)
cand396 probe17
TGAATGGCTTTGCTCCTTTTCTGCATCACTTCCATCAGCGCACCCACAATTCCTGAAGTGGGTGCGGGTGTTGGTGGTGTGGACTCTTGGCCATCA
.((.(((((.((......(((..((((((((......(((((((((....))))))))))...))))))))...)))).

Mmd_31                        1  2  3  4  5  6  7  8  9 10 11 12 13 14 15 16 17 18 19 20 21 22    (SEQ ID NO:617)
mmHP2052196 probe5
AGCTGTGTCATCAATAGAAGCTCAGGGCCTTAGGGAACTGGAGGCACTTCTGACCCACTGCTCTCACTCTTTGGCTCTACTTCTGACAATGACTTGCT
(((((((((.(((((((((((((...(((((((...(((((....)))..)))..)))))))..))))))))))))).))

Mmd_32                        23 24 25 26 27 28 29 30 31 32 33 34 35 36 37 38 39 40 41 42 43 44    (SEQ ID NO:627)
cand756 probe40
AAGCTGACGCTACCCATCCCCTCCACGTGCCCCGAGCCCTTTGCCCGCCTACTGGAGGGTGAGGCAGGGCCCCTGTGGAGGGGTAGGCTCAGCTT
((((((((..(((((((((((((((.((..((.(((((.....)).)).)))..))))))).)))))))).)))))).)))))))

Mmd_33                        1  2  3  4  5  6  7  8  9 10 11 12 13 14 15 16 17 18 19 20 21 22    (SEQ ID NO:638)
cand182 probe18
GCTGTGAGGTCAGAATCCTGTCTTACGACACCTCGGTCTGTTGCCATGGAAACAGGGGCGGATTAAGGCTGGAGCGCAGGGATCAGGCCCCTCCGC
(((.(.(((((.(((((.....))(....)))))..((((....((((((...)).))))...)))))))..))..)))))).)).
```

FIG 2 Con't.

Mmd_35
cand884 probe15 (SEQ ID NO:660)
GGGCTTGGGCTGGCTCTGCTGGGACACTTCACACTTTTGCCATTTTTGCCCAGAAGGCTCTCCCTGCTAGCCGGCTCTGTTC Mmd_36
cand566 probe27 (SEQ ID NO:671)
GCTGATATACAGCATTTGGCAGGATTCCTTGCTAGCATTTGGTAATAATTCCATACCAAATGCTAGGGAGAAACCCACCCAAATGGAACCGCTTCAAGC Mmd_37
mmHP200260 probe14 (SEQ ID NO:682)
CCTTCTGGAATTTGCTTGTGGCGCTGTTTATTACCTACCAGGCATTTTGCTGAAGGTGCAATTTGCAGAGCCATTAATGGCAATGAAGTTCCAGCGGG Mmd_39
cand184 probe5 (SEQ ID NO:273)
CAGCTCAGAATGTGGTAGGAGCTATCAGAACTTAGTGATCAAGTGAAGTCCGTACTTACTAATTTCTGATGCTCTTCCCCTGCAGAAGAGAGCTG Mmd_40
cand619 probe11 (SEQ ID NO:714)
GACGGCTCAGAAGTCCATGGAGCTGTGGGCCAGGTAGTCCTTGCGGCCAATGTTGCTGACCTGCTTGGTCTGCATAGCTTCAAGTTTGGGGCAGTC Mmd_41
cand98 probe29 (SEQ ID NO:725)
ATCAGTTTGTGTGCATTTGCAGGAACTTCTGAGTCTCCTATTGAAATAGACAGGAGACTGACAAGTTCCCGGGAACACCCACAAATCTTCCTACTGGT Mmd_44
cand618 probe6 (SEQ ID NO:757)
GTGAGGAGCAGGTTAGCTGGGTGAAAAGTTCGCAGCGAGGGGAGCTGTCTGTTTCCTTTGCTTAATTTATCCACTATTTGGCTAACCTCACTCTGAAC Mmd_45
cand540 probe12 (SEQ ID NO:768)
GAGGTAAATTTTGGCCCTCCTGATTGTTAAGCTCAATGGAGATAGATTTTTCTTCCTCTGTGTGTGTGTTTATTGTAATATCTGGAGGGCTTTTCTTC Mmd_46
mmHP3140720 probe6 (SEQ ID NO:779)
CTGGAGTATCCTGCTTTGGGATTTGGCTCAGTCAATCAGCAGGTATTTATCCTGCTTTCTTTGGACCCAGAATACTCTTAACTCAGCAGGATACCACAG Mmd_47
cand368 probe44 (SEQ ID NO:788)
GAGTTTGACAGCAGCCTACCACAGAACCAGCCCTTTGTTTTCTCCCTTGGCACTGGCCAGGTTATCAAGGGCTGGGACCAGGGGCTGCTGGGCTAAGTC Mmd_48
cand462 probe35 (SEQ ID NO:798)
CCTTTGGTTCACATTAAAATATAAATTCCCCGTGGGAGAGACCCTATTAAGCCTTGCAGGGAATTACTAAATTTACATTTTAATGTGAATGAGG Mmd_49
cand732 probe22 (SEQ ID NO:809)
GCGCGAGCTGTCCCGAACACCTTGCGGTAGGAGGAGGCGGAGCACAAATAGTGCTCCGATCCGAAGCTCATGGTGCCGGGGTCGGGGCCGGGTGCGC

FIG 2 Con't.

Mmd_52
cand922_probe21                1  2  3  4  5  6  7  8  9  10 11 12 13 14 15 16 17 18 19 20 21 22    (SEQ ID NO:355)
CCAGCAGGAGCTTCAGGCCGACAGCTTCAAAGCTAAGCAGATGGAAAACCACCAGCTTATTAAGGAGGCTGTAGAAATGAAGTCTGTCATGG Mmd_53
mmHP3172562_probe11            1  2  3  4  5  6  7  8  9  10 11 12 13 14 15 16 17 18 19 20 21 22    (SEQ ID NO:848)
ATGACGTAAACTCTAGTTCATATTTGAGTGTCAAAAGTTGGAGTTTGACATATTCCAAAATGTCACTCAAGATGGAGTTTGGGTTAT Mmd_56
cand268_probe12                1  2  3  4  5  6  7  8  9  10 11 12 13 14 15 16 17 18 19 20 21 22    (SEQ ID NO:857)
GACCAAGGTCTTTGGTCTTGGAGGAAGGTGTGCTGCTGGAGGAAGCCACGGAGGCTGGGCTGGTGGGGGCATCTTTCTTCAGACCACGGGCTTTGTC Mmd_57
mmHP1485966_probe13            1  2  3  4  5  6  7  8  9  10 11 12 13 14 15 16 17 18 19 20 21 22    (SEQ ID NO:858)
TGGGAAGGGCATTGCTTATTTTGTATGCTTCTGGGTTGATTTTGGAAGTGATCTGTGACCCAGAAACGCAAAGGACAGTGTGGGCTGCCTTTCATCA Mmd_58
cand712_probe10                1  2  3  4  5  6  7  8  9  10 11 12 13 14 15 16 17 18 19 20 21 22    (SEQ ID NO:859)
GCACCGAACGAGGGGTTGACCAAAGCAGCCATGATGGCAATGTCCGAGTATGAAGACCGGTTGTCATCTGGTCTGGTCAGCCCAGCCCCGACC Mmd_59
cand552_probe8                 1  2  3  4  5  6  7  8  9  10 11 12 13 14 15 16 17 18 19 20 21 22    (SEQ ID NO:860)
CCGCCGCCTGGGCCACGCGCCCGCCAGGTCGGCGGGAAGAGGCGCGGACACGCGCACCAGTCCCGCCGCGGGGGCGCGCCTGGCTCTGGGCGGGG Mmd_60
cand838_probe12                1  2  3  4  5  6  7  8  9  10 11 12 13 14 15 16 17 18 19 20 21 22    (SEQ ID NO:862)
GCCTTGGCTTCCTGTTCTTCTTCATACTGTTCCCGCAGCAGGTCACAGTCATGGCGGGAGGACTGAAGAGCATGAGCTAAGGC Mmd_61
mmHP2157333_probe14            1  2  3  4  5  6  7  8  9  10 11 12 13 14 15 16 17 18 19 20 21 22    (SEQ ID NO:863)
GGGCAGCAATTGTACTGACTCAGCACAAGTTGCTTCGCTGTGTTTACATGTGGCTTGAACTTGCTTGAGTTTCAGTATCTCTGTCCTGCTCTCT Mmd_62
cand398_probe5                 1  2  3  4  5  6  7  8  9  10 11 12 13 14 15 16 17 18 19 20 21 22    (SEQ ID NO:864)
GGAGTGACAGGCGCCGAGGTGATGATGGAGGCTTCTTTCCTCGAACCCTGGAAATCCATTGGTTGTCCATCATCAACTCCATGGTGCTTGTGTTTTT Mmd_63
cand457_probe32                23 24 25 26 27 28 29 30 31 32 33 34 35 36 37 38 39 40 41 42 43 44    (SEQ ID NO:865)
TGGTGTGCTGGGAAGGAGGCCAGTGTGGCTTTCTGTCCTCTGCCTTTTCTAGCAACTTCCCTCCACACTGCCCTCTCTGCCCGGGCAACACCA Mmd_64
cand789a_probe20               1  2  3  4  5  6  7  8  9  10 11 12 13 14 15 16 17 18 19 20 21 22    (SEQ ID NO:866)
GTATTTCTATCTTGGGGTTCTAATGACTAACCACTTGAGCTCTGCTTTTGTGGTTTATAATGTCACCAGAACTCTCCATGGAATTAT Mmd_66
cand938_probe28                23 24 25 26 27 28 29 30 31 32 33 34 35 36 37 38 39 40 41 42 43 44    (SEQ ID NO:868)
CTCACTTTCTCAGCCATTTCATGAGAGTGATGCAGGGAATGTTCCCTTTCTGAGAACATCCTCCTTTGCTCATAGCTGGCTAGACGACAAGTGAG

FIG 2 Con't.

```
Mmd_68                    1  2  3  4  5  6  7  8  9 10 11 12 13 14 15 16 17 18 19 20 21 22    (SEQ ID NO:870)
cand588 probe2
CGGCCTGTTTAAAGGAAGAAGTTTGTTCTGTTGTAAACAGTGATGGGAACTGTTTGCTTTGGATGGGCTTGGTCCTTATGAGCCAAAGAGCG
((((.(((((((((((((...((((((((((((......)))))))))))..))))..))))).))))).....)).).).

Mmd_69                    1  2  3  4  5  6  7  8  9 10 11 12 13 14 15 16 17 18 19 20 21 22    (SEQ ID NO:871)
cand632 probe11
GAGCGCGGAGTTCTCTCAGGAAGAAGCCAGGTGAAACTCAAAGGGTCCAAAGAAGGCTTCGCTTTGAGTTTCTTTCTGGTTCTGTTTGAACCTGACACTC
((((.(((((.(((....((((.((((((((((((....))......).))))))))))))..))))).))))).....)))

Mmd_70                                            23 24 25 26 27 28 29 30 31 32 33 34 35 36 37 38 39 40 41 42 43 44    (SEQ ID NO:873)
cand700 probe39
GATTAATTCTACATGCGCCTAATTAGACCCACAATTGGCTAATTGCATCCACAATTAGCCAATTGCAGGCCCAATTGGCCACTTGTCCCATAATT
........(((.(((((.((((.((.((((((((((((......))))))))))))..))..)).))))))...

Mmd_71                                            23 24 25 26 27 28 29 30 31 32 33 34 35 36 37 38 39 40 41 42 43 44    (SEQ ID NO:874)
cand402 probe35
CACTGTAACAACGGTTTTCCTTCTGACTCATTACATTACATATTGCTATTAGTGAGCATCAGAGTGTAGTGCAATCAGTCAGGGGAAAATGACTG
.((((((.(((((((.(((((((((((((((....)))))....)))))))).))))))))))))))))....

Mmd_73                                            23 24 25 26 27 28 29 30 31 32 33 34 35 36 37 38 39 40 41 42 43 44    (SEQ ID NO:876)
cand715 probe23
GGGCTATGGAGCGGCCACATCTTGCAGCAGACACTGATGGATGAGGGGCTGCGGCTCGCC
((((.((((.((.(((((.((......))).))))).))))))

Mmd_74                                            23 24 25 26 27 28 29 30 31 32 33 34 35 36 37 38 39 40 41 42 43 44    (SEQ ID NO:877)
cand734 probe31
CATGCCCTGATATTTGTGTTGGGATAATTACCATCTCTCAGGCCTTCACTCGGTGGCAAGATGAGATGAAAACCCATAAAACACCACTCAGGGCTGTG
..((((((....((((.((((((((..(((.(...(((((((...))).)))..))).)))))).....))))...))))))))))....

Mmd_75                    1  2  3  4  5  6  7  8  9 10 11 12 13 14 15 16 17 18 19 20 21 22    (SEQ ID NO:878)
cand696 probe13
GGGAAAAAAAAAGGCAGACACTGTGTTTCATGCCAATAATGGTTGCCAGTGCCACCGAGGTTGGCATCAGACCCTCTTTGTCTAGCTGCTGAATGCCT
((((...((((((((..(.(((((((((((((...(((.(((.(((...)))))))..)))))))))))))).)).))))))))..)))

Mmd_76                    1  2  3  4  5  6  7  8  9 10 11 12 13 14 15 16 17 18 19 20 21 22    (SEQ ID NO:879)
cand645 probe3
AGGCAGCAATTTGTGTCAGATTTCAATCTATTTAAGGGAAAAACCAATGAAGTCTGGTTGAAAAATGGAGAGTAAATTGCTGTCT
(((((((((((((.(((..((((((((...(((.((....))))))))..))).))))..))).))..))))))))))))

Mmd_77                    1  2  3  4  5  6  7  8  9 10 11 12 13 14 15 16 17 18 19 20 21 22    (SEQ ID NO:880)
cand483 probe21
TCTCCAAACTGTTATTTAAAGCAGGGTTTGGCAAGGCTCAGCGAGCCTGCACCAATTTTAATTGTGTTTTTAAAAACTCAGGATGGAGA
.(((((((......(((((((((((((((((.(((...(((((((.........)))).))).))).))))))...))).))))))

Mmd_80                    1  2  3  4  5  6  7  8  9 10 11 12 13 14 15 16 17 18 19 20 21 22    (SEQ ID NO:884)
cand261 probe12
GGACAGTGTGTTGATGTTTATTGGTGTCTCTTTTTCTTCTAGGGCCAGCAGAGAAGAGACTCCATCTTCCAGAGGTTGCCACTGTCT
((((((((((((...(((....(((.((((((((((((((((..((.....)).)))))))))))))).))).)))))))))))))

Mmd_81                                            23 24 25 26 27 28 29 30 31 32 33 34 35 36 37 38 39 40 41 42 43 44    (SEQ ID NO:885)
cand28 probe40
TTCCTTTTAACTCTCAGCTTCTATTTAAAAAGCTAAATTGGGAGCCTGTCGATGCTCCCAATTCAGACATTTTAAATAGGGAACTGAAAGTCAGGAA
.((((....(((.((((.(((((((((((((.(((...(((((((........))))))).....)).).)))))))))))).)))...))).)))).

Mmd_82                    1  2  3  4  5  6  7  8  9 10 11 12 13 14 15 16 17 18 19 20 21 22    (SEQ ID NO:886)
cand896 probe6
GGTCCATCTTTGCGCCAAGATACGTAGTCGCCAACAGTGAGTTGGCGACTGTATTTTCGAGTCCTGGCGCAAAGCAAGATC
((((..(((((.((((.(((.((((((((((....)))))))))).....)).))).).)))).)))...))))
```

FIG 2 Con't

```
Mmd_84                  1 2 3 4 5 6 7 8 9 10 11 12 13 14 15 16 17 18 19 20 21 22    (SEQ ID NO:888)
cand6 probe6
GGTGTGAAAGGGTAGGAGAGATGCTGGGGGTGGGGGTGCTTGTGTTTTAGACCCCCAATATTATCGCAGTGTCCCCTGCCTTCCTTCTTCC
(((...((((((((((((((.(..((((((((((((...(((((((((.((((........))))))))))))).....)))))))))))))))..)))...))

Mmd_85                  23 24 25 26 27 28 29 30 31 32 33 34 35 36 37 38 39 40 41 42 43 44    (SEQ ID NO:889)
cand59 probe28
CAGGCCACTCCATCTGTTCAAACATAATGCTCAAAGCAAGGAATATGTTCCAAACCAAGAGCATGATATTTGACAGATGGAGATGCCCATACGCCTG
(((((((((((((((((.(((((((((((.((((((((((.....(((....)))).......))))))).))..))))))))))))))..))......)))))

Mmd_87                  1 2 3 4 5 6 7 8 9 10 11 12 13 14 15 16 17 18 19 20 21 22    (SEQ ID NO:891)
mmHP1815876 probe21
GGCAGTCTGGGAGTGATGTCCCTGTGTCATTAGTGATATGATGGCAATCAACAGTCCAATGTCCCTCTTTGATGGCACTTTGGACATGACCCTAGTGGCT
(((...(((((..((..((((((..(((((((((((((.((....)))..))..)))))))))))...)))))))..))))))..)))..))..)))

Mmd_88                  1 2 3 4 5 6 7 8 9 10 11 12 13 14 15 16 17 18 19 20 21 22    (SEQ ID NO:892)
cand279 probe13
AGCCTAACACTCCGCGGGAGTTTCCATGGCGACCGAAGCCGGGACCGCGCGGCCCTGGCAGCGTTGCCATGGAGACAACTCCGGAGCTGGGGCT
(((((..((((((((...(.(((((((.((((((((((.....)))))..)))))))))))....))))))))))..)))))..))

Mmd_90                  1 2 3 4 5 6 7 8 9 10 11 12 13 14 15 16 17 18 19 20 21 22    (SEQ ID NO:895)
cand363 probe7
GGGATCACGGCCTCCATTTAGGTGTCAAATTGTGTAATTTCCAGCTGTGCTCATCTCAACAGCTGGAGTTCAATATGCTCAGGGCGTATCTGGAGGCCCC
(((......((((((((((...((((((((.((((((((.....(((((....))))).......))))))))))))))))))))))))))))))

Mmd_91                  1 2 3 4 5 6 7 8 9 10 11 12 13 14 15 16 17 18 19 20 21 22    (SEQ ID NO:896)
cand629 probe16
GCAGCAGGTAGCTCTGTCTGCTGTCTCTTTAGATAAAATGTATGTCTGGCACGGAGGGAACAGCTGAGAACTACCTGTTGT
(((((((((((...(((.((((((((((((.......))))))..).))))..)))))..)))...)).)))))))

Mmd_92                  1 2 3 4 5 6 7 8 9 10 11 12 13 14 15 16 17 18 19 20 21 22    (SEQ ID NO:897)
mmHP2160056 probe22
CTTTGAGTGAGGGTACCATGCTGAAGGTATTCATGATGCGGTCAGGATATTCTTCTCTGATCTTGCTGAGAGCAGGGTGCCCCATGCCAGAG
(((((.((((((.((((..(.((......(((((((((.....)))))))))))))).).)))).))))))...)))..))))))

Mmd_93                  1 2 3 4 5 6 7 8 9 10 11 12 13 14 15 16 17 18 19 20 21 22    (SEQ ID NO:898)
cand331 probe6
TTGTAGTTGACTAAACAGCGTCTGGTAGACGCAGATGGCATCATTAATCCGAGCGCTTTCTACATCTACCTGACCGCTTGGGTCAGCAACGA
((((..((.((((((...(((((.((((((.((((((((.....))))..))))).)))))))))))...))).))).)))

Mmd_94                  1 2 3 4 5 6 7 8 9 10 11 12 13 14 15 16 17 18 19 20 21 22    (SEQ ID NO:899)
cand696 probe8
CTTCTGTAGATTGTGGAGAAAAGCCTTAGAAGAGCCAAAGTATAGCTCGCTGTATGCTCAGCTATGCTGCGATTGGCAGAAG
(((((((.(((((.((((........))))..))))).(((((((.....))))))))..)))..)).))))))..))

Mmd_95                  23 24 25 26 27 28 29 30 31 32 33 34 35 36 37 38 39 40 41 42 43 44    (SEQ ID NO:900)
cand584 probe24
GTTCCAGGAGACACTATGAAAGTTAAGGCAGGGGAGCCAGTTAACATCCCTGCAGACGTGACCCGGCCTCCCCATGCCTAAGATTGAGTGGTCCAAGAAT
(((((..((((..((((...(((((((((((((((.(((((..((....))..)))..)))))))))).)..)))))..)))))).))))..)))))

Mmd_97                  1 2 3 4 5 6 7 8 9 10 11 12 13 14 15 16 17 18 19 20 21 22    (SEQ ID NO:902)
cand69 probe2
AGCTTTCTCCAACTGTAACAATCTCCACTTCACTGTCAGTTGAGGTAACATTAATTTCTTCATTGGCAGTGACCTGGGCAGTGAAGGAGGCT
((((((((..((..........((((..(((((((((((((....)).)))))))))))..))))))...))))))))

Mmd_98                  1 2 3 4 5 6 7 8 9 10 11 12 13 14 15 16 17 18 19 20 21 22    (SEQ ID NO:903)
cand482 probe12
TCATCTTTGCCCCGGCTCCGGGTCTCGGCCCGCACGGTCCGGCCGCCATGCTGGCGGCGCTGGGGCCGGGACAGAGCCCGTGGCGGGGCGGCCTGTGG
.))))..(..(((((((((((((((((((...(((((((.....))..))))))..)))))).)))))))))).)))...)))
```

FIG 2 Con't.

```
Mmd_100                        1  2  3  4  5  6  7  8  9 10 11 12 13 14 15 16 17 18 19 20 21 22    (SEQ ID NO:393)
cand424 probe2
TGAGTCATGGAGAAGGGAGGGCAAGTCAGGTGACCAGGTGAGACTCAGAACTCCTGAGGTAGCCTGGTTACCTTGACATTCCTGTGATTATGCCA
..(.(((((....(((((....(((((((((((((((((......(((((......))))))...))))))))))))).)))).)))))....)))))-).

Mmd_101                        1  2  3  4  5  6  7  8  9 10 11 12 13 14 15 16 17 18 19 20 21 22    (SEQ ID NO:394)
cand659 probe2
TGGTGCAGCACTGAGAAATTTTGTCTCCAAGCAAAGGTCATTGGATCGGAGTCTTGGATTTAGTGACGGTGGAGGCTATAATTTTCTTGCTGGCAGCA Mmd_102                        1  2  3  4  5  6  7  8  9 10 11 12 13 14 15 16 17 18 19 20 21 22    (SEQ ID NO:395)
mmHP969107 probe3
GAGATGGAGGAAGCCGGAGTCCAGGCCTCCATGCAGCGGGGAGATGGAGAAGTCGGCCTGGGGCTGTGGAGGCACGGCACTCGGGTTGCTAAGGATGCTC Mmd_104                        1  2  3  4  5  6  7  8  9 10 11 12 13 14 15 16 17 18 19 20 21 22    (SEQ ID NO:397)
mmHP2682003 probe7
GGCAGAGGAATGTGGCTGCTTTTAAAAGGGGTCTCAGGTAAGGCTGTGTGTGCCAGCCTTCCTGACCATCAGTGATAGCAGCTTGGGTGTCTGCT Mmd_105                        1  2  3  4  5  6  7  8  9 10 11 12 13 14 15 16 17 18 19 20 21 22    (SEQ ID NO:398)
cand310 probe9
AGGTTGATGCAAAGAAAGGAAAACATCTTGAAGTTCTGAAAAACAAGACTTCAAAGAATGTTTTCCTTTCTTCTTTCTCGAATCT Mmd_107                        1  2  3  4  5  6  7  8  9 10 11 12 13 14 15 16 17 18 19 20 21 22    (SEQ ID NO:400)
cand906 probe13
ATGCCCGTAATGTACAGTAAATGAGGCCCATAACTCATTGGAGCCTCCAATGAGTTATGTGCTAAATTCATATTTCACAACATGGCCAT Mmd_109                        1  2  3  4  5  6  7  8  9 10 11 12 13 14 15 16 17 18 19 20 21 22    (SEQ ID NO:402)
mmHP121950 probe14
GGGGGTGTGAGCCCCTTTTTCTGCTTTCCAGCATCTTTGGCATTTGCGCAAAGTTGCTCAGATTGCAATGCTGGGGTGCAGTGGGCGCGCGACTCTT Mmd_112                        1  2  3  4  5  6  7  8  9 10 11 12 13 14 15 16 17 18 19 20 21 22    (SEQ ID NO:405)
cand513 probe6
TGTACCTGTTTCCTCCTGTGGCCCGGAGTTTGATGTGCAGGGCAGTGATGCCCAACTCCTTGCACCTCTGGGCCACATCCTGGGCAGCCAACA Mmd_114                        1  2  3  4  5  6  7  8  9 10 11 12 13 14 15 16 17 18 19 20 21 22    (SEQ ID NO:408)
mmHP1647321 probe8
GGCCAGGGCACTTTAGGCTACCCCAGTGTGTCAGTGTGAGAGCAAATGTTGACAAGCTCTGCCTAACTGAGCTGTGGGTGTTCTAGAGGGTATGAGC Mmd_115                       23 24 25 26 27 28 29 30 31 32 33 34 35 36 37 38 39 40 41 42 43 44    (SEQ ID NO:409)
cand458 probe40
GGACATTTCTGTCCCAGGCCAGCAGCTGTCACCTTAGAAAGATTAAGATTCTCCCACCAGGCGACAAGGCTTGTTGTGCCCGAGACAGATACGGCT Mmd_116                        1  2  3  4  5  6  7  8  9 10 11 12 13 14 15 16 17 18 19 20 21 22    (SEQ ID NO:410)
mmHP1779096 probe17
AGACTTTATTATGTTCGCCAAACATCTCGGCCTTCCCAAGTATGTCATTAGACATTGGGCCAGGTGTGAGGCATCAGAGTGGATTGCT Mmd_117                       23 24 25 26 27 28 29 30 31 32 33 34 35 36 37 38 39 40 41 42 43 44    (SEQ ID NO:411)
cand100 probe35
AGGTCCTAGGTGAGGCCATGACTGGCATCTCCCAAAATGCCAAGAATGGAAATCTGCCGGAGTTTGGAGATGCCATTGCCACAGCCTCCAAGGCTCT
```

FIG 2 Con't.

```
Mmd_120
cand578 probe13                  1  2  3  4  5  6  7  8  9 10 11 12 13 14 15 16 17 18 19 20 21 22    (SEQ ID NO:415)
GTGGCCACAGGGGGGTGGGACTGGTCATGTAGCCGTGTGTCAGGAGTAATGATTGTAGAGGGGCGGGGCATGAAGAGTGCCATTCTGGAAAC
((..(((.....((((((..(((((..((((.((((.((.((...)).)).)).)))).))))...))).))))))))...))

Mmd_121
cand913 probe22                  1  2  3  4  5  6  7  8  9 10 11 12 13 14 15 16 17 18 19 20 21 22    (SEQ ID NO:416)
GCTTAGGCCAGCCGCTCGCCGCTTCATGAATGGAACCCACGTGACCAAACATCATGTGACGTCTGAGGAGCGGCGGCGGCGGATTCTGAGC
((((((.((.((((((((((((((.(..(((.....((((((.....))))))..))).))))))))))))..)))))).....)))))

Mmd_122
mmHP204457S probe10              1  2  3  4  5  6  7  8  9 10 11 12 13 14 15 16 17 18 19 20 21 22    (SEQ ID NO:417)
CAGTGAGAAAATTAGGACGGATGTAAAGTAAGCTGGCTTTTTGCCTGAGGGCTTAATTTAAAAGAATCCTTTAGGTGCCTCTGTGATTTCTTACTG
((((((((((((((...((((((.....(((((((....))))))).....))))))...))))))))))))

Mmd_123
cand447 probe19                  1  2  3  4  5  6  7  8  9 10 11 12 13 14 15 16 17 18 19 20 21 22    (SEQ ID NO:418)
TTCCTGKGGATTAATGAATGGCTGGGTGGAGTTAATTGCCTAAAGTATAGTCTCAGGCCATTAACCTCAGTGGTCACTAATCTCAAGGAA
.(((((..((((.........)))).))).)).))))..

Mmd_124
cand168 probe22                  1  2  3  4  5  6  7  8  9 10 11 12 13 14 15 16 17 18 19 20 21 22    (SEQ ID NO:419)
AGGCAGKATACAGAGCTCTTTAAATAATGCCCAGCATTTCCTGGACCAGCATGATATTTAAAGATTTTTGTTCCACCTGCCT
(((((((..((((((((....))))))..))))))...)))))))

Mmd_126
cand496 probe36                 23 24 25 26 27 28 29 30 31 32 33 34 35 36 37 38 39 40 41 42 43 44    (SEQ ID NO:421)
GAAGCAAGGAATTAGCTCTCTAAATGCCCCACGATGACTGGCTGACTTGCTCGTCCTCTGAGGGCCGATTTGAATATCTAACTCCTCTCTTC
((((..((((.(((......(((((.((.(((.....))))).)))))....))))....))))...))))

Mmd_127
mmHP157519 probe4                1  2  3  4  5  6  7  8  9 10 11 12 13 14 15 16 17 18 19 20 21 22    (SEQ ID NO:422)
GGGAATGGAAGGAGGCATTAGGGGAAGAGGGGGACTCTGACCTGATGGATTTTCATTCTTTTTAGGAATTACCCTTGTGTCCCTGGTGGTTCCTGTGCTTCT
(((.((.(((..(((((((..((((((.....((((.....))))))).....))))))..)))))))))..))

Mmd_128
cand556 probe6                   1  2  3  4  5  6  7  8  9 10 11 12 13 14 15 16 17 18 19 20 21 22    (SEQ ID NO:423)
AGCTTTTTTTAAAAATTACTGGTGCCCAGGCTCCACCCTGGACCAATTAAATGAGCTCTCTTGGGGAGGGGCCTGGACATCAGTAATTTTTTAAAAGCT
(((((..((((.......(((((...((((......))))..)))))........))))...)))))

Mmd_129
cand617 probe41                 23 24 25 26 27 28 29 30 31 32 33 34 35 36 37 38 39 40 41 42 43 44    (SEQ ID NO:424)
CCCTGACCTCTACCCTCCACTGACTCCCTCTTCTCCCCCTCCATCAGCCAATGCTGAGGCCTTGAAGGAGATGCTAGGGGACAGTGAAGGAGAAGGG
(((....(((..(((((....(((((....((((....)))).....)))))....)))))..)))..)))

Mmd_130
mmHP115458 probe21               1  2  3  4  5  6  7  8  9 10 11 12 13 14 15 16 17 18 19 20 21 22    (SEQ ID NO:426)
CTCCCCAGAGAGATCTTTCAGTAACTGATCTTCTAGCTGGCATTTTTATAGATTAGGAAGCAGGCCAGCTGGAGCTCATACTAAATTAAACTCTGCTGAG
(((..(((((....(((((.....(((((....(((.....)))....)))))...))))))))))....))).))

Mmd_132
mmHP118158B probe7               1  2  3  4  5  6  7  8  9 10 11 12 13 14 15 16 17 18 19 20 21 22    (SEQ ID NO:428)
GAAGGAGAAAAGCAAGCAGGGTGTGAGGGGACTCGTCCCACACCTGTGTAAACAATGTCACCTTACACCCCGTCAAGCACCCTCGCCTTC
(((((.((((..(((....((((.....(((.....))).....))))...))).)))).)))))

Mmd_133
cand50 probe34                  23 24 25 26 27 28 29 30 31 32 33 34 35 36 37 38 39 40 41 42 43 44    (SEQ ID NO:429)
GTGAAGGCTATTAATTACACTGAGTGACAAAGACTCTCCGTGTTGTATGATTGACACAAGGATGAATCTTTGTTACTGATTGCAAATAATAGGACCGC
..((((((..((((((((((.....))))))))))...))))))
```

FIG 2 Con't.

Mmd_135
mmHP291564 probe22      1 2 3 4 5 6 7 8 9 10 11 12 13 14 15 16 17 18 19 20 21 22      (SEQ ID NO:431)
GACAGTGATTGTTGCTATGGGAGACAGTGTGGGTTTGTGACACAAGAAAAATTCTCTTGCTGTTGCAAAAGTGGATCCAGACTGTCCCAATGGATGTC
(((((.......(((..((.((((((..(((((((((.....(((((((.......)))))..)))..)).......))))).)))))))).))))

Mmd_136
cand605 probe7         1 2 3 4 5 6 7 8 9 10 11 12 13 14 15 16 17 18 19 20 21 22      (SEQ ID NO:432)
GCAGTTAATGATTGGTTTGTTAGTTAATGGCCCAAGGCAAAGCTGAGGGCGGTTAAGACTCTAACAAACGATTTGTGAATTGT
((((((.(..(.(((((((((((((....(((..((((......)))..)))).......)))))))))))))..).).(.))))))

Mmd_137
mmHP3254020 probe13    1 2 3 4 5 6 7 8 9 10 11 12 13 14 15 16 17 18 19 20 21 22      (SEQ ID NO:433)
TGTCTTTTGGATCATCATATTCTTACCAAAACATTTGCTCTGATTGGTGGCCCGGTCAACAAAGACTTTGGCTGAGATGACATGACCAAAAGGGACA
...(((((((((.((....(((((.....(((((((...(((.......))).....)))))))....)))))....))))))))))....

Mmd_138
cand139 probe2         1 2 3 4 5 6 7 8 9 10 11 12 13 14 15 16 17 18 19 20 21 22      (SEQ ID NO:434)
TCTTATTGTGTTTGGCTGAGGCCTAGTAATTTTCAATAAAGCCCTTAATCCAAGTACTTCACTGAAAATTACCAGGCTTCTCTGTCGAGGATGAGA
(((((((.(.(.(((.......(((((.(((((((.(..(((..(((......)))..))).).))))))).)))))....))).).)..))))))

Mmd_139
cand238 probe13        1 2 3 4 5 6 7 8 9 10 11 12 13 14 15 16 17 18 19 20 21 22      (SEQ ID NO:435)
GTATTTCCTGAGGATTAATGATCAACTGGAAGAGGCTGTGGTCTTAGGGCCATTAACTCCGGGTGGTCATTAATTCTGTTGGAAATAT
(((((((..((((((((((((.((((.......((((((.......)))))).....))))..))))))))))))...)))))))

Mmd_140
mmHP2148319 probe5     1 2 3 4 5 6 7 8 9 10 11 12 13 14 15 16 17 18 19 20 21 22      (SEQ ID NO:437)
GTCTTGCCAGCAGAATTCTCAGAGGCAAAAGGAGTGAAATATTTTGCTGGAGGGGATACTTTCCTTTCAAGAAGCATTCCTTTGCCTCCTGAACAAGAT
((((((....(((.....(((((.((((...(((.((((((...)))))))))..))))))))))..)))))))))))))...))))))

Mmd_141
cand620 probe22        1 2 3 4 5 6 7 8 9 10 11 12 13 14 15 16 17 18 19 20 21 22      (SEQ ID NO:438)
GGGCTGCCAAGACAAGGGCTTATTTTGACTTAGGATGCTGCTGAAGCTGTGGCAGCCTTGTCAAAATACATCTGCCTCTCTTACGCTGCCC
(((..(((((..(((..(.((.....))...))))...)))))..))))..))...))..)).)))))

Mmd_145
cand534 probe28        23 24 25 26 27 28 29 30 31 32 33 34 35 36 37 38 39 40 41 42 43 44      (SEQ ID NO:442)
GTCCACTCCATCAAAGGGTCTAATGGTCAGCAGAGGAGGCTAAATGTCTCCCCTGTGACCTGACATTAACGAGTGGAC
(((((((((.............((((((......))))))....))))))))))))

Mmd_146
cand517 probe6         1 2 3 4 5 6 7 8 9 10 11 12 13 14 15 16 17 18 19 20 21 22      (SEQ ID NO:443)
GGAGAAGGTGGGGAAAGAATTAATGTGTGCTCTCTGATTCCTTTCACTGAGGACTTACAGATTAACTCCCACTTCTCC
(((((((((((.....(((.....((.((((..((((....)))..))))))....)))))))))))))))))))))))

Mmd_147
cand356 probe16        1 2 3 4 5 6 7 8 9 10 11 12 13 14 15 16 17 18 19 20 21 22      (SEQ ID NO:444)
GGAAAGACACAGACAAGAGAAAAATAAGCCTGCCTAGCAATTACGTCTGGGCTGCTTGGAGGCGCTCTCTCTCTCTTTCC
(((((((.(((((..(((....(((...(((((((.........)))))))..)))))))).))).))))))))))))))

Mmd_148
cand582 probe38        23 24 25 26 27 28 29 30 31 32 33 34 35 36 37 38 39 40 41 42 43 44      (SEQ ID NO:445)
AGAGCCCTTCTGGCAGCTAATGACCTGCTGGAGTCGTGTGTGCCCAAGGCAAAGCTTAAGGCCATTAGTCCAACAGGTCATTAACTGACAAATGCCT
...((.(...((((((.((((((...(((((((...(.(((...(((......)))..))))..)))))))...))))))..))))))...))

Mmd_149
cand236 probe19        1 2 3 4 5 6 7 8 9 10 11 12 13 14 15 16 17 18 19 20 21 22      (SEQ ID NO:446)
TTGATTTCCGTGCATAAACAGTGGCCTAGATTCTTGCCCTGTGGAAATCCACGGAATTAAGAACTCTAGGTTCCTGGAGTGATAAGAGGTAAGCAA
...(((.(((((((((((...(((..((.(.....))))...))).))))).)..)).))..))).......

FIG 2 Con't.

```
Mmd_152                    1  2  3  4  5  6  7  8  9  10 11 12 13 14 15 16 17 18 19 20 21 22    (SEQ ID NO:450)
cand789 probe9
GGAAAAGGCTGTAATTCCATCTTGGGGTATCTGGTGAACCAAGCTGTGGGTCTGTGGTTTATGATGTCACCAGAACCCCCAGCTGGAATTACAGCCTTCC
(((((((((((((((((((((((((((((((((((((((((((((......))))))).....))))))))))))).).)))))))))))))))))))

Mmd_153                    1  2  3  4  5  6  7  8  9  10 11 12 13 14 15 16 17 18 19 20 21 22    (SEQ ID NO:451)
cand678 probe8
GCTTTGCTTGGCCTTCGGGAGTTGTAGTTCTAGAGGCACCCGGGTTGCCTGGCTGGCCCGGAACTGTGGACTACAAGCTCCCAGGCCTTCTCTAAGC
((((......((((((.....(((((((((..(((((((..((((......)))).)))))))..))))))))))))))))))))))...)))

Mmd_154                    1  2  3  4  5  6  7  8  9  10 11 12 13 14 15 16 17 18 19 20 21 22    (SEQ ID NO:452)
cand814 probe16
GGTCATCGTTGTTCAAAGTGTTGTGTTCGGGGCCCTTCCAGGTGATTGAGGCCTTGGGGCGGCCACAGACACGACATCTAAAAACAACGGTCTCC
(((..(((((((((((...(((((((((((...(((((((((......))))).)))))).)))).),))))))))).))...,)))))))..))

Mmd_155                    1  2  3  4  5  6  7  8  9  10 11 12 13 14 15 16 17 18 19 20 21 22    (SEQ ID NO:453)
cand674 probe14
TGTGGTGTGCCTGCCCCCTTCCGTCATTGCTGTGAATGGGCTGGACGGAGGAGGGGCTGGCGAAAATGACG
.((..((.((((..((((((((((......(((((((......))).)))))))).)))))).)))...)).)).

Mmd_156                    1  2  3  4  5  6  7  8  9  10 11 12 13 14 15 16 17 18 19 20 21 22    (SEQ ID NO:454)
cand907 probe14
GCTTATTTTCCTCCTAGGTAATTTAATTCCAAGACACCAGGAGCTATTTTATAAAAATCCTGTGTTTGCTGGAGTAAGGTTGCCTGAGGTCAAAGATGC
(((((.....((((((......((((((......(((((......))))))......)))))).))))))..))))))))).))..)))...))

Mmd_157                    1  2  3  4  5  6  7  8  9  10 11 12 13 14 15 16 17 18 19 20 21 22    (SEQ ID NO:455)
cand670 probe8
GGCCACAGCTGCTGCGAGCAGCAGGATGAGGCTTCGCCTATATCTGTCCTCTGTAGGTCAACCCCCGAATTGTTTGTGAGAAGCTTCAGTC
((((((((((((((((((((((((..((((((......)))))..))))))))))))))))))))))))).))

Mmd_158                    1  2  3  4  5  6  7  8  9  10 11 12 13 14 15 16 17 18 19 20 21 22    (SEQ ID NO:456)
mmHP2073048 probe4
GTCATTTAGAATGATGTGCACAGGGTAAATTCATTGGGCATATGGGCAGCATGTGTTCAAGGACTCCCTGTAGCATTGAGATGAC
(((((((((.....(((((((..(((((((.((((((((((.....))))))))))..))))))).)))))).)))))))

Mmd_159                    1  2  3  4  5  6  7  8  9  10 11 12 13 14 15 16 17 18 19 20 21 22    (SEQ ID NO:457)
cand625 probe3
CTGTTGGAAGGTGGTCAGAGAGCAGGAAATGGCTTCTAATTTGTAGTGTCCTCACAGGATGCAACTGCAGAAGACAATTTCCTGTCCCCTTATTGGATGG
((((...((((((.(((((((((((.....(((((......((((((.....))))))..))))).))))).))))...)))))))))))))))..)).))))

Mmd_162                    1  2  3  4  5  6  7  8  9  10 11 12 13 14 15 16 17 18 19 20 21 22    (SEQ ID NO:461)
cand339 probe12
GTAAGAAATGAGAAATTTTTAGGGCCATTGAACACCACGTATTTGCAGTGTTCAGTAGCCCTGAAAATTTCTCATTTAAGC
.....((((((((((((((((((....(((((.....((((......)))).))))....))))))))))))))))))..

Mmd_163                    1  2  3  4  5  6  7  8  9  10 11 12 13 14 15 16 17 18 19 20 21 22    (SEQ ID NO:462)
cand378 probe7
GCTAAATCATTGCCAGTAGTTTCCAAGACATTCCCGCTAGGCTAAGCAAATTGCCCTAAGTGGTAGTCAGAACGACTGGCATGGTACTGT
.....(((((..(((((((...(((....((((((..(((......))).)).))))))..)))).))))))))))).....

Mmd_164                    1  2  3  4  5  6  7  8  9  10 11 12 13 14 15 16 17 18 19 20 21 22    (SEQ ID NO:463)
cand658 probe20
GGGATTTAATGGATCCCCATCCTGTCTTTTGCTACACAGTCACAAATTATTAATTTACTGAGTGCAGAGCAAAAGGCATGGTGGTTATCTATTTGGTTAC
..(((...(((((((((((((((......(((((..(((((.......)))))..))))....))))))))..))))).)))))..))))...

Mmd_165                    1  2  3  4  5  6  7  8  9  10 11 12 13 14 15 16 17 18 19 20 21 22    (SEQ ID NO:464)
mmHP3434196 probe13
ACCTAGGAGATTGGCTGTAGGGGCTTCTGAGTCTGATGCCCTTATATCTTAAGGGACATGAGGATAGTCAGTAGTCCAATGTCCCTCTTGATGGT
(((((((((((((...(((((((.(((((..(((((((......))))))).)))).)))..)))..))))))).)).))))))..))))
```

FIG 2 Con't.

```
Mmd_167                                          ● ● ● ● ● ●
cand711 probe18    1  2  3  4  5  6  7  8  9 10 11 12 13 14 15 16 17 18 19 20 21 22    (SEQ ID NO:466)
GCCGGTAGCCCAAGGTTTGCAGGCCTGGCCGAATGACCAGGGCAATGGAAGGAAGTCGTGGTCGTCGCGGGCGTGGGGAATGGGCTTACCGGC
(((..((((...((((..(((..((((..(((((...))))..)))))..))))..)))..))))...)

Mmd_169                                                     ●   ●
cand636 probe14    1  2  3  4  5  6  7  8  9 10 11 12 13 14 15 16 17 18 19 20 21 22    (SEQ ID NO:467)
GTTGATGTCCGTGCCTCACTGTTTGTTAAATATTCTGACCCCGGTCACCCTGGGTCAGGGTGACTGACCTGAAGCGGTGACCAGGAGGAAATGATAAGAGC
(((..((((.....((..(((((..((..((((((((((....)))))))))))..)))..))..)))))....))))..)))

Mmd_170            1  2  3  4  5  6  7  8  9 10 11 12 13 14 15 16 17 18 19 20 21 22    (SEQ ID NO:469)
cand51 probe4
TTTGCTGTGAAAATTGCAAATGTTTGCCTCAAGCAAATATGTGAAAATTTGCAATTTGTTGTAGGTGTGGAATTTTGCTATTTTTCACAGTGGA
(((..(((((((..((((...(((..(((((((.((....)))))))).)))..)))).)))))))..))

Mmd_172            1  2  3  4  5  6  7  8  9 10 11 12 13 14 15 16 17 18 19 20 21 22    (SEQ ID NO:471)
cand650 probe9
TTTCAAGTAGTCAAATTCTGGCTCATGGCTCTGGAAGGTGCTGTAACATTGTATTCTCCTCTGCTATGAGACTGGATTTGTTCTCACTGGGC
(...(((((...(((...((((..(((((((....))))))))..))))...)))))..))

Mmd_173            1  2  3  4  5  6  7  8  9 10 11 12 13 14 15 16 17 18 19 20 21 22    (SEQ ID NO:472)
cand687 probe19
TATGGATTTTCTTTCTCAATTGCTACGGAGTCACCCTGAGGCTATTAATTTGGGCTATTAGCTGAGGGTGATTTCAAAATCCATA
((((((((....(((((((..((((((.....))))))..)))))))...))))))))

Mmd_174            1  2  3  4  5  6  7  8  9 10 11 12 13 14 15 16 17 18 19 20 21 22    (SEQ ID NO:473)
mmHP2021933 probe2
GGAGAACAGCTTTAAAGTTTAGTCACTCTGATGGAATGTAAAAGCTTCTATCAGTGACAGGTTGACAGAGAAAGCTGTTTTCC
(((((((((...((..(((((((..(((((....))))).)))))))...))...))))))))

Mmd_176           23 24 25 26 27 28 29 30 31 32 33 34 35 36 37 38 39 40 41 42 43 44    (SEQ ID NO:475)
cand651 probe26
AGTCTCCAAAGACAATTGTGAAGGGATTGTGTTTGACTGATCAATCAAAGCGCGCCCCCCCTTGCTTGTCTTCCGAGAGT
((((((..((((...((((..(((((((....)))))))..))))...))))..)))))

Mmd_177            1  2  3  4  5  6  7  8  9 10 11 12 13 14 15 16 17 18 19 20 21 22    (SEQ ID NO:476)
mmHP1442327 probe17
TAGAAAAGGCAATTAAAATCCACAACTGACTTCCTTCCGGTGTCCAAGGCGAGGCACAGTGCGTGGGTGTGTGCCCTTTTA
((((..((((....(((((....((((((....))))))..))))...))))..))))

Mmd_178            1  2  3  4  5  6  7  8  9 10 11 12 13 14 15 16 17 18 19 20 21 22    (SEQ ID NO:477)
cand102 probe21
GTCTGCCCTGGAATTAGGTTTTATCTTAAGTCCACACTGGATCGTCTGGATGGGTCCACTGAGGATTTTGAAGGAAGCATAATTCCTTGAC
(((.....(((((((..(((((....((((((((.....)))))).))..))))))))..)))..)))

Mmd_180           23 24 25 26 27 28 29 30 31 32 33 34 35 36 37 38 39 40 41 42 43 44    (SEQ ID NO:480)
cand859 probe42
GAGGAAGGGAGCGGCAGCAGTGAAGGATTTGAGCCCCCTGCCGCAGATGGGCAGTTCTCTGGGGCCAGGAATCAGCTGCGGCGCCCAGTATC
......((((..((((....((((.(((((....))))).))))..))))..))))....

Mmd_181            1  2  3  4  5  6  7  8  9 10 11 12 13 14 15 16 17 18 19 20 21 22    (SEQ ID NO:481)
cand723a probe8
CCGAGACTTTGAAAACGAACGAGACCGAGATCTGGATGCAGATCTTGAGCGAGAAGAGCGAGACCCAGACTTGGATTTGTTTGTTTTTGACATCTTGG
(((..((((...((((...(((((..((((...(((.....))))))).))))..))))...))))..))))

Mmd_182            1  2  3  4  5  6  7  8  9 10 11 12 13 14 15 16 17 18 19 20 21 22    (SEQ ID NO:482)
cand520 probe21
GGTTTGGAGGTGGGCCTGACATCCCTGAGTGTATGTGGTGAACCTGAACTTGCCCTGGGTTTCCTCATATCCATTCAGGAGTGTCAGCTGCCTCTTCGCT
(((((..(((((((....(((((((.....(((((....))))).....))))))))..)))))))..)))))
```

FIG 2 Con't.

```
Mmd_184                    1  2  3  4  5  6  7  8  9  10 11 12 13 14 15 16 17 18 19 20 21 22    (SEQ ID NO:484)
cand405 probe12
GAATGACTAAACAGCCCTGCATATATTTCTGGAATACTTGGAAATGCCTGTTATTTCTGGAAATGTGTGCTTGTTCAGGTTATTC
(((((((((.((((.....((((((((((((..(((-(((..(.....))-)))...)))..))))))))))))...)))))))

Mmd_185                    1  2  3  4  5  6  7  8  9  10 11 12 13 14 15 16 17 18 19 20 21 22    (SEQ ID NO:485)
cand439 probe12
CCACCAGACAGACAGAACGGACGCTGCAGCCTCTGCAGGGACTAATCTGTCTGTGGGGATGG
(((((...(((((((...((.(.(((((...)))))).).)).....))))))))..))..))

Mmd_186                    1  2  3  4  5  6  7  8  9  10 11 12 13 14 15 16 17 18 19 20 21 22    (SEQ ID NO:486)
cand944 probe6
CTGCCTACTCCTCAAAACTTCCGAGGCTACTTTTGATTGGGATAAAAGTGCACATACTGATTTTTTAAAATGTGGCTTTAATTAATGGTGGGTGGGCAG
((((((((((.(((.......(((((((((((((..((((....(((.....)))...))))))))))).))))))).........)))..)))))))))

Mmd_189                    1  2  3  4  5  6  7  8  9  10 11 12 13 14 15 16 17 18 19 20 21 22    (SEQ ID NO:489)
cand579 probe3
AGGTACTTCAAAGCAATGTTTGACAGGCACAGGGACAAATCTTGTTAACAAGTAAGAGGATTTGTGCTTGGCTCTGTCACATGCCACTTTGAAAACCT
((((...(((((((((....(((((((.((((-((((((((..(((.....)))-))))))))..)))))-))))))))....)))))))))))

Mmd_190                    1  2  3  4  5  6  7  8  9  10 11 12 13 14 15 16 17 18 19 20 21 22    (SEQ ID NO:491)
cand147 probe17
TGCCCTGGCTGGCGGCGCTGGCTCTGGGCCTCAGCACACTCTGGAATCGCCAAGGTCTGAGCTCAGGGGCCTGGCCCCCTTCCCAGGCTA
((((((((...((-(((-((((((((((-(((((..(-(((....))))))))))))).-))))))).-))))))...))))))))

Mmd_192                    1  2  3  4  5  6  7  8  9  10 11 12 13 14 15 16 17 18 19 20 21 22    (SEQ ID NO:493)
mmHP1050998 probe13
GCCAGGAGAGGCACATGAAACTGAACACAGTGTCTGGGCTGGCCCCTTGAATTCAGAATCAGGAAGTCATGGTTCTATTCCTGGC
(((((((.(((..(((((..(((.......((.((((....)))))).......))))....))))).-))).-))))))))

Mmd_193                    1  2  3  4  5  6  7  8  9  10 11 12 13 14 15 16 17 18 19 20 21 22    (SEQ ID NO:494)
cand372 probe7
TGGCAAGTGGAGGAGCAGCAGGGTGAAACTGACACAGTGCTGGTGAGTTTCACTTTGCTGCTCCTCCTGACTCCCA
.))..((((((((((((((((((((.((..(((....))))))))))))))))))))))))..))..))

Mmd_195                    1  2  3  4  5  6  7  8  9  10 11 12 13 14 15 16 17 18 19 20 21 22    (SEQ ID NO:496)
cand450 probe11
CTGTAAAGCCTTTACTGCCACTTGTTAAGGAAGACCTGTATAGCTCACTCGTCAGTAATAAGGCGGTCACCCAAACTCAGGCACTAAAAATTTTATAG
((((((((...(((((-(((((..(-(...(((((-(((-(((((....))))).)).....))))..))-.))))..))))-.))))...))))))))

Mmd_196                    23 24 25 26 27 28 29 30 31 32 33 34 35 36 37 38 39 40 41 42 43 44    (SEQ ID NO:497)
cand743 probe27
AGAAACATCTCAAAACCTGCTGACAGCATTTTCACTATTAGCGGCAAACAAATCAACTATAATTAAAATGCTGTCAAAGTGATTGGAGATTTTTCT
(((((.((((....(((..(((((((..(((((((((((((...........))))))))))))))).)))...))....)))))-)))))))

Mmd_197                    1  2  3  4  5  6  7  8  9  10 11 12 13 14 15 16 17 18 19 20 21 22    (SEQ ID NO:498)
cand127 probe3
AATCTGAATCTTGGAGGCAGGTGCTCACATGTCCTCCTCCATGCTTATAAATACATGGAGGAGGCCATAGTGGCAACTGTCACCATGATTGATT
.....(((((.(((.((((.(((.(((((((.((((((..........)))))).))))))).))).)))))))).)))).)))...

Mmd_198                    1  2  3  4  5  6  7  8  9  10 11 12 13 14 15 16 17 18 19 20 21 22    (SEQ ID NO:499)
cand598 probe11
GGTGGGCGGGGGTTCCTGGCTGACCTCACTCCTGTACTGTTTGTTTGCGGGGCTTGTAGGGGGAGAGGAGGACATTTGGAATCCTTTGTGTCAAATC
....((((((((((..(.(.((((.(((((-(((((....))))-)))).)))))))..).)..)))))...))))......

Mmd_199                    1  2  3  4  5  6  7  8  9  10 11 12 13 14 15 16 17 18 19 20 21 22    (SEQ ID NO:500)
mmHP909030 probe18
AAGCACTTAATTGTGGGTGCAGTTAGTCGAGGCGGGCACTCTCTGCAGATTTCAGGGGTGAAGAAACCTAATTATACCCTGCAATTGAGTGCTT
((((((((((((((((((....((((((.....)))))).....))))))))..-.))))))))))))
```

FIG 2 Cm't.

Mmd_202
cand831 probe34    23 24 25 26 27 28 29 30 31 32 33 34 35 36 37 38 39 40 41 42 43 44    (SEQ ID NO:505)
GTGGGAATTCGACTTTGCATCTCTACATCTGTAAACTGAGGAACACTTTCAGTGCTCTCAGTGATGGGTGAGATGACATCTTTGAGCCGAAGAAGC
...((...(((((...((((((((((..((((..(..(((.....))).)))))))))))...)..)))))..))...))))).)...

Mmd_203
cand394 probe43    23 24 25 26 27 28 29 30 31 32 33 34 35 36 37 38 39 40 41 42 43 44    (SEQ ID NO:506)
GCAGAAAATAATCATGTAATCATCTTGTAATTATATGGTACTTACTATGCAATTACATAGTAAACACATTGTAAATTCAAAATAATTACATGGTTATTTGC
(((..(((((((((((((.(.(((..((((((.(..((((((((.....)))))))..)).)))..)))))...))).))-.)))))))))))))))

Mmd_204
cand480 probe13    1 2 3 4 5 6 7 8 9 10 11 12 13 14 15 16 17 18 19 20 21 22    (SEQ ID NO:507)
CCCTGGCAGCAAGCTGCGGTTCGGAAACTGTTGACTCAGAGGGTGCCCTGGCGGCCAGCGTGTGATGTCAGCCTGGAGCCCGGCCCGCGCCGGGG
(((((((((...(((((.(((((((((...(((((((((((((...((((.....))))))))..))))))))))))).))))).)))))))))))

Mmd_205
mmHP1788264 probe19    1 2 3 4 5 6 7 8 9 10 11 12 13 14 15 16 17 18 19 20 21 22    (SEQ ID NO:508)
AGTGGAAGGAGAGGAGTAGCGCGGATCGCTGGTGGGGAATGTTAATGGGCGGGAGCCCAGGCCGCTGGCCACCGAGACGTGGGTATCTCCTCCATT
......(((((((((..((((.....((((((..(((((((((....))))))..))).)))..)))..)..)))))))))...

Mmd_206
cand274 probe30    23 24 25 26 27 28 29 30 31 32 33 34 35 36 37 38 39 40 41 42 43 44    (SEQ ID NO:509)
CTGGCAACCATGAGGCCCAGATGCTAAGCACTGGAAGATATTTCTTCCAATAGCAGCATCTGGCATGCTGGCAG
(((.((.(((((....((.(((((.((((((.....)))))))))))))..)))..)))

Mmd_207
cand689 probe26    23 24 25 26 27 28 29 30 31 32 33 34 35 36 37 38 39 40 41 42 43 44    (SEQ ID NO:510)
TCCGCTACCAGAAGCAGCTGCAGCACAACTATATCCAGATGTACCGGCGTAACCGGCAGCTGGAGCAGGAACTGCAGCAACTGAGCCTGGAGCTGGA
((((((..((((..(((..((((((....((((((.((..((((.....))))..))))))))...))))))..))....)..))))))).)))

Mmd_208
cand640 probe13    1 2 3 4 5 6 7 8 9 10 11 12 13 14 15 16 17 18 19 20 21 22    (SEQ ID NO:511)
AGATGATCCTTCCCCTTACCTGTCTTTCTATCAGTGTAGCTGAAGCTAATTCAGTGCACTGATATAAGATTATTATCAGGTTGAGCACTTATCT
((((((.....(((((((((.....(((((((....(((((((.((((.....))))))))))))))))).....)))).)))..))))))

Mmd_209
mmHP1378833 probe21    1 2 3 4 5 6 7 8 9 10 11 12 13 14 15 16 17 18 19 20 21 22    (SEQ ID NO:512)
ATTTGGGCAGAAATTCTTGACTCAGCTCCCAAGGAATGTAAACCAGACCCTGGGAGTGGAGGAGAGTTAAGAAAAATCTCAGAT
(((((.((.((((((((...((((.((.....)).)))).....))))))))...))))))

Mmd_210
mmHP2825016 probe18    1 2 3 4 5 6 7 8 9 10 11 12 13 14 15 16 17 18 19 20 21 22    (SEQ ID NO:514)
GGTGAGACAGTCAACAGCCCAGTGTCCCTCTTGATGGCACTTTGGAGATGGCTGGAGTGCTCTGTAAGGCCTGGGCTCAATGACCCTCCTCATC
(((((....(((((....(((((....(((((((.(.....).....))))))))))))))).....)))...)))))))

Mmd_211
cand681 probe38    23 24 25 26 27 28 29 30 31 32 33 34 35 36 37 38 39 40 41 42 43 44    (SEQ ID NO:515)
GCGTCAAAAGGCTTATTTTGGGCCTCAATCCTCTCCTTCTCCGATTTTCGGAGGTAAGGAGCAGCTTCGCCAAAAATAGCCATCTCCGC
(((....((((((.....(((((((((((....))))))).))))).-))...))).))))))))).....)))

Mmd_213
cand751 probe17    1 2 3 4 5 6 7 8 9 10 11 12 13 14 15 16 17 18 19 20 21 22    (SEQ ID NO:517)
GTCTTCCTGTAGCAACAGTGGCAGCAGCTCTCTGGTTCCTGTGGTGTAAACAGGAAGCCAGACTGTGTCAAAACGGTAGTCTACAGCTGTGAGAAGGC
((((((((((((..((.(((((((((((((((((((((((....))))))))))))))))))))))..)).).)))))......))))))

Mmd_214
mmHP432573 probe3    1 2 3 4 5 6 7 8 9 10 11 12 13 14 15 16 17 18 19 20 21 22    (SEQ ID NO:518)
CTAGCAGATAAGTTGGAGGGTTATCTAGGAGTGATGTCCCCCTGTTTTGTGTAACATGGGGCAATCAACAGCCTAATGTCCCTCTTGATGGCACCTAG
(((((.(......(((((.(((.(((((((((((((((((....))))).)))).)))))..))))))))))))....).)))))

FIG 2 Con't.

```
Mmd_216                  1  2  3  4  5  6  7  8  9 10 11 12 13 14 15 16 17 18 19 20 21 22   (SEQ ID NO:520)
mmHP855413 probe3
TCAGCATGGAATGAACTGTTAGACTATAGCCAGGGCCTCTGGATTCTATTAGAGGCTCCTGGAATTTCTGAACCACTCCTAAGTTGA
(((((..(((..(((......(((((((((((((((.....))))))))).))))).....)))))..)).))...)))))

Mmd_217                  1  2  3  4  5  6  7  8  9 10 11 12 13 14 15 16 17 18 19 20 21 22   (SEQ ID NO:521)
cand448 probe5
TTGAGCTGTAATTCCACTGAGGGTTTCTAGTGACTCCAGCTTCACACTTGTGGTTATAGTATTCCCAGAACCCCTCGGTGGAGTGATTTCCTGAA
..........(((((((((((..(((((..(..(((..((((..(((....))..))))..))).....)..)))))).))))))))))).........

Mmd_218                  1  2  3  4  5  6  7  8  9 10 11 12 13 14 15 16 17 18 19 20 21 22   (SEQ ID NO:522)
cand418 probe16
CGGATTCTTCTCTGTTTTAGGGTTCTTGTGGTGCCTGCTGGGCTTTCAGTGCTGTGGGGGCCCTTGAAGGGCAGCTGAAGCTGAAAACGGGGAAGCTG
......(((((((((((.((.(((.....(((((((....)))))))...)))...)).))))))))))....)))))))))))))...

Mmd_219                  1  2  3  4  5  6  7  8  9 10 11 12 13 14 15 16 17 18 19 20 21 22   (SEQ ID NO:523)
cand478 probe21
GAGCGGAGTCTCCTGGACATAGTGTTCTGGGGGACTTTTGGGTGTCTGAGCACCACTTTTGGAGGGAGACTTGGCTC
(((((..(((((((....((.(((((.(((...((((...)))))))....)))))..)).)))))))..)))))

Mmd_220                  1  2  3  4  5  6  7  8  9 10 11 12 13 14 15 16 17 18 19 20 21 22   (SEQ ID NO:525)
cand921 probe13
GGTAAAACCTACTTGAAAGGAGTGTTTGTAGGTTCTAGTAAAGCTTTGTGACGGAGTATTGCAGGGCCTGCAGACACATTCTCCTCAGAAGTGTGACT
(((...(((((..((..((((((((((((((((....(((....))..)))).)))))).)))))))))..))))).)))

Mmd_221                  1  2  3  4  5  6  7  8  9 10 11 12 13 14 15 16 17 18 19 20 21 22   (SEQ ID NO:526)
mmHP1210358 probe10
CTCTGCCCCTGCTTTGTCTTTCAGAATAACTGCCATGGAAGGATGCTCCTCCTGCCAATTGCCACTTATCAATGACATCGAGGGAGAGGGACAGAG
(((((..(((((....((((...((.(((((((..(((......)))..))))))).))..)))))...))..))))).)))))))))))

Mmd_222                  1  2  3  4  5  6  7  8  9 10 11 12 13 14 15 16 17 18 19 20 21 22   (SEQ ID NO:527)
cand156 probe4
GCTGAAGAGGAACCAGCCCTGATGGTGTGTCCGCCAAGACATGGAAGTGAGAGGTGGGTGGAGGCCCCATTGGGGTTGGTCGGCTCTCAGC
(((((.(((..(((((((((....(((.((.((((...((((.....))))))..)))))))..)))).))))))..)))))))))

Mmd_223                  1  2  3  4  5  6  7  8  9 10 11 12 13 14 15 16 17 18 19 20 21 22   (SEQ ID NO:528)
cand642 probe13
GCTGTAATTCCATCTTGGTGTTATGGTGACATGAAAATCCACTCAAGCTGGGTTGTCAGGGTTTATGAAGTTATCAAAGCCCCTTGATGGAATTATAGC
(((((((((((((((((((..(((.(((((((((..(((((......)))))..))))))))).)))..))))).)))))))))))))))

Mmd_224                 23 24 25 26 27 28 29 30 31 32 33 34 35 36 37 38 39 40 41 42 43 44   (SEQ ID NO:529)
cand446 probe26
TCATTGTCATCGTCTTGGAGGGACATCATTGTGTCACTAGTCTGCCAGGTTGTTCAGACAGTCCGACCTGATGTCAAGCACCAGGATGATGACATGG
..(((.((((((((((....(((.(((((((((((......))))))))))).))).....))))))))))))))

Mmd_225                  1  2  3  4  5  6  7  8  9 10 11 12 13 14 15 16 17 18 19 20 21 22   (SEQ ID NO:177)
cand458 probe12
TGCATTTCAGAGAATATGCATTTTACCTTTGGGAATATGTTAATTTCAGGCAGCATTCCCTATGGGAAAGGTGATACCAGCTGATATGCA
.((((..(((((....(((((..(((((((.....)))))))...)))))..)))))..))))...

Mmd_226                  1  2  3  4  5  6  7  8  9 10 11 12 13 14 15 16 17 18 19 20 21 22   (SEQ ID NO:530)
cand320 probe1
TTAATGTATCCATTTTCTCAGTTAGTGTCAGGTTTCATTAGGAAAACACGGGAGGCCTGACATTAATCGCATGAAAAATGTGTCTCAGGGA
......(((...(((((((((..((((((((((((......(.....).)))))))))))))))..))))))))))......

Mmd_227                  1  2  3  4  5  6  7  8  9 10 11 12 13 14 15 16 17 18 19 20 21 22   (SEQ ID NO:531)
cand869 probe3
CAGCAAGAGGCTACTTTGTACTTCTGCCAGGAGACCATATGATATCTCTCAGCGACTCTCCTGCATGCCAGGAATACGGAACCATGCCTCTCAGCTG
(((((..(((((((((((((((....)))))))...)))))).)))))....))))))))))..)))
```

FIG 2 Con't.

Mmd_229
cand281 probe12 (SEQ ID NO:532)
GCAGCCCAGTGAAGTGGAGTTCTGTCGTTCCAGTCTGCATCTTTGTAGTTTGGGTCACAGAGACCTTTCTTTAAAATCTTCTTCACTGAATTGC Mmd_230
cand330 probe21 (SEQ ID NO:534)
TATTCTCATCTTGATGTGTGGGGCTGTACAGACAGAAATGCCATTAGCATTAATGGTAATTATGCGCGTGAGTCCCCGTGCTCCATGAGAATA Mmd_231
cand589 probe13 (SEQ ID NO:535)
GTAGGTACTGATTTATGAAAAGCTGTAAAAGATCAGGTGGAACTCCGTAGGACATCGTTTACAGCTGCATGGATTGAAACCTAT Mmd_232
cand549 probe9 (SEQ ID NO:536)
GCTTTCCTCACTTCTGTTTATTTTCAGTCACTCAAACTGACGTGTGCTGTCAGTATCTCCTCACTGTAAGTGTAAGCAGGAGTATTTAAAGAAGC Mmd_234
mmHP1506538 probe23 (SEQ ID NO:538)
TCCTGGAAATGCCCTTTAGGTCAGAGTCTGGGATGCAGCTTCTGACTAACAATGAAGTCCACTCCCACTTCCTCCAGACCTGGCAACCAGGG Mmd_235
cand466 probe13 (SEQ ID NO:539)
GTGTGCTTGTTGTCGAAGATGAGGGCCTCCTGGATGAGCTGGTGCTGCTGCTCCAGCAGGTCCAGGCTGGGCTTGTAGTCCACGATGCTGCGCTC Mmd_236
cand113 probe9 (SEQ ID NO:540)
GCATTTCAGGAGATTAATGGTAGACCGAAGCTAATAGCCTTTGGCTGACTCTCCAGCCATCAGCTTTTCCCAGCTGCTCATTAATTCCCAGAAAATGT Mmd_237
cand733 probe35 (SEQ ID NO:541)
GCAAGATGGCGGCGCTGGCGGAGGAGCAGACGGAGGTGGCGGTCAAGCTAGAGCCTGAGGGACCGCCGACGCTGCTACCTCCGCAGGCTGGCGACGGC Mmd_238
mmHP1679825 probe38 (SEQ ID NO:542)
CCCGCCTTGCCCGCTGGTAGGGCCTACTAGGCCGCCGGGACATCCCGGGTCTCAAGTAGGCCTAGTCTGCCAGCAAGGGCGTCCCAAAGGCGGG Mmd_242
mmHP1170304 probe1 (SEQ ID NO:546)
TTCTGCAATGTTTTGCAGCCAGGCACACACACTACAGGTGCTCTCAGAGATTGAGCTGATGGCCCTGCTGTGTGCACTGTAAACAATTATTATAGAA Mmd_243
cand129 probe40 (SEQ ID NO:547)
GAGAAGCGAAAAGTTCAATCAGTTGCCCAGATGTATGTATTGCCAAATAACAGGGTACTTGGGTACATCTGGACAGCCGAATGAACTCTTAACCCCTC Mmd_244
cand311 probe25 (SEQ ID NO:548)
GTGAAACATAGCCTCAGTATTTTCAGGTCATTTTAATGAACACCTCATAAAAACTGAGGTATACTACCAC

FIG 2 Con't.

Mmd_246
cand410 probe35                    23 24 25 26 27 28 29 30 31 32 33 34 35 36 37 38 39 40 41 42 43 44    (SEQ ID NO:550)
TGACCCCAAGAAACCAAAGGGCAAGATGTCTGCTTATCCCTTCTTTGTGCAGACATGCAGGGAAGAACATAAGAAGAAAAACCCAGAGGTTCCGGTCA
.(((..(((.((((((((((((((((((((((((((((((((((((((.....)))))))))))))))))))))))))))))))))))..)))))..)))

Mmd_247
cand309 probe17                    1 2 3 4 5 6 7 8 9 10 11 12 13 14 15 16 17 18 19 20 21 22    (SEQ ID NO:551)
GCCACTTTGAGAGCATCGGTTTTTATTTAAAAGGCTTAATTGAAGTTTTTATTACTCCCAATTAGGCTTTTTAATTAAAAGGAAAAGTTGAGAGAGGC
(((.(((((.((....(((((((.(((((((((((((((((.((((...))))))))))))))))))))))))))))))))....))))))..)))

Mmd_248
cand811 probe37                    23 24 25 26 27 28 29 30 31 32 33 34 35 36 37 38 39 40 41 42 43 44    (SEQ ID NO:552)
CCATTTTCAAGTGCGCTGGATTTACACTTCAAAAAGTCAGGCGCGACTTCATAATTGAATTGCACCTGATCTTTTCAAGTGCCAGGCACCGGAGCCGGG
(((...(((..((((..(((((.(((((..((((((((.((((....)))).)))))))).)))))))))).)))).))))))..)))))...))

Mmd_249
cand816 probe3                     1 2 3 4 5 6 7 8 9 10 11 12 13 14 15 16 17 18 19 20 21 22    (SEQ ID NO:553)
TAACTCTTTGACTGCCATGGCACAAACCATGCTGATGAATCTAGATTGTGACCGTTGTATGGTTAAGGTTGCCACAGCAGTCAAAGGGTTA
(((((((((((((..((((((.(((((((..((((((((....))))))))..))))))).))))))))))))))))))..))))))

Mmd_250
cand82 probe8                      1 2 3 4 5 6 7 8 9 10 11 12 13 14 15 16 17 18 19 20 21 22    (SEQ ID NO:555)
ACCAAAGGAGCTTTTCTGGTCTATTGGGTAAATATGTATTAAAGTAATTTTTAAAATACTTATGTACTCAATAGGCTGGAAGTGGTCAATGGT
(((..(((.(((..(((((((((((((((..(((((((.....))))))).))))))))))))).))..))))..))))))

Mmd_253
cand48 probe12                     1 2 3 4 5 6 7 8 9 10 11 12 13 14 15 16 17 18 19 20 21 22    (SEQ ID NO:194)
CCTTGATTTCAATGTTTCCCACTTTGGTGGTTGATCTGATAATAGGTCTTCCAACCAAAGCTGGGAAGATGTGTTCTGG
(((..(((...(((((((((((((((((....(((((((....)))))))..)))))))))))))))))...)))..))).

Mmd_254
mmHP2341379 probe21                1 2 3 4 5 6 7 8 9 10 11 12 13 14 15 16 17 18 19 20 21 22    (SEQ ID NO:558)
GCAATGAGCCATGGGCCAACAATGTGAGTAATGGCTAGTTTTGTTATTTTGAACTTGGGTAGTTGGCTGATGGGTGTTTATTGC
(((((((((((((((((((((((...(((((((....))))))).))..))))))))))))))).)))....))))))))

Mmd_255
cand536 probe14                    1 2 3 4 5 6 7 8 9 10 11 12 13 14 15 16 17 18 19 20 21 22    (SEQ ID NO:559)
GTGCTGAAGTTGGTATGGCAGCCTGCACCATGCCAGTTCCCTGGAATGGGCTTGGGGTCAAAGGTTGCTATCACCCCAAAGTCTTCGCAT
(((((((..(((((.(((((((((..(((((((.....))))))).))))))))).)))))..))))))).))..))

Mmd_256
cand960 probe22                    1 2 3 4 5 6 7 8 9 10 11 12 13 14 15 16 17 18 19 20 21 22    (SEQ ID NO:560)
GCGGCCCGAGCCGGTAGGCCCCGAGGAGGGTTGTGGGCCCTTCTTTTTGTGAATGAAGCTCCACGGAACATCCCTCCTGGGGGTCCCCGGGAGCCGC
((((..((((..((((.(((((((.....((((.....((((...))))..))))....))))))).))))..))))..))))

Mmd_257
cand511 probe9                     1 2 3 4 5 6 7 8 9 10 11 12 13 14 15 16 17 18 19 20 21 22    (SEQ ID NO:561)
GTGTGCTCAGCTGGAGTAATTAGAGGAAAAACCTGAGGGAAGTCTACCCCAGAAGACTCACTCAGCCTTCTCCAGCTGAGTCTCAC
(((..((((((((((......(((.....((((.((.(((......))).)))))).))..)))))))))))..))).

Mmd_258
cand713 probe11                    1 2 3 4 5 6 7 8 9 10 11 12 13 14 15 16 17 18 19 20 21 22    (SEQ ID NO:562)
GCGGTGCTGCCTTCTTTTCTCGGTCTGCTGGTTGGAGGACGAAGATGACGAGGAGCTGGTGCTGGCCCTCGAATCGTCATCCGACATAGCCGAACCCCCC
(((((...(((.....))).))))))))))...(((((.(((..((((.(((.....)))))))..))))))))..)))..))

Mmd_259
cand376 probe15                    1 2 3 4 5 6 7 8 9 10 11 12 13 14 15 16 17 18 19 20 21 22    (SEQ ID NO:563)
TCCCCTGCTGCACTAAATTGACACTTGTGCAAGCAATGGCTCTCGTCAGTCACTCTGAAGCTGCTGCCTCCAGAAGTGTCGATTTAGTGCAGTGGGAGA
((((.(((((((..(((((((((.(((.((....((....))..))))))))..)))))))))..)))))))))).))

FIG 2 Cont.

Mmd_261
cand873 probe8    1  2  3  4  5  6  7  8  9  10 11 12 13 14 15 16 17 18 19 20 21 22    (SEQ ID NO:565)
AGAATCTTCTGACAATGAAGGTAGGCGTACAACTAGGAGATTGCTGTCACGGATAGCTTCTAGCATGTCATCTACTTTTTTCTCACGAAGATCT
(((.(((((((....(((..(((((...((((...)))).)).))..))).))))))..))).))))))

Mmd_262
cand360 probe7    1  2  3  4  5  6  7  8  9  10 11 12 13 14 15 16 17 18 19 20 21 22    (SEQ ID NO:566)
TTACACCTGAAACTTCTCACTTGGGGGTACAATTAGCCTCTGGCGCCTTTAGAATGAGTTGCCAGTGACTAATGGTGCCCTCAAGGAAGCATTTGTAA
.(((.(((((((((.((((((((((.(.((.(((((...))).)).)..))))))))))))))))))....)))).

Mmd_263
cand568 probe21   1  2  3  4  5  6  7  8  9  10 11 12 13 14 15 16 17 18 19 20 21 22    (SEQ ID NO:567)
GAGGACAGCTGGCAGAAAGTGTTACAGGTATAACCCTAAGTCTCCTTGTTTCTGTTGGTGTTGTAGGAGAGATCTGTAGGCCTTTCTGTCCAGCGCTC
(((((((((((((((((((((....)))...))))))))))).....))))))))))

Mmd_264
cand393 probe14   1  2  3  4  5  6  7  8  9  10 11 12 13 14 15 16 17 18 19 20 21 22    (SEQ ID NO:568)
AAACGCTGTGACTCAAACTCGGGGAAATTGTTCCTGTAATGGAGTTCTCAATTTATTGGTCAATTTCACCTTGATTTTGTGTCACTGTTGGTTT
(((((((.((((.(((((((((((((.((.((((((....))).))).))))))))))))))))))))))))).)).))

Mmd_269
cand570 probe12   1  2  3  4  5  6  7  8  9  10 11 12 13 14 15 16 17 18 19 20 21 22    (SEQ ID NO:572)
TCTCGGGCTCTGCGGGACTATGACTACAAGTGTGTGGATGGCAAGCGGCCTACAGAGCAGCTTGTTTCTCCAGAGCCTGACG
.(((.(((((((((((....)))((((.((((..(((....)))))))))))).)))))))))))))))).

Mmd_270
cand126 probe18   1  2  3  4  5  6  7  8  9  10 11 12 13 14 15 16 17 18 19 20 21 22    (SEQ ID NO:574)
TTGGGTGTGGGATAGGGGCACTTCTGTTCCTGATAACCTTATTATGTGTTTATCAGGAGCAGACACTGCCCAGGTTGTCACGACAACCAG
.(((.(((((..(((((..((((((((((((((.(......))))))))))))))...))))).))).)).)))..))).

Mmd_271
cand377 probe20   1  2  3  4  5  6  7  8  9  10 11 12 13 14 15 16 17 18 19 20 21 22    (SEQ ID NO:575)
CTTGGAGGCTTTGCCTCATCCACAGGCATTTGCATCGGAGATGGAAAATTTCACTTGTCAGGTCACCATGGAAACAAGCAGAGCCACTGAG
(((.(((((((...(((((.((.(((((((((....))))))...))))))))...))))...))))))).)).))

Mmd_272
cand19 probe18    1  2  3  4  5  6  7  8  9  10 11 12 13 14 15 16 17 18 19 20 21 22    (SEQ ID NO:576)
TTAGCATGTTAATAGGTCTTTGTGCCCAAAGGCTTTGGATTATAAATTATCAAGACTGCATTAGCCAGATGGGCAGGATTAATTAGCATGCTAG
.(((((((((((((..((((...((((...((((((....))).))).))))...))))..)))))))))))))).

Mmd_274
cand275 probe10   1  2  3  4  5  6  7  8  9  10 11 12 13 14 15 16 17 18 19 20 21 22    (SEQ ID NO:578)
GGGTGGCTGGGGTCATACATCTGTGGGTAAGGATAAGCATGCAAGTATTGTATGTAGGACTGGTGCTGACTCATGGGTGAGGACACGGCCACTC
(((((((((...((((((((...((((.((.(((...))))).))))...)))))))).)))))).)))

Mmd_275
cand616 probe16   1  2  3  4  5  6  7  8  9  10 11 12 13 14 15 16 17 18 19 20 21 22    (SEQ ID NO:579)
GGCACCAGCTCCGTCAGCTCCAGCCCCAGGTCCTGCGCGATGCGGCCCACAAAGGTGCCGTGTTTGGCCTCCTCTGGGACGGAGTAGCGGAGCTGGCC
....((((((...(((((.((((((.(((((.....)))))..)))))).)))))...))))))...

Mmd_276
cand723a probe15  1  2  3  4  5  6  7  8  9  10 11 12 13 14 15 16 17 18 19 20 21 22    (SEQ ID NO:580)
CCGAGACTTTGAAAGCAAACGAGACCGAGATCTGGATGCAGATCTTGAGCGAGAAGAGCGAGACCCAGACTTGGTTTGTTGTTTTTGACATCTTGG
(((((((....(((((((((((((((((.....(((....))).....)))))))))))))))))))))))...)))))

Mmd_277
cand318 probe13   1  2  3  4  5  6  7  8  9  10 11 12 13 14 15 16 17 18 19 20 21 22    (SEQ ID NO:581)
TAGTTAGCTAATTGCAGGTGCAATTCGGCCACTTGCTCCATCAGATGAAGGGTAAGTGGTTAATTGAACTCATGAGTGACCTA
..(((((.(((...((.(((...((((((((.((.(((....))..)).))))))))))).))))))))))))...

FIG 2 Con't.

```
Mmd_279                    1  2  3  4  5  6  7  8  9 10 11 12 13 14 15 16 17 18 19 20 21 22   (SEQ ID NO:583)
cand566 probe18
GGCTTGTTTTGAGTTCATTGTTCAGCAGATGAGCTAGTTCAGGTTTTAGCTTTCAGCAGTTCATTTGATTGAACTTGGGACCAATAAAAGTGAGAGGCC
((((.-(((((.-(((...(((((((((((((((.-(((-.(((((....)))))..)))))))))))))))..)))))))....))..-)))))

Mmd_280                    1  2  3  4  5  6  7  8  9 10 11 12 13 14 15 16 17 18 19 20 21 22   (SEQ ID NO:585)
cand860 probe10
CCTGGCTGCAAGGAGGCTTGCTGCCTAGTCCGAGGCCAGCAGTGTTGTGTCTGGCCTGTAAGAGGCAGGTAGCAAGCCGAGACTATGTCCAAAGG
(((((...(((((.-(((((((((.-..((((((((.-(((((-(((((((...)).-.)))))))))))...-)))))))))....))-)))....)))

Mmd_283                                              23 24 25 26 27 28 29 30 31 32 33 34 35 36 37 38 39 40 41 42 43 44   (SEQ ID NO:588)
cand680 probe23
GTTAGCGCAGAGCTTCAAGCTAAGCAAGGCATCTCAGCACGGAGGTGTCAAACATAAGACAGCTAATGCTGGAAGCCAGAGCAAGAAGGCTCTTCTTGAC
(((((((-.(((((-.(((..(((((((((((((((.-((((-..))))..))))))))).-)))).)))))).-))))))

Mmd_284                                              23 24 25 26 27 28 29 30 31 32 33 34 35 36 37 38 39 40 41 42 43 44   (SEQ ID NO:589)
cand149 probe35
ACGTTAGTCCATTTGCTCAGCGGCCCTTCCACGATGGACGCCATCTTGGGAGCCGCCAATGACAACAAACGGCCTGACGT
((((((((.-(((.-(((((((((-..(((((-.((((((...))))))).-.))))))))))..-)))...))).-))))))))

Mmd_285                                              1  2  3  4  5  6  7  8  9 10 11 12 13 14 15 16 17 18 19 20 21 22   (SEQ ID NO:590)
cand488 probe10
ATTAATTGAGCCAAGCCAAGCTCAACCTGAAGATGCTACTTTGGTGTGTTCCCGAAATAGGGCTGAGCTTATGGCTGGTTCTTACTTGTTAGT
........(((((-(((((((((.-(((((((((....)))))))))..))))))))))))..........

Mmd_288                                              23 24 25 26 27 28 29 30 31 32 33 34 35 36 37 38 39 40 41 42 43 44   (SEQ ID NO:593)
mmHP1540701 probe28
TTGGCTGTTTTCCTATTAGCATATGAGGAACCTAGGACTGTCCCTTGTTGTCAAGGTAACGGCTATTCCTTGGCTAGCTGCAATAGAAAAGAAGCCAA
.((((((.(((((.(((((((((((((....((..(((((.(((((....))))).)))))..))....))))))))))))).)))))).))))).

Mmd_290                    1  2  3  4  5  6  7  8  9 10 11 12 13 14 15 16 17 18 19 20 21 22   (SEQ ID NO:596)
mmHP1876696 probe21
GCTGGCCTCACTGACCCAGGAATTCATAGCAGGAAATTAGGCAGGATTAAGGAAGGCTAGTTTTCTTGTGTGAGAGGGTAAAGGTGGAGGAAAGC
(((.((((.-(((((-.(((((((((.-(((((....(((...))).....)))))..-)))))))))-.))))).-))))-.))))

Mmd_291                    1  2  3  4  5  6  7  8  9 10 11 12 13 14 15 16 17 18 19 20 21 22   (SEQ ID NO:597)
cand496 probe20
GTCGCAGCGCGTGGCCGATCGCCTGGGCCTGGAGCTGGGCAAGGTGGTCACCAAGAAGTTTAGCAACCAGGAGACCAGGTGGGAGCCTCGCTGGGC
(((..(((((-...((((-..(((((((.-(((((((.-...(((...)))....))))))))-.)))))))-.)))))..)))))

Mmd_292                                              1  2  3  4  5  6  7  8  9 10 11 12 13 14 15 16 17 18 19 20 21 22   (SEQ ID NO:598)
cand710 probe3
AGCTTCTTTTCCCGGGCGAGCTGCCTACGGGTCCGCTGCTGGCACACAGCCAGCTGGGTCTTGGCGGCTTTGTTGCTGGGATAGAGCT
((((.(((..(((((((((((.((((-..((-.(((((.....))))).))..-)))).-.))))))))))))....-)))))))))))))

Mmd_293                    1  2  3  4  5  6  7  8  9 10 11 12 13 14 15 16 17 18 19 20 21 22   (SEQ ID NO:599)
cand138 probe15
GCTTGAGCTGAGGGGCCTACCTCAAGCTATGGAAAAAATTAGGGTTAGACAAGAAGCATTTTTTTATAGCCTGAGGAAGGCCCATGGCAAGAGC
((((..(((...(((((...(((((-.(((((((((.-(.-.(((....)))...))...))))))))))-.))))).-))))..-))))

Mmd_294                    1  2  3  4  5  6  7  8  9 10 11 12 13 14 15 16 17 18 19 20 21 22   (SEQ ID NO:600)
cand214 probe3
CGTCACCTAGGGATCTTGTTAAAAAGCAGAGTCTGATTGAGGGGCCAAGATTCTGCATTTTTAGCAAGCTCTCAAGTGATG
-(((((((.-(((((((((((((((.-((((...))))))....)))))))))))))))))..))..

Mmd_295                    1  2  3  4  5  6  7  8  9 10 11 12 13 14 15 16 17 18 19 20 21 22   (SEQ ID NO:601)
mmHP2069067 probe14
GGTCAGGATGCTTTGTTGTCTGGATTCTCAGTTGCTTGTATTGGCTTTTGAAAAGGTCATTATGAGAAAAGGGATCTGAATAGCAAAAGGATTCCAGCT
(((((..(((((-.(((((..(((((...((((((((....))))))-)).)))))..-)))))))))...))))).)))))-.-))))
```

FIG 2 Con't.

```
Mmd_297                              1  2  3  4  5  6  7  8  9  10 11 12 13 14 15 16 17 18 19 20 21 22   (SEQ ID NO:603)
cand461 probe9
TAGACTAATTAATGTTTGAGTGTTTAAACACAATGCCTTTACAGAAGCAATGGCATTATAATGTGTTGGGACACTCTAGCATTGTAATTAGCACTA
..(((((((((((((..(((((((((((((((((((.....))))))..))))))..)))))).)))))...))))))))....

Mmd_298                              1  2  3  4  5  6  7  8  9  10 11 12 13 14 15 16 17 18 19 20 21 22   (SEQ ID NO:604)
cand248 probe6
CTTCAGCAACCTTGCAGCCCCATCGCTCATTTGCATAATGGATGCCTTTTTATCCATTATGCAAATGGTATGAGAGGAAAATTAGGCAATAAGGGAAG
...((((.(((((((..(((((((((((((.....))))))))))))))..)))..).).........)))..))))....

Mmd_299                              1  2  3  4  5  6  7  8  9  10 11 12 13 14 15 16 17 18 19 20 21 22   (SEQ ID NO:605)
cand686 probe10
GGTGATGAATGTATATTGGTAAGGAGGGTGAAGTTGAAGGGGCAGAGACCTCTCAAATGAATTGACTTTTCTTTACCAACATAATTCAGAACACC
(((((((((((((..((((((((((((((.(((((......))))).)).)))).)))))))))))).))))))...))))

Mmd_300                              1  2  3  4  5  6  7  8  9  10 11 12 13 14 15 16 17 18 19 20 21 22   (SEQ ID NO:608)
cand420 probe12
CAGCTAGAACTCCCCTGGCGAGTGGAAACAGCTTTTACCGCGGCTGTAGCTGTGGTTTTGGAATTTTCCAACGCCCCCTGTGATTGGCTG
(((((((((((((..((((((((((((((.........)))))))..))).))))))))))..))))))..)))))))

Mmd_301                              1  2  3  4  5  6  7  8  9  10 11 12 13 14 15 16 17 18 19 20 21 22   (SEQ ID NO:609)
cand445 probe4
GGCTATGATTCCACTGAGGGGTGCTGGCGGTGACATGTGCCATGAAGTCAATCTGAGTGGTTTATCACCAGAACTCCCAGGGTGGAATTATAACC
((((((((((((..(((((((..((((((((.....))..))))))))).)...).))).))))))))))))

Mmd_302                              23 24 25 26 27 28 29 30 31 32 33 34 35 36 37 38 39 40 41 42 43 44   (SEQ ID NO:610)
cand615 probe36
GCAGTGCCTAAGGAATTAATGACCAGCTGAGGTTAATGAGTCCCCACTCAGCTCCGGGCCATCAACTCTCCCAGCTGGCCATTAATCCCCTGGAAATGC
(((...((..(((((..((((((((..(((((..(((((....)))))..))).)).....)))))))..))...)))))))

Mmd_304                              23 24 25 26 27 28 29 30 31 32 33 34 35 36 37 38 39 40 41 42 43 44   (SEQ ID NO:612)
cand467 probe44
TTCCAGCCAGGCCACCTCTCCCTTTATCTGCACAGTCTATTTTAAGAGTACTCTACTGCAAGGAGAATGGGGCCTAGGCAGGAA
.(((((((((((((..((((((((.....(((((..((((.....))))..)))))...))))))))..)))))).)))..

Mmd_305                              1  2  3  4  5  6  7  8  9  10 11 12 13 14 15 16 17 18 19 20 21 22   (SEQ ID NO:613)
cand657 probe8
GCGAAGCATTGCATTTGGGTGACAGGCAGTTGTTCGTGCTTGAATAACTCAGGATTTGAATTCTACAGTTTGTGGCACCCGTGTAATGCTTAGC
(((.(((((((((..((((((((((.((.(((((.....))))).).)).))))))))).)))).))))))))))))).))

Mmd_306                              23 24 25 26 27 28 29 30 31 32 33 34 35 36 37 38 39 40 41 42 43 44   (SEQ ID NO:614)
mmHP1541151 probe27
CCACATTTTCTTCGCCACAGAATGACTCCTCTGAGAACAAAGTCATTGTTGACTTCAAAGAACTCTGAGGAAGTTCAGTGGATGGAAAGAATTTGG
((((((((((((((((....))))))..((((((....(((((.....)))..)......)))))..)).))))).))))).

Mmd_309                              1  2  3  4  5  6  7  8  9  10 11 12 13 14 15 16 17 18 19 20 21 22   (SEQ ID NO:616)
mmHP874966 probe9
GGCCTTTTCCATGTTGGGTAACTGCTGTGCATGCTACCCAGTTACCCAAGCCAGGAAGCAGCC
((((((((((((..(((((((((((((.....))))))))))))..))))))))))

Mmd_311                              1  2  3  4  5  6  7  8  9  10 11 12 13 14 15 16 17 18 19 20 21 22   (SEQ ID NO:619)
cand124 probe1
ATTGGTCAGGAAAGACACTTTTTATATTGTCAAGTGCACTTAAGCCACTAATTCTTGACTGTGAAACTGCTTTTCCTGGGCAAT
((((.(((((((..((((((((....))))).....))))))))..))))).))))

Mmd_312                              23 24 25 26 27 28 29 30 31 32 33 34 35 36 37 38 39 40 41 42 43 44   (SEQ ID NO:620)
cand421 probe39
GGGAGGAGGCGGAAAGCCGACATTGTTTACTTAATTAAAAGTAAACAACAATTTGCCGCTGCCAGCCTCCC
((((..(((((..((..(((((((......))))))))..)).)))))..))))
```

FIG 2 Con't.

FIG 2 Con't.

Mmd_332
mmHP2109324 probe14      1  2  3  4  5  6  7  8  9  10 11 12 13 14 15 16 17 18 19 20 21 22    (SEQ ID NO:641)
TACTCCACGGGTAGCATGTTGGAGATGGTCAGGTGGAATAATAAGGAGAGTCCACAGACCAGGAGCTTCTCCGTAACTGCTGCCTGGAACGGGTG
(((((..(((((((((((((((((..(((((((.....))))))).))))..))))).).))))))))))..)))))

Mmd_333
mmHP1301606 probe19      1  2  3  4  5  6  7  8  9  10 11 12 13 14 15 16 17 18 19 20 21 22    (SEQ ID NO:642)
CGGCTGATGAGCAGTTCAAGCTCCCTGCATAGAAATAGCCTCAGAATAGTTGTGGTGTTGTTTCTAATTGCAATGGGTGAACAGACTGGCTCATTAATCC
(((.((((((((((((...((((((((((((((((.(((.(.......).))).))))))))))))..)))...))).)))).)))))))))..))

Mmd_334
cand787 probe21          1  2  3  4  5  6  7  8  9  10 11 12 13 14 15 16 17 18 19 20 21 22    (SEQ ID NO:643)
TCCTTCACAAAGTACAAAGGGTTTCAGAATCAAGTGTATTCCAGCAGCAGCCCAGGCTTGCTGACAAGATATTTTGAAACAACTTGCTATTAGGAAGGA
((((((..((((((((((((((((..(((...((((.....))))))))))..)))))))))...))).)))).)))))

Mmd_335
cand781 probe9           1  2  3  4  5  6  7  8  9  10 11 12 13 14 15 16 17 18 19 20 21 22    (SEQ ID NO:644)
GAGGCGAGTGTGGATCTAATCTTCAGCTGATTAAATGTCCCTCATTAATGAGTTTCTTTAATTAATGAAGTTTTGGGGCCTGCTCCACTTGCTTT
((((((((((...(((((.((((((...(((.....)))..)))))).))))).))))))))))

Mmd_336
cand430 probe8           1  2  3  4  5  6  7  8  9  10 11 12 13 14 15 16 17 18 19 20 21 22    (SEQ ID NO:645)
GCATGCCAGTGGGAATCATAGGCTGGAGAGACCTTCCTTCTGCAGGAGATGAAATTCTTGAAGTAGAATCTGAGGTATTCAAGCCTAATTCCCTAATGT
(((((((((((((((((((((((((...((((.....))))...)))))))))))))))))..)))

Mmd_337
cand246 probe3           1  2  3  4  5  6  7  8  9  10 11 12 13 14 15 16 17 18 19 20 21 22    (SEQ ID NO:646)
AATTTATTTTCGCTAGGAGAGGAATGACCCATAACTCACGAACGGTGATGCTTAAAGTGAGTTATGGAGGTTACTCTCCTGTGAGAGGAAATGGATT
.((((.((((((..(((((((.(((..(((((((((.....))....))))))))))))))))))).)))).....

Mmd_338
cand307 probe2           1  2  3  4  5  6  7  8  9  10 11 12 13 14 15 16 17 18 19 20 21 22    (SEQ ID NO:647)
TCCAAGTTCATGATGAAGAGTTTGTCAGTGGGAGTCAGTTCCACAGGCTGCCTGGTGAACTCTTTGTCGAAGTTGGA
(((((((((..(((.....(((((...(((..(.((((.....)))).).)))...)))))...)))))..)))))))

Mmd_339
cand434 probe18          1  2  3  4  5  6  7  8  9  10 11 12 13 14 15 16 17 18 19 20 21 22    (SEQ ID NO:648)
GGCCGCCATCTGGGAGGATGATGTCATCTATCTCCCCAAAGAAAAGGCCACACTTTCCTTTGTGGAAGTCCATGGTGACATCACCTTCTGATCACATGCC
((((((((((((((((((((((((((((((....))))))..)))))))..)))).))))....)))

Mmd_340
cand853 probe27          23 24 25 26 27 28 29 30 31 32 33 34 35 36 37 38 39 40 41 42 43 44    (SEQ ID NO:650)
GGCCCAGCCACAGTGACATTCATCCCCCGGTGGGTCTGGCTGCCTCCTCACAACCCACCGACAACAATGAATGTTAATTGTGACCTTTGCTGTGGCC
((((((((((((((..(((((....))))).)).......))))))))))))..)))

Mmd_341
cand86 probe20           1  2  3  4  5  6  7  8  9  10 11 12 13 14 15 16 17 18 19 20 21 22    (SEQ ID NO:651)
GCAATGTGGAGAAGCCTAGGGCTTGCCCTGGCTCTCTGTCTCCTCCCCTATGGAGGAGCAGAGAGCCAAGGCCAAAGCTCTGCTTGTTACAAAGC
(((..(((((..(((((((((...(((((((((.....(((((((...)))))))..)))))))))..)))))))))..))))).)))

Mmd_342
cand403 probe29          23 24 25 26 27 28 29 30 31 32 33 34 35 36 37 38 39 40 41 42 43 44    (SEQ ID NO:652)
TTATTCACCTGGAAAACTGCTCAGGAGCACAAATGTCACAAGATAAATCAAACCTGTCAGAATTGGCATCTCTCAGCAGCAGGATGGGTAG
.(((((((((....((((((((...((-((((......))))-))))))))).)).)).)).)))))))).)))))).

Mmd_343
cand673 probe6           1  2  3  4  5  6  7  8  9  10 11 12 13 14 15 16 17 18 19 20 21 22    (SEQ ID NO:653)
CAGGGTGATGGTTAGGGATTGGCAGCATGGCCCCATTAACATTAGTGGGAGTTACTCAGCTAAATCCCAGACATGAACAGAATCCTG
(((((((((((...((((((((((..)))))))))).))).....))..)))))

FIG 2 Con't.

```
Mmd_346                                                                              (SEQ ID NO:656)
cand365 probe11        1  2  3  4  5  6  7  8  9 10 11 12 13 14 15 16 17 18 19 20 21 22
CTCAGGCGGGGTGGGGGAGGATGTTTTGGATGCCGCTCTGCTGACGTTGGTGCCCTCTGTTCTTACATCCTCCTTAATTTACTGCCTGAG
((((((((((((...((((((((((...((((((((...(((((((((((...((.....))))))..)))..)))))..)))))))))..)))))))))))

Mmd_347                                                                              (SEQ ID NO:657)
cand492 probe32       23 24 25 26 27 28 29 30 31 32 33 34 35 36 37 38 39 40 41 42 43 44
GCGGCGGGCTGAGTTTTGAAAACTTAGGATTCTAAATGTATAAATTGTTGGAACATTTAACATCTAGTCATTAAGCAGTCACCCTCTTGCCCCTCGGC
((((.((((..(((...((..((((....(((.((((.((((((.((.....))))))))))).))).....)))))...)))..)).))))..))))

Mmd_348                                                                              (SEQ ID NO:658)
cand598 probe12        1  2  3  4  5  6  7  8  9 10 11 12 13 14 15 16 17 18 19 20 21 22
GGCCCTCTTAGCTGCTCTAATTAGGATCCCCTTAGTCCCTCCGGGTTTCTCCGGAGAGGACAGGGGCTTTTTAATTGAGGCTATTAGGAGTTC
....(((((((.((..((((((((((...(((((((((...((.....))))))..)))))..))))))))..)))..)).))))))...

Mmd_349                                                                              (SEQ ID NO:659)
cand690 probe14        1  2  3  4  5  6  7  8  9 10 11 12 13 14 15 16 17 18 19 20 21 22
AGCCATTAACATGTCACCCCTGCTTGAAACAATGACTCAGCTTGGTTCTGCATAATAGGACAAGTGAGGGAGACAAGCAGAGGTGACAGGAAGCTT
((((.((..((((((((((...((..((((.((((..(((((....)))))..))))))))..))...)))))))))).))..))))

Mmd_350                                                                              (SEQ ID NO:661)
cand264 probe4         1  2  3  4  5  6  7  8  9 10 11 12 13 14 15 16 17 18 19 20 21 22
TTCCAAATTTTATGGGCCAAATTCTGCCCTCAATTATGCACATGCAACTAATTGCACACATATAACAGAGGGCAGAATTCGCTTTTGGAACTGGAA
.((((..((((((((((.((...(((.(((((.....)))))..)))...)))))))))))..))))..

Mmd_351                                                                              (SEQ ID NO:662)
cand631 probe10        1  2  3  4  5  6  7  8  9 10 11 12 13 14 15 16 17 18 19 20 21 22
CAAAAGCAGATATTTTCCCAAGCAGACACCAGCCACAGCCTTCTTGGCTGAAAGGCTAAATGGCTGGCTACTCATGTACTGTTGAATGTCTGAGTATG
.....((((((((((((((.((((.((((((((((.....))..)).))))))))))))))).))))))..)))))).......

Mmd_352                                                                              (SEQ ID NO:663)
cand21 probe20         1  2  3  4  5  6  7  8  9 10 11 12 13 14 15 16 17 18 19 20 21 22
GTTTAAGTACCTGTKGGCAGCATCAGGGTCTGCCTTGCGGTGGGACCTTTTGGGTTTCAGCGCAGGGTCTCTGGTGTTCCTGACAGGCGATCGAAGC
(((((.(((...(((((.((((.(((((((((((((((...(((.....)))..)))))))))))))))).)))))))).))..))))

Mmd_353                                                                              (SEQ ID NO:664)
cand395 probe7         1  2  3  4  5  6  7  8  9 10 11 12 13 14 15 16 17 18 19 20 21 22
GCATTTTCTGCAGATTAATAATTAGCTAGAAGGAGTTGATGGTCCTTGGCTAAAACGTGGGTCATTAACTCCAGCCAGTCATTAATTGCCTGGAAATGT
(((((((.((((.((((((...((((((((...((.((.....))..)))))))))).))).)))))).)))))))))).))))

Mmd_354                                                                              (SEQ ID NO:665)
cand704 probe5         1  2  3  4  5  6  7  8  9 10 11 12 13 14 15 16 17 18 19 20 21 22
GACTCTGTATTTAATTTGGCTCAGCCGGGAAGATTTTTTGGCTCTGTGTGTGTATGTGTATTCTGAAAAATCTTTTCCGAGCAAGCCCCAGGGTC
((((((....((((((((((((..(....((...(((((..))))).....)))))))))))))).))))))

Mmd_355                                                                              (SEQ ID NO:666)
cand323 probe1         1  2  3  4  5  6  7  8  9 10 11 12 13 14 15 16 17 18 19 20 21 22
TTGTAGCATGTGGTTGTATTAATGAACGTTACAGGACAGCTTTATAATCATTTATAAATCTGTAACATTCAATAAAGAAGCACATGTGGCAA
.(((((((((((...(((((((((((((((....(((((((.....)))))))..))))))))))).)))))))))))).))).

Mmd_356                                                                              (SEQ ID NO:667)
cand182 probe10        1  2  3  4  5  6  7  8  9 10 11 12 13 14 15 16 17 18 19 20 21 22
TTGGTGTTGTCAATTGTGAGACCAGTCTGGAATTTTCAGCCTTGGTACACAAGATCTAGAATTAAGAGATTGCACACACAAATGAGACAAACACCAG
.((((((((((.(((((((((.(.((((((..(((((.(((((((.....))).)))))))).))).))))..)).)))))))).

Mmd_358                                                                              (SEQ ID NO:669)
cand668 probe30       23 24 25 26 27 28 29 30 31 32 33 34 35 36 37 38 39 40 41 42 43 44
GCGACGTCCGTGCAGCGGAGAAGCAGAGGATAATGGCGTCTGCAGCGCGTGTCGCCCTGTAGCGCCCTCCTCTTTTCTCGTTGCGCACTCTGTGGT
((((((..(((((...(((((((....((((((((((((.....)))))).)).)))))))....))))))).))..))))).)))
```

FIG 2 Con't.

```
Mmd_360
mmHP811508 probe6                1  2  3  4  5  6  7  8  9 10 11 12 13 14 15 16 17 18 19 20 21 22   (SEQ ID NO:672)
GGCACTGGGGGCAGAAGGCCATTTGAAAATTTTCCACATTGAAATTTTGATTAATTAAATTTGTCTCAAGTGGCTGGCTTTCAGTGTC
((((((((..(((....(((((((((((((((.....((..(.....)))......))))))))...)))))))))))..)))))))

Mmd_361
cand18 probe11                   1  2  3  4  5  6  7  8  9 10 11 12 13 14 15 16 17 18 19 20 21 22   (SEQ ID NO:673)
AGAAGGATGCTGAAACCAATGAAACAATATATTGTACAAAAGAGCCTTTCATCCAGGCTCGGGTTATTGTCATTCGTTGGCTGGTTTCTTTCT
((((((((.(((...((((((((((((......((....(((((((......)))))))..)))))))))..)))))))).)))).)))))

Mmd_363
mmHP2216591 probe41              23 24 25 26 27 28 29 30 31 32 33 34 35 36 37 38 39 40 41 42 43 44  (SEQ ID NO:675)
AGGCAAACCCTACAAAATGTAGCAGAAGCATTTCCGCACACTGGCATCAACATCTAGTTTGTGCAGAAATGTTTCCACTAGATTCATAGAGTGTTCTT
((((.(((.(((..(((.(((..((((((((((.((((-(((...))))))..)))).-)))))).))..))).))))..)))..)))..)))

Mmd_364
mmHP1290061 probe10              1  2  3  4  5  6  7  8  9 10 11 12 13 14 15 16 17 18 19 20 21 22   (SEQ ID NO:676)
CCATGGCTGCTGCTGTAGCAGAAGGGTTGAGCCAGTCCAGGCTGGAAGGATCTGTCACCCGATCCCAGGTCTGTGCTACAGCCAGTCTTGG
((((((((..(((.....(((..((((((.(((((-((....)))))))...))))))..))).-)))))))))))))))).)))

Mmd_365
cand682 probe37                  23 24 25 26 27 28 29 30 31 32 33 34 35 36 37 38 39 40 41 42 43 44  (SEQ ID NO:677)
GGAAGGATATCTGAGGACTGGATGTGTTCATGTTTTACACCAAATGCTTTCAACATGAGAATCCGCCCAGTCGTATCTAATAAAAATATCCTTCC
(((((((((((...(((((((((.(-((((((((((.....))))))))-)).))))).))..))))))))))))))))

Mmd_366
cand390 probe17                  1  2  3  4  5  6  7  8  9 10 11 12 13 14 15 16 17 18 19 20 21 22   (SEQ ID NO:678)
GTCACCTCTTCAAGGTGTTTGGGATTCGCTTTGATATCCTTGTGGATGGCAAGGTAAGTGTCCTATGTGAAGGGATGGC
(((((((((((((.....((((((..(((((((.((((((.....))))).-))))))).))))))..))))))))))))

Mmd_367
cand558 probe1                   1  2  3  4  5  6  7  8  9 10 11 12 13 14 15 16 17 18 19 20 21 22   (SEQ ID NO:679)
CACACGTTGGCACTGGAAATTTTATTTGAATCAGGGAAGAATATTATTTGCGATATTTCCTAAATGACAAATGAATGATTTACCGGCAGCAATGTG
((((.....((((((((((((((((((....((((((.((((((....)))))))))))...))))))))).))))..))..))).))))

Mmd_368
mmHP2416251 probe5               1  2  3  4  5  6  7  8  9 10 11 12 13 14 15 16 17 18 19 20 21 22   (SEQ ID NO:680)
CCCGCATTGCTCCAGTGGACAGTGGTGCGCACCCACTTCAAGATACACTGGGCTAGTGTCAGTCTCCAAGGAGCCGTGCGG
(((((((((((....((((((((((....((...)).))))))))))....))))).)))))).))))

Mmd_369
cand399 probe3                   1  2  3  4  5  6  7  8  9 10 11 12 13 14 15 16 17 18 19 20 21 22   (SEQ ID NO:681)
TGAGACGTTTCTGCTCTCGCTGTGGTTATGTGTCTGACTGTTTCTCTACAAGGGTGAGACAAAGCAATTTCACAGTTATCAGAAGCGTTATCA
.(((((((((((.....((((((....((((((((((((......)))))))))))).......))))))...))))))))))).

Mmd_370
cand548 probe16                  1  2  3  4  5  6  7  8  9 10 11 12 13 14 15 16 17 18 19 20 21 22   (SEQ ID NO:683)
ATGCCATGCAAATTGGCACGAAGGCAATCAGTCTGACTCTGAAGGCTGCCCCACCGGCCGCAGGCTGGCTCATTGTCTTTTCTGTCAATTTGCATCTCAT
(((...((((((((...((((((((...(.(.((((...((((((.....)))))..))))...))).))))))))..))))))))))))).))

Mmd_371
cand854 probe3                   1  2  3  4  5  6  7  8  9 10 11 12 13 14 15 16 17 18 19 20 21 22   (SEQ ID NO:684)
AGAAGGCTGCCAGGTGCTGGTGGAAATAGAGCCGAAGAGGCTGCAGAGCAGCTGGCAGGCAGCTGTCCACCAGTGATGTAAGCCAGCATGCCTCT
((((((((...(((.((((((((....(((...(((......)))...)))))))))))...))).))))))).

Mmd_372
cand181 probe20                  1  2  3  4  5  6  7  8  9 10 11 12 13 14 15 16 17 18 19 20 21 22   (SEQ ID NO:685)
GTCCCCGTTGTCTGCGTCCTTGCCTGTCTCTTCCCTGCCCAGTGGCCTCCTTGTCCGGCTCACTGGCAGGAGCCCTAATCGGATTGGACAGCTGAGAT
(((.(.((((((((.(((.......((((((.....((((((......))))).))))))).........)))))))))))).).)))
```

FIG 2 Con't.

```
Mmd_374                     1  2  3  4  5  6  7  8  9 10 11 12 13 14 15 16 17 18 19 20 21 22   (SEQ ID NO:687)
cand273 probe11
GGCAGTCGTCACCTTTCTTCCGGGCACTGGCCAAGCCAAAGTCAGTGATGATGATCTTGGAGTCAGTGCCTGGGTGGTAGTAAAGGAGATTCTCAGGCT
((((...((((..(((((((((((((((....(((...(((......))).))))).))))))))))))))).........)).))))).))......)))

Mmd_375                     1  2  3  4  5  6  7  8  9 10 11 12 13 14 15 16 17 18 19 20 21 22   (SEQ ID NO:688)
cand580 probe18
AAAAGCTTGGCGTAATTATCTCTGAACAGGTTGACCGCAAGGTCTCTGCAAAATCTGCTCAGGGTGATTATTTTGCTGGGGTTTT
((((-((...((((.(((((.(((((((.(-....).))......))))))))-))))).-))))..)).))))

Mmd_376                     1  2  3  4  5  6  7  8  9 10 11 12 13 14 15 16 17 18 19 20 21 22   (SEQ ID NO:689)
cand294 probe16
GTTATCAGGAAATAATCATAGCCCTCGGGTGCTGGGAGACACTGGGTGTAGCTAAGTGTCTCTAATTCCCCAAGGGTATGATTAGCTCACGTTAAC
(((-(....(((((..(((....(((((((((-(((....))).)))))))).....))).)))))...))))).)..).)

Mmd_377                     1  2  3  4  5  6  7  8  9 10 11 12 13 14 15 16 17 18 19 20 21 22   (SEQ ID NO:690)
mmHP1218232 probe16
ACTCGGGAAGCAGCATTCAGGTCTCTGGGTCCTGGATGTCCTTGGTGCACACTCCAAGGACTCCTCGTCCTTAAGTTCATAGTCTGTATTCCCTGAGT
(((((((((((((..(((...(((..(((((.((((((.......)))))))....).))).))..))))))))...).)))..).)))))))).))

Mmd_378                     1  2  3  4  5  6  7  8  9 10 11 12 13 14 15 16 17 18 19 20 21 22   (SEQ ID NO:691)
cand136 probe8
CGAACACCCAAAATAATGTGAGATCAGGCTCATGCGTTATGCATGAGGTCTGATTTAACATGAACATTATTTCTTGTGTACG
((-(((((...(((.(((((((((((((.....))))).))))))))))))))....)))))))...))))))))..)

Mmd_379                     1  2  3  4  5  6  7  8  9 10 11 12 13 14 15 16 17 18 19 20 21 22   (SEQ ID NO:692)
cand70 probe16
CATTCCAAGCCACTCTCTGATTTGCTGTGAGTGGCAGAATCATTCACCGTNNTGAATCACAGAGAGNGAGCCATGTGGAGTG
(((((((((((((((((...((((....((((((.......))))..)).))))..))))).))))))))))))))))

Mmd_382                     1  2  3  4  5  6  7  8  9 10 11 12 13 14 15 16 17 18 19 20 21 22   (SEQ ID NO:696)
mmHP1665736 probe7
CGGGANGAGCTCAGTGAAGGACTCAATGACGTTGAAGTTGCACAGGGGGCTGACTTCAAAGAAGGTCATGCAGTTCTTCTCTGCATAGGCTCTGGCCTG
((((((((((((((((((((((..((((((((((((....))))))))).))))))))..))))))))))))))))))))))

Mmd_383                     1  2  3  4  5  6  7  8  9 10 11 12 13 14 15 16 17 18 19 20 21 22   (SEQ ID NO:697)
cand875 probe1
TTCACCTGGCGCACTGGGCAGGAAGACTTTATTCAGATCCAAGGAGGAGGCTCTGGAATGGGTTTTCTCTGGCCGTGGTGGTGGGGTGGG
-((((-((-(((((((((((((((((..-(((((((((-.......))-)))))))))....)))))))))...))-)))))))))-))))))).

Mmd_384                     1  2  3  4  5  6  7  8  9 10 11 12 13 14 15 16 17 18 19 20 21 22   (SEQ ID NO:698)
mmHP2197503 probe16
CATCTGGAATTCTATTGCTCAATGGGAGGCTGATGGGGGAGCTGATCTGGAAAGAGCCTCCAAAAAGAAATAATGAGTTCCAGATG
((((((((((((-((((..((((((((((-((....)).))......)))))))...).)))..))))))))))

Mmd_387                     1  2  3  4  5  6  7  8  9 10 11 12 13 14 15 16 17 18 19 20 21 22   (SEQ ID NO:700)
cand265 probe16
CAACTAGAGAGACCCGGTTGCTTGGGTGGATCCAGACAAAGGTGGATTTCCATCCCTGGATTTTGTGCCCACGCCTCTGGGTCACCCTGTCTCCCTTG
......((((((((((((..((-((((((((((......(((((((((((......))))).))))).)))..)).))))).)))))))).......))))))

Mmd_388                    23 24 25 26 27 28 29 30 31 32 33 34 35 36 37 38 39 40 41 42 43 44   (SEQ ID NO:701)
cand635 probe43
AGGGTGCGTATTACAGACGAACAATGATATGCCTTGCCAGTAATGGCACTCAGTCAAAACTACCACGGGCATGTCATTAGGTCATAATACCCACCCT
-..(((....((((.(((((((((((((..((((...((((......)))).....))))..)))..))))))))))).))))

Mmd_390                     1  2  3  4  5  6  7  8  9 10 11 12 13 14 15 16 17 18 19 20 21 22   (SEQ ID NO:703)
mmHP3025219 probe1
TCTACTAGGAATGGGATACATTCACAGGTGTGGTTGTTGGAGACATGCTGCGCAAAGCTGTGAGTTAAAATCTGATTTCTCTCCTAGGGGA
(((..(((((((..(((((((((((((..(((...((......).))..)))...))).))))))))..))))))))..))
```

FIG 2 Con't.

```
Mmd_393
cand12 probe10                1  2  3  4  5  6  7  8  9 10 11 12 13 14 15 16 17 18 19 20 21 22      (SEQ ID NO:706)
CTCTCCATATGCTGTGGCATCTGTAACTGGCATGTAAGGGACTCATTTTCCTCACATATCTCATTAAAGATGCAAAGCAAAATGGAGGG
((((((((-(((((((-((((((((((((-(((((((((((-(-((((((-.....))))))-..))))))..))))))))).))))))))

Mmd_394
mmHP2549249 probe8            1  2  3  4  5  6  7  8  9 10 11 12 13 14 15 16 17 18 19 20 21 22      (SEQ ID NO:707)
ATTTACTATTTTAGTGCTGGATCCAGTTGCAGCTGAAACATTTCAACCAGGCTGCGGAGTTGGGCGCAGCTGTGTGATGGTCAGT
....(((((((-((((-((((((-((((((((((.......)))))))))))..))))))))))..)))-))))))))....

Mmd_396
cand187 probe38              23 24 25 26 27 28 29 30 31 32 33 34 35 36 37 38 39 40 41 42 43 44      (SEQ ID NO:709)
TACAGGACGTCTGTGCAATTCGATGGAGCTCATCACTTTCCGGTCTATGAGCAATTAAATTGCACCAGGAAGCCCTGTA
((((((-(-(((((((((((((-((((-(((((((((.....))))).)))).))))-)-))))))))))).-)))).-.)))))))

Mmd_398
cand361 probe11               1  2  3  4  5  6  7  8  9 10 11 12 13 14 15 16 17 18 19 20 21 22      (SEQ ID NO:711)
TGCTTGATTAGTCAGATTGATGGAGGAGGCCATATGTGGCCGTGTCAAAACTTGGCTACCAGGCTCCTTTCCTCTCTCTGAAGGACAGGCA
.(((((-(((-((..((((-(((((-(((((-(((((....))))).....))))))))-)))))-))))...))))))-.

Mmd_399
cand694 probe2                1  2  3  4  5  6  7  8  9 10 11 12 13 14 15 16 17 18 19 20 21 22      (SEQ ID NO:712)
GCTCACCCTGGAGGGCCACAGATGCTGATGGAAGCCGGCATCCATGCTACTGTGGACTACAGCATCATCAGTGGCAATCGGGGCCGAGT
((((((((-(-((((((((((((-((((((((((((.....)))))).))))))).))))))))...)))))))))

Mmd_400
cand516 probe21               1  2  3  4  5  6  7  8  9 10 11 12 13 14 15 16 17 18 19 20 21 22      (SEQ ID NO:715)
TCATGCCGAGCGAAAAAGCCCCTGACGTCACCTGCAGCCAATCAGAGTGAGCCGCTCGGKGGCAGKGTGSCGTCAGCGGAGCGGGCCGCTGGGTGCGG
-(((((((-((((((....(((((((((((((-(((...(-(((((....)))))..))).))).))-)).))-...)))))-))))-.

Mmd_403
cand978 probe3                1  2  3  4  5  6  7  8  9 10 11 12 13 14 15 16 17 18 19 20 21 22      (SEQ ID NO:718)
AACGGAGGGTATGGTGAGGATGGTGGTCTTGGACGCGGACATTTATCCAACAGAATGCTACTATTAGACAAGGCCGTTTTTACCTAGATTCCTTT
(((((((..-(((((((((((((-(((((...((-((-(((((........)))))-))..)))...)))))..))))))))))))..)))))))

Mmd_404
mmHP1595839 probe41          23 24 25 26 27 28 29 30 31 32 33 34 35 36 37 38 39 40 41 42 43 44      (SEQ ID NO:719)
CTTGACATGTCCCTTTAACGTTAGAGGCATTTGCTGATGCCACTAACTTATGGGTCAATGTGGTCAAG
(((((-((-((((((((-(((((((-((((((((....))))))).))))))))).))).-......))))))

Mmd_406
cand484 probe5                1  2  3  4  5  6  7  8  9 10 11 12 13 14 15 16 17 18 19 20 21 22      (SEQ ID NO:721)
CCTTATCATAGAGTTTACTGAAGTGGGGCCAGTTCCCCGCCTCTTCCAGCTTTGCTGCCAAAGTTGGAGAGGGGTGGAGTGGCCTGAAGACTGTTGGG
.....(((((-.(((((-((((((-((((((....))))))-)))))).)))))..-)))))

Mmd_407
cand703 probe4                1  2  3  4  5  6  7  8  9 10 11 12 13 14 15 16 17 18 19 20 21 22      (SEQ ID NO:722)
GATGATGAGCTGTCCTTTCCCGAGGGAGCAATTATTCGCATCTTGAACAAAGAAAACCAAGATGATGATGGCTTCTGGGAAGGGGAGTTCAGTGGTC
(((((-(((((((((-(((((((-((((((-....(((((-((-(((((((-.....))))))))-)))))-)))))))-))))))-.-.)))

Mmd_408
cand547 probe13               1  2  3  4  5  6  7  8  9 10 11 12 13 14 15 16 17 18 19 20 21 22      (SEQ ID NO:723)
GAGAAATCAGCTTTAATTAATTTGAGTGCCAGCTCTGTGTATAATTACCCAGCATGAGAATTTGCATGCAAATGCCGGAAATGCTGATTCTT
(((((-(((((-........((((-((((-((((((.............))))).-)))-)))))........))))))))))

Mmd_409
cand292 probe2                1  2  3  4  5  6  7  8  9 10 11 12 13 14 15 16 17 18 19 20 21 22      (SEQ ID NO:724)
CCATCAGTCAGGAAAATTGTATGATAAATAGGAGGTAGCCAGGTTTAGTGGCACTTCCTTCTGCTTCAGCAGTTTTTGCCTGACTTTGG
(((.-(((((((((((-(((((.....((((((.......))))))))).......))))))))).-.....)))))))).)))
```

FIG 2 Con't.

Mmd_411
cand257 probe3                    1  2  3  4  5  6  7  8  9 10 11 12 13 14 15 16 17 18 19 20 21 22     (SEQ ID NO:727)
CTTCTTGTATAAGCACTGTGCTAAAATTGCAGGAACTAAGATTCTATCTTGCTTTTTGTAATAATGCTAGCAGAGTACACACAAGAAG
(((((((...((((.(((((...(((((((((((((((((...))))))))))))))))...))))).))).).)).)))))))

Mmd_412
mmHP453167 probe8                 1  2  3  4  5  6  7  8  9 10 11 12 13 14 15 16 17 18 19 20 21 22     (SEQ ID NO:728)
CCACCAGTTAGCAGCAGGCTGTGGATTAGGAGTGGCAGAAAGGATGTCTTTAAATAGGTTTCCGTTTCTGTTTGTTTGGTTTGAGGCTTGGTGATGGAGG
((-(((....((-(((((((...(((((((((((((((((((((((...)))..))))))))))))..)))))))))...))-)))

Mmd_413
cand718 probe33                  23 24 25 26 27 28 29 30 31 32 33 34 35 36 37 38 39 40 41 42 43 44     (SEQ ID NO:729)
GCAGGCGTTTCCTGGGGATTAATGACCAGCTGGGAAGAACCAGTGCCCTCGGCTCTGCCTCCCAGCCAGCCATTAACTCCAAGGAAATGTCTTTTGC
..((((((((((((.(.((((((..(...((.((((...))))))...))..)).)))))))).)).)))))))).....

Mmd_416
cand8 probe3                      1  2  3  4  5  6  7  8  9 10 11 12 13 14 15 16 17 18 19 20 21 22     (SEQ ID NO:732)
TGGGGGAGGCGGGCTGTGCTGGTGCCCGGTGTATAATCGGGTTAATCCAGTAGACAAAGAATAAACCAATAACCCTCCCA
.(((((.(((.((.((((((((.(((((....))))).....)))))))).))).)))))).

Mmd_417
cand193 probe30                  23 24 25 26 27 28 29 30 31 32 33 34 35 36 37 38 39 40 41 42 43 44     (SEQ ID NO:733)
CTATCGAATTTGTGGCTTTTGCTAGCTTTGCAGAAAGGGACTTTTAAAAATACTTCTCTTGATAGTGTAAAACTAGCGAAAGCCACAAATGGAATGG
((((-((((((((((((((((-((((((.(((((-(.....))-)))))...))))))..)))))))))))))))...)))

Mmd_418
cand425 probe43                  23 24 25 26 27 28 29 30 31 32 33 34 35 36 37 38 39 40 41 42 43 44     (SEQ ID NO:734)
CACTAGTTCTCCTCCCATCCCCCTACCCCAAACTTCTCTACTCTGGTTTACCAGCACCAACAACCACGTGGGGGAGGGGTAAGAGAGTAGAACCGGTG
(((-.((((((-(((((....((((((.(((((...((((((....)))))).))))).))))))...)))))).)))))...((-))))..)))

Mmd_419
mmHP683 probe18                   1  2  3  4  5  6  7  8  9 10 11 12 13 14 15 16 17 18 19 20 21 22     (SEQ ID NO:735)
CAGCCTTTTCTTGGTGTGCGAATGTGAGTGTGTGTAATGATGTTATCTATATGCCGTCGGCGCACCTGCACATTTGCATATTGGGGAAGAACTG
(((...((((...(((((((((((.(((-(((((((...)))..)))))-.))))).))))))))))))...)))))).)))

Mmd_422
cand196 probe33                  23 24 25 26 27 28 29 30 31 32 33 34 35 36 37 38 39 40 41 42 43 44     (SEQ ID NO:739)
CCCATTTCGAGTCATAATCCCCTTTTGTGACATCACAATTAGCCACTTGTGGTGATGATTATAATGTCACAAACGCAGGATTAGGACAAGGAATGCG
((((((((-.(((-(((((.(.(((((((((.(((((((((...(....)..)))))).))))))))...))).)))))).))...)))))))

Mmd_423
cand408 probe22                   1  2  3  4  5  6  7  8  9 10 11 12 13 14 15 16 17 18 19 20 21 22     (SEQ ID NO:740)
CAGTGTAAACCCATGCTGGCTGCAGCAATGAGGGCCTGCTGGATGGCGTGGCTCTTCTTAAACACTCCTTGCTGCTGGCCAGCCATTGTCCAGTCACACTG
((((((.((.-(((((((((((((((((((.((((((...))))-.)))...)))))))))...)))).))))).)))

Mmd_424
cand443 probe6                    1  2  3  4  5  6  7  8  9 10 11 12 13 14 15 16 17 18 19 20 21 22     (SEQ ID NO:741)
GTCCCGAGAGTTGCTGATACAAGCTCTACAAGCCATTGAGCTGGAGTGGGAACCCCCAGCTTTCAATGCTGGTGGGGAAATTATGGGGCTACTTTGTTGAT
......(((((.(((.(((...((((((.((((((((((((.(.(....).))))))))))....))))))...)))))...))).)))......

Mmd_426
cand427 probe13                   1  2  3  4  5  6  7  8  9 10 11 12 13 14 15 16 17 18 19 20 21 22     (SEQ ID NO:743)
GCCTGTTGACATGTCCAGACACTACTCCAGCAGAGGCACTGGGCCTGGCAAGAGGCCAGGCCTGAGTCACAGCTGCTGGATATCAACGTGGC
(((((((((((((((((((.........((((.(.(.((.)).)-.))))...))))))))))).))).)))))..)))

Mmd_427
mmHP1499491 probe4                1  2  3  4  5  6  7  8  9 10 11 12 13 14 15 16 17 18 19 20 21 22     (SEQ ID NO:744)
CTGGACGTGTTAGTGGAGGCCTTAAGGCCTGTGGGCACCTTTAAGAAAATCGGAAAGGTGTTCCGCAAGGAAGAGGACTCCACGGTGGGGATGCTGCAG
((((.(((((.((.(((((((((((((((((((((.(.(-....).).)))....))))))))))....)))))))...))).))))

FIG 2 Com't.

```
Mmd_429
cand685 probe7                          1  2  3  4  5  6  7  8  9  10 11 12 13 14 15 16 17 18 19 20 21 22   (SEQ ID NO:746)
GTTTTACAGCTCAGAGGGGATTAGGACAAGAGATGTCTTTAAAATACGATGTGTCTCTCTCTCTGCAGCTGATGGAGC
((((((((((((((((((((((((((((((((((((.....))))))))..)))))..))))).)).))))))))).....

Mmd_430
cand607 probe6                          1  2  3  4  5  6  7  8  9  10 11 12 13 14 15 16 17 18 19 20 21 22   (SEQ ID NO:748)
TGGAAGACCATCGTGCAGGACTACATTTGTTCTCCCCATGCAGAGAGCATGAGGAAGAGAAACCAGATTGTGTTCACGATGGTGGAGGCCG
.((...(((((((((..((..(((((((((((((((.....)))))...))))...)))))).)).)))))))))))....))..

Mmd_431
mmHP2175366 probe12                     1  2  3  4  5  6  7  8  9  10 11 12 13 14 15 16 17 18 19 20 21 22   (SEQ ID NO:749)
GCTGGTTTTGGCACTTCTCTCACTCTAGTGAGTTGCAAAAAAACAAGCAGGTGCTAGCAAATCTGAGAGACCACATGCCAGCTCCAGC
(((((...(((((...(((((((.....(((((((.....))))))).....)))))))...))))).....)))))

Mmd_432
cand134 probe34                         23 24 25 26 27 28 29 30 31 32 33 34 35 36 37 38 39 40 41 42 43 44   (SEQ ID NO:750)
CTGAGCCAGCTGAGGCCATGCTGTCTGGCTCAATGAGGCCCTCAGGAACAGAGGAGCCAAAGCCACGGGACAGGGCCTCAGATGCCGATTTCAG
((((((((((.(((((((((((...((((((((((......)))).)))-)))..))))))))))))))))...)))))

Mmd_433
cand192 probe4                          1  2  3  4  5  6  7  8  9  10 11 12 13 14 15 16 17 18 19 20 21 22   (SEQ ID NO:751)
GTTGGTGCCCTGATAAAGCCGGAGCCCTGGCAGATAAATGCTGAGGTGGAGCCAAGCCATTTATTTGAGGAGCAGCAGCGGCTCCTATCAGGGGCCGGC
((((((((((((((((((((((((((.((((...((((.(((......)))))))...))))))))))))))))))))))))))))))

Mmd_434
mmHP2810075 probe14                     1  2  3  4  5  6  7  8  9  10 11 12 13 14 15 16 17 18 19 20 21 22   (SEQ ID NO:752)
GACAAGATAGGGTCCTTAAAATAAACTCTCTGGTTTCCTTCCCTTCCTTTATCTAAGGGGAGGCTAAAGTGGGGTTTGCACAAAGGGCTCTTCGTGTT
((((-((.((((((((((.....((((((((((((((......))))))))))...)).)))))).....)))))))))-))))

Mmd_435
cand126 probe11                         1  2  3  4  5  6  7  8  9  10 11 12 13 14 15 16 17 18 19 20 21 22   (SEQ ID NO:753)
TTTGTGTGTATAAAATGGGTAATTGCACACACAAATGAACAATTTTGTATGCAATTATCCATTTTGCATACAGA
((((((((((....((((((((((.....(((.((((.....)))))))...)))))))))))))))))))

Mmd_436
cand544 probe10                         1  2  3  4  5  6  7  8  9  10 11 12 13 14 15 16 17 18 19 20 21 22   (SEQ ID NO:754)
CAGGGTATCCACCAAGGACATGCCCCTGGCACTGATGGCCTGTGCCCTCCGAAAAAGGCCACAGTGTTCCGGCAGCCTCTGGTGGAGCAGCCTG
((((((.(((((((((((...(((((((((((((.....)))))))))))).....)))))))))...)))))).

Mmd_438
cand957 probe5                          1  2  3  4  5  6  7  8  9  10 11 12 13 14 15 16 17 18 19 20 21 22   (SEQ ID NO:756)
GTTGTTCTTAAATCACCTTGAAGTGTCTCTTGTCAAAGATAACTCCCTGCATTGTAGAAAACGTCTTTGACAAGAGAGGATTAGGGTGAAATTGCAAT
((((((.....)))))))(((((((((((((-((((.....))))...))))))))..).)))))

Mmd_439
cand165 probe14                         1  2  3  4  5  6  7  8  9  10 11 12 13 14 15 16 17 18 19 20 21 22   (SEQ ID NO:302)
TCTAGGGAGCCACCAGTGGTGTAAGTGCTTTGGCTAAGTGATGGAGACAACTGAGGAGGAGTGTGATTACCACTGGGTTCCTGAATGGA
((((((((((((...((.(((....(((((((.....)))))..))..))))))...)))))))))..)))

Mmd_442
mmHP1626774 probe9                      1  2  3  4  5  6  7  8  9  10 11 12 13 14 15 16 17 18 19 20 21 22   (SEQ ID NO:760)
CAGCAGAGGTAAGCCTGTGAGACTAACAGCTTTAGCCGCAGGATTCATCTTTCCTTCTTGACTGTGGTTTACAGAGTGCTTTACCTCCAGCTG
((((.((((((((((.((((((((.((((..((((.......)))).)))))).)))))))..)))))))))))..))))

Mmd_443
cand73 probe10                          1  2  3  4  5  6  7  8  9  10 11 12 13 14 15 16 17 18 19 20 21 22   (SEQ ID NO:761)
CAGAGATGGGATTCACATGAACCACAGCTGAGTTCACAGAGATGATTTGTGAGCCTCAGTATTTGCACATATGTGGTCATGCGGGACCTCTCTG
((((((.((..((((.(((((((((((.....)))))))).)))))............))))))))..))))))))
```

FIG 2 Cont.

```
Mmd_445                    23 24 25 26 27 28 29 30 31 32 33 34 35 36 37 38 39 40 41 42 43 44   (SEQ ID NO:763)
cand761 probe23
GAACCCAGGGCTTCTTAAGGGAACTACAACTCCCAGTGTACATGCAAAGCAGCTGTGATGCACACTGGGAGTTGTAGTCCTTGAGCTCTCAGTTT
((((..(((((((....((((.(((((((((((((((..(((((((......)))),))..)))))))))))))))))))))))..))))

Mmd_446                     1  2  3  4  5  6  7  8  9 10 11 12 13 14 15 16 17 18 19 20 21 22   (SEQ ID NO:764)
cand843a probe19
TTCCACCTGAAGCCTAATCCCTGCTTTGCTACAACACAATTGGTTGCGGTGGAAATGATTATGTTGTCACAAACAGAGGATTAGAACTTCGGGTGGAGA
..(((((((((((..((((((..(((((..((((((..(.....(...)..))))))..)))))..)))))))..)))))))))))...

Mmd_447                    23 24 25 26 27 28 29 30 31 32 33 34 35 36 37 38 39 40 41 42 43 44   (SEQ ID NO:765)
cand327 probe37
TCAAAATAATGCTGCTAATTACCTCTGATCTCCTTTAATGGGAAGCTGCTCCCAACTCCACAAAGGAGTAAATGAGAGGTCCACAGCACAGACCCAGGA
..........(((((((((((...((((((((((((...(((((((......))))))).....)))))))))))).))))))))))).

Mmd_449                     1  2  3  4  5  6  7  8  9 10 11 12 13 14 15 16 17 18 19 20 21 22   (SEQ ID NO:767)
mmHP693133 probe7
GGCTTCTGAGTCTGATGCCCTCAATACCTTGAGGGACATGATCATCAGTAGCCCAATGTCCCTCTTGATGGCAACTTAGACATAGTCAGAATAGCT
(((((((((((((((((((.(((......(((((((((.............))))))))).))).(((..))))))..)))))..))))

Mmd_450                     1  2  3  4  5  6  7  8  9 10 11 12 13 14 15 16 17 18 19 20 21 22   (SEQ ID NO:769)
cand636 probe8
GCAGCTGGAAAGGGCTTAGCCCTTTAATGCCAGCAGCTGTATCTCCAATGTGGCTGCTCTGCTGAGGGGCTGGATGCTATCCAGAAGC
(((..(((((((..((((((((((...(((((((((...(((((......))))))))))))))..))))))))).))))))).))

Mmd_452                     1  2  3  4  5  6  7  8  9 10 11 12 13 14 15 16 17 18 19 20 21 22   (SEQ ID NO:771)
cand167 probe11
GGATTATAATAAATTAAATGCCTAAACTGGCAGAGTGCAAACAATTTTGACTCAGATCTAAATGTTTGCACTGGCTGTTTAAACATTTAATTTGTTCC
..........(((((((((((..(((((((-((((((..(((((((......))))))).....)))))))))))))..)))))))))..

Mmd_453                     1  2  3  4  5  6  7  8  9 10 11 12 13 14 15 16 17 18 19 20 21 22   (SEQ ID NO:772)
mmHP1778980 probe5
GGTGGAGGTGGGTGGGCTGCCTCCCAATCCTGGCTCAGGCAGGGTGGCCTCTGATCTGGGCTCCGGAGTTGGGAAAGGGAGCTGACCCATGGAAGACACC
((((....(((((..((((((((((((((((..(((((((((((....))))..)))))))).))))..))))))..))))....))))

Mmd_454                     1  2  3  4  5  6  7  8  9 10 11 12 13 14 15 16 17 18 19 20 21 22   (SEQ ID NO:773)
mmHP3397717 probe17
GATATATACATTCTATTGTCCCTAGAAGGTGTATTCCTTCAGGGACAATGTGTTGGCTGTGAGTC
(((.(((((((..(((((((((((.....))))))))))))))...)..))))))).)))

Mmd_455                     1  2  3  4  5  6  7  8  9 10 11 12 13 14 15 16 17 18 19 20 21 22   (SEQ ID NO:774)
cand190 probe12
GTCTTTGTCGTGGTGTCAGAAGATTAATTACACTCATGTGAGAACAACTTTCTCATTGGGTGAAAAGAGACATTATCCTTCTGACTGTGATAGCGAC
(((((..((((((..(((((..((((((....))))))....)))))..))))))..))..)))..)).)))))))).))

Mmd_456                     1  2  3  4  5  6  7  8  9 10 11 12 13 14 15 16 17 18 19 20 21 22   (SEQ ID NO:775)
cand239 probe7
GCATGCAGCTTTGGAGACGCCAAGGGGAAAATGGATTTAATTGATTCGTTACCTTTGGTATTGTAATGCCTGCTGCGATGT
((((((((...(((..((((((....(((((((......))))))).))..))))))..)))..))))))))

Mmd_457                     1  2  3  4  5  6  7  8  9 10 11 12 13 14 15 16 17 18 19 20 21 22   (SEQ ID NO:776)
mmHP2347 probe4
TGCCTTAGCTAGTTAAACCGGAAGCCTATGGTAATCAGAGAGAGGCACTTCTTGCCTTCTCCTATGCTTTCTTCATTAGCAGAGGTA
(((((.(((((......(((((((...((((.....))))....)))))))..))))))..)))))))

Mmd_459                    23 24 25 26 27 28 29 30 31 32 33 34 35 36 37 38 39 40 41 42 43 44   (SEQ ID NO:778)
cand881 probe30
GACCAGCTCACGGGAAGTGGCCCTTCAATAGTCCGATAGCTTCCTGTATCCTGACATTGTGAAGGCCCACTTCCTGCTCTGTC
..(((..(((((((((((((...(((.((((....))))))))))))))...))))....)))))
```

FIG 2 Con't.

```
Mmd_462
mmHP1121223 probe5                1  2  3  4  5  6  7  8  9 10 11 12 13 14 15 16 17 18 19 20 21 22   (SEQ ID NO:782)
AGAGGCTTGGAGCTCGAGGCTAATTGTGAATTAGGAGCCCAAATTATGCCCTGCACAATTGGCTCCACGCTACCTTCTCT
(((((((...((((((...((((((((((((((((....))))))))))))...))))))...))))))...))))))

Mmd_464
cand688 probe8                    1  2  3  4  5  6  7  8  9 10 11 12 13 14 15 16 17 18 19 20 21 22   (SEQ ID NO:783)
TTAGGCAGCTGGAGAAAACAATGGGCCAGATTCTCACTCTGTGTAATCACAGAGGACGACTCCATTGTATAGCCCATTGTTTCTCCCATGTACTGCCTGA
(((((((...(((((((.(((((((((((.(((((....))))))))))...))))))))))...))..)))))).))

Mmd_465
cand449 probe19                   1  2  3  4  5  6  7  8  9 10 11 12 13 14 15 16 17 18 19 20 21 22   (SEQ ID NO:784)
CCGTGTGAGTTTGCGCTGCAAAGCTCCTTGGCATCCTTGCATGGGTTGGGTGTTGGGGAGCTCAAATTGCAGCTACAACTGGCTGG
(((((((...(((((((.((((((((((....))))))))))...))))))...))))))

Mmd_466
cand438 probe6                    1  2  3  4  5  6  7  8  9 10 11 12 13 14 15 16 17 18 19 20 21 22   (SEQ ID NO:785)
GTGTTTATTTGAATGTGTGATGAGGAGGTCATCAAAATGAACACGCTCGTTGTGTTTATTTGAATCTCACATCGCTCATGAGAGAATACACGC
((((((-((((...(((-.(((((((((((....))))))))))...)))))....)))))))

Mmd_468
cand58 probe19                    1  2  3  4  5  6  7  8  9 10 11 12 13 14 15 16 17 18 19 20 21 22   (SEQ ID NO:786)
CCGCGGAGTCTCTAACTGGCGACAGATGGGCCACTTTCTTCTGGCCACAAGGGGCCGGAATGGAGCGCTCCGCGG
(((((((((((((-(((((((...((((((....))))))...)))-))..)))))))))))

Mmd_471
cand428 probe21                   1  2  3  4  5  6  7  8  9 10 11 12 13 14 15 16 17 18 19 20 21 22   (SEQ ID NO:790)
AAAATTTTTGTAGGTGGACTGGGAAAGCAGCGGATTGCAGATGCGTTTAACAGCAGGGTATTTTCCGCTGCCATGACCAGTTAAGGGAGATTTT
(((((((((.((.((((((((.((((((((....))))))))...)))))))...)))))))).)))))))

Mmd_472
cand141 probe6                    1  2  3  4  5  6  7  8  9 10 11 12 13 14 15 16 17 18 19 20 21 22   (SEQ ID NO:791)
GGGCCCTCTGTGTGGCTGCTGCTGGCTCAGACCCCAGCCCACCTTGGGCGGTGGGTTTGGGTTTTGGCTGGCACATTCACCAAGGGGCC
(((((((...((.((((((...((((((.(((....)))))))))...)))))))...))))))).))))

Mmd_474
cand55 probe43                   23 24 25 26 27 28 29 30 31 32 33 34 35 36 37 38 39 40 41 42 43 44   (SEQ ID NO:792)
GAAGTCAGACTTGCCTCCGCAACTGCATCACAGCTACATCTTTGGAGCTGTTGAAATCCAGCTGACGGAGGAATCCGTCCTTT
....(((((-..((((((..(((((((((((-....)))))))))...))))...))))))....)))).....

Mmd_475
cand411 probe13                   1  2  3  4  5  6  7  8  9 10 11 12 13 14 15 16 17 18 19 20 21 22   (SEQ ID NO:793)
GAGTTTGCTGGCTCTGAATGGGGTATGAGACTTGTTCTTACCCAAAGCCCTGATCACTCTTTCAGGGCTAGCAGACTT
(((((((((...(((((-.(((((((....))))))....)))))...)))))))))

Mmd_476
cand416 probe11                   1  2  3  4  5  6  7  8  9 10 11 12 13 14 15 16 17 18 19 20 21 22   (SEQ ID NO:794)
CGGCTCTCAGAAATCAGGCTTCCGGAGAGTGTAGTTTGTTTGTAATAATAATACGAATTATTCTCTCAGCCTGAGGTCACTAGGGCGTG
((-(((((..(((-..((((((.((((((((....)))))))))-...))))))...)))..))))..))))

Mmd_477
cand415 probe21                   1  2  3  4  5  6  7  8  9 10 11 12 13 14 15 16 17 18 19 20 21 22   (SEQ ID NO:795)
GTCCAGCAATATTTTAAGCTCCCAGCCAGACAGCTTTTATGAAGGGAGGGATGTTTGGAAAACAATGGGAGAGAGAGAATGGGAGAGCTCTGCTGGCC
((((((((...((((((...(((((((((((((....))))))))))...))))))...))))))...))))))

Mmd_478
cand622 probe21                   1  2  3  4  5  6  7  8  9 10 11 12 13 14 15 16 17 18 19 20 21 22   (SEQ ID NO:796)
CTGTCCGGAATATGGTTGGTTGGTCCTGAGCATGTTAGAGGAATTCCTGTTCAGCATGACATGCTCAGAGGCCACTTGGCCAGAGATGAGCTGGGAGG
((((((((-(((-(((((...((((((((....)))))))-...))))))-)...)))...))))...))))))
```

FIG 2 Con't.

```
Mmd_480                                                                              (SEQ ID NO:799)
cand963 probe9       1  2  3  4  5  6  7  8  9 10 11 12 13 14 15 16 17 18 19 20 21 22
GATCACGTCACCATGGCCAACCGGGAGTTGGCATTTAAGGCTGGCGACGTCATCAAAGTCTTGGATGCTTCCAACAAGGATTGGTGGTGGGGCCAGATC
((((..((((.(((((((((.(((....((((((((((((...((((.....))))...))))))))))))....)))))))))..)))))..))))

Mmd_481                                                                              (SEQ ID NO:800)
cand269 probe2       1  2  3  4  5  6  7  8  9 10 11 12 13 14 15 16 17 18 19 20 21 22
GCGGTTTGGAGGGCTGCATTCATTTTGAGTGCTGTTGTAATCAATTTTAGATACAGTATTCCACAATGGATCAGTTTGCATCCAAACCTGC
(((((((((((.-(((((-.(((((((((--(((((((((-.-(((.....))).).-))))))))))))))))-...))))))))))-))

Mmd_482                                                                              (SEQ ID NO:801)
cand486 probe16      1  2  3  4  5  6  7  8  9 10 11 12 13 14 15 16 17 18 19 20 21 22
TCCCTGGAGCCCGCTCCACTGACGGCACCATCTTGGCACAAAAACTAGCCGAGGAGGTGCCCGTGGACGTGGCCTCTTACCTCTACACTGGGGA
.....(.((((((((((.....(((((..((((((....(((.....)))...))))))..)))))....)))))))))).((((.....))))..

Mmd_483                                                                              (SEQ ID NO:802)
cand271 probe10      1  2  3  4  5  6  7  8  9 10 11 12 13 14 15 16 17 18 19 20 21 22
CCAGCTGCCCGGGAAGCTTGGCGGCCAGGCTGAGGAGGAAGCGTCGGCTCTCTTGAAGGTCGGCTGCCAGTGAATCTCAGGCAGCTGG
((((((((..((((((((..((((..(((((...((((((.....))))))..))))).)))).))))))))..))))))))

Mmd_485                                                                              (SEQ ID NO:804)
cand57 probe38                             23 24 25 26 27 28 29 30 31 32 33 34 35 36 37 38 39 40 41 42 43 44
ACTCTTATTTCCTCCACTGCCTGACTTTATTGAATGCCGTGGGGCATATTAATCAGTAAAGCCAAGTAGTGCATGAAATAAAAGT
(((-(((((((....(((((((((.((((((....(((....)))....)))))).)))))))))..))))))).-)))

Mmd_486                                                                              (SEQ ID NO:805)
cand38 probe12       1  2  3  4  5  6  7  8  9 10 11 12 13 14 15 16 17 18 19 20 21 22
GAGCGGTTACATTTGGCAGCATTCCTTGTTAGCATTTGATAAACAATTATTGCCAAATGTTAGCAAGGAAACCTGCCAAATGTTACAGCTC
((((-((-(((((((....((((((...(((-(((.....)))..)))..))))))..))).)))))-.))-.))))

Mmd_487                                                                              (SEQ ID NO:806)
cand780 probe9       1  2  3  4  5  6  7  8  9 10 11 12 13 14 15 16 17 18 19 20 21 22
TGCTGTTGTCCTTGGAGAAATCTGGGCCTGAGACAGAGGAGGGATGTAATTTGAGTGCTCCTTTGTCACAGGTTACCAGGGTGTGCTTGAGGGGACGGTA
((..((((-(((((..(((((..((((((((-.(((((-((((.....))))-))))).)))))))).))))).)))))..))))..))..

Mmd_488                                                                              (SEQ ID NO:807)
cand255 probe13      1  2  3  4  5  6  7  8  9 10 11 12 13 14 15 16 17 18 19 20 21 22
GGAGCAGCCGGCTTCATTTGTGATCCGGGAGCCTGGTGCCAGCAAGACCTGGAATTTCCGGTCTGGTTGGTCTTGGGCCCCGTGGAGCCAGGTTGATACC
((..((((((((((((.....(((-(((....(((((.-(((((.((....)).)))))..))))).)))..)))..)))))))))))..))..

Mmd_489                                                                              (SEQ ID NO:808)
cand604 probe27                            23 24 25 26 27 28 29 30 31 32 33 34 35 36 37 38 39 40 41 42 43 44
GGTGGAGGAGGACTGTTATTTAAAAGGCTTTTAAATGATGTCACTATATATTCTTTTAACATCCTCTAAAAGCCTTTGAAAAAACAGTCTCTACCTCCCT
((((..((((((.((-(((.((((((((...(((((.....))))...))))))))...)))..))).)))))).)).)))))

Mmd_491                                                                              (SEQ ID NO:811)
cand247 probe17      1  2  3  4  5  6  7  8  9 10 11 12 13 14 15 16 17 18 19 20 21 22
TGAGCTGCTTCTTCCTCTCTCCTCTTTTGCACAAAGAGTCTCATGTCTGATATTTAGACATGATGAGCTTTGTGCAAAGTGGAAGCTGGTTTCTTCTCA
.((..((((((((((...((((..(((((.....))))).))))...)))))))).))..))..

Mmd_492                                                                              (SEQ ID NO:812)
cand243 probe7       1  2  3  4  5  6  7  8  9 10 11 12 13 14 15 16 17 18 19 20 21 22
AAGGATTTGGCATTTCAATCGATGGGAAATGATGTGTGATCATTCTAAATTTATTATACATCATTCCCATCAATGGACGGGTTGAACCCTT
((((.((..(((..((.(((((((((.(((((((((((..(.....).))))))))))))))))))))))..)))..)).))))

Mmd_493                                                                              (SEQ ID NO:813)
mmHP3423784 probe36                        23 24 25 26 27 28 29 30 31 32 33 34 35 36 37 38 39 40 41 42 43 44
CCTAGGTGCCATCAGGAGGGACATCAGGCTGTCGATTGCCCTCGAGTAGCACAGAACAGAGGGACATCACCCCCAAGTGACCTCCAGCTGACCTCCTAGG
((((((.(.(((.(.((((.(((.((((..(((((.....)))))..)))).))).))))).))).)..)))))))
```

FIG 2 Con't.

Mmd_495
mmHP200292 probe14  (SEQ ID NO:815)
TCATTCATTGTCTTTCTTATGTTTCCCAACAGACACTGAGCACATTGAAGAGCTGCAGTGGGTCTGGAGAACATACTTGAACAATCAGAAATGAATGA Mmd_496
mmHP2299700 probe14  (SEQ ID NO:816)
GCTCATTTTTGCCATGTGGAGTCAGTCATTCTGGAGTGGCTGGGGACAGCAGGAAAGCCAGCAGAGTTGGCTGACCCGGATGGTTTCAAGGGC Mmd_497
cand451 probe7  (SEQ ID NO:817)
CTAGACTAGCCTAGACTGGGAAGCCTGGGCTAAGATGCAGTAAACTATTTTCAGTTTATAAACAAGTCCTGACATCCCAGTTTGGGTGTTGG Mmd_498
cand146 probe42  (SEQ ID NO:818)
AGAGTGTTCCAGCCCTGAGCCACCCTCCCAGGAGCCCCACAGATCCAGTCTTGACTGTCCCAATGGGGCAGGGAGGAAAGGTGGCCGCTGGGATTTTTT Mmd_499
cand836 probe2  (SEQ ID NO:819)
CTCGAAAAGGTCACACATGTAATGAATTGTGGGTGCTTGCCTGGCTTCCCAGGCGAGAACCGTAAGCAATTATTAAATGCCATTGTGTGTCAGGAAGGG Mmd_500
cand322 probe32  (SEQ ID NO:822)
GACATTCCCAACATTTTATGGCAATTTGTTTCATTTGCGCAGGCCCATAACGATGCAAATTGCCATAAAGTGGGATAATC Mmd_501
cand7 probe8  (SEQ ID NO:823)
TAATGGTCAGATAATGGATGACAATAAAAGTTATGGGTCCCTAGCTGGGGTGTAGCTCATAATGGTTGGCAAGATCCATTATTAGACCATTA Mmd_503
cand887 probe4  (SEQ ID NO:825)
GGCCAAAAGCTGCCCTCAGCTATGCATGCACAGCTTCCATTGACGTCAGTAAGAACTGTGCTCATGTAACAGGAGGCAGAAATTTGGCT Mmd_505
cand949 probe25  (SEQ ID NO:826)
TCCCATGTGCCTTTAAGGAATCACTCTTGATCTCAGTCATAAAATTGGAAAGCCACACAACTGACAAGATGATCCCCCCAAGCGCAGCTGAAATATGGG Mmd_506
cand93 probe8  (SEQ ID NO:827)
GTCTTTAACTCTCTATTGCTGGTGGCTCTGATTTCATGATGCATTTTGCTTATGAAACTCTAGCTTTCAGCACTAAATTGAGTTAAAGAT Mmd_507
cand244 probe12  (SEQ ID NO:828)
GGTGCGGGCGCGTCGCCCCCTCAGGCCACCAGAGCCCGGATACCTCAGAAATTCGGCTCTGGGTCTGTGGGGAGCGAAATGCAACCCAAACC Mmd_508
cand601 probe10  (SEQ ID NO:829)
AGCTTGAAGTAGAAAAACAAAAATGGGAAACAGATGGGTAATACCCAGAAGAAAATTTTCTCGGTATTGCCCATCTGCTTCTCTGCCTGAAAGCT

FIG 2 Con't.

```
Mmd_510                       1  2  3  4  5  6  7  8  9 10 11 12 13 14 15 16 17 18 19 20 21 22    (SEQ ID NO:832)
cand692 probe3
CAAGGTCTTGGTATGGTAGCGCCCCAGGATGGAGTAGGCAGGGCCAAGGTCCTTGCCAGTCTTCAGGATCTTGGGGTTCACACTGTAGCGGGGCCCTG
...(((((((((..((((((((((((((...(((((((((....)))))))))...)))))))...))))))))).).)))))))))))).....

Mmd_511                       1  2  3  4  5  6  7  8  9 10 11 12 13 14 15 16 17 18 19 20 21 22    (SEQ ID NO:833)
cand693 probe8
GGAAGGTACTCTGTGGGAGGGAGGAGATCAGAGCCAAGGATGACATTCCTCCTTCACACTTGCAGTACCTCC
(((..((((((((..((((((((((..(((...(......).)))...)))))))))).)))...)))))))))

Mmd_512                       1  2  3  4  5  6  7  8  9 10 11 12 13 14 15 16 17 18 19 20 21 22    (SEQ ID NO:834)
mmHP668436 probe3
GGCTGCTCCTTGCCTTGATGTGAGGCAAGCTGGGGCAGTGCAGCCCTGTTCTGGTTGCCTTTTGTCAGATAGGAGTTGACAGCC
(((((((((((....(((((((((..((((((((..(.((((((......))))))......)))))))).)).)))))..))))))))..))))

Mmd_515                       1  2  3  4  5  6  7  8  9 10 11 12 13 14 15 16 17 18 19 20 21 22    (SEQ ID NO:350)
cand389 probe14
GGGCATAGTTGGACGAGAGGGCGTCTTGGCCAGGTCTCTGTGTTTAAAGAGCACAGGTGTGAGACACTGGGACGCACGCTTTCGGCTCAACATTGCCT
((((..((((((..((((((((((((((....(((((((((((((...)))))))))).)))))))...))))).).)))))))).).))))..))))

Mmd_516                       1  2  3  4  5  6  7  8  9 10 11 12 13 14 15 16 17 18 19 20 21 22    (SEQ ID NO:836)
cand722 probe18
TTACAGCTGATTGGACGGGGTCGATACGGAGCAGTATATAAAGGTTCCTTGGATGAGCGTCCAGTTGCTGTAA
.(((((((..(((((((..(((.(..((((((..(....)..)))))).))))))))))))))))))).

Mmd_517                       1  2  3  4  5  6  7  8  9 10 11 12 13 14 15 16 17 18 19 20 21 22    (SEQ ID NO:837)
cand842 probe10
GCACACCGCACAGAAGTCCTCATTGTCTATGGGGCCGGGGTGTTCTTCTTGGCTCCTGGAGCTCGGCGGATGAGTCTGTGTTCCTCAGATGTGC
((((.(((((((...((((((((((((....((((((((((...)))))))))....)))))))).))))))))))))))))

Mmd_518                       1  2  3  4  5  6  7  8  9 10 11 12 13 14 15 16 17 18 19 20 21 22    (SEQ ID NO:838)
cand790 probe5
CGCATGTCACACAGCCGGATTGTCCCCTTGCCTGCTGCTGTATACGAAGGTGTTGCAGTGGTGGGGGTGGAACTCAGCTGCAGTGATCACCTCTGTG
((((((((((..(((((..(.(..((((...((((...(((((...))).).))))...)).))).).)).)..)))..(((..)))).))....)))

Mmd_519                       1  2  3  4  5  6  7  8  9 10 11 12 13 14 15 16 17 18 19 20 21 22    (SEQ ID NO:839)
cand676 probe12
GGAGGTGCCCAGGTCAGTGCGCTGGTTCATGGAGGCCGACCTATCTATGAGGAACAGCAGGATGGGCATCTTC
(((((((((((((..((....((((((((((..((....)).))))))))))...)))))..))))))))))))

Mmd_520                       1  2  3  4  5  6  7  8  9 10 11 12 13 14 15 16 17 18 19 20 21 22    (SEQ ID NO:840)
cand627 probe2
TGCACCAGGGAGAACAGCTGATGGATCACAAATCTCTGCATTTCACCAACAGAAATGAATTTGAATCCATCAATTTTATTCCCTTATGCA
.(((.(((((((..((((((..(((((....(((((.....))))))....))))))..))))))))))))..))).

Mmd_521                       1  2  3  4  5  6  7  8  9 10 11 12 13 14 15 16 17 18 19 20 21 22    (SEQ ID NO:841)
mmHP152804.0 probe19
GGGTCTGCTTACACATTAGCAACTGACTGTCTCCTTCAACCAAACATGATCCCACAGACAGTCAGGAGCTGTGGAAGCAAAGAAAACC
((.((((((..(((..((((((((((((...((((......))))))))))))...)))).))..))))))..)).))))

Mmd_523                       1  2  3  4  5  6  7  8  9 10 11 12 13 14 15 16 17 18 19 20 21 22    (SEQ ID NO:843)
cand433 probe8
CCGTTCAAATAAAAGATTGAAGGATGCTGTGGCCACTGCCATGAGGCAGACAGGAACACAGCTTTACGTTCAAGTTTAGAATGG
(((((((....(((((((.(.(((((...((((....))))...))))))).))))))..)))))))))))

Mmd_524                       1  2  3  4  5  6  7  8  9 10 11 12 13 14 15 16 17 18 19 20 21 22    (SEQ ID NO:357)
cand89 probe16
GGGTCTGATAGGTATACAGCTGGTTGTTACCATGGTGATGGCCAGTGTCATGCAGAAGATTATACCT
((((.(((((..((((((...((((((..((((...)))..)))))).))))))..))))).))))
```

FIG 2 Con't.

Mmd_627
cand332 probe20      1 2 3 4 5 6 7 8 9 10 11 12 13 14 15 16 17 18 19 20 21 22    (SEQ ID NO:845)
GTCTGTGCTGTGGACCTCTCATTTACTCCTTTGTGGAGTTGGGAGCAGCTTCCCATTAAAGGAGATCAGAGGTAATTAGCAGCATTATTTTGAC
(((.(((((((((..(((((((..(((((((((((((((....))))..))))).)))))))))))..)))))).......)))

Mmd_628
mmHP166179 probe15      1 2 3 4 5 6 7 8 9 10 11 12 13 14 15 16 17 18 19 20 21 22    (SEQ ID NO:846)
TGAGCAGCTGTTCCATAGAGGCCTACTATAGAAACAGCTACAACAGCATAACCAGCGCGACTAGCCGATGAGGAGCTCCTAGATGGAGCAGGTGCCA
.(((((((((((((((((((..((((.......(((((....((......))....))))).)))).)))..)))..))))))))))).))))..

Mmd_629
cand741 probe26      23 24 25 26 27 28 29 30 31 32 33 34 35 36 37 38 39 40 41 42 43 44    (SEQ ID NO:847)
GTATAAAATTTCTAAGCAGTGTGTGAGAGGTGTACGCAGAAATCATGTTGGCAAAATATTTTGTGTAAGTGCCTCCCACACACAGCTTTAAAATGTTAC
(((....(((..(((((((.(((((((((((....((((........))))..)))))))))))).)))))))..))).))).

Mmd_630
cand523 probe3      1 2 3 4 5 6 7 8 9 10 11 12 13 14 15 16 17 18 19 20 21 22    (SEQ ID NO:849)
TGGGCTCCATGGGTGTCCAGATGCCTGATACATTCTCCAGGCCAAGGTATATAAGAACCTGTGGCCTGGGGAGGCGAGGACAGCTGGACAAACAGCTTA
((((((..(((((((((..(((((....((((((((......))))))))....))))).))))))))).)))).)).)))))))..))))))

Mmd_631
mmHP141642 probe4      1 2 3 4 5 6 7 8 9 10 11 12 13 14 15 16 17 18 19 20 21 22    (SEQ ID NO:850)
GCCGCCTAGTGAAAGAGCTAGCGTGGGCAGTTCTTTTGTACTCCAGCTGGAGTAAAATGAACGCAGGCTCGCGTGTTTCATCGCTGGT
(((.(..(((((((.....((((((((..((((.((((....)))).)))).)))..)))))).)))))))..)))

Mmd_632
cand111 probe13      1 2 3 4 5 6 7 8 9 10 11 12 13 14 15 16 17 18 19 20 21 22    (SEQ ID NO:851)
GCTCGCAGGCAGGGGATTTGAGGAGCGGTTGTGTGATTGTACAGCTGTCATTAGGGTAATTGCACGATATTTTCCCAAATTTCTCCTGCAGC
(((.((((((...(((..((((((((((((....(((....)))..))))))))))..)))))))...))))))).

Mmd_633
cand95 probe8      1 2 3 4 5 6 7 8 9 10 11 12 13 14 15 16 17 18 19 20 21 22    (SEQ ID NO:852)
TTAAGCTGAGTGCATTGTGATTTCCAATAATTGAGGCAGTGGTTCTAAAAGCTGTCTACATTAATGAAAAGAGCAATGTGGCCAGCTTGA
(((((((((..(((((((...(((..(((.((((..(((((((......))))))).)))).))).)))..))))))))))

Mmd_634
cand477 probe12      1 2 3 4 5 6 7 8 9 10 11 12 13 14 15 16 17 18 19 20 21 22    (SEQ ID NO:853)
TGCCCTCAGAGCTGATCTGAGTGTGGAGATTCCATTGACTTCAAAGGAAGCTTCATGCTTGGATCTTCTCCACAGGGGTG
((((((..(((..(((((..(((((.((((.(((....)))..)))).))))).))))).)))))))

Mmd_638
cand109 probe41      23 24 25 26 27 28 29 30 31 32 33 34 35 36 37 38 39 40 41 42 43 44    (SEQ ID NO:365)
GGCTGGGGCTGAACCGAATGCTGGCACCCTCCAAACCCAGGGGATCCCCAAAAGTAGGAGGCTGCCAAACACTGGAGCAGCACCGAAGCC
(((.((((((..((.....(((.(((((......(((...)))......))))).))).))..)))...))).))))

FIG. 4: A collection of nucleic acid molecules.

SEQ. ID. NO: 913, SEQ. ID. NO: 916, SEQ. ID. NO: 919, SEQ. ID. NO: 920, SEQ. ID. NO: 921, SEQ. ID. NO: 922, SEQ. ID. NO: 923, SEQ. ID. NO: 929, SEQ. ID. NO: 930, SEQ. ID. NO: 931, SEQ. ID. NO: 932, SEQ. ID. NO: 933, SEQ. ID. NO: 934, SEQ. ID. NO: 936, SEQ. ID. NO: 938, SEQ. ID. NO: 942, SEQ. ID. NO: 943, SEQ. ID. NO: 945, SEQ. ID. NO: 948, SEQ. ID. NO: 949, SEQ. ID. NO: 952, SEQ. ID. NO: 956, SEQ. ID. NO: 967, SEQ. ID. NO: 970, SEQ. ID. NO: 972, SEQ. ID. NO: 976, SEQ. ID. NO: 977, SEQ. ID. NO: 982, SEQ. ID. NO: 984, SEQ. ID. NO: 986, SEQ. ID. NO: 987, SEQ. ID. NO: 988, SEQ. ID. NO: 989, SEQ. ID. NO: 990, SEQ. ID. NO: 991, SEQ. ID. NO: 992, SEQ. ID. NO: 993, SEQ. ID. NO: 995, SEQ. ID. NO: 996, SEQ. ID. NO: 999, SEQ. ID. NO: 1000, SEQ. ID. NO: 1001, SEQ. ID. NO: 1002, SEQ. ID. NO: 1005, SEQ. ID. NO: 1006, SEQ. ID. NO: 1007, SEQ. ID. NO: 1008, SEQ. ID. NO: 1010, SEQ. ID. NO: 1011, SEQ. ID. NO: 1014, SEQ. ID. NO: 1015, SEQ. ID. NO: 1016, SEQ. ID. NO: 1017, SEQ. ID. NO: 1019, SEQ. ID. NO: 1020, SEQ. ID. NO: 1021, SEQ. ID. NO: 1022, SEQ. ID. NO: 1023, SEQ. ID. NO: 1024, SEQ. ID. NO: 1032, SEQ. ID. NO: 1033, SEQ. ID. NO: 1034, SEQ. ID. NO: 1035, SEQ. ID. NO: 1036, SEQ. ID. NO: 1037, SEQ. ID. NO: 1038, SEQ. ID. NO: 1039, SEQ. ID. NO: 1040, SEQ. ID. NO: 1047, SEQ. ID. NO: 1050, SEQ. ID. NO: 1051, SEQ. ID. NO: 1052, SEQ. ID. NO: 1053, SEQ. ID. NO: 1054, SEQ. ID. NO: 1057, SEQ. ID. NO: 1058, SEQ. ID. NO: 1059, SEQ. ID. NO: 1062, SEQ. ID. NO: 1063, SEQ. ID. NO: 1064, SEQ. ID. NO: 1065, SEQ. ID. NO: 1066, SEQ. ID. NO: 1067, SEQ. ID. NO: 1068, SEQ. ID. NO: 1069, SEQ. ID. NO: 1070, SEQ. ID. NO: 1071, SEQ. ID. NO: 1072, SEQ. ID. NO: 1074, SEQ. ID. NO: 1076, SEQ. ID. NO: 1078, SEQ. ID. NO: 1079, SEQ. ID. NO: 1080, SEQ. ID. NO: 1082, SEQ. ID. NO: 1084, SEQ. ID. NO: 1085, SEQ. ID. NO: 1086, SEQ. ID. NO: 1094, SEQ. ID. NO: 1095, SEQ. ID. NO: 1096, SEQ. ID. NO: 1097, SEQ. ID. NO: 1098, SEQ. ID. NO: 1099, SEQ. ID. NO: 1100, SEQ. ID. NO: 1101, SEQ. ID. NO: 1105, SEQ. ID. NO: 1109, SEQ. ID. NO: 1244, SEQ. ID. NO: 1391, SEQ. ID. NO: 8833, SEQ. ID. NO: 8834, SEQ. ID. NO: 8835, SEQ. ID. NO: 8836, SEQ. ID. NO: 8837, SEQ. ID. NO: 8838, SEQ. ID. NO: 8839, SEQ. ID. NO: 8840, SEQ. ID. NO: 8841, SEQ. ID. NO: 8842, SEQ. ID. NO: 8845, SEQ. ID. NO: 8846, SEQ. ID. NO: 8847, SEQ. ID. NO: 8848, SEQ. ID. NO: 8849, SEQ. ID. NO: 8850, SEQ. ID. NO: 8851, SEQ. ID. NO: 8852, SEQ. ID. NO: 8853, SEQ. ID. NO: 8854, SEQ. ID. NO: 8855, SEQ. ID. NO: 8856, SEQ. ID. NO: 8857, SEQ. ID. NO: 8858, SEQ. ID. NO: 8859, SEQ. ID. NO: 8860, SEQ. ID. NO: 8861, SEQ. ID. NO: 8862, SEQ. ID. NO: 8863, SEQ. ID. NO: 8864, SEQ. ID. NO: 8865, SEQ. ID. NO: 8866, SEQ. ID. NO: 8867, SEQ. ID. NO: 8868, SEQ. ID. NO: 8869, SEQ. ID. NO: 8870, SEQ. ID. NO: 8871, SEQ. ID. NO: 8872, SEQ. ID. NO: 8873, SEQ. ID. NO: 8874, SEQ. ID. NO: 8875, SEQ. ID. NO: 8876, SEQ. ID. NO: 8877, SEQ. ID. NO: 8878, SEQ. ID. NO: 8879, SEQ. ID. NO: 8880, SEQ. ID. NO: 8881, SEQ. ID. NO: 8882, SEQ. ID. NO: 8883, SEQ. ID. NO: 8884, SEQ. ID. NO: 8885, SEQ. ID. NO: 8886, SEQ. ID. NO: 8887, SEQ. ID. NO: 8889, SEQ. ID. NO: 8890, SEQ. ID. NO: 8891, SEQ. ID. NO: 8892, SEQ. ID. NO: 8893, SEQ. ID. NO: 8894, SEQ. ID. NO: 8895, SEQ. ID. NO: 8896, SEQ. ID. NO: 8898, SEQ. ID. NO: 8899, SEQ. ID. NO: 8900, SEQ. ID. NO: 8903, SEQ. ID. NO: 8905, SEQ. ID. NO: 8906, SEQ. ID. NO: 8908, SEQ. ID. NO: 8909, SEQ. ID. NO: 8910, SEQ. ID. NO: 8911, SEQ. ID. NO: 8912, SEQ. ID. NO: 8914, SEQ. ID. NO: 8915, SEQ. ID. NO: 8916, SEQ. ID. NO: 8917, SEQ. ID. NO: 8918, SEQ. ID. NO: 8921, SEQ. ID. NO: 8922, SEQ. ID. NO: 8923, SEQ. ID. NO: 8924, SEQ. ID. NO: 8925, SEQ. ID. NO: 8926, SEQ. ID. NO: 8927, SEQ. ID. NO: 8929, SEQ. ID. NO: 8930, SEQ. ID. NO: 8931, SEQ. ID. NO: 8932, SEQ. ID. NO: 8933, SEQ. ID. NO: 8934, SEQ. ID. NO: 8935, SEQ. ID. NO: 8936, SEQ. ID. NO: 8937, SEQ. ID. NO: 8938, SEQ. ID. NO: 8939, SEQ. ID. NO: 8940, SEQ. ID. NO: 8941, SEQ. ID. NO: 8942, SEQ. ID. NO: 8943, SEQ. ID. NO: 8944, SEQ. ID. NO: 8945, SEQ. ID. NO: 8950, SEQ. ID. NO: 8951, SEQ. ID. NO: 8952, SEQ. ID. NO: 8953, SEQ. ID. NO: 8954, SEQ. ID. NO: 8955, SEQ. ID. NO: 8956, SEQ. ID. NO: 8957, SEQ. ID. NO: 8958, SEQ. ID. NO: 8959, SEQ. ID. NO: 8960, SEQ. ID. NO: 8961, SEQ. ID. NO: 8962, SEQ. ID. NO: 8963, SEQ. ID. NO: 8964, SEQ. ID. NO: 8965, SEQ. ID. NO: 8966, SEQ. ID. NO: 8968, SEQ. ID. NO: 8969, SEQ. ID. NO: 8971, SEQ. ID. NO: 8972, SEQ. ID. NO: 8975, SEQ. ID. NO: 8976, SEQ. ID. NO: 8977, SEQ. ID. NO: 8978, SEQ. ID. NO: 8979, SEQ. ID. NO: 8980, SEQ. ID. NO: 8981, SEQ. ID. NO: 8982, SEQ. ID. NO: 8983, SEQ. ID. NO: 8984, SEQ. ID. NO: 8985, SEQ. ID. NO: 8986, SEQ. ID. NO: 8987, SEQ. ID. NO: 8988, SEQ. ID. NO: 8989, SEQ. ID. NO: 8990, SEQ. ID. NO: 8991, SEQ. ID. NO: 8992, SEQ. ID. NO: 8993, SEQ. ID. NO: 8994, SEQ. ID. NO: 8995, SEQ. ID. NO: 8996, SEQ. ID. NO: 8997, SEQ. ID. NO: 8998, SEQ. ID. NO: 8999, SEQ. ID. NO: 9000, SEQ. ID. NO: 9001, SEQ. ID. NO: 9003, SEQ. ID. NO: 9004, SEQ. ID. NO: 9005, SEQ. ID. NO: 9006, SEQ. ID. NO: 9007, SEQ. ID. NO: 9008, SEQ. ID. NO: 9009, SEQ. ID. NO: 9010, SEQ. ID. NO: 9011, SEQ. ID. NO: 9012, SEQ. ID. NO: 9013, SEQ. ID. NO: 9014, SEQ. ID. NO: 9015, SEQ. ID. NO: 9016, SEQ. ID. NO: 9017, SEQ. ID. NO: 9019, SEQ. ID. NO: 9022, SEQ. ID. NO: 9024, SEQ. ID. NO: 9025, SEQ. ID. NO: 9027, SEQ. ID. NO: 9031, SEQ. ID. NO: 9032, SEQ. ID. NO: 9034, SEQ. ID. NO: 9035, SEQ. ID. NO: 9039, SEQ. ID. NO: 9041, SEQ. ID. NO: 9043, SEQ. ID. NO: 9044, SEQ. ID. NO: 9046, SEQ. ID. NO: 9048, SEQ. ID. NO: 9049, SEQ. ID. NO: 9050, SEQ. ID. NO: 9058, SEQ. ID. NO: 9061, SEQ. ID. NO: 9062, SEQ. ID. NO: 9064, SEQ. ID. NO: 9065, SEQ. ID. NO: 9066, SEQ. ID. NO: 9070, SEQ. ID. NO: 9072, SEQ. ID. NO: 9074, SEQ. ID. NO: 9080, SEQ. ID. NO: 9082, SEQ. ID. NO: 9084, SEQ. ID. NO: 9086, SEQ. ID. NO: 9087, SEQ. ID. NO: 9088, SEQ. ID. NO: 9089, SEQ. ID. NO: 9090, SEQ. ID. NO: 9091, SEQ. ID. NO: 9092, SEQ. ID. NO: 9093, SEQ. ID. NO: 9094, SEQ. ID. NO: 9095, SEQ. ID. NO: 9096, SEQ. ID. NO: 9097, SEQ. ID. NO: 9100, SEQ. ID. NO: 9101, SEQ. ID. NO: 9102, SEQ. ID. NO: 9103, SEQ. ID. NO: 9104, SEQ. ID. NO: 9105, SEQ. ID. NO: 9106, SEQ. ID. NO: 9107, SEQ. ID. NO: 9108, SEQ. ID. NO: 9109, SEQ. ID. NO: 9110, SEQ. ID. NO: 9111, SEQ.

FIG 4 Con't.

ID. NO: 9112, SEQ. ID. NO: 9113, SEQ. ID. NO: 9114, SEQ. ID. NO: 9115, SEQ. ID. NO: 9116, SEQ. ID. NO: 9117, SEQ. ID. NO: 9118, SEQ. ID. NO: 9119, SEQ. ID. NO: 9120, SEQ. ID. NO: 9121, SEQ. ID. NO: 9122, SEQ. ID. NO: 9123, SEQ. ID. NO: 9124, SEQ. ID. NO: 9125, SEQ. ID. NO: 9126, SEQ. ID. NO: 9127, SEQ. ID. NO: 9128, SEQ. ID. NO: 9129, SEQ. ID. NO: 9130, SEQ. ID. NO: 9131, SEQ. ID. NO: 9132, SEQ. ID. NO: 9133, SEQ. ID. NO: 9134, SEQ. ID. NO: 9135, SEQ. ID. NO: 9136, SEQ. ID. NO: 9137, SEQ. ID. NO: 9138, SEQ. ID. NO: 9139, SEQ. ID. NO: 9140, SEQ. ID. NO: 9141, SEQ. ID. NO: 9142, SEQ. ID. NO: 9143, SEQ. ID. NO: 9144, SEQ. ID. NO: 9145, SEQ. ID. NO: 9146, SEQ. ID. NO: 9148, SEQ. ID. NO: 9149, SEQ. ID. NO: 9150, SEQ. ID. NO: 9151, SEQ. ID. NO: 9154, SEQ. ID. NO: 9155, SEQ. ID. NO: 9156, SEQ. ID. NO: 9157, SEQ. ID. NO: 9158, SEQ. ID. NO: 9159, SEQ. ID. NO: 9160, SEQ. ID. NO: 9161, SEQ. ID. NO: 9162, SEQ. ID. NO: 9163, SEQ. ID. NO: 9164, SEQ. ID. NO: 9165, SEQ. ID. NO: 9166, SEQ. ID. NO: 9167, SEQ. ID. NO: 9168, SEQ. ID. NO: 9170, SEQ. ID. NO: 9175, SEQ. ID. NO: 9176, SEQ. ID. NO: 9182, SEQ. ID. NO: 9183, SEQ. ID. NO: 9184, SEQ. ID. NO: 9185, SEQ. ID. NO: 9186, SEQ. ID. NO: 9187, SEQ. ID. NO: 9188, SEQ. ID. NO: 9189, SEQ. ID. NO: 9190, SEQ. ID. NO: 9191, SEQ. ID. NO: 9192, SEQ. ID. NO: 9194, SEQ. ID. NO: 9196, SEQ. ID. NO: 9197, SEQ. ID. NO: 9198, SEQ. ID. NO: 9199, SEQ. ID. NO: 9200, SEQ. ID. NO: 9206, SEQ. ID. NO: 9207, SEQ. ID. NO: 9208, SEQ. ID. NO: 9209, SEQ. ID. NO: 9210, SEQ. ID. NO: 9211, SEQ. ID. NO: 9212, SEQ. ID. NO: 9213, SEQ. ID. NO: 9214, SEQ. ID. NO: 9217, SEQ. ID. NO: 9218, SEQ. ID. NO: 9219, SEQ. ID. NO: 9221, SEQ. ID. NO: 9222, SEQ. ID. NO: 9223, SEQ. ID. NO: 9224, SEQ. ID. NO: 9225, SEQ. ID. NO: 9226, SEQ. ID. NO: 9228, SEQ. ID. NO: 9231, SEQ. ID. NO: 9233, SEQ. ID. NO: 9235, SEQ. ID. NO: 9236, SEQ. ID. NO: 9237, SEQ. ID. NO: 9238, SEQ. ID. NO: 9239, SEQ. ID. NO: 9241, SEQ. ID. NO: 9242, SEQ. ID. NO: 9243, SEQ. ID. NO: 9244, SEQ. ID. NO: 9245, SEQ. ID. NO: 9246, SEQ. ID. NO: 9249, SEQ. ID. NO: 9251, SEQ. ID. NO: 9257, SEQ. ID. NO: 9258, SEQ. ID. NO: 9260, SEQ. ID. NO: 9262, SEQ. ID. NO: 9263, SEQ. ID. NO: 9264, SEQ. ID. NO: 9265, SEQ. ID. NO: 9268, SEQ. ID. NO: 9274, SEQ. ID. NO: 9276, SEQ. ID. NO: 9278, SEQ. ID. NO: 9279, SEQ. ID. NO: 9280, SEQ. ID. NO: 9299, SEQ. ID. NO: 9303, SEQ. ID. NO: 9304, SEQ. ID. NO: 9305, SEQ. ID. NO: 9308, SEQ. ID. NO: 9319, SEQ. ID. NO: 9320, SEQ. ID. NO: 9321, SEQ. ID. NO: 9322, SEQ. ID. NO: 9323, SEQ. ID. NO: 9324, SEQ. ID. NO: 9325, SEQ. ID. NO: 9326, SEQ. ID. NO: 9327, SEQ. ID. NO: 9328, SEQ. ID. NO: 9329, SEQ. ID. NO: 9330, SEQ. ID. NO: 9331, SEQ. ID. NO: 9332, SEQ. ID. NO: 9333, SEQ. ID. NO: 9334, SEQ. ID. NO: 9335, SEQ. ID. NO: 9336, SEQ. ID. NO: 9337, SEQ. ID. NO: 9338, SEQ. ID. NO: 9339, SEQ. ID. NO: 9340, SEQ. ID. NO: 9341, SEQ. ID. NO: 9342, SEQ. ID. NO: 9343, SEQ. ID. NO: 9344, SEQ. ID. NO: 9345, SEQ. ID. NO: 9346, SEQ. ID. NO: 9347, SEQ. ID. NO: 9348, SEQ. ID. NO: 9349, SEQ. ID. NO: 9350, SEQ. ID. NO: 9351, SEQ. ID. NO: 9352, SEQ. ID. NO: 9353, SEQ. ID. NO: 9354, SEQ. ID. NO: 9355, SEQ. ID. NO: 9356, SEQ. ID. NO: 9357, SEQ. ID. NO: 9358, SEQ. ID. NO: 9359, SEQ. ID. NO: 9361, SEQ. ID. NO: 9362, SEQ. ID. NO: 9363, SEQ. ID. NO: 9364, SEQ. ID. NO: 9365, SEQ. ID. NO: 9366, SEQ. ID. NO: 9367, SEQ. ID. NO: 9368, SEQ. ID. NO: 9369, SEQ. ID. NO: 9370, SEQ. ID. NO: 9371, SEQ. ID. NO: 9372, SEQ. ID. NO: 9373, SEQ. ID. NO: 9374, SEQ. ID. NO: 9375, SEQ. ID. NO: 9376, SEQ. ID. NO: 9377, SEQ. ID. NO: 9378, SEQ. ID. NO: 9379, SEQ. ID. NO: 9380, SEQ. ID. NO: 9381, SEQ. ID. NO: 9382, SEQ. ID. NO: 9383, SEQ. ID. NO: 9384, SEQ. ID. NO: 9385, SEQ. ID. NO: 9386, SEQ. ID. NO: 9387, SEQ. ID. NO: 9388, SEQ. ID. NO: 9389, SEQ. ID. NO: 9390, SEQ. ID. NO: 9391, SEQ. ID. NO: 9392, SEQ. ID. NO: 9393, SEQ. ID. NO: 9394, SEQ. ID. NO: 9395, SEQ. ID. NO: 9396, SEQ. ID. NO: 9397, SEQ. ID. NO: 9398, SEQ. ID. NO: 9399, SEQ. ID. NO: 9400, SEQ. ID. NO: 9401, SEQ. ID. NO: 9402, SEQ. ID. NO: 9403, SEQ. ID. NO: 9404, SEQ. ID. NO: 9405, SEQ. ID. NO: 9406, SEQ. ID. NO: 9407, SEQ. ID. NO: 9408, SEQ. ID. NO: 9409, SEQ. ID. NO: 9410, SEQ. ID. NO: 9411, SEQ. ID. NO: 9412, SEQ. ID. NO: 9413, SEQ. ID. NO: 9414, SEQ. ID. NO: 9415, SEQ. ID. NO: 9417, SEQ. ID. NO: 9418, SEQ. ID. NO: 9419, SEQ. ID. NO: 9421, SEQ. ID. NO: 9422, SEQ. ID. NO: 9423, SEQ. ID. NO: 9424, SEQ. ID. NO: 9425, SEQ. ID. NO: 9426, SEQ. ID. NO: 9427, SEQ. ID. NO: 9429, SEQ. ID. NO: 9430, SEQ. ID. NO: 9431, SEQ. ID. NO: 9432, SEQ. ID. NO: 9433, SEQ. ID. NO: 9434, SEQ. ID. NO: 9435, SEQ. ID. NO: 9436, SEQ. ID. NO: 9437, SEQ. ID. NO: 9438, SEQ. ID. NO: 9439, SEQ. ID. NO: 9440, SEQ. ID. NO: 9441, SEQ. ID. NO: 9442, SEQ. ID. NO: 9443, SEQ. ID. NO: 9444, SEQ. ID. NO: 9445, SEQ. ID. NO: 9446, SEQ. ID. NO: 9447, SEQ. ID. NO: 9448, SEQ. ID. NO: 9449, SEQ. ID. NO: 9450, SEQ. ID. NO: 9451, SEQ. ID. NO: 9452, SEQ. ID. NO: 9453, SEQ. ID. NO: 9454, SEQ. ID. NO: 9455, SEQ. ID. NO: 9456, SEQ. ID. NO: 9457, SEQ. ID. NO: 9458, SEQ. ID. NO: 9459, SEQ. ID. NO: 9460, SEQ. ID. NO: 9461, SEQ. ID. NO: 9462, SEQ. ID. NO: 9463, SEQ. ID. NO: 9465, SEQ. ID. NO: 9466, SEQ. ID. NO: 9467, SEQ. ID. NO: 9468, SEQ. ID. NO: 9471, SEQ. ID. NO: 9472, SEQ. ID. NO: 9473, SEQ. ID. NO: 9474, SEQ. ID. NO: 9475, SEQ. ID. NO: 9476, SEQ. ID. NO: 9477, SEQ. ID. NO: 9478, SEQ. ID. NO: 9479, SEQ. ID. NO: 9480, SEQ. ID. NO: 9481, SEQ. ID. NO: 9482, SEQ. ID. NO: 9483, SEQ. ID. NO: 9484, SEQ. ID. NO: 9485, SEQ. ID. NO: 9486, SEQ. ID. NO: 9487, SEQ. ID. NO: 9488, SEQ. ID. NO: 9489, SEQ. ID. NO: 9490, SEQ. ID. NO: 9491, SEQ. ID. NO: 9492, SEQ. ID. NO: 9493, SEQ. ID. NO: 9494, SEQ. ID. NO: 9495, SEQ. ID. NO: 9496, SEQ. ID. NO: 9497, SEQ. ID. NO: 9498, SEQ. ID. NO: 9499, SEQ. ID. NO: 9500, SEQ. ID. NO: 9501, SEQ. ID. NO: 9502, SEQ. ID. NO: 9503, SEQ. ID. NO: 9504, SEQ. ID. NO: 9505, SEQ. ID. NO: 9506, SEQ. ID. NO: 9507, SEQ. ID. NO: 9508, SEQ. ID. NO: 9509, SEQ. ID. NO: 9510, SEQ. ID. NO: 9511, SEQ. ID. NO: 9512, SEQ. ID. NO: 9513, SEQ. ID. NO: 9514, SEQ. ID. NO: 9515, SEQ. ID. NO: 9516, SEQ. ID. NO: 9517, SEQ. ID. NO: 9518, SEQ. ID. NO: 9519, SEQ. ID. NO: 9520, SEQ. ID. NO: 9521, SEQ. ID. NO: 9522, SEQ. ID. NO: 9523, SEQ. ID. NO: 9524, SEQ. ID. NO: 9525, SEQ. ID. NO: 9526, SEQ. ID. NO: 9527, SEQ. ID. NO: 9528, SEQ. ID. NO: 9529, SEQ. ID. NO: 9530, SEQ. ID. NO: 9531, SEQ. ID. NO: 9532, SEQ. ID. NO: 9533, SEQ. ID. NO: 9534, SEQ. ID. NO: 9535, SEQ. ID. NO: 9536, SEQ. ID. NO: 9537, SEQ. ID. NO: 9538, SEQ. ID. NO: 9539, SEQ. ID. NO: 9540, SEQ.

FIG 4 Con't.

ID. NO: 9541, SEQ. ID. NO: 9542, SEQ. ID. NO: 9543, SEQ. ID. NO: 9546, SEQ. ID. NO: 9547, SEQ. ID. NO: 9548, SEQ. ID. NO: 9549, SEQ. ID. NO: 9550, SEQ. ID. NO: 9551, SEQ. ID. NO: 9552, SEQ. ID. NO: 9553, SEQ. ID. NO: 9554, SEQ. ID. NO: 9556, SEQ. ID. NO: 9557, SEQ. ID. NO: 9558, SEQ. ID. NO: 9559, SEQ. ID. NO: 9560, SEQ. ID. NO: 9561, SEQ. ID. NO: 9562, SEQ. ID. NO: 9563, SEQ. ID. NO: 9564, SEQ. ID. NO: 9565, SEQ. ID. NO: 9566, SEQ. ID. NO: 9568, SEQ. ID. NO: 9569, SEQ. ID. NO: 9570, SEQ. ID. NO: 9571, SEQ. ID. NO: 9572, SEQ. ID. NO: 9573, SEQ. ID. NO: 9574, SEQ. ID. NO: 9575, SEQ. ID. NO: 9576, SEQ. ID. NO: 9577, SEQ. ID. NO: 9578, SEQ. ID. NO: 9579, SEQ. ID. NO: 9580, SEQ. ID. NO: 9581, SEQ. ID. NO: 9583, SEQ. ID. NO: 9584, SEQ. ID. NO: 9585, SEQ. ID. NO: 9586, SEQ. ID. NO: 9588, SEQ. ID. NO: 9589, SEQ. ID. NO: 9590, SEQ. ID. NO: 9591, SEQ. ID. NO: 9592, SEQ. ID. NO: 9593, SEQ. ID. NO: 9595, SEQ. ID. NO: 9596, SEQ. ID. NO: 9597, SEQ. ID. NO: 9598, SEQ. ID. NO: 9599, SEQ. ID. NO: 9600, SEQ. ID. NO: 9601, SEQ. ID. NO: 9602, SEQ. ID. NO: 9603, SEQ. ID. NO: 9604, SEQ. ID. NO: 9605, SEQ. ID. NO: 9606, SEQ. ID. NO: 9607, SEQ. ID. NO: 9608, SEQ. ID. NO: 9609, SEQ. ID. NO: 9610, SEQ. ID. NO: 9611, SEQ. ID. NO: 9612, SEQ. ID. NO: 9613, SEQ. ID. NO: 9614, SEQ. ID. NO: 9615, SEQ. ID. NO: 9616, SEQ. ID. NO: 9617, SEQ. ID. NO: 9619, SEQ. ID. NO: 9620, SEQ. ID. NO: 9621, SEQ. ID. NO: 9622, SEQ. ID. NO: 9623, SEQ. ID. NO: 9624, SEQ. ID. NO: 9625, SEQ. ID. NO: 9626, SEQ. ID. NO: 9627, SEQ. ID. NO: 9628, SEQ. ID. NO: 9629, SEQ. ID. NO: 9630, SEQ. ID. NO: 9631, SEQ. ID. NO: 9633, SEQ. ID. NO: 9634, SEQ. ID. NO: 9636, SEQ. ID. NO: 9637, SEQ. ID. NO: 9638, SEQ. ID. NO: 9639, SEQ. ID. NO: 9640, SEQ. ID. NO: 9641, SEQ. ID. NO: 9642, SEQ. ID. NO: 9643, SEQ. ID. NO: 9644, SEQ. ID. NO: 9645, SEQ. ID. NO: 9646, SEQ. ID. NO: 9647, SEQ. ID. NO: 9648, SEQ. ID. NO: 9649, SEQ. ID. NO: 9650, SEQ. ID. NO: 9651, SEQ. ID. NO: 9652, SEQ. ID. NO: 9653, SEQ. ID. NO: 9654, SEQ. ID. NO: 9655, SEQ. ID. NO: 9656, SEQ. ID. NO: 9657, SEQ. ID. NO: 9658, SEQ. ID. NO: 9659, SEQ. ID. NO: 9660, SEQ. ID. NO: 9661, SEQ. ID. NO: 9662, SEQ. ID. NO: 9663, SEQ. ID. NO: 9664, SEQ. ID. NO: 9665, SEQ. ID. NO: 9666, SEQ. ID. NO: 9667, SEQ. ID. NO: 9668, SEQ. ID. NO: 9669, SEQ. ID. NO: 9670, SEQ. ID. NO: 9671, SEQ. ID. NO: 9672, SEQ. ID. NO: 9673, SEQ. ID. NO: 9674, SEQ. ID. NO: 9675, SEQ. ID. NO: 9676, SEQ. ID. NO: 9677, SEQ. ID. NO: 9678, SEQ. ID. NO: 9679, SEQ. ID. NO: 9680, SEQ. ID. NO: 9681, SEQ. ID. NO: 9683, SEQ. ID. NO: 9686, SEQ. ID. NO: 9688, SEQ. ID. NO: 9689, SEQ. ID. NO: 9690, SEQ. ID. NO: 9691, SEQ. ID. NO: 9692, SEQ. ID. NO: 9693, SEQ. ID. NO: 9694, SEQ. ID. NO: 9695, SEQ. ID. NO: 9697, SEQ. ID. NO: 9698, SEQ. ID. NO: 9699, SEQ. ID. NO: 9700, SEQ. ID. NO: 9701, SEQ. ID. NO: 9702, SEQ. ID. NO: 9703, SEQ. ID. NO: 9704, SEQ. ID. NO: 9705, SEQ. ID. NO: 9706, SEQ. ID. NO: 9707, SEQ. ID. NO: 9708, SEQ. ID. NO: 9709, SEQ. ID. NO: 9710, SEQ. ID. NO: 9711, SEQ. ID. NO: 9712, SEQ. ID. NO: 9713, SEQ. ID. NO: 9714, SEQ. ID. NO: 9715, SEQ. ID. NO: 9716, SEQ. ID. NO: 9717, SEQ. ID. NO: 9718, SEQ. ID. NO: 9719, SEQ. ID. NO: 9720, SEQ. ID. NO: 9721, SEQ. ID. NO: 9722, SEQ. ID. NO: 9723, SEQ. ID. NO: 9724, SEQ. ID. NO: 9725, SEQ. ID. NO: 9726, SEQ. ID. NO: 9727, SEQ. ID. NO: 9728, SEQ. ID. NO: 9729, SEQ. ID. NO: 9730, SEQ. ID. NO: 9731, SEQ. ID. NO: 9732, SEQ. ID. NO: 9733, SEQ. ID. NO: 9734, SEQ. ID. NO: 9735, SEQ. ID. NO: 9736, SEQ. ID. NO: 9737, SEQ. ID. NO: 9738, SEQ. ID. NO: 9739, SEQ. ID. NO: 9740, SEQ. ID. NO: 9741, SEQ. ID. NO: 9742, SEQ. ID. NO: 9743, SEQ. ID. NO: 9744, SEQ. ID. NO: 9745, SEQ. ID. NO: 9747, SEQ. ID. NO: 9748, SEQ. ID. NO: 9749, SEQ. ID. NO: 9750, SEQ. ID. NO: 9751, SEQ. ID. NO: 9752, SEQ. ID. NO: 9753, SEQ. ID. NO: 9754, SEQ. ID. NO: 9755, SEQ. ID. NO: 9756, SEQ. ID. NO: 9757, SEQ. ID. NO: 9758, SEQ. ID. NO: 9759, SEQ. ID. NO: 9760, SEQ. ID. NO: 9764, SEQ. ID. NO: 9765, SEQ. ID. NO: 9766, SEQ. ID. NO: 9767, SEQ. ID. NO: 9768, SEQ. ID. NO: 9770, SEQ. ID. NO: 9771, SEQ. ID. NO: 9772, SEQ. ID. NO: 9773, SEQ. ID. NO: 9774, SEQ. ID. NO: 9775, SEQ. ID. NO: 9777, SEQ. ID. NO: 9778, SEQ. ID. NO: 9779, SEQ. ID. NO: 9780, SEQ. ID. NO: 9781, SEQ. ID. NO: 9782, SEQ. ID. NO: 9783, SEQ. ID. NO: 9784, SEQ. ID. NO: 9785, SEQ. ID. NO: 9786, SEQ. ID. NO: 9787, SEQ. ID. NO: 9788, SEQ. ID. NO: 9789, SEQ. ID. NO: 9790, SEQ. ID. NO: 9791, SEQ. ID. NO: 9792, SEQ. ID. NO: 9793, SEQ. ID. NO: 9794, SEQ. ID. NO: 9795, SEQ. ID. NO: 9796, SEQ. ID. NO: 9797, SEQ. ID. NO: 9798, SEQ. ID. NO: 9799, SEQ. ID. NO: 9800, SEQ. ID. NO: 9801, SEQ. ID. NO: 9802, SEQ. ID. NO: 9803, SEQ. ID. NO: 9804, SEQ. ID. NO: 9805, SEQ. ID. NO: 9806, SEQ. ID. NO: 9807, SEQ. ID. NO: 9808, SEQ. ID. NO: 9809, SEQ. ID. NO: 9810, SEQ. ID. NO: 9811, SEQ. ID. NO: 9812, SEQ. ID. NO: 9813, SEQ. ID. NO: 9814, SEQ. ID. NO: 9815, SEQ ID. NO: 9816, SEQ. ID. NO: 9817, SEQ. ID. NO: 9818, SEQ. ID. NO: 9819, SEQ. ID. NO: 9821, SEQ. ID. NO: 9822, SEQ. ID. NO: 9823, SEQ. ID. NO: 9824, SEQ. ID. NO: 9825, SEQ. ID. NO: 9826, SEQ. ID. NO: 9827, SEQ. ID. NO: 9829, SEQ. ID. NO: 9830, SEQ. ID. NO: 9831, SEQ. ID. NO: 9832, SEQ. ID. NO: 9833, SEQ. ID. NO: 9834, SEQ. ID. NO: 9835, SEQ. ID. NO: 9836, SEQ. ID. NO: 9837, SEQ. ID. NO: 9839, SEQ. ID. NO: 9840, SEQ. ID. NO: 9841, SEQ. ID. NO: 9842, SEQ. ID. NO: 9843, SEQ. ID. NO: 9844, SEQ. ID. NO: 9845, SEQ. ID. NO: 9846, SEQ. ID. NO: 9847, SEQ. ID. NO: 9849, SEQ. ID. NO: 9850, SEQ. ID. NO: 9851, SEQ. ID. NO: 9852, SEQ. ID. NO: 9853, SEQ. ID. NO: 9854, SEQ. ID. NO: 9856, SEQ. ID. NO: 9857, SEQ. ID. NO: 9858, SEQ. ID. NO: 9859, SEQ. ID. NO: 9860, SEQ. ID. NO: 9861, SEQ. ID. NO: 9863, SEQ. ID. NO: 9865, SEQ. ID. NO: 9866, SEQ. ID. NO: 9867, SEQ. ID. NO: 9868, SEQ. ID. NO: 9869, SEQ. ID. NO: 9870, SEQ. ID. NO: 9871, SEQ. ID. NO: 9873, SEQ. ID. NO: 9874, SEQ. ID. NO: 9875, SEQ. ID. NO: 9876, SEQ. ID. NO: 9877, SEQ. ID. NO: 9878, SEQ. ID. NO: 9879, SEQ. ID. NO: 9880, SEQ. ID. NO: 9881, SEQ. ID. NO: 9882, SEQ. ID. NO: 9883, SEQ. ID. NO: 9884, SEQ. ID. NO: 9885, SEQ. ID. NO: 9886, SEQ. ID. NO: 9887, SEQ. ID. NO: 9888, SEQ. ID. NO: 9890, SEQ. ID. NO: 9891, SEQ. ID. NO: 9892, SEQ. ID. NO: 9893, SEQ. ID. NO: 9894, SEQ. ID. NO: 9895, SEQ. ID. NO: 9896, SEQ. ID. NO: 9897, SEQ. ID. NO: 9898, SEQ. ID. NO: 9899, SEQ. ID. NO: 9900, SEQ. ID. NO: 9901, SEQ. ID. NO: 9905, SEQ. ID. NO: 9907, SEQ. ID. NO: 9909, SEQ. ID. NO: 9910, SEQ. ID. NO: 9911, SEQ. ID. NO: 9912, SEQ. ID. NO: 9913, SEQ. ID. NO: 9914, SEQ. ID. NO: 9915, SEQ. ID. NO: 9916, SEQ. ID. NO: 9917, SEQ.

FIG 4 Con't.

ID. NO: 9918, SEQ. ID. NO: 9919, SEQ. ID. NO: 9920, SEQ. ID. NO: 9921, SEQ. ID. NO: 9922, SEQ. ID. NO: 9923, SEQ. ID. NO: 9924, SEQ. ID. NO: 9925, SEQ. ID. NO: 9926, SEQ. ID. NO: 9927, SEQ. ID. NO: 9928, SEQ. ID. NO: 9929, SEQ. ID. NO: 9930, SEQ. ID. NO: 9931, SEQ. ID. NO: 9932, SEQ. ID. NO: 9933, SEQ. ID. NO: 9934, SEQ. ID. NO: 9936, SEQ. ID. NO: 9937, SEQ. ID. NO: 9938, SEQ. ID. NO: 9939, SEQ. ID. NO: 9940, SEQ. ID. NO: 9941, SEQ. ID. NO: 9942, SEQ. ID. NO: 9943, SEQ. ID. NO: 9944, SEQ. ID. NO: 9945, SEQ. ID. NO: 9946, SEQ. ID. NO: 9947, SEQ. ID. NO: 9948, SEQ. ID. NO: 9949, SEQ. ID. NO: 9950, SEQ. ID. NO: 9951, SEQ. ID. NO: 9952, SEQ. ID. NO: 9953, SEQ. ID. NO: 9955, SEQ. ID. NO: 9958, SEQ. ID. NO: 9963, SEQ. ID. NO: 9965, SEQ. ID. NO: 9967, SEQ. ID. NO: 9970, SEQ. ID. NO: 9971, SEQ. ID. NO: 9972, SEQ. ID. NO: 9974, SEQ. ID. NO: 9975, SEQ. ID. NO: 9976, SEQ. ID. NO: 9977, SEQ. ID. NO: 9979, SEQ. ID. NO: 9982, SEQ. ID. NO: 9984, SEQ. ID. NO: 9985, SEQ. ID. NO: 9986, SEQ. ID. NO: 9987, SEQ. ID. NO: 9989, SEQ. ID. NO: 9991, SEQ. ID. NO: 9992, SEQ. ID. NO: 9993, SEQ. ID. NO: 9994, SEQ. ID. NO: 9997, SEQ. ID. NO: 9998, SEQ. ID. NO: 9999, SEQ. ID. NO: 10000, SEQ. ID. NO: 10001, SEQ. ID. NO: 10003, SEQ. ID. NO: 10006, SEQ. ID. NO: 10007, SEQ. ID. NO: 10010, SEQ. ID. NO: 10011, SEQ. ID. NO: 10018, SEQ. ID. NO: 10019, SEQ. ID. NO: 10020, SEQ. ID. NO: 10021, SEQ. ID. NO: 10023, SEQ. ID. NO: 10024, SEQ. ID. NO: 10025, SEQ. ID. NO: 10026, SEQ. ID. NO: 10028, SEQ. ID. NO: 10029, SEQ. ID. NO: 10031, SEQ. ID. NO: 10032, SEQ. ID. NO: 10033, SEQ. ID. NO: 10036, SEQ. ID. NO: 10037, SEQ. ID. NO: 10039, SEQ. ID. NO: 10040, SEQ. ID. NO: 10041, SEQ. ID. NO: 10044, SEQ. ID. NO: 10045, SEQ. ID. NO: 10046, SEQ. ID. NO: 10047, SEQ. ID. NO: 10048, SEQ. ID. NO: 10050, SEQ. ID. NO: 10051, SEQ. ID. NO: 10052, SEQ. ID. NO: 10053, SEQ. ID. NO: 10054, SEQ. ID. NO: 10056, SEQ. ID. NO: 10062, SEQ. ID. NO: 10071, SEQ. ID. NO: 10072, SEQ. ID. NO: 10073, SEQ. ID. NO: 10076, SEQ. ID. NO: 10077, SEQ. ID. NO: 10078.

FIG. 5: A collection of nucleic acid molecules.

SEQ. ID. NO: 913, SEQ. ID. NO: 918, SEQ. ID. NO: 938, SEQ. ID. NO: 946, SEQ. ID. NO: 948, SEQ. ID. NO: 949, SEQ. ID. NO: 956, SEQ. ID. NO: 968, SEQ. ID. NO: 972, SEQ. ID. NO: 982, SEQ. ID. NO: 997, SEQ. ID. NO: 1011, SEQ. ID. NO: 1025, SEQ. ID. NO: 1043, SEQ. ID. NO: 1059, SEQ. ID. NO: 1073, SEQ. ID. NO: 1086, SEQ. ID. NO: 1110, SEQ. ID. NO: 1112, SEQ. ID. NO: 1113, SEQ. ID. NO: 1116, SEQ. ID. NO: 1117, SEQ. ID. NO: 1119, SEQ. ID. NO: 1120, SEQ. ID. NO: 1123, SEQ. ID. NO: 1124, SEQ. ID. NO: 1125, SEQ. ID. NO: 1126, SEQ. ID. NO: 1127, SEQ. ID. NO: 1129, SEQ. ID. NO: 1131, SEQ. ID. NO: 1132, SEQ. ID. NO: 1133, SEQ. ID. NO: 1134, SEQ. ID. NO: 1136, SEQ. ID. NO: 1137, SEQ. ID. NO: 1139, SEQ. ID. NO: 1140, SEQ. ID. NO: 1142, SEQ. ID. NO: 1144, SEQ. ID. NO: 1145, SEQ. ID. NO: 1146, SEQ. ID. NO: 1147, SEQ. ID. NO: 1148, SEQ. ID. NO: 1149, SEQ. ID. NO: 1150, SEQ. ID. NO: 1151, SEQ. ID. NO: 1153, SEQ. ID. NO: 1155, SEQ. ID. NO: 1157, SEQ. ID. NO: 1158, SEQ. ID. NO: 1159, SEQ. ID. NO: 1160, SEQ. ID. NO: 1161, SEQ. ID. NO: 1162, SEQ. ID. NO: 1163, SEQ. ID. NO: 1166, SEQ. ID. NO: 1167, SEQ. ID. NO: 1168, SEQ. ID. NO: 1171, SEQ. ID. NO: 1172, SEQ. ID. NO: 1173, SEQ. ID. NO: 1174, SEQ. ID. NO: 1175, SEQ. ID. NO: 1176, SEQ. ID. NO: 1178, SEQ. ID. NO: 1180, SEQ. ID. NO: 1181, SEQ. ID. NO: 1182, SEQ. ID. NO: 1183, SEQ. ID. NO: 1185, SEQ. ID. NO: 1186, SEQ. ID. NO: 1188, SEQ. ID. NO: 1189, SEQ. ID. NO: 1191, SEQ. ID. NO: 1193, SEQ. ID. NO: 1197, SEQ. ID. NO: 1199, SEQ. ID. NO: 1201, SEQ. ID. NO: 1202, SEQ. ID. NO: 1204, SEQ. ID. NO: 1205, SEQ. ID. NO: 1206, SEQ. ID. NO: 1207, SEQ. ID. NO: 1208, SEQ. ID. NO: 1209, SEQ. ID. NO: 1212, SEQ. ID. NO: 1215, SEQ. ID. NO: 1216, SEQ. ID. NO: 1217, SEQ. ID. NO: 1218, SEQ. ID. NO: 1219, SEQ. ID. NO: 1220, SEQ. ID. NO: 1222, SEQ. ID. NO: 1223, SEQ. ID. NO: 1224, SEQ. ID. NO: 1226, SEQ. ID. NO: 1228, SEQ. ID. NO: 1229, SEQ. ID. NO: 1230, SEQ. ID. NO: 1231, SEQ. ID. NO: 1232, SEQ. ID. NO: 1233, SEQ. ID. NO: 1235, SEQ. ID. NO: 1236, SEQ. ID. NO: 1238, SEQ. ID. NO: 1239, SEQ. ID. NO: 1242, SEQ. ID. NO: 1244, SEQ. ID. NO: 1246, SEQ. ID. NO: 1248, SEQ. ID. NO: 1249, SEQ. ID. NO: 1250, SEQ. ID. NO: 1251, SEQ. ID. NO: 1255, SEQ. ID. NO: 1259, SEQ. ID. NO: 1260, SEQ. ID. NO: 1261, SEQ. ID. NO: 1262, SEQ. ID. NO: 1264, SEQ. ID. NO: 1265, SEQ. ID. NO: 1267, SEQ. ID. NO: 1268, SEQ. ID. NO: 1269, SEQ. ID. NO: 1272, SEQ. ID. NO: 1273, SEQ. ID. NO: 1274, SEQ. ID. NO: 1276, SEQ. ID. NO: 1277, SEQ. ID. NO: 1278, SEQ. ID. NO: 1279, SEQ. ID. NO: 1283, SEQ. ID. NO: 1284, SEQ. ID. NO: 1285, SEQ. ID. NO: 1287, SEQ. ID. NO: 1292, SEQ. ID. NO: 1293, SEQ. ID. NO: 1294, SEQ. ID. NO: 1297, SEQ. ID. NO: 1298, SEQ. ID. NO: 1299, SEQ. ID. NO: 1300, SEQ. ID. NO: 1301, SEQ. ID. NO: 1302, SEQ. ID. NO: 1303, SEQ. ID. NO: 1304, SEQ. ID. NO: 1308, SEQ. ID. NO: 1309, SEQ. ID. NO: 1310, SEQ. ID. NO: 1311, SEQ. ID. NO: 1313, SEQ. ID. NO: 1314, SEQ. ID. NO: 1315, SEQ. ID. NO: 1318, SEQ. ID. NO: 1320, SEQ. ID. NO: 1322, SEQ. ID. NO: 1323, SEQ. ID. NO: 1324, SEQ. ID. NO: 1325, SEQ. ID. NO: 1327, SEQ. ID. NO: 1328, SEQ. ID. NO: 1329, SEQ. ID. NO: 1330, SEQ. ID. NO: 1331, SEQ. ID. NO: 1333, SEQ. ID. NO: 1334, SEQ. ID. NO: 1336, SEQ. ID. NO: 1337, SEQ. ID. NO: 1338, SEQ. ID. NO: 1340, SEQ. ID. NO: 1341, SEQ. ID. NO: 1345, SEQ. ID. NO: 1346, SEQ. ID. NO: 1348, SEQ. ID. NO: 1350, SEQ. ID. NO: 1352, SEQ. ID. NO: 1353, SEQ. ID. NO: 1355, SEQ. ID. NO: 1356, SEQ. ID. NO: 1358, SEQ. ID. NO: 1359, SEQ. ID. NO: 1360, SEQ. ID. NO: 1363, SEQ. ID. NO: 1364, SEQ. ID. NO: 1365, SEQ. ID. NO: 1366, SEQ. ID. NO: 1368, SEQ. ID. NO: 1369, SEQ. ID. NO: 1372, SEQ. ID. NO: 1373, SEQ. ID. NO: 1374, SEQ. ID. NO: 1376, SEQ. ID. NO: 1377, SEQ. ID. NO: 1378, SEQ. ID. NO: 1379, SEQ. ID. NO: 1380, SEQ. ID. NO: 1381, SEQ. ID. NO: 1382, SEQ. ID. NO: 1383, SEQ. ID. NO: 1385, SEQ. ID. NO: 1386, SEQ. ID. NO: 1389, SEQ. ID. NO: 1391, SEQ. ID. NO: 1394, SEQ. ID. NO: 1396, SEQ. ID. NO: 1398, SEQ. ID. NO: 1399, SEQ. ID. NO: 1400, SEQ. ID. NO: 1403, SEQ. ID. NO: 1406, SEQ. ID. NO: 1407, SEQ. ID. NO: 1408, SEQ. ID. NO: 1409, SEQ. ID. NO: 1410, SEQ. ID. NO: 1412, SEQ. ID. NO: 1413, SEQ. ID. NO: 1415, SEQ. ID. NO: 1416, SEQ. ID. NO: 1417, SEQ. ID. NO: 1418, SEQ. ID. NO: 1420, SEQ. ID. NO: 1421, SEQ. ID. NO: 1424, SEQ. ID. NO: 1428, SEQ. ID. NO: 1429, SEQ. ID. NO: 1430, SEQ. ID. NO: 1433, SEQ. ID. NO: 1435, SEQ. ID. NO: 1437, SEQ. ID. NO: 1438, SEQ. ID. NO: 1439, SEQ. ID. NO: 1440, SEQ. ID. NO: 1441, SEQ. ID. NO: 1443, SEQ. ID. NO: 1444, SEQ. ID. NO: 1446, SEQ. ID. NO: 1447, SEQ. ID. NO: 1449, SEQ. ID. NO: 1452, SEQ. ID. NO: 1453, SEQ. ID. NO: 1457, SEQ. ID. NO: 1458, SEQ. ID. NO: 1461, SEQ. ID. NO: 1462, SEQ. ID. NO: 1463, SEQ. ID. NO: 1464, SEQ. ID. NO: 1467, SEQ. ID. NO: 1468, SEQ. ID. NO: 1470, SEQ. ID. NO: 1471, SEQ. ID. NO: 1473, SEQ. ID. NO: 1474, SEQ. ID. NO: 1476, SEQ. ID. NO: 1478, SEQ. ID. NO: 1480, SEQ. ID. NO: 1482, SEQ. ID. NO: 1486, SEQ. ID. NO: 1488, SEQ. ID. NO: 1490, SEQ. ID. NO: 1492, SEQ. ID. NO: 1495, SEQ. ID. NO: 1496, SEQ. ID. NO: 1498, SEQ. ID. NO: 1499, SEQ. ID. NO: 1501, SEQ. ID. NO: 1502, SEQ. ID. NO: 1503, SEQ. ID. NO: 1504, SEQ. ID. NO: 1507, SEQ. ID. NO: 1509, SEQ. ID. NO: 1510, SEQ. ID. NO: 1512, SEQ. ID. NO: 1514, SEQ. ID. NO: 1515, SEQ. ID. NO: 1516, SEQ. ID. NO: 1518, SEQ. ID. NO: 1519, SEQ. ID. NO: 1521, SEQ. ID. NO: 1522, SEQ. ID. NO: 1525, SEQ. ID. NO: 1527, SEQ. ID. NO: 1529, SEQ. ID. NO: 1531, SEQ. ID. NO: 1532, SEQ. ID. NO: 1533, SEQ. ID. NO: 1534, SEQ. ID. NO: 1536, SEQ. ID. NO: 1538, SEQ. ID. NO: 1540, SEQ. ID. NO: 1542, SEQ. ID. NO: 1543, SEQ. ID. NO: 1544, SEQ. ID. NO: 1546, SEQ. ID. NO: 1547, SEQ. ID. NO: 1549, SEQ. ID. NO: 1550, SEQ. ID. NO: 1551, SEQ. ID. NO: 1552, SEQ. ID. NO: 1556, SEQ. ID. NO: 1557, SEQ. ID. NO: 1558, SEQ. ID. NO: 1559, SEQ. ID. NO: 1562, SEQ. ID. NO: 1566, SEQ. ID. NO: 1570, SEQ. ID. NO: 1571, SEQ. ID. NO: 1572, SEQ. ID. NO: 1573, SEQ. ID. NO: 1574, SEQ. ID. NO: 1575, SEQ. ID. NO: 1576, SEQ. ID. NO: 1577, SEQ. ID. NO: 1578, SEQ. ID. NO: 1580, SEQ. ID. NO: 1581, SEQ. ID. NO: 1583, SEQ. ID. NO: 1585, SEQ. ID. NO: 1586, SEQ. ID. NO: 1587, SEQ. ID. NO: 1589, SEQ. ID. NO: 1590, SEQ. ID. NO: 1592, SEQ. ID. NO: 1594, SEQ. ID. NO: 1595, SEQ. ID. NO: 1596,

FIG. 5 Con't.

SEQ. ID. NO: 1597, SEQ. ID. NO: 1598, SEQ. ID. NO: 1599, SEQ. ID. NO: 1600, SEQ. ID. NO: 1602, SEQ. ID. NO: 1604, SEQ. ID. NO: 1606, SEQ. ID. NO: 1607, SEQ. ID. NO: 1609, SEQ. ID. NO: 1616, SEQ. ID. NO: 1617, SEQ. ID. NO: 1619, SEQ. ID. NO: 1621, SEQ. ID. NO: 1624, SEQ. ID. NO: 1626, SEQ. ID. NO: 1627, SEQ. ID. NO: 1629, SEQ. ID. NO: 1630, SEQ. ID. NO: 1631, SEQ. ID. NO: 1633, SEQ. ID. NO: 1636, SEQ. ID. NO: 1641, SEQ. ID. NO: 1644, SEQ. ID. NO: 1646, SEQ. ID. NO: 1647, SEQ. ID. NO: 1648, SEQ. ID. NO: 1649, SEQ. ID. NO: 1650, SEQ. ID. NO: 1653, SEQ. ID. NO: 1654, SEQ. ID. NO: 1657, SEQ. ID. NO: 1658, SEQ. ID. NO: 1659, SEQ. ID. NO: 1663, SEQ. ID. NO: 1664, SEQ. ID. NO: 1666, SEQ. ID. NO: 1667, SEQ. ID. NO: 1672, SEQ. ID. NO: 1674, SEQ. ID. NO: 1675, SEQ. ID. NO: 1676, SEQ. ID. NO: 1681, SEQ. ID. NO: 1683, SEQ. ID. NO: 1684, SEQ. ID. NO: 1685, SEQ. ID. NO: 10079, SEQ. ID. NO: 10080, SEQ. ID. NO: 10081, SEQ. ID. NO: 10082, SEQ. ID. NO: 10083, SEQ. ID. NO: 10084, SEQ. ID. NO: 10085, SEQ. ID. NO: 10086, SEQ. ID. NO: 10087, SEQ. ID. NO: 10088, SEQ. ID. NO: 10089, SEQ. ID. NO: 10090, SEQ. ID. NO: 10091, SEQ. ID. NO: 10092, SEQ. ID. NO: 10094, SEQ. ID. NO: 10097, SEQ. ID. NO: 10099, SEQ. ID. NO: 10101, SEQ. ID. NO: 10102, SEQ. ID. NO: 10103, SEQ. ID. NO: 10104, SEQ. ID. NO: 10105, SEQ. ID. NO: 10106.

FIG. 6: A collection of nucleic acid molecules.

SEQ. ID. NO: 938, SEQ. ID. NO: 948, SEQ. ID. NO: 949, SEQ. ID. NO: 952, SEQ. ID. NO: 956, SEQ. ID. NO: 967, SEQ. ID. NO: 970, SEQ. ID. NO: 972, SEQ. ID. NO: 982, SEQ. ID. NO: 996, SEQ. ID. NO: 1024, SEQ. ID. NO: 1040, SEQ. ID. NO: 1086, SEQ. ID. NO: 8972, SEQ. ID. NO: 9080.

FIG. 7: A collection of nucleic acid molecules.

SEQ. ID. NO: 938, SEQ. ID. NO: 948, SEQ. ID. NO: 949, SEQ. ID. NO: 956, SEQ. ID. NO: 968, SEQ. ID. NO: 972, SEQ. ID. NO: 982, SEQ. ID. NO: 997, SEQ. ID. NO: 1025, SEQ. ID. NO: 1043, SEQ. ID. NO: 1086, SEQ. ID. NO: 1110, SEQ. ID. NO: 1112, SEQ. ID. NO: 1116, SEQ. ID. NO: 1117, SEQ. ID. NO: 1119, SEQ. ID. NO: 1120, SEQ. ID. NO: 1123, SEQ. ID. NO: 1126, SEQ. ID. NO: 1127, SEQ. ID. NO: 1129, SEQ. ID. NO: 1131, SEQ. ID. NO: 1133, SEQ. ID. NO: 1139, SEQ. ID. NO: 1142, SEQ. ID. NO: 1144, SEQ. ID. NO: 1145, SEQ. ID. NO: 1146, SEQ. ID. NO: 1147, SEQ. ID. NO: 1148, SEQ. ID. NO: 1149, SEQ. ID. NO: 1150, SEQ. ID. NO: 1151, SEQ. ID. NO: 1153, SEQ. ID. NO: 1155, SEQ. ID. NO: 1157, SEQ. ID. NO: 1158, SEQ. ID. NO: 1160, SEQ. ID. NO: 1161, SEQ. ID. NO: 1162, SEQ. ID. NO: 1166, SEQ. ID. NO: 1167, SEQ. ID. NO: 1168, SEQ. ID. NO: 1171, SEQ. ID. NO: 1172, SEQ. ID. NO: 1173, SEQ. ID. NO: 1174, SEQ. ID. NO: 1175, SEQ. ID. NO: 1176, SEQ. ID. NO: 1180, SEQ. ID. NO: 1181, SEQ. ID. NO: 1183, SEQ. ID. NO: 1186, SEQ. ID. NO: 1189, SEQ. ID. NO: 1191, SEQ. ID. NO: 1197, SEQ. ID. NO: 1199, SEQ. ID. NO: 1201, SEQ. ID. NO: 1202, SEQ. ID. NO: 1204, SEQ. ID. NO: 1205, SEQ. ID. NO: 1206, SEQ. ID. NO: 1207, SEQ. ID. NO: 1208, SEQ. ID. NO: 1209, SEQ. ID. NO: 1212, SEQ. ID. NO: 1215, SEQ. ID. NO: 1216, SEQ. ID. NO: 1217, SEQ. ID. NO: 1218, SEQ. ID. NO: 1219, SEQ. ID. NO: 1220, SEQ. ID. NO: 1222, SEQ. ID. NO: 1223, SEQ. ID. NO: 1224, SEQ. ID. NO: 1228, SEQ. ID. NO: 1229, SEQ. ID. NO: 1230, SEQ. ID. NO: 1232, SEQ. ID. NO: 1236, SEQ. ID. NO: 1238, SEQ. ID. NO: 1239, SEQ. ID. NO: 1242, SEQ. ID. NO: 1246, SEQ. ID. NO: 1248, SEQ. ID. NO: 1251, SEQ. ID. NO: 1255, SEQ. ID. NO: 1259, SEQ. ID. NO: 1260, SEQ. ID. NO: 1261, SEQ. ID. NO: 1264, SEQ. ID. NO: 1265, SEQ. ID. NO: 1267, SEQ. ID. NO: 1268, SEQ. ID. NO: 1272, SEQ. ID. NO: 1277, SEQ. ID. NO: 1278, SEQ. ID. NO: 1279, SEQ. ID. NO: 1283, SEQ. ID. NO: 1284, SEQ. ID. NO: 1285, SEQ. ID. NO: 1287, SEQ. ID. NO: 1292, SEQ. ID. NO: 1293, SEQ. ID. NO: 1294, SEQ. ID. NO: 1297, SEQ. ID. NO: 1298, SEQ. ID. NO: 1299, SEQ. ID. NO: 1300, SEQ. ID. NO: 1301, SEQ. ID. NO: 1304, SEQ. ID. NO: 1308, SEQ. ID. NO: 1309, SEQ. ID. NO: 1310, SEQ. ID. NO: 1314, SEQ. ID. NO: 1318, SEQ. ID. NO: 1322, SEQ. ID. NO: 1323, SEQ. ID. NO: 1324, SEQ. ID. NO: 1327, SEQ. ID. NO: 1329, SEQ. ID. NO: 1330, SEQ. ID. NO: 1334, SEQ. ID. NO: 1336, SEQ. ID. NO: 1337, SEQ. ID. NO: 1340, SEQ. ID. NO: 1341, SEQ. ID. NO: 1345, SEQ. ID. NO: 1346, SEQ. ID. NO: 1348, SEQ. ID. NO: 1352, SEQ. ID. NO: 1353, SEQ. ID. NO: 1355, SEQ. ID. NO: 1356, SEQ. ID. NO: 1358, SEQ. ID. NO: 1359, SEQ. ID. NO: 1360, SEQ. ID. NO: 1364, SEQ. ID. NO: 1365, SEQ. ID. NO: 1368, SEQ. ID. NO: 1369, SEQ. ID. NO: 1372, SEQ. ID. NO: 1377, SEQ. ID. NO: 1378, SEQ. ID. NO: 1379, SEQ. ID. NO: 1380, SEQ. ID. NO: 1381, SEQ. ID. NO: 1382, SEQ. ID. NO: 1383, SEQ. ID. NO: 1385, SEQ. ID. NO: 1386, SEQ. ID. NO: 1389, SEQ. ID. NO: 1394, SEQ. ID. NO: 1396, SEQ. ID. NO: 1399, SEQ. ID. NO: 1400, SEQ. ID. NO: 1406, SEQ. ID. NO: 1407, SEQ. ID. NO: 1408, SEQ. ID. NO: 1409, SEQ. ID. NO: 1410, SEQ. ID. NO: 1412, SEQ. ID. NO: 1413, SEQ. ID. NO: 1415, SEQ. ID. NO: 1416, SEQ. ID. NO: 1417, SEQ. ID. NO: 1418, SEQ. ID. NO: 1420, SEQ. ID. NO: 1421, SEQ. ID. NO: 1424, SEQ. ID. NO: 1428, SEQ. ID. NO: 1429, SEQ. ID. NO: 1430, SEQ. ID. NO: 1438, SEQ. ID. NO: 1444, SEQ. ID. NO: 1447, SEQ. ID. NO: 1452, SEQ. ID. NO: 1457, SEQ. ID. NO: 1458, SEQ. ID. NO: 1468, SEQ. ID. NO: 1470, SEQ. ID. NO: 1471, SEQ. ID. NO: 1486, SEQ. ID. NO: 1488, SEQ. ID. NO: 1490, SEQ. ID. NO: 1492, SEQ. ID. NO: 1496, SEQ. ID. NO: 1498, SEQ. ID. NO: 1499, SEQ. ID. NO: 1502, SEQ. ID. NO: 1503, SEQ. ID. NO: 1509, SEQ. ID. NO: 1510, SEQ. ID. NO: 1512, SEQ. ID. NO: 1519, SEQ. ID. NO: 1532, SEQ. ID. NO: 1536, SEQ. ID. NO: 1540, SEQ. ID. NO: 1543, SEQ. ID. NO: 1544, SEQ. ID. NO: 1546, SEQ. ID. NO: 1547, SEQ. ID. NO: 1549, SEQ. ID. NO: 1550, SEQ. ID. NO: 1556, SEQ. ID. NO: 1557, SEQ. ID. NO: 1558, SEQ. ID. NO: 1562, SEQ. ID. NO: 1566, SEQ. ID. NO: 1570, SEQ. ID. NO: 1571, SEQ. ID. NO: 1572, SEQ. ID. NO: 1576, SEQ. ID. NO: 1583, SEQ. ID. NO: 1594, SEQ. ID. NO: 1595, SEQ. ID. NO: 1597, SEQ. ID. NO: 1604, SEQ. ID. NO: 1606, SEQ. ID. NO: 1616, SEQ. ID. NO: 1617, SEQ. ID. NO: 1619, SEQ. ID. NO: 1621, SEQ. ID. NO: 1626, SEQ. ID. NO: 1627, SEQ. ID. NO: 1631, SEQ. ID. NO: 1633, SEQ. ID. NO: 1644, SEQ. ID. NO: 1647, SEQ. ID. NO: 1649, SEQ. ID. NO: 1653, SEQ. ID. NO: 1659, SEQ. ID. NO: 1674, SEQ. ID. NO: 1683, SEQ. ID. NO: 1684, SEQ. ID. NO: 10080, SEQ. ID. NO: 10081, SEQ. ID. NO: 10082, SEQ. ID. NO: 10084, SEQ. ID. NO: 10090, SEQ. ID. NO: 10091, SEQ. ID. NO: 10092, SEQ. ID. NO: 10099, SEQ. ID. NO: 10105.

FIG. 8: A collection of nucleic acid molecules.

SEQ. ID. NO: 13, SEQ. ID. NO: 118, SEQ. ID. NO: 119, SEQ. ID. NO: 122, SEQ. ID. NO: 127, SEQ. ID. NO: 129, SEQ. ID. NO: 134, SEQ. ID. NO: 142, SEQ. ID. NO: 165, SEQ. ID. NO: 169, SEQ. ID. NO: 172, SEQ. ID. NO: 174, SEQ. ID. NO: 177, SEQ. ID. NO: 180, SEQ. ID. NO: 185, SEQ. ID. NO: 189, SEQ. ID. NO: 197, SEQ. ID. NO: 216, SEQ. ID. NO: 221, SEQ. ID. NO: 223, SEQ. ID. NO: 225, SEQ. ID. NO: 236, SEQ. ID. NO: 240, SEQ. ID. NO: 278, SEQ. ID. NO: 282, SEQ. ID. NO: 283, SEQ. ID. NO: 285, SEQ. ID. NO: 287, SEQ. ID. NO: 295, SEQ. ID. NO: 297, SEQ. ID. NO: 306, SEQ. ID. NO: 309, SEQ. ID. NO: 310, SEQ. ID. NO: 317, SEQ. ID. NO: 320, SEQ. ID. NO: 322, SEQ. ID. NO: 325, SEQ. ID. NO: 328, SEQ. ID. NO: 334, SEQ. ID. NO: 349, SEQ. ID. NO: 353, SEQ. ID. NO: 354, SEQ. ID. NO: 358, SEQ. ID. NO: 384, SEQ. ID. NO: 386, SEQ. ID. NO: 390.

FIG. 9: A collection of nucleic acid molecules.

SEQ. ID. NO: 118, SEQ. ID. NO: 129, SEQ. ID. NO: 134, SEQ. ID. NO: 172, SEQ. ID. NO: 287, SEQ. ID. NO: 297, SEQ. ID. NO: 334, SEQ. ID. NO: 349, SEQ. ID. NO: 384, SEQ. ID. NO: 390

Dual color image of part of the raw microarray expression results for normal lung tissue (red) compared to adenoma tumor material (green). microRNAs that are upregulated or downregulated in tumor material show up as green and red, SEQ. ID. NO. respectively. microRNAs that do not change expression are yellow and non-expressed microRNAs appear black.

FIG. 11 differential expressed microRNAs between glioblastoma and normal control brain tissue

| | cand_id | human_hairpin | mouse_hairpin | intensity | log2(tumor / normal) | fold-change | Human patent_id | Mouse patent_id |
|---|---|---|---|---|---|---|---|---|
| 1 | mmHP1417069 | N/D | N/D | 9 | -2.88 | -7.4 | - | - |
| 2 | mmHP1417070 | mmu-mir-26a-2 | mmu-mir-26a-2 | 8.9 | -2.67 | -6.4 | - | - |
| 3 | cand706 | N/D | N/D | 10.5 | -2.58 | -6.0 | - | - |
| 4 | cand74 | mmu-mir-181a-1 | mmu-mir-181a-1 | 9 | -2.49 | -5.6 | - | - |
| 5 | mmu-mir-103-2 | mmu-mir-103-2 | mmu-mir-103-2 | 8.5 | -2.24 | -4.7 | - | - |
| 6 | cand943 | mmu-mir-128b | mmu-mir-128b | 7.5 | -2.19 | -4.6 | - | - |
| 7 | cand104 | N/D | N/D | 7.7 | -2.14 | -4.4 | - | - |
| 8 | cand225 | Hsd_from_Mmd_215 | Mmd_215 | 13.4 | -2.1 | -4.3 | 172 | 519 |
| 9 | cand284 | N/D | N/D | 7.9 | -2.08 | -4.2 | - | - |
| 10 | cand8 | Hsd_from_Mmd_416 | Mmd_416 | 7.7 | -2.08 | -4.2 | 287 | 732 |
| 11 | cand106 | mmu-let-7d | mmu-let-7d | 8.1 | -2.05 | -4.1 | - | - |
| 12 | cand578 | Hsd_from_Mmd_120 | Mmd_120 | 14.1 | -2.04 | -4.1 | 118 | 415 |
| 13 | cand226 | mmu-let-7e | mmu-let-7e | 8.1 | -2.03 | -4.1 | - | - |
| 14 | cand137 | mmu-mir-30e | mmu-mir-30e | 7.7 | -1.89 | -3.7 | - | - |
| 15 | cand277 | mmu-mir-103-1 | mmu-mir-103-1 | 9.1 | -1.83 | -3.6 | - | - |
| 16 | cand928 | N/D | N/D | 7.9 | -1.78 | -3.4 | - | - |
| 17 | cand358 | mmu-mir-107 | mmu-mir-107 | 9 | -1.69 | -3.2 | - | - |
| 18 | cand482 | Hsd_from_Mmd_98 | Mmd_98 | 7.7 | -1.64 | -3.1 | 390 | 903 |
| 19 | cand315 | N/D | N/D | 8.2 | -1.61 | -3.1 | - | - |
| 20 | cand369 | N/D | N/D | 7.2 | -1.56 | -2.9 | - | - |
| 21 | cand683 | Hsd_from_Mmd_511 | Mmd_511 | 9.3 | -1.55 | -2.9 | 349 | 833 |
| 22 | cand94 | mmu-mir-185 | mmu-mir-185 | 7.4 | -1.53 | -2.9 | - | - |
| 23 | cand306 | mmu-mir-320 | mmu-mir-320 | 7.8 | -1.51 | -2.8 | - | - |
| 24 | cand566 | N/D | Mmd_36 | 9.9 | -1.42 | -2.7 | - | 671 |
| 25 | mmHP2810075 | N/D | Mmd_434 | 8.4 | -1.38 | -2.6 | - | 752 |
| 26 | cand732 | Hsd_from_Mmd_49 | Mmd_49 | 11.2 | -1.26 | -2.4 | 334 | 809 |
| 27 | cand98 | Hsd_from_Mmd_41 | Mmd_41 | 9 | -1.25 | -2.4 | 282 | 725 |
| 28 | cand135 | N/D | N/D | 7.6 | -1.23 | -2.3 | - | - |
| 29 | cand192 | Hsd_from_Mmd_433 | Mmd_433 | 10 | -1.16 | -2.2 | 297 | 751 |
| 30 | cand629 | Hsd_from_Mmd_91 | Mmd_91 | 8.4 | -1.12 | -2.2 | 384 | 896 |
| 31 | cand341 | mmu-mir-19b-2 | mmu-mir-19b-2 | 7.7 | -1.1 | -2.1 | - | - |
| 32 | mmHP1181578 | N/D | N/D | 7.2 | -1.09 | -2.1 | - | - |
| 33 | cand674 | Hsd_from_Mmd_155 | Mmd_155 | 10 | -1.07 | -2.1 | 134 | 453 |
| 34 | cand497 | N/D | N/D | 7.1 | -1.06 | -2.1 | - | - |
| 35 | cand852 | N/D | Mmd_312 | 7.7 | -1.02 | -2.0 | - | 620 |
| 36 | mmu-mir-19b-1 | mmu-mir-19b-1 | mmu-mir-19b-1 | 7.8 | -1.02 | -2.0 | - | - |
| 37 | mmHP1778980 | N/D | Mmd_453 | 11.9 | 1.08 | 2.1 | - | 772 |
| 38 | cand160 | N/D | N/D | 9.9 | 1.11 | 2.2 | - | - |
| 39 | mmu-mir-329 | mmu-mir-329 | mmu-mir-329 | 11.4 | 1.12 | 2.2 | - | - |
| 40 | mmHP1170304 | N/D | Mmd_242 | 11.8 | 1.13 | 2.2 | - | 546 |
| 41 | cand356 | Hsd_from_Mmd_147 | Mmd_147 | 11.8 | 1.14 | 2.2 | 129 | 444 |
| 42 | cand913 | N/D | Mmd_121 | 15.7 | 1.36 | 2.6 | - | 416 |
| 43 | cand631 | N/D | Mmd_351 | 13.6 | 1.47 | 2.8 | - | 662 |
| 44 | cand189 | mmu-mir-21 | mmu-mir-21 | 8.4 | 2.82 | 7.1 | - | - |
| 45 | cand403 | N/D | Mmd_342 | 9 | 3.97 | 15.7 | - | 652 |

Total RNA was isolated from human tumor material and normal control brain tissue using a Trizol-based method. Samples were labelled using Kreatech ULS microRNA reagents and hybridized to custom-spotted Codelink microarrays that contained 847 different microRNA probes (DNA backbone), including about 150 known microRNAs. Each probe was represented 8 times on every slide. Microarray images were processed with FeatureExtractor software and the data was analyzed using limma package (Bioconductor). N/D not determined.

FIG. 12 differential expressed microRNAs between adenoma and normal control lung tissue

| | cand_id | human_hairpin | mouse_hairpin | intensity | log2 (tumor / normal) | fold-change | Human patent_id | Mouse patent_id |
|---|---|---|---|---|---|---|---|---|
| 1 | cand631 | N/D | Mmd_351 | 8.6 | -4.87 | -29.2 | - | 662 |
| 2 | mmHP1778980 | N/D | Mmd_453 | 8.3 | -3.77 | -13.6 | - | 772 |
| 3 | cand578 | Hsd_from_Mmd_120 | Mmd_120 | 11.8 | -3.25 | -9.5 | 118 | 415 |
| 4 | cand225 | Hsd_from_Mmd_215 | Mmd_215 | 9.9 | -2.95 | -7.7 | 172 | 519 |
| 5 | mmHP1170304 | N/D | Mmd_242 | 7.8 | -2.85 | -7.2 | - | 546 |
| 6 | cand326 | Hsd_from_Mmd_410 | Mmd_410 | 7.8 | -2.83 | -7.1 | 283 | 726 |
| 7 | cand706 | N/D | N/D | 12 | -2.69 | -6.5 | - | - |
| 8 | cand356 | Hsd_from_Mmd_147 | Mmd_147 | 8 | -2.36 | -5.1 | 129 | 444 |
| 9 | cand370 | mmu-mir-326 | mmu-mir-326 | 7.5 | -2.32 | -5.0 | - | - |
| 10 | cand445 | Hsd_from_Mmd_301 | Mmd_301 | 7.7 | -2.15 | -4.4 | 225 | 609 |
| 11 | cand192 | Hsd_from_Mmd_433 | Mmd_433 | 8.4 | -2.07 | -4.2 | 297 | 751 |
| 12 | mmu-mir-329 | mmu-mir-329 | mmu-mir-329 | 7.6 | -2.02 | -4.1 | - | - |
| 13 | cand884a | mmu-mir-125b-1 | mmu-mir-125b-1 | 7.5 | -1.89 | -3.7 | - | - |
| 14 | cand856 | mmu-mir-184 | mmu-mir-184 | 8.3 | -1.83 | -3.6 | - | - |
| 15 | cand674 | Hsd_from_Mmd_155 | Mmd_155 | 8.8 | -1.81 | -3.5 | 134 | 453 |
| 16 | cand540 | Hsd_from_Mmd_45 | Mmd_45 | 7.3 | -1.78 | -3.4 | 306 | 768 |
| 17 | cand418 | N/D | Mmd_218 | 7.6 | -1.77 | -3.4 | - | 522 |
| 18 | cand711 | Hsd_from_Mmd_167 | Mmd_167 | 7.5 | -1.76 | -3.4 | 142 | 466 |
| 19 | cand141 | Hsd_from_Mmd_472 | Mmd_472 | 7.4 | -1.75 | -3.4 | 320 | 791 |
| 20 | mmu-mir-370 | mmu-mir-370 | mmu-mir-370 | 7.5 | -1.72 | -3.3 | - | - |
| 21 | cand87 | Hsd_from_Mmd_245 | Mmd_245 | 7.5 | -1.69 | -3.2 | 189 | 549 |
| 22 | cand170 | mmu-mir-19a | mmu-mir-19a | 8.1 | -1.65 | -3.1 | - | - |
| 23 | mmHP291564 | N/D | Mmd_135 | 7.3 | -1.59 | -3.0 | - | 431 |
| 24 | cand224 | Hsd_from_Mmd_324 | Mmd_324 | 7.3 | -1.51 | -2.8 | 236 | 632 |
| 25 | mmu-mir-350 | mmu-mir-350 | mmu-mir-350 | 7.7 | -1.47 | -2.8 | - | - |
| 26 | mmu-mir-150 | mmu-mir-150 | mmu-mir-150 | 7.2 | -1.46 | -2.8 | - | - |
| 27 | cand162 | Hsd_from_Mmd_33 | Mmd_33 | 8.6 | -1.38 | -2.6 | 240 | 638 |
| 28 | cand447 | Hsd_from_Mmd_123 | Mmd_123 | 7.2 | -1.31 | -2.5 | 119 | 418 |
| 29 | cand254 | Hsd_11 | Mmd_11 | 7.1 | -1.24 | -2.4 | 13 | 403 |
| 30 | cand8 | Hsd_from_Mmd_416 | Mmd_416 | 10.7 | -1.23 | -2.3 | 287 | 732 |
| 31 | cand784a | N/D | MM_129 | 7.9 | -1.21 | -2.3 | - | 4284 |
| 32 | cand647 | mmu-mir-182 | mmu-mir-182 | 7.1 | -1.19 | -2.3 | - | - |
| 33 | cand510 | mmu-mir-145 | mmu-mir-145 | 7.2 | -1.18 | -2.3 | - | - |
| 34 | cand678 | N/D | Mmd_153 | 7.4 | -1.18 | -2.3 | - | 451 |
| 35 | mmu-mir-339 | mmu-mir-339 | mmu-mir-339 | 7.1 | -1.18 | -2.3 | - | - |
| 36 | cand291 | mmu-mir-196b | mmu-mir-196b | 7.1 | -1.11 | -2.2 | - | - |
| 37 | cand516 | N/D | Mmd_400 | 9.8 | -1.11 | -2.2 | - | 715 |
| 38 | cand963 | Hsd_from_Mmd_480 | Mmd_480 | 7.6 | 1 | 2.0 | 325 | 799 |
| 39 | cand342 | mmu-mir-92-2 | mmu-mir-92-2 | 7.4 | 1.01 | 2.0 | - | - |
| 40 | cand620 | Hsd_from_Mmd_141 | Mmd_141 | 6.2 | 1.03 | 2.0 | 127 | 438 |
| 41 | mmHP855413 | N/D | Mmd_216 | 6.7 | 1.13 | 2.2 | - | 520 |
| 42 | cand683 | Hsd_from_Mmd_511 | Mmd_511 | 7.5 | 1.15 | 2.2 | 349 | 833 |
| 43 | cand541 | Hsd_from_Mmd_228 | Mmd_228 | 7.2 | 1.16 | 2.2 | 180 | 180 |
| 44 | cand466 | Hsd_from_Mmd_235 | Mmd_235 | 8.4 | 1.19 | 2.3 | 185 | 539 |
| 45 | cand239 | Hsd_from_Mmd_456 | Mmd_456 | 7.2 | 1.23 | 2.3 | 310 | 775 |
| 46 | cand331 | Hsd_from_Mmd_93 | Mmd_93 | 10 | 1.25 | 2.4 | 386 | 898 |
| 47 | mmHP874966 | N/D | Mmd_309 | 8.2 | 1.27 | 2.4 | - | 616 |
| 48 | mmHP2052148 | N/D | Mmd_83 | 6.7 | 1.31 | 2.5 | - | 887 |
| 49 | mmHP901055 | N/D | N/D | 6.3 | 1.31 | 2.5 | - | - |
| 50 | cand190 | Hsd_from_Mmd_455 | Mmd_455 | 7.1 | 1.33 | 2.5 | 309 | 774 |
| 51 | cand852 | N/D | Mmd_312 | 7.2 | 1.45 | 2.8 | - | 620 |
| 52 | cand271 | Hsd_from_Mmd_483 | Mmd_483 | 8.1 | 1.47 | 2.8 | 328 | 802 |
| 53 | mmu-mir-296 | mmu-mir-296 | mmu-mir-296 | 7.4 | 1.53 | 2.9 | - | - |

FIG. 12 Con't.

differential expressed microRNAs between adenoma and normal control lung tissue

| | cand_id | human_hairpin | mouse_hairpin | intensity log2 | fold-change | Human patent_id | Mouse patent_id |
|---|---|---|---|---|---|---|---|
| | | | | (tumor / normal) | | | |
| 54 | cand478 | Hsd_from_Mmd_219 | Mmd_219 | 6.6 | 1.55 | 2.9 | 174 | 523 |
| 55 | cand667 | N/D | N/D | 9.8 | 1.57 | 3.0 | - | - |
| 56 | cand629 | Hsd_from_Mmd_91 | Mmd_91 | 9.9 | 1.61 | 3.1 | 384 | 896 |
| 57 | mmHP533267 | N/D | Mmd_21 | 6.9 | 1.62 | 3.1 | - | 513 |
| 58 | cand607 | Hsd_from_Mmd_430 | Mmd_430 | 6.8 | 1.63 | 3.1 | 295 | 748 |
| 59 | cand676 | Hsd_from_Mmd_519 | Mmd_519 | 6.9 | 1.67 | 3.2 | 354 | 839 |
| 60 | mmu-mir-134 | mmu-mir-134 | mmu-mir-134 | 5.8 | 1.72 | 3.3 | - | - |
| 61 | cand189 | mmu-mir-21 | mmu-mir-21 | 15.2 | 1.8 | 3.5 | - | - |
| 62 | cand460 | N/D | Mmd_331 | 8.4 | 1.84 | 3.6 | - | 640 |
| 63 | cand690 | N/D | Mmd_349 | 6.5 | 1.84 | 3.6 | - | 659 |
| 64 | cand458 | Hsd_from_Mmd_225 | Mmd_225 | 6.4 | 1.86 | 3.6 | 177 | 177 |
| 65 | mmHP2682003 | N/D | Mmd_104 | 6.3 | 1.88 | 3.7 | - | 397 |
| 66 | cand658 | N/D | Mmd_164 | 7.2 | 1.9 | 3.7 | - | 463 |
| 67 | cand223 | mmu-mir-203 | mmu-mir-203 | 7.1 | 1.93 | 3.8 | - | - |
| 68 | cand380 | mmu-mir-200b | mmu-mir-200b | 6.7 | 1.93 | 3.8 | - | - |
| 69 | mmu-mir-188 | mmu-mir-188 | mmu-mir-188 | 7.4 | 1.93 | 3.8 | - | - |
| 70 | cand482 | Hsd_from_Mmd_98 | Mmd_98 | 11.4 | 2.05 | 4.1 | 390 | 903 |
| 71 | cand617 | Hsd_from_Mmd_129 | Mmd_129 | 7.2 | 2.06 | 4.2 | 122 | 424 |
| 72 | cand300 | mmu-mir-93 | mmu-mir-93 | 6.7 | 2.13 | 4.4 | - | - |
| 73 | cand790 | Hsd_from_Mmd_518 | Mmd_518 | 6.7 | 2.15 | 4.4 | 353 | 838 |
| 74 | cand686 | Hsd_from_Mmd_299 | Mmd_299 | 7.1 | 2.17 | 4.5 | 223 | 805 |
| 75 | mmHP453167 | Hsd_from_Mmd_412 | Mmd_412 | 6.6 | 2.18 | 4.5 | 285 | 728 |
| 76 | cand498 | Hsd_from_Mmd_291 | Mmd_291 | 8.5 | 2.23 | 4.7 | 216 | 597 |
| 77 | cand521 | N/D | N/D | 6.5 | 2.25 | 4.8 | - | - |
| 78 | cand246 | N/D | Mmd_337 | 7.8 | 2.27 | 4.8 | - | 646 |
| 79 | mmHP2549445 | N/D | Mmd_134 | 6.5 | 2.3 | 4.9 | - | 430 |
| 80 | cand368 | Hsd_from_Mmd_47 | Mmd_47 | 7.4 | 2.33 | 5.0 | 317 | 788 |
| 81 | cand978 | N/D | Mmd_403 | 9.2 | 2.41 | 5.3 | - | 718 |
| 82 | mmHP1181575 | N/D | N/D | 6.7 | 2.41 | 5.3 | - | - |
| 83 | mmHP157519 | N/D | Mmd_127 | 9.6 | 2.49 | 5.6 | - | 422 |
| 84 | cand415 | Hsd_from_Mmd_477 | Mmd_477 | 7.3 | 2.55 | 5.9 | 322 | 795 |
| 85 | cand713 | Hsd_from_Mmd_258 | Mmd_258 | 8.1 | 2.76 | 6.8 | 197 | 562 |
| 86 | cand306 | mmu-mir-320 | mmu-mir-320 | 7 | 2.79 | 6.9 | - | - |
| 87 | cand732 | Hsd_from_Mmd_49 | Mmd_49 | 9.2 | 2.9 | 7.5 | 334 | 809 |
| 88 | cand595 | Hsd_from_Mmd_198 | Mmd_198 | 11.7 | 2.98 | 7.9 | 165 | 499 |
| 89 | cand708 | mmu-mir-365-1 | mmu-mir-365-1 | 7.1 | 3.07 | 8.4 | - | - |
| 90 | cand593 | Hsd_from_Mmd_526 | Mmd_526 | 11 | 3.14 | 8.8 | 356 | 844 |
| 91 | mmHP1181586 | N/D | Mmd_132 | 7.3 | 3.14 | 8.8 | - | 428 |
| 92 | cand152 | N/D | N/D | 7.4 | 3.43 | 10.8 | - | - |
| 93 | cand519 | Hsd_from_Mmd_40 | Mmd_40 | 7.1 | 3.52 | 11.5 | 278 | 714 |
| 94 | cand592 | N/D | N/D | 13 | 3.67 | 12.7 | - | - |
| 95 | mmHP432573 | N/D | Mmd_214 | 9.3 | 3.69 | 12.9 | - | 518 |
| 96 | cand461 | Hsd_from_Mmd_297 | Mmd_297 | 9.9 | 3.77 | 13.6 | 221 | 603 |
| 97 | mmHP3140720 | N/D | Mmd_46 | 10.1 | 3.77 | 13.6 | - | 779 |
| 98 | cand640 | Hsd_from_Mmd_208 | Mmd_208 | 9.5 | 3.79 | 13.8 | 169 | 511 |
| 99 | mmu-mir-30c-1 | mmu-mir-30c-1 | mmu-mir-30c-1 | 10.3 | 3.85 | 14.4 | - | - |
| 100 | cand209 | mmu-mir-494 | mmu-mir-494 | 11.9 | 3.94 | 15.3 | - | - |

Total RNA was isolated from human tumor material and normal control tissue using a Trizol-based method. Samples were labelled using Kreatech ULS microRNA reagents and hybridized to custom-spotted Codelink microarrays that contained 847 different microRNA probes (DNA backbone), including about 150 known microRNAs. Each probe was represented 8 times on every slide. Microarray images were processed with FeatureExtractor software and the data was analyzed using limma package (Bioconductor). N/D not determined.

NUCLEIC ACID MOLECULES AND COLLECTIONS THEREOF, THEIR APPLICATION AND MODIFICATION

This application is a 371 of PCT/NL2007/000012 filed Jan. 10, 2007, and which claims priority to Netherlands PCT/NL2006/000010 filed Jan. 10, 2006 and Netherlands PCT/NL2006/000491, filed Sep. 29, 2006.

The invention relates to nucleic acid molecules and collections thereof. The invention further relates to the use of nucleic acid molecules in therapeutic and diagnostic applications. The invention furthermore relates to a method for identifying a miRNA molecule or a precursor molecule thereof.

MicroRNAs (miRNAs) are non-coding RNAs that regulate the expression of genes at the post-transcriptional level (reviewed in Bartel, 2004). Although only recently discovered, they have been found to play key roles in a wide variety of biological processes, including cell fate specification, cell death, proliferation, and fat storage (Brennecke, 2003, Poy et al., 2004, reviewed in Ambros, 2004). About 200 different miRNAs have now been described for mouse and human (Griffiths-Jones, 2004). The molecular requirements and mechanism by which miRNAs regulate gene expression are currently being clarified (Bartel, 2004), but individual biological functions remain largely unknown. Temporal and spatial expression of miRNAs may be key features driving cellular specificity.

MiRNAs, like siRNAs, are known in the context of RNA interference (RNAi). RNAi is the silencing of gene expression by the administration of double-stranded RNA (dsRNA). Endogenous RNAi seems to be a primitive sort of immune system, aimed at the defense of genomes against molecular parasites like viruses and transposons. During the process of RNAi, the dsRNA is converted into a shorter form: the siRNAs. siRNA is shorthand for "short interfering RNA", and synthetic versions of these 21 nucleotide long molecules are widely used to induce RNAi in mammalian cell systems because they circumvent the aspecific interferon response of these cells to dsRNA. The miRNAs are another species of small RNA molecules. MiRNAs, however, are always encoded by the genome itself, as hairpin structures, whereas siRNAs can both be artificial as well as endogenous (Hamilton & Baulcombe 1999; Aravin et al, 2001; Reinhart & Bartel 2002; Ambros et al, 2003). Both molecules feed largely into one and the same process that can either lead to mRNA degradation or to the inhibition of protein synthesis. As a rule, siRNAs cause mRNA destruction, whereas miRNAs can do both: in plants the majority of miRNAs direct cleavage, whereas miRNAs in animals most often induce translation inhibition; however, examples of translation inhibition in plants and cleavage in animals have been found (Chen 2004; Yekta et al, 2004).

MiRNA genes are transcribed by RNA polymerase II and transcripts are subsequently capped and poly-adenylated (Cai et al., 2004). Therefore, expression patterns of miRNAs in *C. elegans* can be easily determined by fusing green fluorescent protein (GFP) to upstream sequences (Johnson et al, 2003; Johnston & Hobert 2003). The nascent transcript of the miRNA is named pri-miRNA (primary miRNA) and can contain more than one miRNA. The individual miRNA-containing hairpin precursor (or pre-miRNA) is excised from this pri-miRNA by the enzyme Drosha (Lee et al, 2003) in the nucleus, and is assisted by a dsRNA-binding protein, gripper (G. Hannon, Cold Spring Harbor, N.Y., USA). Drosha is an animal-specific RNaseIII enzyme, and is essential for the production of miRNA precursor structures that can be exported from the nucleus. In plants, this role appears to be taken by one of the Dicer homologues (DCL1; Park et al, 2002; Reinhart et al, 2002; Xie et al, 2004).

The pre-miRNA is then exported to the cytosol (Yi et al, 2003; Bohnsack et al, 2004; Lund et al, 2004), where it is further processed by Dicer (Grishok et al, 2001; Hutvagner et al, 2001; Ketting et al, 2001). This enzyme basically can take any dsRNA and convert it to si/miRNAs (Bernstein et al, 2001) and there have been many models for how this is achieved. However, now it seems clear that the human Dicer enzyme does so by binding, as a monomer, to one end of the dsRNA through the PAZ (=Piwi-Argonaute-Zwille) domain (Lingel et al, 2003; Song et al, 2003; Yan et al, 2003), which seems to specifically recognize dsRNA ends produced by RNaseIII enzymes (Ma et al, 2004). This positions the two RNaseIII domains of the Dicer monomer such that they form one active site approximately 21 basepairs away (Zhang et al, 2004). In the case of miRNAs, this mode of action usually leads to the production of only one miRNA of specific sequence, as only the paired end of the pre-miRNA hairpin can be recognized. The mode of action of production of miRNAs from pre-miRNAs is unpredictable in that specific miRNAs cannot be predicted on the basis of the nucleic acid sequence of the pre-miRNA.

The complex that is ultimately responsible for silencing has been named the RNA-induced silencing complex (RISC), which incorporates both si- and miRNAs. Only single-stranded RNA is incorporated, however, and which of the two strands makes it into RISC is determined by the thermodynamically asymmetric nature of the siRNA: the strand with the most loosely basepaired 5' end is in most cases incorporated (Khvorova et al, 2003; Schwarz et al, 2003). P. Zamore (Worcester, Mass., USA) reported that this asymmetry is sensed by Dicer in complex with the dsRNA-binding protein R2D2, which literally takes this strand to the RISC complex (Lee et al, 2004; Pham et al, 2004; Tomari et al, 2004). What happens next is determined by a combination of factors: the origin of the small RNA (that is, whether it has been processed by Drosha and/or Dicer), associated proteins and the extent of basepairing between the target mRNA and the si/miRNA.

One of the outcomes is cleavage of the mRNA. The protein that executes this cleavage ("Slicer") remains elusive, but it is known what chemistry this enzyme should use: a 3' hydroxyl and a 5' phosphate group characterize the cleavage product (Martinez & Tuschl 2004; Schwarz et al, 2004). Also, RISC behaves like a true enzyme, so it catalyses many rounds of cleavage. The other outcome, translation inhibition, is not completely elucidated either. The step of translation that is actually inhibited could be initiation and/or elongation. Alternatively the process of translation could not be inhibited at all. One way of translational silencing might involve nascent chain degradation.

Currently, about 200 different mammalian miRNAs are known. A published estimate of the total number of miRNA genes in the human genome has been that the human genome contains at most 255 miRNA genes (Lim et al., 2003). The invention surprisingly found that there are many more different miRNA expressed in mammalian cells. At least ~1000 putative miRNAs in the human genome are conserved in at least some other vertebrates, and there are also a substantial number of species-specific miRNAs.

The invention provides novel miRNA sequences and precursors and complements thereof. The larger RNA species from which miRNA are excised have various names such as pre-miRNA, pri-miRNA and as used in the invention hairpin RNA. The invention provides many different miRNA and at least some of the larger RNA species from which they are derived. The miRNA and hairpin RNA provided by the invention are listed in FIG. 1. This figure contains a substantial amount of information on the miRNA, the cloning source, the hairpin RNA structure, mammalian homologues thereof, and extracted data from experimental results of FIG. 2, etc. The various elements of FIG. 1 are detailed in FIG. 1A. Different cell types were analysed for the presence of the respective miRNAs. In cases where a miRNA was produced by a cell, the structure and nucleotide sequence of the miRNA was determined. The invention thus further provides a method for analysing a sample comprising nucleic acid from a cell by determining the presence therein of a particular miRNA or hairpin RNA of FIG. 1. Correlation of the detected miRNAs with the pre-miRNAs revealed that accurate prediction of miRNA directly on the basis of the nucleic acid sequence of a pre-miRNA is not possible. The results found by the modified RAKE-approach, as detailed in FIG. 2A, for example in, one instance, showed a resulting miRNA from one strand of a predicted miRNA precursor, in another instance from two strands of a precursor. Moreover there was a significant variability of the position of the miRNA in the predicted precursor, the amount and sequence of nucleotides at either end of a strand.

It was found that miRNAs and hairpin RNAs of the invention are differentially expressed in cells of various origins. A probe specific for an individual miRNA or hairpin RNA can thus be used to differentiated samples on the basis of the expression of the respective miRNA or hairpin RNA. The invention therefore provides a method for characterising a sample comprising nucleic acid derived from a cell, said method comprising determining whether said sample comprises at least a minimal sequence of at least one miRNA (miRNA) of the invention or a mammalian homologue thereof and/or whether said sample comprises a precursor of said miRNA (hairpin RNA) of the invention or mammalian homologue thereof and characterizing said sample on the basis of the presence, relative abundance, or absence of said miRNA or hairpin RNA.

FIG. 1 depicts miRNA and precursors thereof (further referred to herein as hairpin RNA) of the invention. The hairpin RNA provided in FIG. 1 is typically shorter than the actual precursor RNA found in the cell. It contains the sequences that form the stem-loop structure from which miRNA are excised.

MiRNA were detected in various biological sources, depending on the miRNA and the biological source. Analysis of the structure of the miRNA revealed that miRNA produced from hairpin RNA are a heterologous group wherein the individual miRNA share a typically central, sequence. The individual miRNA produced from a pre-miRNA differ from each other at the 5' end, the 3' end, or both ends. A minimal sequence of a miRNA of the invention is a sequence that is shared by all identified miRNA variants from one half of the pre-miRNA or hairpin RNA. The half may be the half having the 5' of the pre-miRNA or hairpin RNA or the half having the 3' end of the pre-miRNA or hairpin RNA. A minimal sequence of a miRNA containing an uneven number of nucleotides is typically a sequence of at least 10 nucleotides comprising the central nucleotide of the miRNA and at least the 4 nucleotides next to the central nucleotide at either the 5' or the 3' side of the central nucleotide. For a miRNA containing an even number of nucleotides, a minimal sequence is typically a sequence of 10 nucleotides comprising the two central nucleotide of the miRNA and at least the 4 nucleotides next to the central nucleotides at either the 5' or the 3' side of the two central nucleotides. In another embodiment a minimal sequence of a miRNA of FIG. 1, comprises at least the "seed" sequence of said miRNA, i.e. nucleotides 2-8 of a miRNA of FIG. 1.

As different miRNA are differently expressed in various cell types or tissues, a method of the invention can be used to characterized the source of the sample. For instance, a probe specific for a miRNA that is expressed in heart tissue but not in embryonic cells can be used to classify a sample as either not containing RNA from the heart or vice versa, not containing nucleic acid derived from embryonic cells. For miRNA expressed in other tissues or cells similar characterizations are possible.

Nucleic acid obtained from a natural source can be either DNA or RNA. In the present invention it is preferred that said nucleic acid comprises RNA. The nucleic acid is preferably directly derived from a cell. However, the nucleic acid can also have undergone one or more processing steps such as but not limited to chemical modification. A miRNA or pre-miRNA of the invention, or complement thereof can also be used to analyse DNA samples, for instance, by analysing a sequence of an obtained (pre-) miRNA it is possible to determine the species that the cell belonged to that provided the nucleic acid for the analysis.

Characterisation of a sample on the basis of the presence, relative abundance, or absence of a particular miRNA and/or hairpin RNA can be used as an indicator for the presence or absence of disease, such as cancer. For instance, when a sample from a tissue comprises a different expression pattern of miRNA and/or hairpin RNA when compared to a comparable tissue from a normal individual, or when compared to a comparable tissue from an unsuspected part of said tissue from the same individual. A difference in the presence of one miRNA and/or hairpin RNA provides an indication in this type of analysis. However, the accuracy (i.e. predictive value) of the analysis typically increases with increasing numbers of different miRNA and/or hairpin RNA that are analysed. Thus a method for the characterisation of a sample of the invention preferably comprises determining whether said sample comprises at the least minimal sequence of 5 different miRNA or hairpin RNA of FIG. 1 or a mammalian homologue thereof. Preferably, at the least minimal sequence of 10, preferably at least 20 more preferably at least 60 different miRNA and/or hairpin RNA of FIG. 1 or a mammalian homologue thereof. A method of the invention may of course further include detection of miRNA and/or hairpin RNA of the art. It is preferred that the presence or absence of at least a minimal sequence of a miRNA of FIG. 1 is determined in a method of the invention. It is typically the miRNA that exerts an expression regulating function in a cell. The presence of pre-miRNA and/or hairpin RNA in a sample is of course indicative for the presence of at least the minimal sequence of the corresponding miRNA in said sample, although this does not always have to be true. Preferably, a method of the invention, further comprises determining whether said sample comprises at least a minimal sequence of at least five miRNA (miRNA) of FIG. 1, or a mammalian homologue thereof wherein said at least five miRNA are derived from at least five different hairpin RNA and characterizing said sample on the basis of the presence or absence of said miRNA.

A sample can comprise cells. Typically, however, a sample has undergone some type of manipulation prior to analysing the presence or absence therein of a miRNA and/or hairpin RNA according to the invention. Such manipulation, typically, though not necessarily comprises isolation of at least (part of) the nucleic acid of the cells. The nucleic acid in a sample may also have undergone some type of amplification and/or conversion prior to analysis with a method of the invention. miRNA can be detected directly via complementary probe specific for said miRNA or indirectly. Indirect forms include, but are not limited to conversion into DNA or protein and subsequent specific detection of the product of the conversion. Conversion can also involve several conversions. For instance, RNA can be converted into DNA and subsequently into RNA which in turn can be translated into protein. Of course such conversions may involve adding the appropriate signal sequences such as promoters, translation initiation sites and the like. Other non-limiting examples include amplification, with or without conversion of said miRNA in said sample for instance by means of PCR or NASBA or other nucleic acid amplification method. All these indirect methods have in common that the converted product retains at least some of the specificity information of the original miRNA and/or hairpin RNA, for instance in the nucleic acid sequence or in the amino acid sequence or other sequence. Indirect methods can further comprise that nucleotides or amino acids other than occurring in nature are incorporated into the converted and/or amplified product. Such products are of course also within the scope of the invention as long as they comprise at least some of the specificity information of the original miRNA and/or hairpin RNA. By at least some of the specificity information of the original miRNA and/or hairpin RNA is meant that the converted product (or an essential part thereof) is characteristic for the miRNA and/or hairpin RNA of which the presence or absence is to be determined.

The cell comprising said nucleic acid can be any type of cell. As mentioned above, it can be an embryonic cell, a foetal cell or other pre-birth cell, or it can be a cell of an individual after birth, for instance a juvenile or an adult. It can also be a cell from a particular part of a body or tissue of a mammal. Preferably, said cell is an aberrant cell, preferably a cell with an aberrant proliferation phenotype such as a tumour cell or a tissue culture cell. Preferably a cancer cell, or a cell suspected of being a cancer cell. In a preferred embodiment said cancer cell is a glioma cell. In another preferred embodiment said cancer cell is a lung cancer cell. In another preferred embodiment said cell is an adenoma cell, preferably a lung adenoma cell. In another preferred embodiment said cell is a cell that is infected with a pathogen. Preferably said pathogen is a virus or a (myco)bacterium. A method of the invention is particularly suited for determining the stage of said aberrant cell. For instance, tumorigenic cells can have varying degrees of malignancy. While progressing through the various degrees of malignancy the pattern of expression of (pre-) miRNA changes and can be detected. Such a pattern can thus be correlated with the degree of malignancy. A method of the invention can thus be used for determining a prognosis for the individual suffering from said cancer.

The cell is preferably a lung cell, a skin cell, a brain cell, a liver cell, an embryonic cell, a heart cell, an embryonic cell line or an aberrant cell derived there from.

Changes in expression are better detected when a test sample is compared with a reference. Thus in one aspect the invention provides a method for determining whether a cell in a sample is different from a reference cell, comprising determining whether expression of at least one at least one miRNA of FIG. 1 or a mammalian homologue thereof or at least one hairpin RNA of FIG. 1 or a mammalian homologue thereof, in said cell is different when compared to said reference cell. Preferably it is determined whether the expression of at least 5 miRNA or hairpin RNA is different in said cell in said sample when compared to a reference cell. Expression is different when there is at least a factor of two difference in the level of expression. Preferably, the difference is a difference between detectable miRNA expression and not detectable.

Preferably said at least 5 miRNA or pre-miRNA are of FIG. 1. Expression levels can be compared by comparing steady state levels or by comparing synthesis rates.

A cell as used herein is a cell of a mammal, preferably a mouse, a rat, a primate or a human. A sample is for example characterized for the presence or absence of a disease, for belonging or not belonging to a certain species, or for being in a specific stage of development. In many instances however, a sample is best characterized by determining the presence, relative abundance, or absence therein of a collection of miRNAs and/or hairpin RNAs of the invention, as a sample of an organism usually displays a natural and/or pathological variation in diverse parameters.

Another reason why a sample is preferably characterized on the basis of a collection of miRNAs and/or hairpin RNAs, is that a disorder manifests itself in variable manners in different individuals. These two causes of variability can however, be calculated in through providing detection information of a collection of miRNAs and/or hairpin RNAS. For example, a characteristic expression profile of a disease is composed of a collection of miRNAs and/or hairpin RNAS. By comparing an expression profile of said collection in a sample to a reference expression profile of said collection that is characteristic of said disease, an individual from whom this sample is taken, is thus tested for presence or absence of said disease. The process of determining whether a sample matches an expression profile of a disease or a species depends on multiple factors. A miRNA itself has more or less distinctive power within, for example, a disorder or a species. Further a miRNA as part of a collection represents a percentage of a total collection. Characterizing a sample thus preferably comprises, apart from determining the absence or presence of one miRNA, determining the absence or presence of more miRNAs. Absence or presence of a miRNA is for example a positive or a negative indicator for a disease or a species. A collection or an expression profile preferably comprises one or more positive and/or negative indicators. Said positive and/or negative indicators are for example expressed as a percentage of a total number of miRNAs or as an absolute number of miRNAs. When expressing indicators in percentages, a weight is optionally attributed to an indicator. An indicator with a higher distinctive power is herein preferably given a higher weight than an indicator with a low distinctive power.

In one embodiment the invention provides a method according to the invention, comprising determining whether said sample comprises at least a minimal sequence of at least two, preferably at least three, more preferably at least four, most preferably at least five miRNAs of FIG. 1 or a mammalian homologue thereof wherein said miRNA are preferably derived from different precursor miRNA (pre-miRNA) and characterizing said sample on the basis of the presence or absence of said miRNA. The presence on a different hairpin RNA as depicted in FIG. 1, or on different mammalian homologs thereof is indicative for the presence on different precursor miRNA. In a preferred embodiment said characterization of said sample is a test for a disease. In many instances a test comprising more miRNAs has a higher diagnostic value, however, this need not always be the case. In another preferred embodiment of the invention one or more miRNAs according to the invention are determined in a sample, in combination with one or more other miRNAs. In a further preferred embodiment at least one miRNA according to the invention is determined in a sample in combination with one or more other miRNAs, resulting in determining a total of at least 10, preferably at least 15, more preferably at least 20 or most preferably at least 25 miRNAs. In a preferred embodiment said other miRNAs determined in a sample are involved in the same type of disorder as said miRNA according to the invention that is determined in said sample. Alternatively, a test is composed of miRNAs with indicative values of two or more diseases or two or more species.

Said sample preferably comprises nucleic acid of a differentiated cell. Differentiated as used herein is either cellular differentiated or evolutionary differentiated. Preferably differentiated is cellular differentiated. A differentiated cell is derived from any part of an organism. Said cell is preferably derived from a part of an organism that is associated with a disease. For example, when characterizing a sample for cancer, said cell is preferably derived from a tumour. In another preferred embodiment said sample comprises nucleic acid of an embryonic cell. An embryonic cell can be derived from any organism but is preferably derived from a mammal. A sample comprising nucleic acid derived from an embryonic cell, is for example taken for early diagnosis of a disease in an organism. A embryonic cell is in one embodiment an embryonic stem cell. In a further preferred embodiment said sample comprises nucleic acid of a cell with an aberrant proliferation phenotype. An aberrant proliferation phenotype indicates that a proliferation process has somehow been disturbed. The disturbance is either caused by internal factors or by external factors or by a combination thereof. An aberrant proliferation phenotype is for example found in hepatitis, a bowel disease or a cancer. Preferably a cell with an aberrant proliferation phenotype is a tumour cell and/or cell line cell. A tumour cell is for example a leukemic cell, such as a leukemic B-cell. Said tumour cell line cell is for example obtained from a cell line that is cultured from a cell derived from a tumour of an organism, preferably a mammal. Alternatively said tumour cell line cell is obtained from a cell line that is cultured from a cell wherein tumour characteristics have been induced artificially, for example with a chemical substance. In a preferred embodiment the invention provides a method for characterizing a sample comprising nucleic acid derived from a cell according to the invention, wherein said cell is a lung cell, a skin cell, a brain cell, a liver cell, an embryonic cell, a heart cell, or an embryonic cell line.

In one embodiment the invention provides a method for determining whether a cell in a sample is modified when compared to a reference cell, comprising determining whether expression of at least one at least one miRNA of FIG. 1 or a mammalian homologue thereof and/or a hairpin RNA of FIG. 1 or a mammalian homologue thereof in said cell is altered when compared to said reference cell. A reference cell as used herein is for example a healthy or pathological counterpart of respectively a pathological or healthy cell. A reference cell is for example another cell of the same cell type of the same organism wherefrom said sample is taken but preferably from another organism. The other organism is preferably comparable in species and/or constitution and/or development and/or age. In a preferred embodiment said cell is a differentiated cell. In another preferred embodiment is an embryonic cell. In a further embodiment said cell is a cell with an aberrant proliferation phenotype. Preferably said cell with an aberrant proliferation phenotype is a tumour cell and/or cell line cell. In one embodiment the invention provides a method for determining whether a cell in a sample is modified when compared to a reference cell according to the invention, wherein said cell is a lung cell, a skin cell, a brain cell, a liver cell, an embryonic cell, a heart cell, or an embryonic cell line.

A mammalian homologue of a hairpin RNA as depicted in FIG. 1 is a sequence that comprises at least 70% sequence identity with a hairpin RNA of FIG. 1 that can fold in a similar stem loop (hairpin) structure as the corresponding hairpin RNA of FIG. 1 (graphically depicted in FIG. 3). A mammalian homologue of a miRNA as depicted in FIG. 1 is a sequence that exhibits 90% sequence identity with at least 20, preferably consecutive, nucleotides of the corresponding miRNA of FIG. 1 (graphically depicted in FIG. 3). Preferably, said mammalian homologue of a miRNA of FIG. 1 is present in a mammalian homologue of the corresponding hairpin RNA. Preferably, said miRNA homologue is present in a part of said hairpin homologue that can form a stem structure.

The presence, relative abundance or absence of a miRNA of FIG. 1 or a mammalian homologue thereof and/or a hairpin RNA of FIG. 1 or a mammalian homologue thereof in a sample, can be determined by using a detection method. Typically a method for the specific detection of nucleic acid is used. Currently there are many methods for the specific detection of nucleic acids. Typically, though not necessarily these use a probe that specifically recognizes at least part of the nucleic acid to be tested. Such probe is often nucleic acid, but can also be an analogue thereof. For instance, various nucleotide analogues are presently available that mimic at least some of the base pairing characteristics of the "standard" nucleotides A, C, G, T and U. Alternatively, nucleotide analogues such as inosine can be incorporated into such probes. Other types for analogues include LNA, PNA, morpholino and the like. Further methods for the specific detection of nucleic acid include but are not limited to specific nucleic acid amplification methods such as polymerase chain reaction (PCR) and NASBA. Such amplification methods typically use one or more specific primers. A primer or probe preferably comprises at least 12 nucleotides having at least 90% sequence identity to a sequence as depicted in FIG. 1, or the complement thereof.

The present invention provides an isolated nucleic acid molecule comprising:
  a) a nucleotide sequence as shown in FIG. 1, and/or
  b) a nucleotide sequence which is a complement of a), and/or
  c) a nucleotide sequence which has an identity of at least 80% to a sequence of a) or b) and/or
  d) a nucleotide sequence which hybridizes under stringent conditions to a sequence of a), b) or c).

A complement of a nucleic acid sequence as used herein is a sequence wherein most, but not necessarily all bases are replaced by their complementary base: adenine (A) by thymidine C) or uracil (U), cytosine (C) by guanine (G), and vice versa. Identity of sequence in percentage is preferably determined by dividing the number of identical nucleotides between a given and a comparative sequence by the length of the comparative sequence. In a preferred embodiment the invention provides a nucleic acid molecule according to the invention, wherein the identity of sequence c) to a sequence of a) or b) is at least 90%. In a more preferred embodiment said identity of sequence c) to a sequence of a) or b) is at least 95%. Preferably, said sequence identity to a miRNA of FIG. 1 or its complement is 90% in a stretch of preferably 20 nucleotides of said miRNA. Nucleotides A, C, G and U as used in the invention, are either ribonucleotides, deoxyribonucleotides and/or other nucleotide analogues, such as synthetic nucleotide analogues. A nucleotide analogue as used in the invention is, for example, a peptide nucleic acid (PNA), a locked nucleic acid (LNA), or alternatively a backbone- or sugar-modified ribonucleotide or deoxyribonucleotide. Furthermore the nucleotides are optionally substituted by corresponding nucleotides that are capable of forming analogous H-bonds to a complementary nucleic acid sequence. An example of such a substitution is the substitution of U by T. Stringent conditions under which a nucleotide sequence hybridizes to a sequence according to the invention are highly controlled conditions. Stringent laboratory hybridization conditions are known to a person skilled in the art.

In a preferred embodiment the invention provides a nucleic acid molecule according to the invention, which is a miRNA molecule or an analogue thereof. A further preferred embodiment of the invention provides a hairpin RNA molecule and a DNA molecule encoding miRNA or hairpin molecule. In another embodiment the invention provides an miRNA homologue of FIG. 1 or a mammalian homologue of a miRNA of FIG. 1. A homologue as used herein is a sequence, preferably a gene or a product of this gene that has evolved from a common ancestor in two or more species.

An isolated nucleic acid according to the invention preferably has a length of from 18 to 100 nucleotides, more preferably from 18 to 80 nucleotides. Mature miRNA usually has a length of from 18 to 26 nucleotides, mostly approximately 22 nucleotides. In a preferred embodiment the invention thus provides a nucleic acid molecule according to the invention having a length of from 18 to 26 nucleotides, preferably of from 19-24 nucleotides, most preferably 20, 21, 22 or 23 nucleotides. MiRNAs are also provided by the invention as precursor molecules. The invention thus further provides a nucleic acid molecule according to the invention which is a pre-miRNA, a hairpin RNA as depicted in FIG. 1 or a DNA molecule coding therefore. Precursor or hairpin molecules usually have a length of from 50-90 nucleotides. The invention provides a nucleic acid molecule according to the invention, having a length of 50-90 nucleotides of a hairpin RNA of FIG. 1. In a preferred embodiment the invention thus provides a nucleic acid molecule according to the invention, which is a pre-miRNA or a DNA molecule coding therefore, having a length of 60-110 nucleotides. The invention further provides a nucleic acid molecule according to the invention which has a length of more than 110 nucleotides, as a precursor miRNA is for example produced by processing a primary transcript. In a preferred embodiment the invention provides a nucleic acid molecule according to the invention, wherein said pre-miRNA is a pre-miRNA of FIG. 1 or a mammalian homologue or ortholog thereof.

As mentioned above, single-stranded miRNA is incorporated in a RISC. A miRNA precursor molecule is often partially double-stranded. Usually a miRNA precursor molecule is at least partially self-complementary and forms double-stranded parts such as loop- and stem-structures. The invention in one embodiment provides a nucleic acid molecule according to the invention, which is single-stranded. In another embodiment the invention provides a nucleic acid molecule according to the invention, which is at least partially double-stranded. In one embodiment of the invention a nucleic acid molecule according to the invention is selected from RNA, DNA, or nucleic acid analogue molecules or a combination thereof. In another embodiment of the invention aforementioned nucleic acid molecule is a molecule containing at least one modified nucleotide analogue. In a further embodiment the invention provides use of said nucleic acid molecule according to the invention in a therapeutic and/or diagnostic application.

A nucleic acid molecule according to the invention is in one embodiment part of a collection of nucleic acid molecules. Such a collection is preferably, but not exclusively, used in a test. A collection of nucleic acid molecules is for example used in a test as described above, for instance to determine absence or presence of a disease in an individual by testing a sample taken from this individual. A collection of nucleic acid molecules usually has a higher predictive value in any experimental setting when the number of nucleic acid molecules provided herein is larger. Thus, in one embodiment, the invention provides a collection of nucleic acid molecules, comprising at least 5, preferably at least 10, more preferably at least 20 nucleic acid molecules comprising a nucleotide sequence as shown in FIG. 1. A collection of nucleic acid molecules according to the invention, is in one embodiment used for the diagnosis of diseases such as cancer, heart disease, viral infections or disease susceptibility.

Further provided is a collection of nucleic acid molecules, comprising at least 5, preferably at least 10, more preferably at least 20 nucleic acid molecules that are complementary to miRNAs shown in FIG. 1, or that have nucleotide sequences which hybridize under stringent conditions to miRNAs shown in FIG. 1. A collection of nucleic acid molecules are preferably used in the diagnosis of cancer, heart disease, viral infections and other diseases.

A nucleic acid molecule according to the invention can be obtained by any method. Non-limiting examples are chemical synthesis methods or recombinant methods. A nucleic acid molecule according to the invention is in one embodiment modified. Said modification is for example a nucleotide replacement. Said modification is for example performed in order to modify a target specificity for a target in a cell, for instance a specificity for an oncogene. Said modified nucleic acid molecule preferably has an identity of at least 80% to the original miRNA, more preferably of at least 85%, most preferred of at least 90%. In another embodiment a nucleic acid molecule according to the invention is modified to form a siRNA molecule. For example, a miRNA molecule is processed in a symmetrical form and subsequently generated as a double-stranded siRNA. In a preferred embodiment the invention provides a nucleic acid molecule according to the invention, which is selected from RNA, DNA or nucleic acid analogue molecules which preferably further comprises at least one nucleotide analogue. In one embodiment a nucleic acid molecule of the invention is present in a recombinant expression vector. A recombinant expression vector according to the invention for example comprises a recombinant nucleic acid operatively linked to an expression control sequence. Said vector is any vector capable of establishing nucleic acid expression in an organism, preferably a mammal. Said vector is preferably a viral vector or a plasmid. In a preferred embodiment introduction of said vector in an organism establishes transcription of said nucleic acid. In a preferred embodiment after said transcription the transcript is processed to result in a pre-miRNA molecule and/or a hairpin molecule and subsequently in a miRNA molecule.

Nucleic acids according to the invention are in one embodiment provided as a probe. Many different kinds of probes are presently known in the art. Probes are often nucleic acids, however, alternatives having the same binding specificity in kind, not necessarily in amount are available to the person skilled in the art, such alternatives include but are not limited to nucleotide analogues. In one embodiment the invention provides a set of probes comprising at least one nucleic acid molecule according to the invention. In a preferred embodiment the invention provides a set of probes according to the invention, wherein said nucleic acid molecule is a miRNA molecule of FIG. 1 or a functional part, derivative and/or analogue thereof. In a further preferred embodiment the invention provides a set of probes according to the invention, wherein said nucleic acid molecule is a complement of a miRNA molecule or a functional part, derivative and/or analogue thereof. In a further preferred embodiment the invention provides a set of probes comprising a collection of nucleic acid molecules according to the invention. A collection in this embodiment preferably is a collection of nucleic acid molecules, comprising at least 5, preferably at least 10, more preferably at least 20 nucleic acid molecules comprising a nucleotide sequence as shown in FIG. 1 or a mammalian homologue thereof, or is a collection of nucleic acid molecules, comprising at least 5, preferably at least 10, more preferably at least 20 nucleic acid molecules with a nucleotide sequence which is a complement of a nucleotide sequence as shown in FIG. 1, or with a nucleotide sequence which hybridizes under stringent conditions to a nucleotide sequence as shown in FIG. 1, or is a combination thereof.

Further provided is an array comprising one or more nucleic acids of the invention. An array is used to analyze one or more samples at the same time. Preferably said array comprises at least two probes, wherein at least one probe comprises a nucleic acid molecule according to the invention. In a preferred embodiment said array comprises a set of probes comprising a collection of nucleic acid molecules according to the invention, or a combination of collections of nucleic acid molecules according to the invention. In one embodiment an array of the invention is a microarray. Said microarray preferably comprises oligonucleotides. A set of probes or an array or microarray according to the invention is in a preferred embodiment used in a diagnostic test.

A diagnostic test as used in the invention, is a test wherein a nucleic acid molecule according to the invention is used to subject a sample of an organism to a diagnostic procedure. Said organism preferably is a mammal, more preferably a human being. A sample as used in the invention preferably is a biological sample. A biological sample is for example a bodily fluid. A preferred biological sample is a tissue sample. A tissue sample is, for instance, used to determine a stage of differentiation or development of a cell. Alternatively a cell type or tissue type is classified as corresponding with a disorder. Said disorder is, for example, characterized by a typical expression level of a miRNA molecule or a typical expression pattern of miRNA molecules. The invention provides a nucleic acid molecule according to the invention for diagnostic applications as well as for therapeutic applications. A diagnostic of therapeutic application according to the invention relates to a disorder, for example a viral infection or cancer. Recently miRNAs have been described to be an important causal factor in cancer (Lu et al., 2005; He et al., 2005; O'Donnell et al., 2005; Alvarez-Garcia and Miska, 2005) or a powerful indicator for prognosis and progression of cancer (Calin et al., 2005). A cancer is for example leukemia.

In one embodiment the invention provides a pharmaceutical composition, comprising as an active agent at least one nucleic acid molecule according to the invention, and optionally a pharmaceutically acceptable carrier. A pharmaceutical composition according to the invention further optionally comprises another additive. Such another additive can for example be a preservative or a colorant. Alternatively an additive is a known pharmaceutically active compound. A carrier is any suitable pharmaceutical carrier. A preferred carrier is a compound that is capable of increasing the efficacy of a nucleic acid molecule to enter a target-cell. Examples of such compounds are liposomes, particularly cationic liposomes. A composition is for example a tablet, an ointment or a cream. Preferably a composition is an injectable solution or an injectable suspension. In one embodiment the invention provides a pharmaceutical composition according to the invention for diagnostic applications. In another embodiment the invention provides a pharmaceutical composition according to the invention for therapeutic applications. In a preferred embodiment the invention provides a pharmaceutical composition according to the invention, as a modulator for a developmental or pathogenic disorder. In a preferred embodiment said developmental or pathogenic disorder is cancer. A miRNA molecule for example functions as a suppressor gene or as a regulator of translation of a gene.

A nucleic acid molecule according to the invention is administered by any suitable known method. The mode of administration of a pharmaceutical composition of course depends on its form. In a preferred embodiment a solution is injected in a tissue. A nucleic acid molecule according to the invention is introduced in a target cell by any known method in vitro or in vivo. Said introduction is for example established by a gene transfer technique known to the person skilled in the art, such as electroporation, microinjection, DEAE-dextran, calcium phosphate, cationic liposomes or viral methods.

A nucleic acid molecule according to the invention is in one embodiment used as a marker of a gene. A marker identifies a gene, for example a gene involved in cancer or another developmental disorder. A marker is, for instance, a miRNA that is typically differentially expressed in a disorder or is a set of two or more miRNAs that display a typical expression pattern in a disorder. A nucleic acid molecule is alternatively for example labelled with a fluorescent or a radioactive label. A nucleic acid molecule according to the invention is, in another embodiment, a target for a diagnostic or therapeutic application. For example, a miRNA molecule according to the invention is inhibited or activated and the effect of the inhibition or activation is determined by measuring differentiation of a cell type. In another embodiment, a nucleic acid according to the invention is not a target itself, but alternatively used to address a target in a cell. A target in a cell is preferably a gene. Preferably said gene is at least partially complementary to said nucleic acid molecule. For example, a miRNA according to the invention is used to find a gene in a cell that has a sequence that is at least partially complementary to the sequence of said miRNA. In a preferred embodiment the invention provides a pharmaceutical composition as a marker or modulator of expression of a gene. In another preferred embodiment the invention provides a pharmaceutical composition according to the invention, wherein said gene is at least partially complementary to said nucleic acid molecule. A modulator of expression of a gene is for example a miRNA. A miRNA that functions as a tumour-suppressor is for instance provided and expressed in and/or delivered to a tumour cell thus suppressing the development of a tumour. In a preferred embodiment the invention provides a use of a nucleic acid molecule according to the invention, for down regulating expression of a gene. Down regulating expression of a gene is for example important in cancer. In an alternative embodiment a miRNA is introduced and/or expressed in a cell of a tissue that does not express said miRNA. As a result said cell of said tissue for example shows a different differentiation type. Such a procedure is for example used as a tissue reprogramming procedure.

At present, there are essentially two approaches for identification of novel miRNA genes: cloning of size-fractionated (18-25 nt) RNAs and computational prediction based on different structural features of miRNAs followed by experimental verification. Cloning of size-fractioned RNAs is a laborious procedure and has resulted in a restricted amount of identified miRNAs. Established methods for validation of predicted miRNA genes rely on construction of size-fractionated cDNA libraries. This is a technically challenging procedure that does not scale well. Moreover it requires testing many tissues and developmental time points. Established methods of experimental validation of predicted miRNAs thus do not scale for the analysis of thousands of candidates regions. The invention surprisingly found a high-throughput approach for testing candidate miRNA regions. The invention provides a modified RAKE assay for high-throughput expression studies of candidate miRNA regions. The provided assay allows exact mapping of 3' ends of mature miRNAs, thus providing information on both structure and expression profiles of novel miRNA genes. Different microarray technologies, including RAKE assay, have been applied for expression profiling of known miRNAs. However, microarrays were not previously used for detection of novel, computationally predicted miRNAs. The unique method of combining a computational method with a modified RAKE assay, provided by the invention, has led to the discovery of numerous new miRNAs. Furthermore the provided method offers an opportunity to discover further miRNAs.

Cross-species sequence comparison is a powerful approach to identify functional genomic elements, but its sensitivity decreases with increasing phylogenetic distance, especially for short sequences. In addition, taxon-specific elements may be missed. To overcome the limitations of classical phylogenetic footprinting methods, the invention applied the phylogenetic shadowing approach (Boffelli et al., 2003), allowing unambiguous sequence alignments and accurate conservation determination at single nucleotide resolution level. This approach is based on the alignment of phylogenetically closely related species; since these show only few sequence differences, many different (but related) genomes need to be aligned to identify invariant (conserved) positions. In the invention 700 bp regions surrounding 122 miRNAs in 10 different primate species were sequenced, including orangutan, gorilla, 2 chimpanzee and 2 macaque species, tamarin, spider monkey, wooly monkey and lemur. Besides the region spanning the pre-miRNA, no additional conserved regions common to different miRNAs could be found, suggesting that, in contrast to *C. elegans* (Ohler et al., 2004), no common cis-acting elements can be immediately recognized in mammalian miRNAs. In the invention it was surprisingly found that there is a prominent drop of conservation immediately flanking pre-miRNA regions. This characteristic conservation pattern can also be recognized in pair-wise alignments between more diverged species like human and mouse and was used to identify novel miRNA genes by screening mouse-human and rat-human whole-genome sequence alignments for this typical conservation profile. Additional stringent filtering for the ability of candidate regions to fold into a thermodynamically favorable stable hairpin, as calculated by Randfold software (Bonnet et al., 2004), resulted in the identification of 976 candidate miRNAs, containing 83% of all known human miRNAs (158 out of 189, based on miRNA registry v.3.1).

Screening for homologues in additional vertebrate genomes (zebrafish, chicken, opossum, cow and dog) revealed that 678 candidates are conserved in at least one other species besides rodents. A substantial part of the predictions consists of miRNAs unique to mammals. Both the genomic distribution and the extent of supportive data for expression are comparable for the mammalian-specific subset and the set of candidates that are also conserved in at least one non-mammalian species. Even though the degree of genome coverage varies for the species used in the comparisons, this data suggests that there are a significant number of lineage-specific miRNAs and indicates that both rapidly and slowly evolving miRNAs exist (let-7 being a typical example of a slow evolver).

Fourteen novel candidates share homology with known miRNAs and an additional 60 share homology with at least one other candidate, making up novel subfamilies. In addition to the established clustering behavior of miRNAs (Bartel 2004, Rodriguez et al., 2004), the ratio between the number of miRNA genes in inter- and intragenic regions is similar for both known and novel miRNAs. Although a fair proportion of candidates are predicted on the strand opposite to annotated transcripts, the disproportionate presence of miRNA genes in introns is intriguing and may reflect expression mechanisms by co-transcription with the host gene and processing of spliced introns. 171 of the predicted novel miRNAs reside in genomic regions that are annotated as exons. In experimental approaches, such candidates are often discarded as potential cloning artifacts, but these regions can be processed into mature miRNAs. Work by Cullen and co-workers (Cai et al., 2004) demonstrated that a transcript harbouring simultaneously a miRNA and an ORF is efficiently used for both miRNA and protein production. About 25% (44) of the exonic candidates reside in non-coding parts and although 127 candidates overlap with annotated protein coding sequences, 75 are predicted on the opposite strand.

Support for the expression of candidate miRNAs is provided through various sources. Three candidates are present in the FANTOM2 database of expressed sequences and 11 candidates reside in gene clusters containing one or more known miRNAs. These miRNAs are likely to be co-expressed from the same primary transcript (Bartel, 2004, Rodriguez et al., 2004). Systematic human transcriptome analysis using high-density oligonucleotide tiling arrays (Kapranov et al., 2002) is in progress and in the invention it was found that the genomic regions encoding 64 known and 214 novel miRNAs has now been covered. From this set, 13 known (20%) and 72 novel (34%) miRNAs are expressed in the SK-N-AS cell line, for which data is publicly available. Although poly (A)+RNA was used for these experiments and properties of miRNA-containing transcripts remain largely to be elucidated, both intergenic and intronic miRNAs were detected. Various lines of research support the finding that at least some miRNAs are processed from poly-adenylated RNA (Cai et al., 2004, Lee et al., 2004).

To provide experimental support for the predicted miRNAs, in the invention Northern blotting experiments were performed for 69 candidates, confirming the expression of 16 mature miRNAs (23%). Although these verification rates are lower than previously published rates using cloning- and PCR-based approaches (38 out of 93; Lim et al., 2003), they may be an under-representation as a result of a bias in the set of already known miRNAs for highly expressed and thus most easily detectable miRNAs, the sensitivity of the detection method, and spatio-temporal limitations of the RNA samples used. Therefore, we developed another potentially more sensitive strategy for candidate miRNA validation based on the RAKE (RNA-primed Array-based Klenow Extension, Nelson et al., 2004) assay.

This assay is based on the ability of an RNA molecule to function as a primer for Klenow polymerase extension when fully base-paired with a single stranded DNA molecule. As the exact 3'-end of the miRNA should be known for successful extension and computational predictions are not optimal for predicting the correct start and end of the mature miRNA, we designed a tiling path of probes complementary to both known and predicted miRNA precursors. Such a tiling path RAKE assay is less prone to false positives than standard hybridization assays, as it depends on the presence of a fully matching 3'-end of the miRNA and hence distinguishes between miRNA family members that differ in their 3' sequences. Flanking tiling path probes function as negative controls. Although some rules have been put forward to determine which strand of the stem is preferentially loaded as mature miRNA in the RISC complex (Khvorova et al., 2003; Schwarz et al., 2003), such computational predictions can only be done when the precise ends of the processed miRNA duplex are known. In addition, due to the nature of the hairpin sequence it is often difficult to predict which strand of the genomic DNA encodes a precursor. To take a fully unbiased approach, we designed tiling paths of 11 probes covering each arm of the stem-loop structure, for the sense as well as the anti-sense genomic sequence, resulting in sets of 44 probes per candidate miRNA gene. Due to G-U pairing allowed in RNA folding and different nucleotide composition of the complementary DNA strand, anti-sense transcripts do not necessarily fold into stable stem-loop structures and for such candidates only 22 probes were included. The central position in the tiling path was determined by predicting the most likely Dicer/Drosha processing sites from secondary structure hairpin information. We designed a custom validation microarray with 44,000 features, covering 271 known mouse miRNAs and 676 of the predicted miRNAs that are conserved between mouse and human, and filled up the array with 199 additional candidates based on stringent randfold criteria (Bonnet et al., 2004) and mouse and rat genome conservation. These arrays were probed with 4 different sources of small RNAs: mouse embryos at embryonic days 8.5 and 16.5, adult mouse brain and embryonic stem (ES) cells (FIG. 2). Mature miRNAs were semi-manually annotated after pre-processing the raw microarray output data using custom scripts. A redundant set of 221 of the known miRNAs (82%), 429 of the candidate conserved miRNAs (63%), and 126 of the extra set (63%) were found positive (FIG. 2). As different genomic loci can produce an identical mature miRNA from a different hairpin (e.g. miR-1-1 and miR-1-2), the total number of non-redundant mature miRNAs is lower. Interestingly, for more than half of the known miRNAs, the most prominent 3' end observed in the RAKE assay differed from the annotated form, including 8 mature miRNAs residing in the other arm of the hairpin, suggesting that originally the star-sequence was annotated. In addition, for various candidate and known miRNAs, multiple subsequent probes (2 or 3) resulted in a positive signal, indicating that 3' end processing of miRNAs is not a completely accurate process at the single nucleotide level. These findings are in line with the observed variation in ends of cloned miRNAs (Aravin and Tuschl, 2005).

The second approach we pursued to experimentally confirm novel miRNAs is deep sequencing of size-fractionated small RNA libraries of isolated human and mouse tissues. Although it was suggested previously that such efforts had reached near saturation (Lim et al., 2003), only limited numbers of library clones from a selected set of vertebrate tissues have been sequenced (Lagos-Quintana et al., 2001, Lim et al., 2003, Bentwich et al., 2005). Moreover, our computational predictions and microarray(RAKE)-based confirmations suggested many novel miRNAs to be discovered. Therefore, we generated seven high-titer non-concatemerized libraries of size-fractioned small RNA's from mouse brain and various human fetal tissues (brain, skin, heart, lung, and mixed tissues) and sequenced 83,040 clones. After vector and quality trimming 51,044 inserts longer than 17 bases were recovered that represent 8,768 and 7,306 non-redundant mouse and human sequences, respectively. We established a computational pipeline for automated annotation of the cloned sequences, taking into account unique chromosomal position, location in repetitive elements or rRNA, tRNA, snoRNA genes, conservation data from 9 vertebrate genomes (human, mouse, rat, dog, cow, chicken, opossum, zebrafish, and fugu), and secondary structure information using randfold (Bonnet et al., 2004). This analysis was applied to the mouse and human cloned fragments, as well as to all known human and mouse miRNAs and the positive candidates identified using the RAKE assay. 214 out of 238 mouse (90%) and 306 out of 319 human (96%) miRNAs, as deposited in miRBase (Griffiths-Jones, 2004), passed the automated filtering and annotation, showing that the false negative rate is low for the known miRNAs. For the sequenced small RNAs, 21,537 mouse (69%) and 13,120 human (66%) clones passed this filtering. Known abundant miRNA sequences dominate this set, but interestingly about 2% of the reads represent 115 novel mouse and 111 novel human miRNA genes (FIG. 1).

Taken together, we identified 535 novel mouse (RAKE and cloning) and 111 novel human (cloning only) miRNA genes. Although only 17 miRNAs were cloned from both human and mouse samples, the majority of the novel mouse miRNAs has a clear human homologue (over 90% identity for the mature miRNA and 70% for the pre-miRNA), adding up to 401 and 542 of newly discovered miRNA genes in the human and mouse genomes, respectively.

As the majority of novel miRNAs were cloned only once and our cloning efforts identified only about ⅔ of all known miRNAs, we reasoned that the cloning efforts were not exhausted. Therefore, we generated another 32 size-fractionated small RNA libraries from human, chimpanzee, and macaque brain samples. These libraries were not cloned in bacteria, but amplified clonally in an emulsion PCR, followed by massively parallel pyrosequencing (Margulies et al., 2005). A total of more than 1.6 million sequencing reads were evaluated using the bioinformatics analysis pipeline mentioned above. As more vertebrate genomes were available at the time of this analysis, we used an alternative approach for the identification of homologous miRNA genes in other species for this set of miRNAs. The human, chimpanzee, and macaque experiments resulted in the identification of 878, 227, and 1973 novel miRNAs respectively (FIG. 1C). Homology analysis resulted in a set of 2384 novel human microRNAs. 65 microRNAs were found to be human-specific, whereas 17 and 519 were restricted to the chimpanzee and macaque genome, respectively In one embodiment the invention provides a method of identifying a human miRNA or a mouse miRNA. In a further embodiment a method according to the invention comprises an additional step. Said step comprises determining an ortholog or a homologue of a gene. An ortholog or a homologue is determined by comparison of sequences. A human homologue or ortholog is for example determined of a mouse sequence or vice versa, a mouse ortholog is determined of a human sequence. A homologue of a miRNA of FIG. 1 is preferably a mammalian homologue. Mammalian homologues of a miRNA of FIG. 1, comprise at least 90% sequence identity in a stretch of at least 20 consecutive nucleotides of a miRNA of FIG. 1, and are preferably situated in a larger RNA that comprises 70% sequence identity with the corresponding hairpin RNA of said miRNA, wherein said larger RNA is preferably capable of forming a stem loop structure as predicted by an appropriate computer model, and wherein said homologue is preferably situated in a predicted stem region in said larger RNA.

MiRNAs are single strand products derived of longer stem-loop precursors; they can base-pair to messenger RNAs, and thus prevent their expression. Animal genomes contain hundreds of miRNA genes and thousands of genes that are targeted by them. miRNAs often have striking organ-specific expression and can thus be used to discriminate between different cell types.

Historically miRNAs were discovered as freak regulators in weird worms: mutants defective in the timing of cell division in the larvae of the nematode C. elegans were found to be defective in a gene lin-4, which encoded a small RNA that was shown to bind to and silence translation of the lin-14 mRNA (Lee at al., 1993). The general relevance of this landmark discovery became clearer when a second small RNA, let-7, was found to be strongly conserved from worms to flies and human (Reinhart et al., 2000), and when subsequently additional miRNAs were discovered. The current picture is that the human genome contains probably at least 500 miRNA genes (Bartel 2004, Berezikov et al., 2005), which are likely to regulate thousands of target genes (Lim et al., 2005, Lewis et al., 2005). Only the 7 base seed sequence (position 2-8 from the 5' end) seems required for miRNA action in animal cells; why then is the entire miRNA so strongly conserved? Surely other positions contribute small but nevertheless significant effects to miRNA action, but additional explanations may be that the other sequences within the miRNA are required for processing of the precursors, so before the miRNA is mature, and one can not rule out that miRNAs serve other unknown functions in the cell, for which these other sequences are required.

Independent of the discovery of miRNAs, gene silencing by siRNAs was discovered: RNA interference (Fire et al., 1997). The similarity was not immediately recognized, but the central agents in RNAi were RNA molecules of the same size as miRNAs, and since the RNase that makes siRNAs out of longer double stranded RNA had been discovered (Bernstein et al., 2001), it did not—as the phrase is since the 1953 double helix paper-escape anybody's notice that perhaps Dicer might also be responsible for making miRNAs (which was indeed confirmed by a series of parallel papers that showed Dicer mutants are defective in miRNA synthesis). Since then an impressive body of genetic and biochemical analysis has lead to the conclusion that the complexes that silence a mRNA and are guided by a small RNA (RISC, for RNA induced silencing complex) may differ from organism to organism, from tissue to tissue, and there may even be parallel pathways within one cell, but in essence miRNAs and siRNAs act via a fairly similar complex, which always contains at least one member of the family of Argonaut proteins.

The precise mechanism by which miRNAs silence mRNAs is unclear, with several issues that need to be resolved. The original discovery of the first miRNA lin-4 indicated that the target mRNA was left intact and not changed in stead-state levels (Lee et al., 1993); the miRNA was thought to silence but not degrade its target. Since then it has been found that miRNA silencing is actually accompanied by a drop of the levels of the target mRNAs; the drop is often modest, a factor of 2-3 is common, which seems insufficient to fully explain the drop in protein levels, suggesting that also intact mRNAs are silenced (Bagga et al., 2005). The discrepancy with earlier data may be explained because the original study measured RNA levels by RNase protection rather than Northern blots, a technique that is not so sensitive to partial degradation of RNA. A second point that needs to be clarified is whether the translation-suppressing effect of miRNAs is on initiation or elongation of translation, with a recent study showing that introduction of an IRES (Internal Ribosome Entry Site) over-rules miRNA repression, suggesting the action is on initiation (Pillai et al., 2005).

What is the function of miRNAs? The virtual lack of miRNA mutants discovered in forward mutant hunts in genetic systems such as Drosophila or C. elegans may partly be attributed to the small size of the miRNAs as targets of mutagenesis; in addition the miRNAs seem fairly tolerant of a single base change as long as it does not affect the "seed sequence" of 7 nucleotides. Furthermore researchers trying to map a mutation to a protein coding region may have chosen to ignore mutations in non-coding miRNA sequences. However, probably the most important explanation that the miRNAs have been missed in mutant screens is that their knock-out has often no phenotype. In a recent study miRNAs in the nematode genome were knocked out, and the result was that single mutants did not while multiple mutants did have a phenotype (Abbott et al., 2005). We also see this with knock-down of miRNAs in zebrafish embryos using morpholinos. The conclusion is that there is much redundancy; possibly the very high levels of miRNAs in a cell (often more than 50,000 copies) is best achieved by a set of related miRNA encoding genes, and the loss of one of them leads to a modest reduction of levels that is not immediately resulting in a strong visible phenotype. As so often in biology, this raises the question why so many miRNA genes have been strongly conserved if there seems so little selective pressure, and as so often the answer needs to lay in subtle effects that are not recognized under laboratory conditions.

As the seed sequence seems to determine the target specificity of the miRNA the present invention further provides a nucleic acid sequence comprising at least nucleotides 2-8 of a miRNA as depicted in FIG. 1, or the seed sequence of a mammalian homologue of a miRNA as depicted in FIG. 1. In a preferred embodiment said nucleic acid sequence comprising at least nucleotides 2-8 of a miRNA of FIG. 1 comprises between about 18 and 26 nucleotides. Preferably, between about 20-24 nucleotides, more preferably about 22 nucleotides.

As described, knock out mutants of single miRNAs give few hints about the function of miRNAs. One indication of function comes from the study of the expression pattern of miRNAs: our laboratory showed recently that many miRNAs have striking organ specific expression, or even expression restricted to single tissue layers within one organ. This indicates that they play no general housekeeping role in cell metabolism, but most likely a role in an aspect of the difference between differentiated cells (Wienholds et al., 2005). An example of such expression patterns is miR-206 in muscle and miR-34A in the cerebellum. A second hint comes from the crudest miRNA knock out experiment possible: the knock out of all miRNAs (plus siRNAs), by disruption of the Dicer gene, which encodes the nuclease that make miRNAs. (Wienholds et al., 2003). As perhaps expected, this mutation is lethal. In mouse Dicer function is even required for stem cell formation. In zebrafish, however, it is not. Thus one can cross two Dicer heterozygous fish, and analyze the homozygous progeny: it develops normally until approximately a week of age, at which time growth stops and the animals eventually die. The fish embryos have formed most of their organs by 24-48 hour, and after a week swim around, eat and behave as real little beasts, all of this without Dicer. Analysis of miRNA levels show part of the explanation: maternal rescue. In the first days of development even Dicer mutant embryos form new zygotic miRNAs, and this must be done by maternal Dicer function (Dicer mRNA and/or protein in the oocyte). Still it is noteworthy that—with the exception of a few miR-NAs-in the first 24-48 hours of development only low levels are seen, also in the wildtype (Wienholds et al., 2006). Thus the temporal pattern of miRNA expression is that they appear long after most cells have differentiated and tissues have been formed. The slow rise of levels must be the result of accumulation over time: many miRNA genes are embedded in introns of protein coding genes, and are initially transcribed together with their "host" mRNA, and therefore presumably equimolar to the mRNAs; while the mRNA levels remain modest, the miRNA levels build up over time, because the miRNAs are much less turned over than their host mRNAs. An elegant experiment (Giraldez et al., 2005) further drove down the point that miRNAs play no great role in early development: the maternal expression of Dicer can be removed by transplanting germ cells from Dicer mutant embryos into wildtype embryos of the same age: when the fish grow up they are fertile, but their germ line is genetically Dicer mutant. In this situation the fish do not have maternal Dicer, and indeed the animals now arrest earlier in development, but they still form several tissues. The conclusion of these experiments is that miRNAs are required for full development, have an expression patterns suggestive of developmental roles, but are not required for initial tissue differentiation. The abovementioned studies can be further refined with the discovery of the miRNAs of FIG. 1 as new targets for expression of miRNAs in development have now become available.

Some recent studies describe how miRNAs can tune gene expression in development. One study describes the role of mir-61 in determining the fate of one cell in vulval development of the nematode via a feedback loop: cell fate is determined by mutually exclusive expression of one gene or another, and one protein turns on the expression of a miRNA, which tunes down the expression of the second protein (Yoo and Greenwald, 2005). Another recent study describes how miR-196 acts upstream of Hox genes (Hornstein et al., 2005). Genes in the Notch signaling cascade are regulated by a set of miRNAs (Lai et al., 2005). All of these cases can be referred to as programmed miRNA action: the action of miRNAs is an integral part of a developmental event. The logical consequence is that the action is under positive evolutionary pressure, and indeed the Notch-pathway study could exploit the evolutionary conservation of the target sites among insect species to recognize them in 3' UTRs of genes.

A prerequisite for such developmental switches is that at some moment in time the miRNA and its target mRNA are expressed in the same tissue, so that the miRNA can exert its action and silence the expression of its target. Intuitively this is what one might expect to be the rule: if a mRNA is a "genuine target" of a miRNA, the two need to be co-expressed. In other words: a naïve approach to discover biologically relevant miRNA/target pairs would be the following: screen the sequence of the crucial seven base pair "seed" sequence of each miRNA against the 3'UTR of all known genes; take the sets of miRNA/mRNA pairs that result, then filter the entire set by only accepting the pairs where miRNA and target mRNA are expressed in the same tissue. This would seem logical, since how could the two interact if they are not expressed in the same cells? Interestingly two recent studies show the situation is more complex than that. One study was done in Drosophila (Stark et al., 2005), the other in mammals (Farh et al., 2005), and in essence the conclusion are largely the same. The first striking result is this. If one takes miRNAs known to be expressed in a certain type of tissue (say muscle), and looks at the expression levels of genes whose 3'UTR contain a (potential) target-site of such a miRNA (defined operationally as a perfect match to the 7 base seed sequence), then genes with a target site are expressed at higher levels in tissues that do not express the miRNA than in tissues that do! So real partners (miRNAs plus targets) are not necessarily co-expressed. Is this effect cause or consequence? Both of these studies compare miRNA levels to mRNA transcript levels, and since miRNAs can reduce transcript levels (see above) the cause/consequence relation is not entirely clear in all cases. Thus saying that mRNAs and miRNAs avoid co-expression may be an overstatement, since the reduction of a mRNA may also be the consequence of the action of the miRNA, not a consequence of avoidance at the transcriptional level. Bartel and coworkers addressed this point in an elegant fashion: they looked at genes in mouse that do not have a miRNA target, while the human ortholog does. These mouse genes are nevertheless still significantly avoiding expression in the tissues that express the miRNA. This suggests the avoidance is really at the transcriptional level, and is not absence as a result of miRNA action (because the mouse version of the gene sees no miRNA action in that tissue).

Then there is a second effect. Both papers find evidence for "anti-targets": there is selective avoidance of target sites in genes that are expressed at high levels in tissues where the miRNAs are expressed. Since gene expression is reduced by miRNAs, the acquisition of new miRNA target sites for miR-NAs expressed in that tissue (probably not an infrequent event in evolution, since the crucial seed sequence is only 7 nucleotides long) is bad news and will be selected against if it results in an undesired knock down of that gene.

So how do the examples of programmed miRNA action, serving as developmental switches, relate to the notion of avoidance of co-expression? If the miRNA relates to its target as vacuum cleaner to dust, how can the two be seen as fine-tuned partners in a subtle developmental switch? The answer is provided by a beautiful distinction made in the study by Bartel and colleagues (Farh et al., 2005): targets of miRNAs fall into two classes: conserved and non-conserved. This is here operationally defined as those targets which are or are not conserved in the 3'UTRs of human versus orthologous mouse genes. The majority is not conserved, a minority is. Now here is the discovery: the conserved targets are in genes that do not avoid co-expression with their miRNAs, the non-conserved do avoid it.

The class of conserved targets is explained by the essential role the miRNA plays in developmental switches, such as those discussed above in the vulva and the Notch pathways, and we can refer to those cases as programmed miRNA silencing. A second type of conserved targets are those where gene expression is required in one phase of development, but after cell fate determination the miRNAs survey cells to wipe out the remaining traces of expression of these mRNAs that are not meant to be expressed in that tissue. The miRNA system is a vacuum cleaner removing the last speckle of undesired transcripts. Alternatively the system may serve to tune down but deliberately not shut off their targets. Together with the late onset and perseverance of expression of many miRNAs and the differentiation of tissues in embryos of fish devoid of all miRNAs, this indicates that the primary function of many miRNAs may not be to switch cell fate, but rather to dampen the expression of undesired genes, to remind a cell of the fate it has chosen previously: remember you are a muscle cell, do not have the nerve to highly express other genes!

The non-conserved majority has a completely different explanation: apparently 3'UTRs of genes are full of sequences to which miRNAs can bind; this is not surprising if the only truly essential feature is homology to the 7 nucleotide seed sequence: with a 3'UTR of one or two thousand base pairs, and with hundreds of different miRNAs, there will often be matches. In evolution such new "miRNA" recognition sequences pop up all of the time, and there is nothing wrong with them per se. The problem appears only if the target is in a gene that needs to be expressed at a significant level precisely in the tissue in which the corresponding miRNA is present at high levels, ready to silence any miRNA that matches its seed sequence. For these genes the match to this miRNA may be a nuisance, with negative fitness as result, and thus these matches are counter selected. Newly appearing miRNA target sequences (of no function, and thus under no evolutionary pressure to remain conserved) will not be selected against, and have essentially neutral fitness effects if the miRNA that could bind to them is not expressed in the same tissue. These target sequences have no physiological relevance, and thus are therefore ignored by evolution, neither selected for nor against, as long as they are not expressed in the tissues that express the miRNAs. These 7 base pair sequences are to the organism like EcoRI restriction sites in DNA (GAATTC): of no concern or interest (as long as there is no EcoRI around in the cell).

The combinations between miRNAs and their target can thus be classified in at least three groups: positively selected, neutral and negatively selected.

1. The positively selected or programmed interactions can be genuine cell fate switches, such as the switch of the 2nd vulval cell fate by miR-61 in worms, where at a crucial phase in time a cell needs to make a choice. A second type of programmed targets are those where after cell fate determination all traces of mRNAs that were required in a previous developmental stage need to be removed, or levels of genes need to remain tuned down significantly. Such interactions may be expected to be conserved, since they contribute positively to stable establishment or maintenance of cell fate.

2. The second class of combinations is neutral. There are two possibilities. The first one is trivial: miRNAs and targets are not expressed in the same tissue. If a gene is expressed uniquely in gut epithelium, the presence of a target for a muscle miRNA is irrelevant. A second class of pairs is real, meaning the miRNA and its target do interact in real life, but the effect is evolutionarily neutral. A gene may be tuned down a bit, or it may not, and the organism does not care. Note that these interactions are neutral in an evolutionary sense, no selective effect, but not in a biochemical sense, since the miRNAs do down-regulate (and experimental knock out of the miRNA would therefore result in an upward effect on target gene expression). The class of neutral but active miRNA-target interactions may turn out to be very large. While the first class (programmed interactions) will be conserved among species, the second class is not.

3. The third class of miRNA-target interactions are those where the miRNA is expressed in the same tissue as the mRNA, shutting off genes that need to be expressed. The avoidance data suggest that there is selective pressure against such co-expression, and they have been referred to as anti-targets. There is inevitably a steady state level of recently appeared target sites in anti-target genes, but these will be filtered out eventually by selective pressure.

Given these distinctions, there are several ways that mutation of miRNA-target interactions may cause disease. A miRNA may mutate and lose function; there is in many cases some level of redundancy, but this is at a gross level (visible in the laboratory), while loss of even one miRNA gene may have subtle negative disease-causing effects. Also a programmed miRNA target site may mutate, releasing the gene from miRNA-control. Finally a gene may acquire a novel and undesired miRNA target sequence: there are numerous sequences that are only one mutation away from becoming a target for one of the miRNAs expressed in the same tissue. Some of these mutations will result in undesired reduction of gene activity, and may cause disease. So the three possible causes of disease are: 1. mutation of a miRNA gene 2. mutation of a programmed miRNA target site 3. mutation that creates a new target-site in an anti-target gene.

On a more positive note: given complex combinatorial effects of regulation of genes by often more than one miRNA, each of which has a subtle effect on gene expression, polymorphisms in miRNA targets may be the ideal substrate for the type of small variations in development that natural selection can act upon in evolution. Protein coding changes may often either fully disrupt protein function altogether, which rarely contributes positively to fitness, they may leave the protein unaltered, or reduce the activity of the encoded protein. On the other hand miRNA target changes may sculpture expression patterns with great finesse. The many gradual differences that add up to make a mouse embryo out of a mouse zygote and a fish out of a fish zygote are certainly mostly differences in timing and levels of expression of factors that perform essentially identical biochemical actions, rather than differences in protein action. Therefore fine tuning of gene expression by gain or loss of miRNA target sequences may be expected to be a major mechanism in evolution and disease processes.

Where in the present invention the expression of a miRNA of FIG. 1 is measured in a method of the invention, or a collection of miRNA of FIG. 1 is provided or a complement thereof or a sequence which hybridizes under stringent conditions thereto, or the complement thereof, or a (micro-)array comprising a miRNA of FIG. 1 is provided, or of a complement thereof or a sequence which hybridizes under stringent conditions thereto, or the complement thereof, it is preferred that the expression, collection or array is measured of or comprises at least 5 miRNA of FIG. 1 or a complement thereof or a sequence which hybridizes under stringent conditions thereto, or the complement thereof. More preferably, the expression, collection or array is measured of or comprises at least 10 miRNA of FIG. 1 or a complement thereof or a sequence which hybridizes under stringent conditions thereto, or the complement thereof. More preferably, the expression, collection or array is measured of or comprises at least 20 miRNA of FIG. 1 or a complement thereof or a sequence which hybridizes under stringent conditions thereto, or the complement thereof. More preferably, the expression, collection or array is measured of or comprises at least 40 miRNA of FIG. 1 or a complement thereof or a sequence which hybridizes under stringent conditions thereto, or the complement thereof. More preferably, the expression, collection or array is measured of or comprises at least 60 miRNA of FIG. 1 or a complement thereof or a sequence which hybridizes under stringent conditions thereto, or the complement thereof. More preferably, the expression, collection or array is measured of or comprises at least 100 miRNA of FIG. 1 or a complement thereof or a sequence which hybridizes under stringent conditions thereto, or the complement thereof. More preferably, the expression, collection or array is measured of or comprises at least 200 miRNA of FIG. 1 or a complement thereof or a sequence which hybridizes under stringent conditions thereto, or the complement thereof. More preferably, the expression, collection or array is measured of or comprises at least 400 miRNA of FIG. 1 or a complement thereof or a sequence which hybridizes under stringent conditions thereto, or the complement thereof. More preferably, the expression, collection or array is measured of or comprises at least 600 miRNA of FIG. 1 or a complement thereof or a sequence which hybridizes under stringent conditions thereto, or the complement thereof.

Where in the present invention the expression of a hairpin RNA of FIG. 1 is measured in a method of the invention, or a collection of hairpin RNA of FIG. 1 is provided or a complement thereof or a sequence which hybridizes under stringent conditions thereto, or the complement thereof, or a (micro-)array comprising a hairpin RNA of FIG. 1 is provided, or a complement thereof or a sequence which hybridizes under stringent conditions thereto, or the complement thereof, it is preferred that the expression, collection or array is measured of or comprises at least 5 hairpin RNA of FIG. 1 or a complement thereof or a sequence which hybridizes under stringent conditions thereto, or the complement thereof. More preferably, the expression, collection or array is measured of or comprises at least 10 hairpin RNA of FIG. 1 or a complement thereof or a sequence which hybridizes under stringent conditions thereto, or the complement thereof. More preferably, the expression, collection or array is measured of or comprises at least 20 hairpin RNA of FIG. 1 or a complement thereof or a sequence which hybridizes under stringent conditions thereto, or the complement thereof. More preferably, the expression, collection or array is measured of or comprises at least 40 hairpin RNA of FIG. 1 or a complement thereof or a sequence which hybridizes under stringent conditions thereto, or the complement thereof. More preferably, the expression, collection or array is measured of or comprises at least 60 hairpin RNA of FIG. 1 or a complement thereof or a sequence which hybridizes under stringent conditions thereto, or the complement thereof. More preferably, the expression, collection or array is measured of or comprises at least 100 hairpin RNA of FIG. 1 or a complement thereof or a sequence which hybridizes under stringent conditions thereto, or the complement thereof. More preferably, the expression, collection or array is measured of or comprises at least 200 hairpin RNA of FIG. 1 or a complement thereof or a sequence which hybridizes under stringent conditions thereto, or the complement thereof. More preferably, the expression, collection or array is measured of or comprises at least 400 hairpin RNA of FIG. 1 or a complement thereof or a sequence which hybridizes under stringent conditions thereto, or the complement thereof. More preferably, the expression, collection or array is measured of or comprises at least 600 hairpin RNA of FIG. 1 or a complement thereof or a sequence which hybridizes under stringent conditions thereto, or the complement thereof. Expression is preferably measured through determining whether a cell comprises said miRNA or hairpin RNA. This is also used for characterizing a cell or a sample.

In a preferred embodiment expression or the presence of a human miRNA or hairpin RNA is measured or characterized in a cell or sample using a method of the invention. Thus in a preferred embodiment said collection and or (micro-)array comprises at least one, preferably at least 5, more preferably at least 10, more preferably at least 20, more preferably at least 40, more preferably at least 60, more preferably at least 100, more preferably at least 200, more preferably at least 200, more preferably at least 400, more preferably at least 600 human miRNA and/or human hairpin RNA of FIG. 1, or a complement thereof or a sequence which hybridizes under stringent conditions thereto, or the complement thereof.

In a preferred embodiment expression or the presence of a primate miRNA or hairpin RNA is measured or characterized in a cell or sample using a method of the invention. Thus in a preferred embodiment said collection and or (micro-)array comprises at least one, preferably at least 5, more preferably at least 10, more preferably at least 20, more preferably at least 40, more preferably at least 60, more preferably at least 100, more preferably at least 200, more preferably at least 200, more preferably at least 400, more preferably at least 600 primate miRNA and/or primate hairpin RNA of FIG. 1, or a complement thereof or a sequence which hybridizes under stringent conditions thereto, or the complement thereof. In a preferred embodiment said primate is a human. In another preferred embodiment said primate is a chimpanzee or a macaque.

Where in the present invention a nucleic acid molecule is provided comprising a nucleotide sequence as shown in FIG. 1, and/or a nucleotide sequence which is the complement thereof, and/or a nucleotide sequence which has an identity of at least 80% to said nucleotide sequence or complement thereof, and/or a nucleotide sequence which hybridizes under stringent conditions to such a nucleotide sequence it is preferred at least 5 different nucleic acid molecules comprising a nucleotide sequence as shown in FIG. 1, and/or a nucleotide sequence which is the complement thereof, and/or a nucleotide sequence which has an identity of at least 80% to said nucleotide sequence or complement thereof, and/or a nucleotide sequence which hybridizes under stringent conditions to such a nucleotide sequence, are provided. Preferably at least 10, more preferably at least 20, more preferably at least 40, more preferably at least 60, more preferably at least 100, more preferably at least 200 and more preferably at least 600 different nucleic acid molecules comprising a nucleotide sequence as shown in FIG. 1, and/or a nucleotide sequence which is the complement thereof, and/or a nucleotide sequence which has an identity of at least 80% to said nucleotide sequence or complement thereof, and/or a nucleotide sequence which hybridizes under stringent conditions to such a nucleotide sequence, are provided. In a preferred aspect of this embodiment, said sequence of FIG. 1 is a miRNA sequence, preferably a human miRNA sequence. In a further preferred aspect of this embodiment, said sequence of FIG. 1 is a hairpin RNA sequence, preferably a primate hairpin sequence, more preferably a human sequence. In another preferred embodiment said hairpin RNA sequence is a chimpanzee sequence or macaque sequence.

The invention further provides a collection of oligonucleotides or oligonucleotide analogues selected from the group consisting of set A, set B and set C, wherein;
  set A is a set of oligonucleotides or oligonucleotide analogues comprising complementary sequences to all of the sequences identified in FIG. 9,
  set B is a set of oligonucleotides or oligonucleotide analogues comprising complementary sequences to all of the sequences of set A and
  set C is the set of oligonucleotides identified in FIG. 9.
These collections are especially suited to determine the differentiation state of a cell. A sample comprising RNA of said cell can be scrutinized for the presence of the microRNAs identified in FIG. 9. These microRNAs are differentially expressed in primitive versus differentiated cells. Cells that have undergone one or more modification on the way to tumorigenesis, or tumour cells themselves are often dedifferentiated when compared to the cell type they originated from. The sets A, B or C are therefore very well suited to determine whether a sample of cells comprises dedifferentiated cells, preferably tumour cells. The miRNA referred to is often under expressed in the dedifferentiated tissue. In a preferred embodiment the invention provides a collection of oligonucleotides or oligonucleotide analogues selected from the group consisting of set A, set B and set C, wherein;
  set A is a set of oligonucleotides or oligonucleotide analogues comprising complementary sequences to at least the minimal sequence and/or seed sequence of all of the miRNA sequences identified in FIG. 9,
  set B is a set of oligonucleotides or oligonucleotide analogues comprising complementary sequences to at least the minimal sequence and/or seed sequence of all of the miRNA sequences of set A and set C is the set of oligonucleotides comprising at least the minimal sequence and/or seed sequence of the miRNAs identified in FIG. 9.

Set A is a set of oligonucleotides or oligonucleotide analogues comprising complementary sequences to all of the sequences identified in FIG. 9. The set A therefore preferably comprises the same number of oligonucleotides are oligonucleotide analogues as specified in FIG. 9. Similarly, set B is a set of oligonucleotides or oligonucleotide analogues comprising complementary sequences to at least the minimal sequence and/or seed sequence of all of the miRNA sequences of set A. Thus set B therefore preferably comprises the same number of oligonucleotides are oligonucleotide analogues as specified in FIG. 9. An oligonucleotide analogue is a nucleic acid analogue having a sequence that corresponds to the sequence of an oligonucleotide. A set of oligonucleotides of the invention preferably comprises oligonucleotides or nucleic acid analogues thereof, having or corresponding to a sequence length of a nucleic acid of the invention, preferably a miRNA of the invention. Thus an oligonucleotide is defined herein as a nucleic acid molecule according to the invention having a length of from 18 to 26 nucleotides, preferably of from 19-24 nucleotides, most preferably 20, 21, 22 or 23 nucleotides. Currently many different types of nucleic acid modifications and alternative structures are generated that mimic the sequence of a nucleic acid but are themselves sometime not referred to as nucleic acid. Non-limiting examples of such nucleic acid analogues are analogues containing one or more nucleotide analogues that mimic the base pairing characteristics of the nucleotide they replace. Nucleic acid molecules that include such nucleotide analogues are considered to be a nucleic acid analogue of a nucleic acid molecule of the invention if they contain the same hybridisation characteristics or base pairing characteristics in kind not necessarily in amount as said nucleic acid molecule of the invention. Other non-limiting examples of nucleic acid molecule analogues are locked nucleic acid (LNA), peptide nucleic acid (PNA) or morpholino. Yet other nor-limiting examples of nucleic acid molecule analogues of the invention are modifications of the sugar backbone that alter the stability of the molecule, such modifications typically do not alter the kind of base pairing characteristics. A non-limiting example of such a modification is the 2-O-methyl modification often used for oligonucleotides.

In a preferred embodiment the invention provides a collection of oligonucleotides or nucleic acid analogues thereof selected from the group consisting of set A, set B and set C, wherein;
set A is a set of oligonucleotides or nucleic acid analogues thereof comprising complementary sequences to all of the sequences identified in FIG. 9,
set B is a set of oligonucleotides or nucleic acid analogues thereof comprising complementary sequences to all of the sequences of set A and
set C is the set of oligonucleotides identified in FIG. 9.

The invention further provides a collection of oligonucleotides or nucleic acid analogues thereof selected from the group consisting of sets D-R, wherein;
set D is the set of oligonucleotides identified in FIG. 4,
set E is the set of oligonucleotides identified in FIG. 5,
set F is the set of oligonucleotides identified in FIG. 6,
set G is the set of oligonucleotides identified in FIG. 7,
set H is the set of oligonucleotides identified in FIG. 8,
set I is a set of oligonucleotides or nucleic acid analogues thereof comprising complementary sequences to all of the sequences identified in FIG. 4,
set J is a set of oligonucleotides or nucleic acid analogues thereof comprising complementary sequences to all of the sequences identified in FIG. 5,
set K is a set of oligonucleotides or nucleic acid analogues thereof comprising complementary sequences to all of the sequences identified in FIG. 6,
set L is a set of oligonucleotides or nucleic acid analogues thereof comprising complementary sequences to all of the sequences identified in FIG. 7,
set M is a set of oligonucleotides or nucleic acid analogues thereof comprising complementary sequences to all of the sequences identified in FIG. 8, and
oligonucleotide sets N, O, P, Q and R or nucleic acid analogues thereof, that comprise complementary sequences to all of the sequences of respectively sets I, J, K, L and M. Set N thus corresponds to set I, set O to set J, set P to set K, set Q to set L and set R to set M.

The invention further provides a collection of oligonucleotides or nucleic acid analogues thereof selected from the group consisting of sets D-R, wherein;
set D is the set of oligonucleotides comprising at least the minimal sequence and/or seed sequence of the microRNAs identified in FIG. 4,
set E is the set of oligonucleotides comprising at least the minimal sequence and/or seed sequence of the microRNAs identified in FIG. 5,
set F is the set of oligonucleotides comprising at least the minimal sequence and/or seed sequence of the microRNAs identified in FIG. 6,
set G is the set of oligonucleotides comprising at least the minimal sequence and/or seed sequence of the microRNAs identified in FIG. 7,
set H is the set of oligonucleotides comprising at least the minimal sequence and/or seed sequence of the microRNAs identified in FIG. 8,
set I is a set of oligonucleotides or nucleic acid analogues thereof comprising complementary sequences to at least the minimal sequence and/or seed sequence of all of the microRNAs identified in FIG. 4,
set J is a set of oligonucleotides or nucleic acid analogues thereof comprising complementary sequences to at least the minimal sequence and/or seed sequence of all of the microRNAs identified in FIG. 5,
set K is a set of oligonucleotides or nucleic acid analogues thereof comprising complementary sequences to at least the minimal sequence and/or seed sequence of all of the microRNAs identified in FIG. 6,
set L is a set of oligonucleotides or nucleic acid analogues thereof comprising complementary sequences to at least the minimal sequence and/or seed sequence of all of the microRNAs identified in FIG. 7,
set M is a set of oligonucleotides or nucleic acid analogues thereof comprising complementary sequences to at least the minimal sequence and/or seed sequence of all of the microRNAs identified in FIG. 8, and
oligonucleotide sets N, O, P, Q and R or nucleic acid analogues thereof, that comprise complementary sequences to all of the sequences of respectively sets I, J, K, L and M. Set N thus corresponds to set I, set O to set J, set P to set K, set Q to set L and set R to set M.

BRIEF DESCRIPTION OF THE DRAWINGS

FIG. 2

Figure 1A:
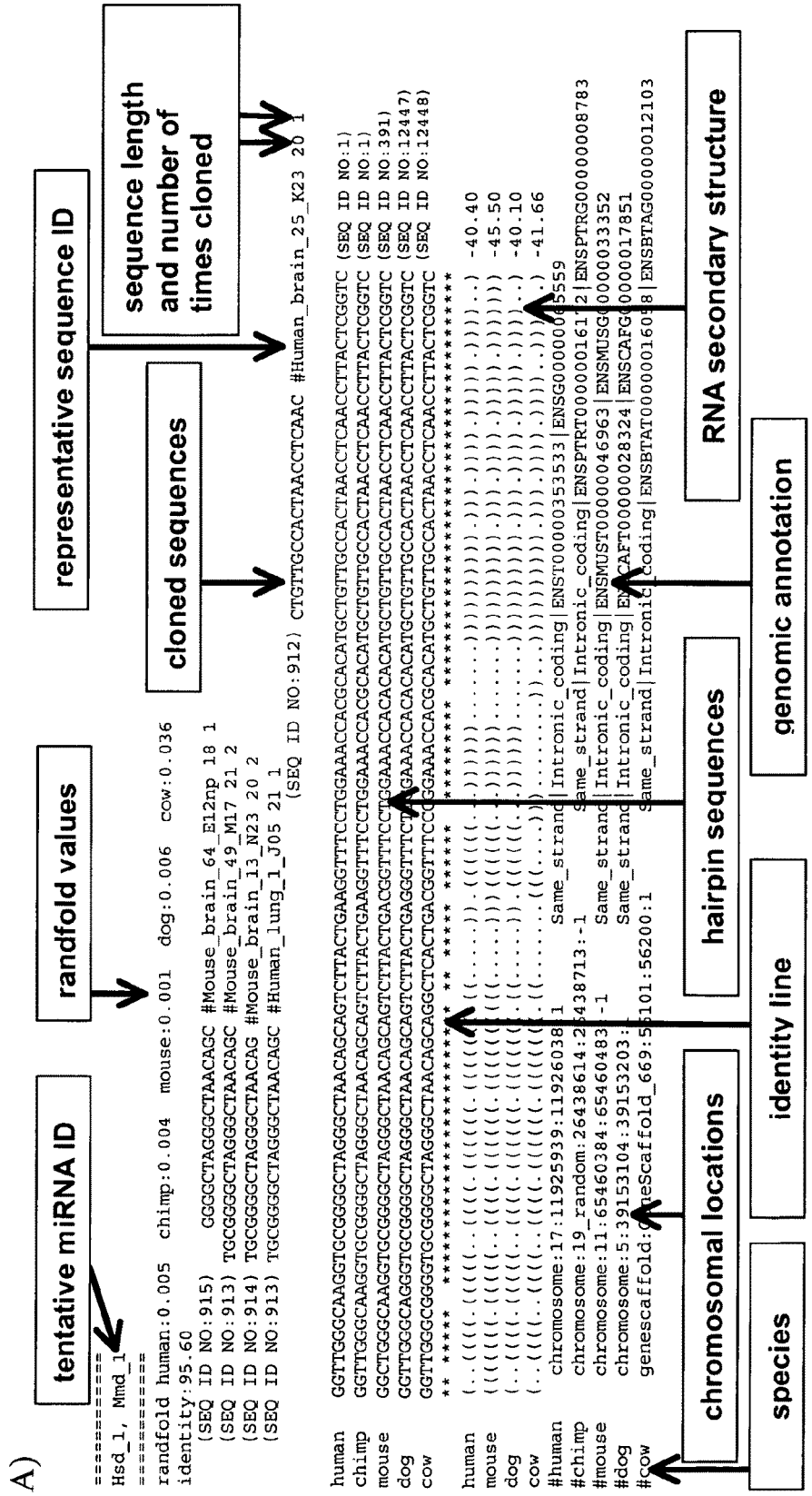
FIG. 1*a* contains an explanation of the format.
Figure 1B:
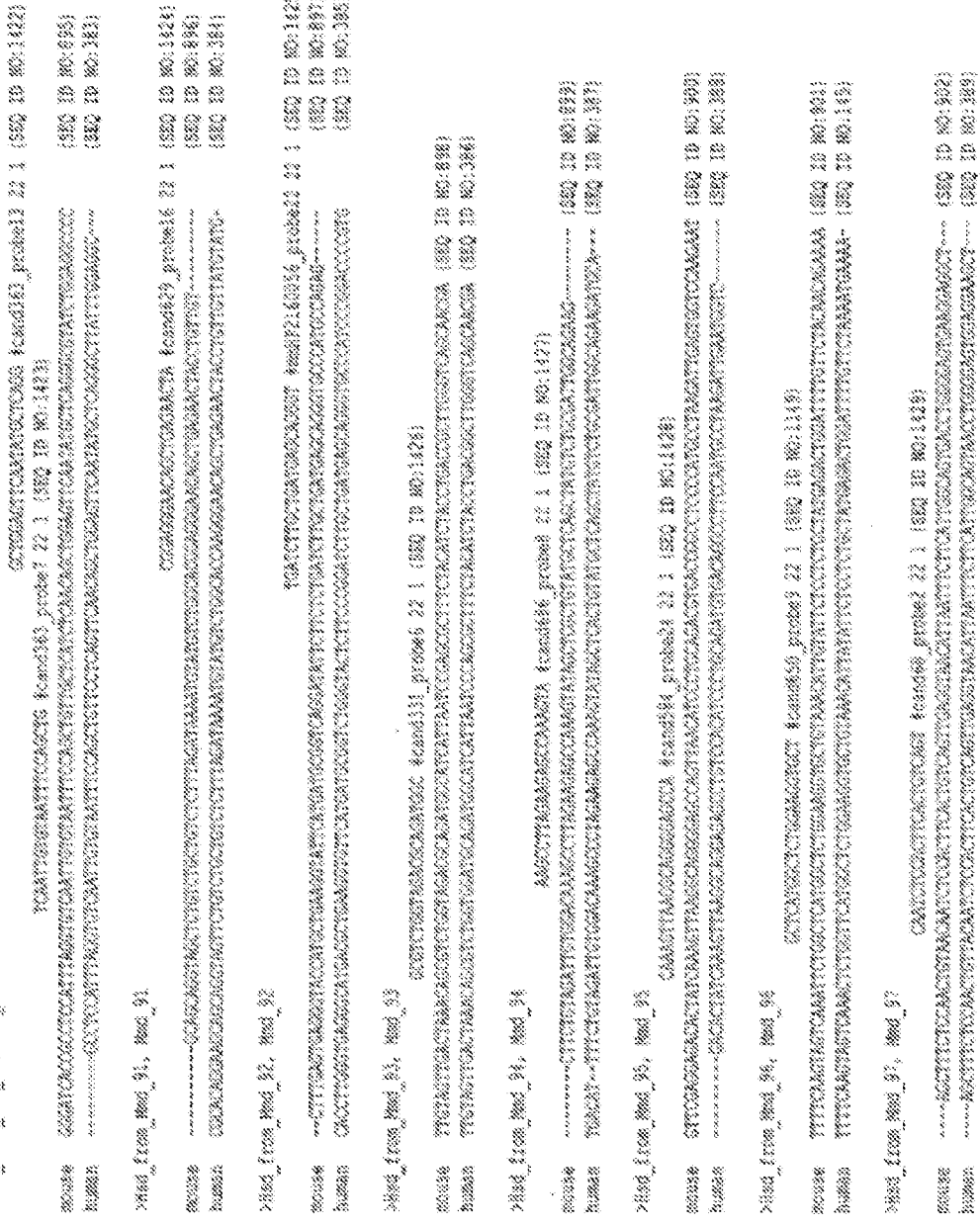
FIG. 1
Compilation of miRNA and hairpin RNA and expression thereof.
Figure 1C:
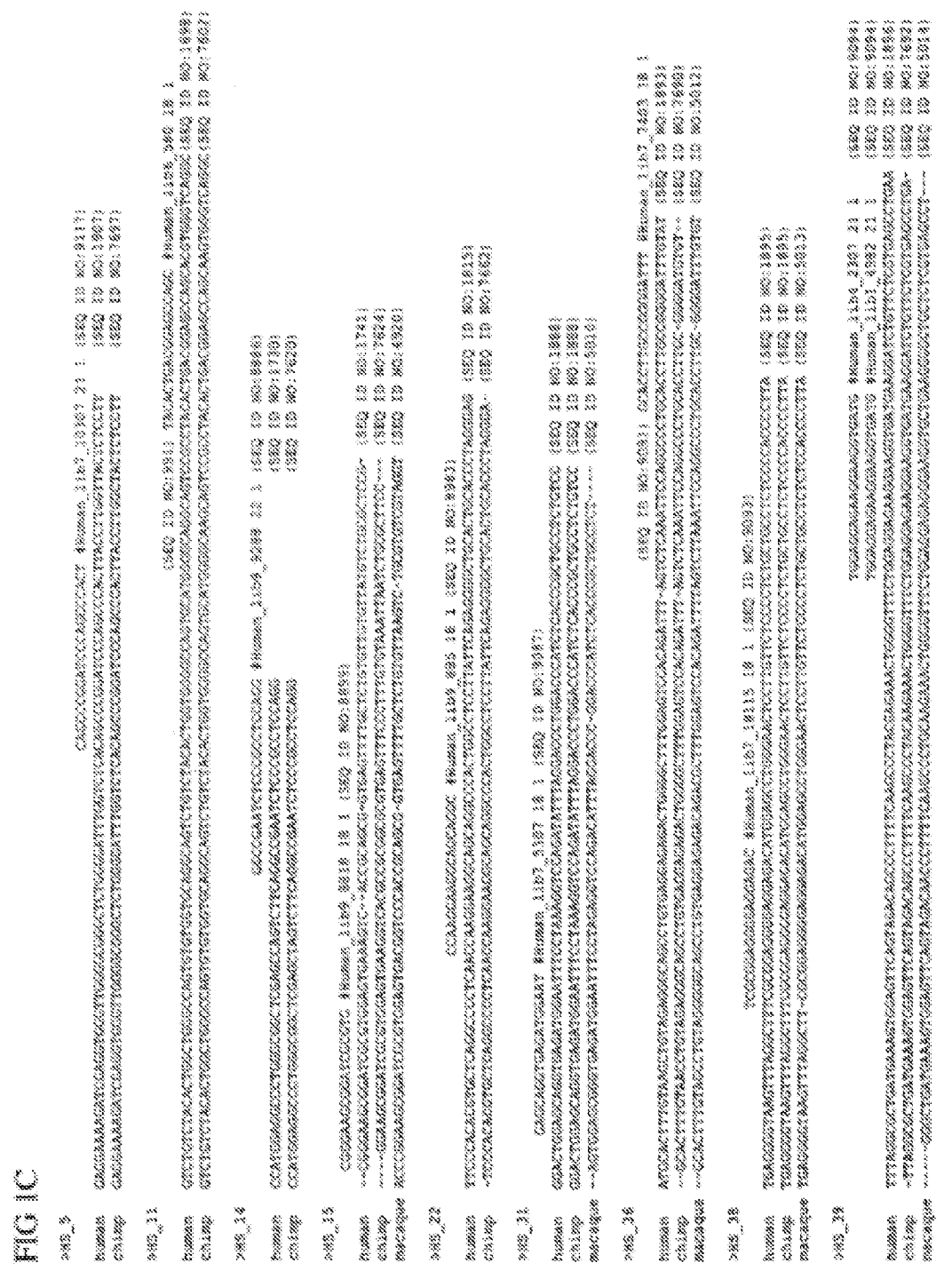
Figure 1C:
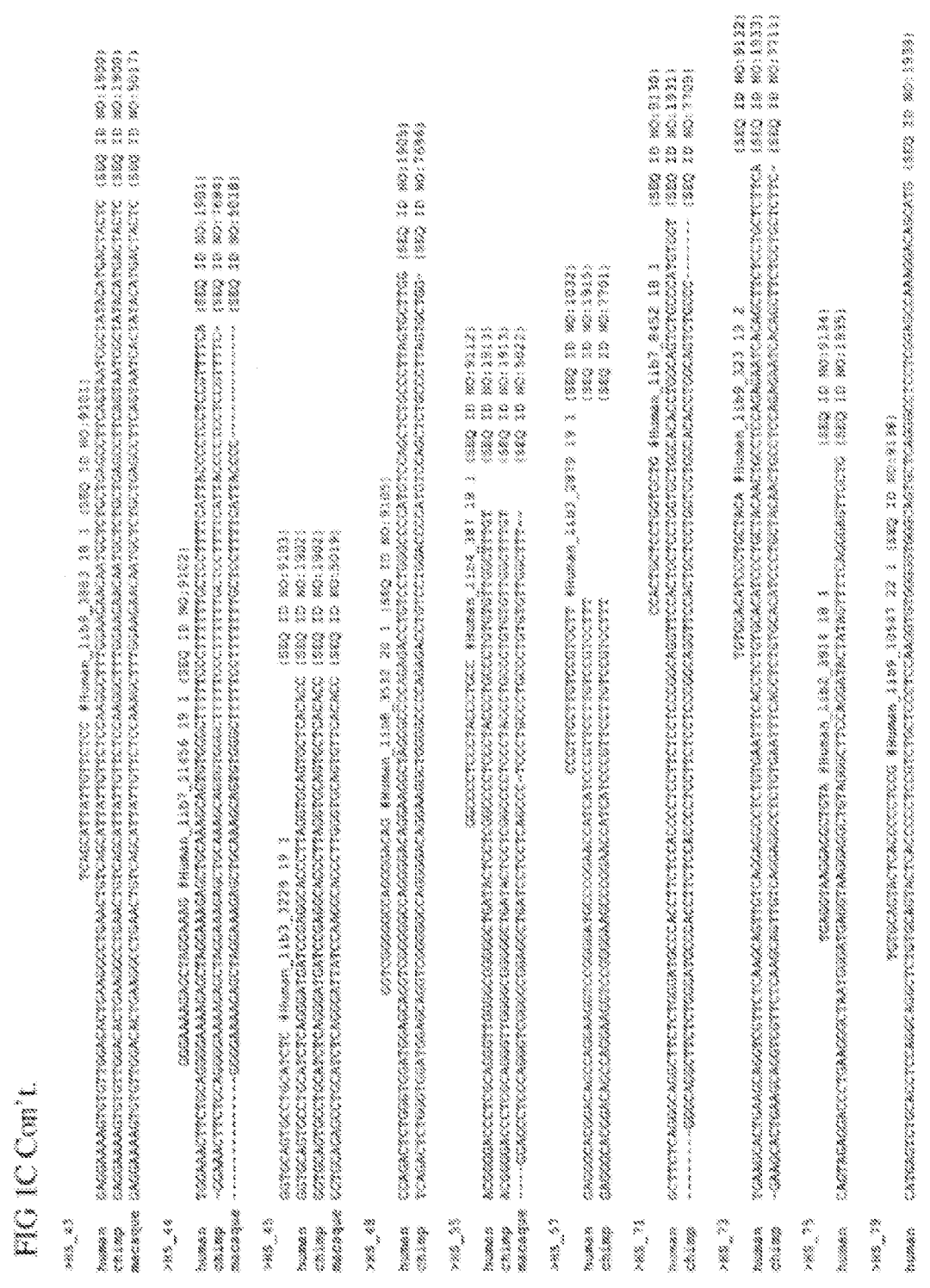
Figure 1C:
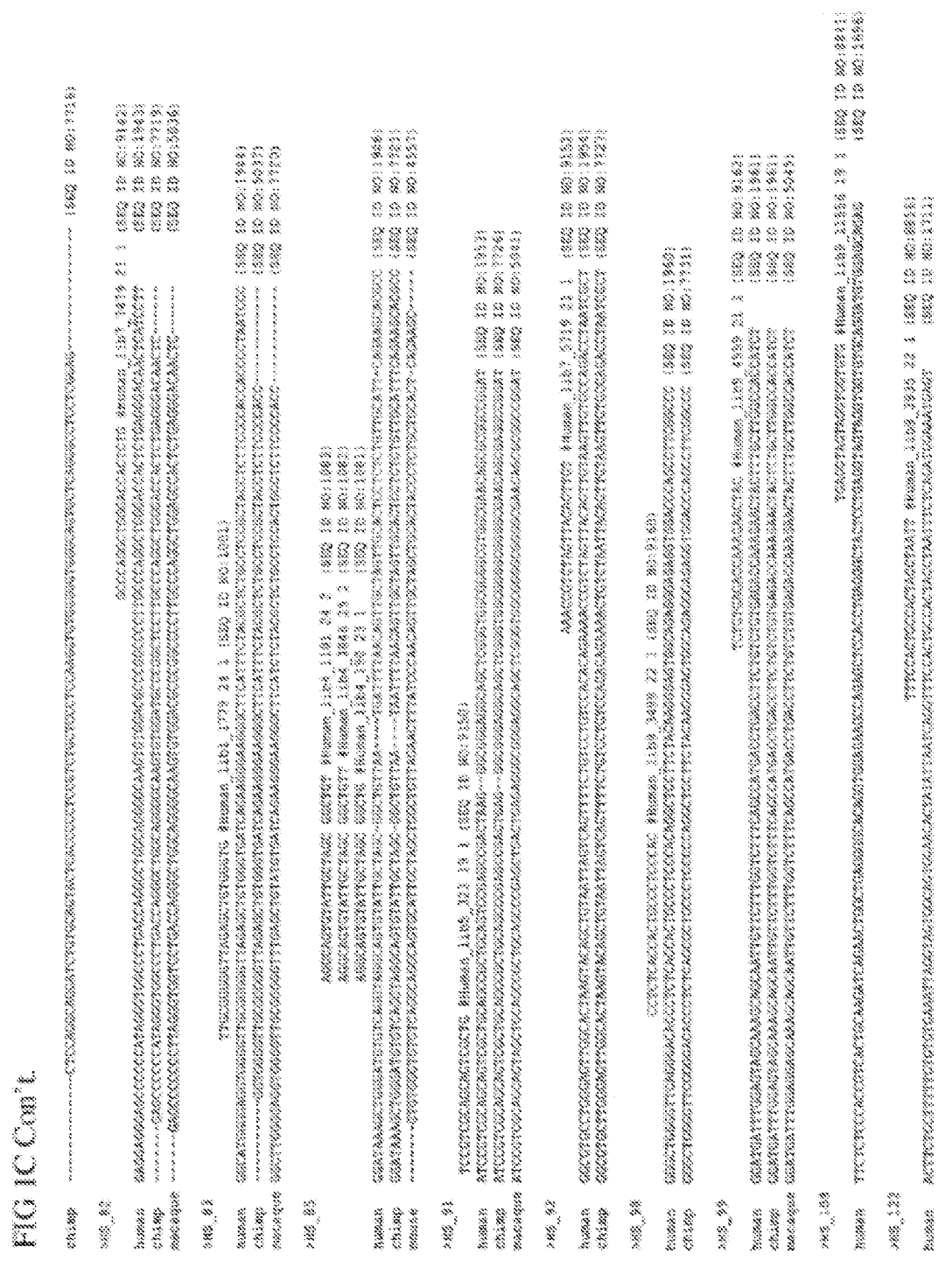
Figure 1C:
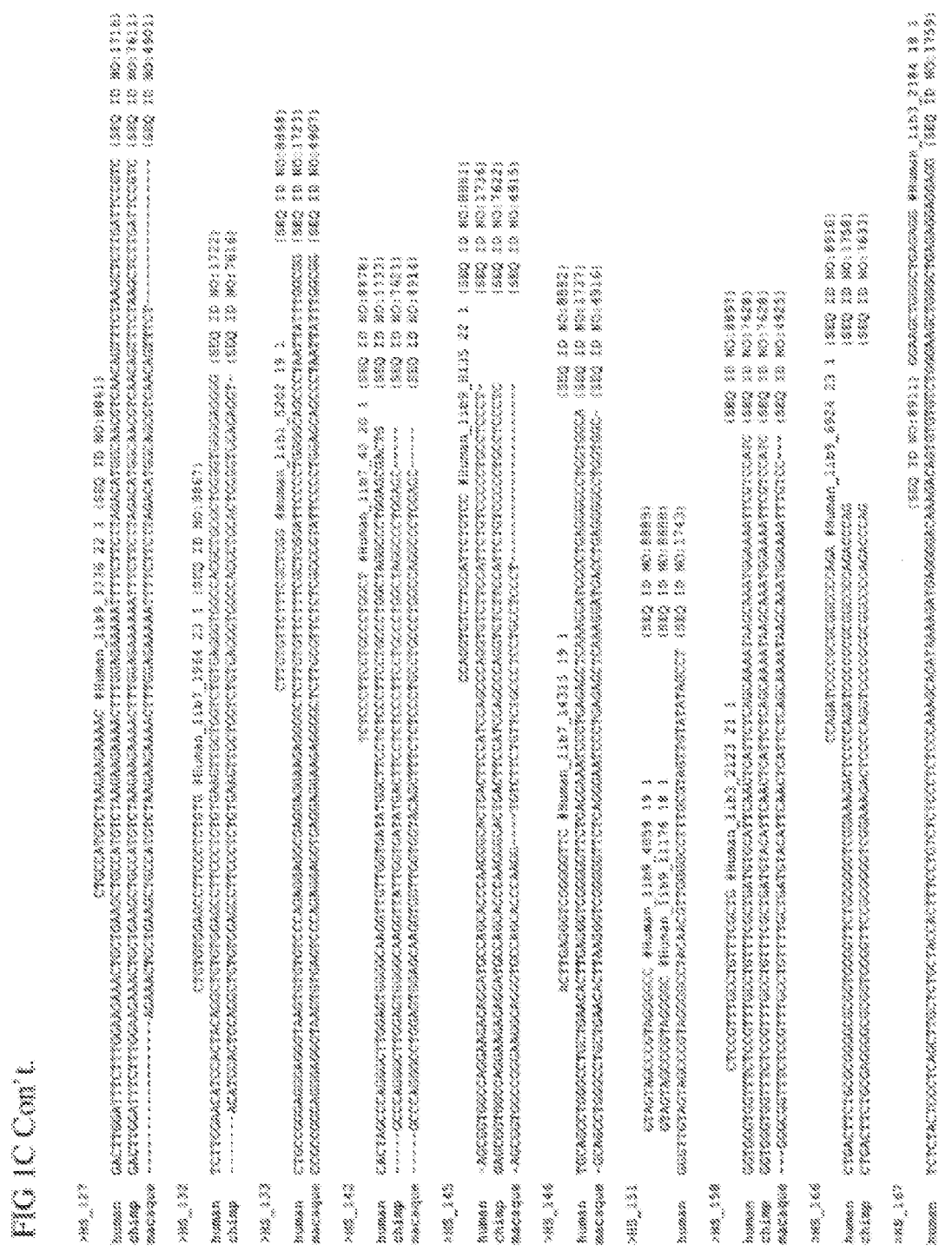
Figure 1C:
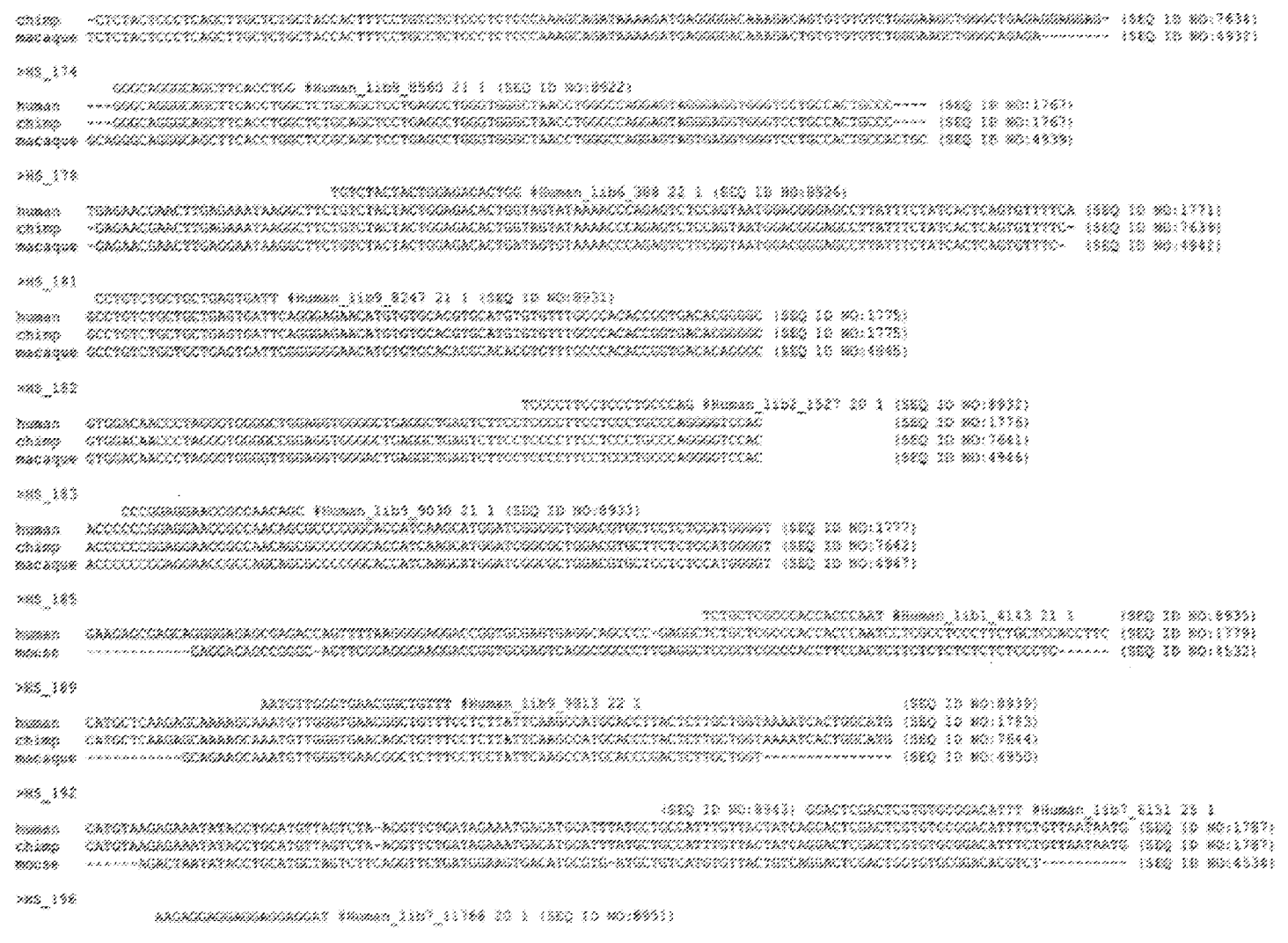
Figure 1C:
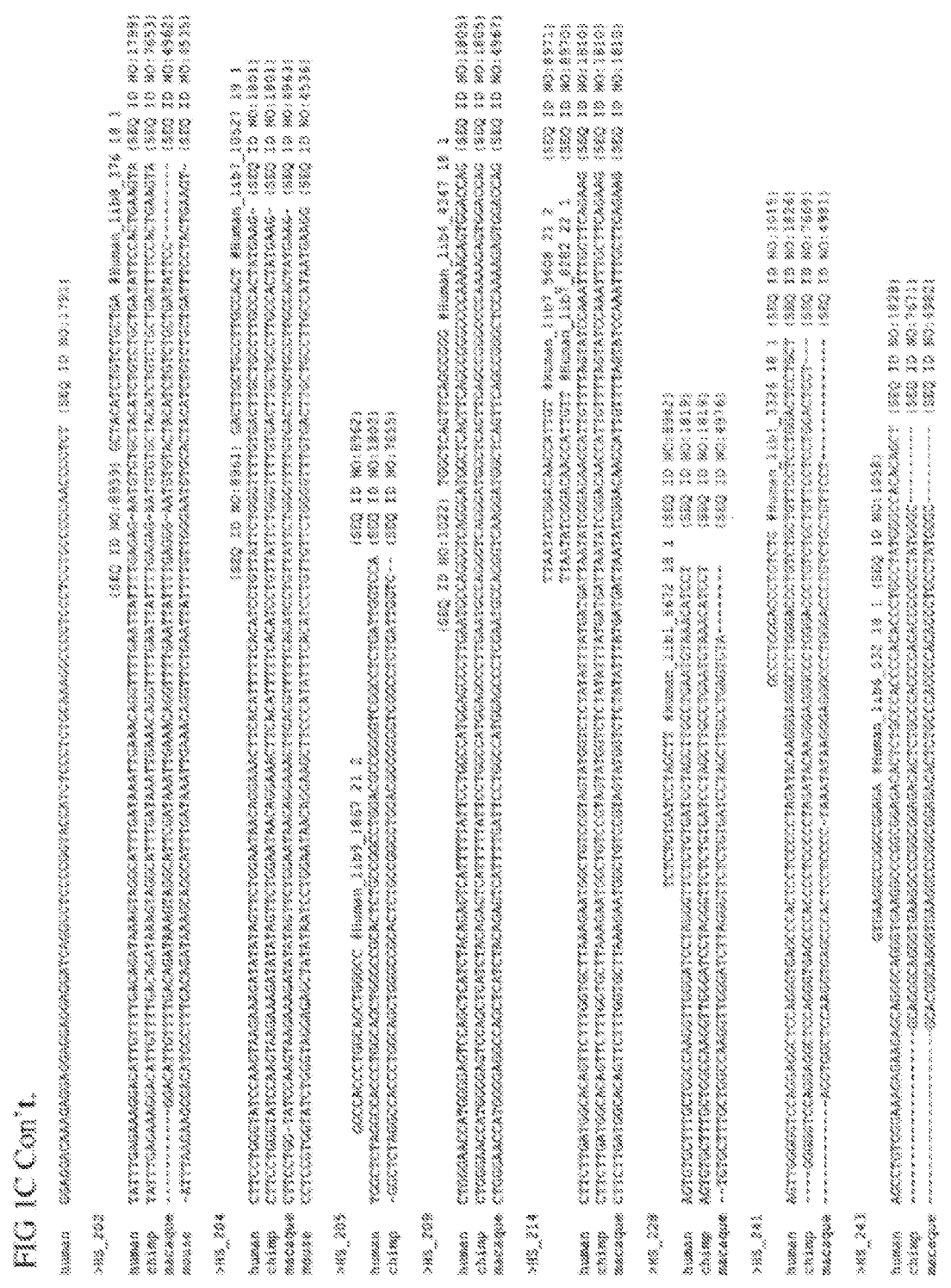
Figure 1C:
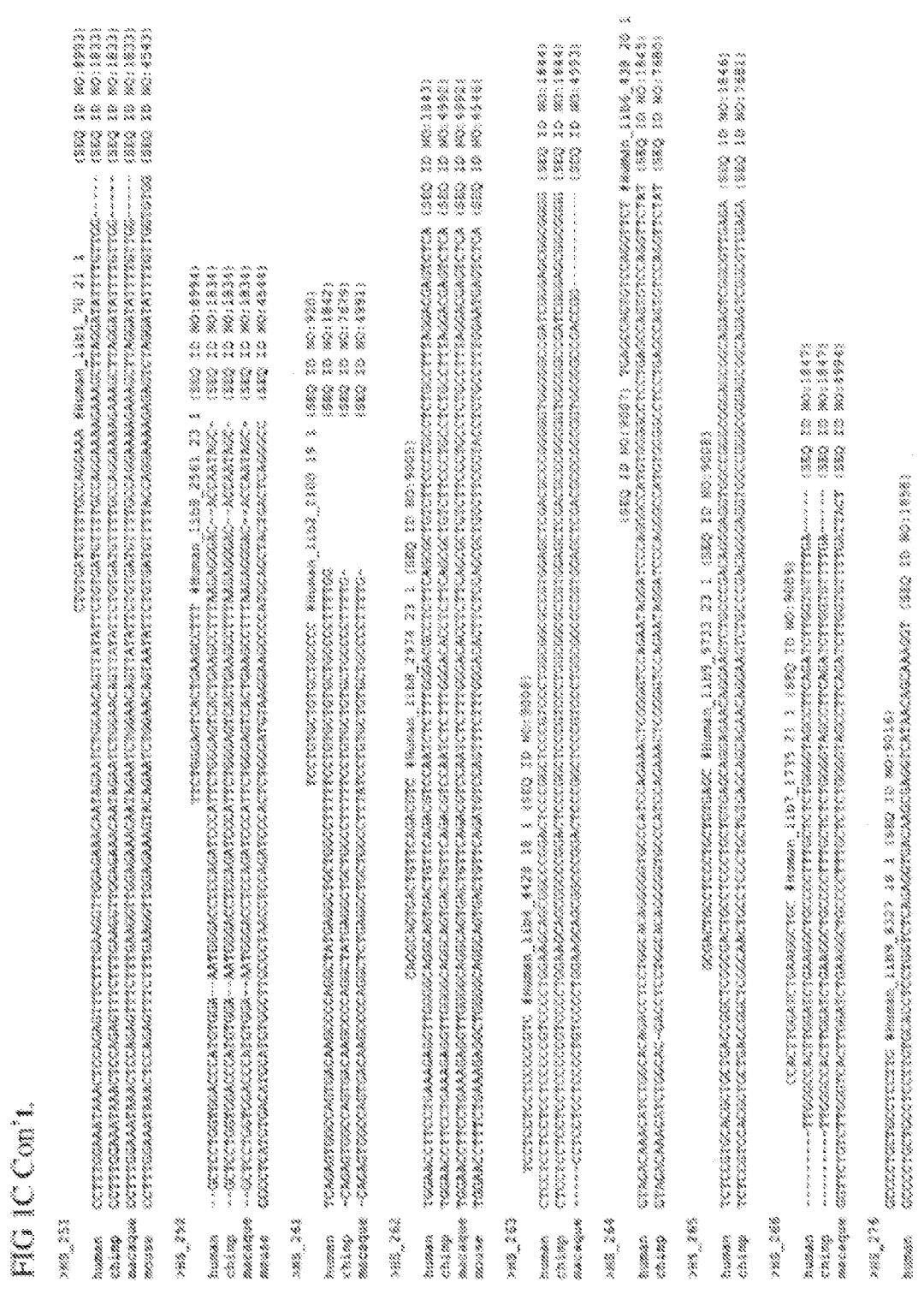
Figure 1C:
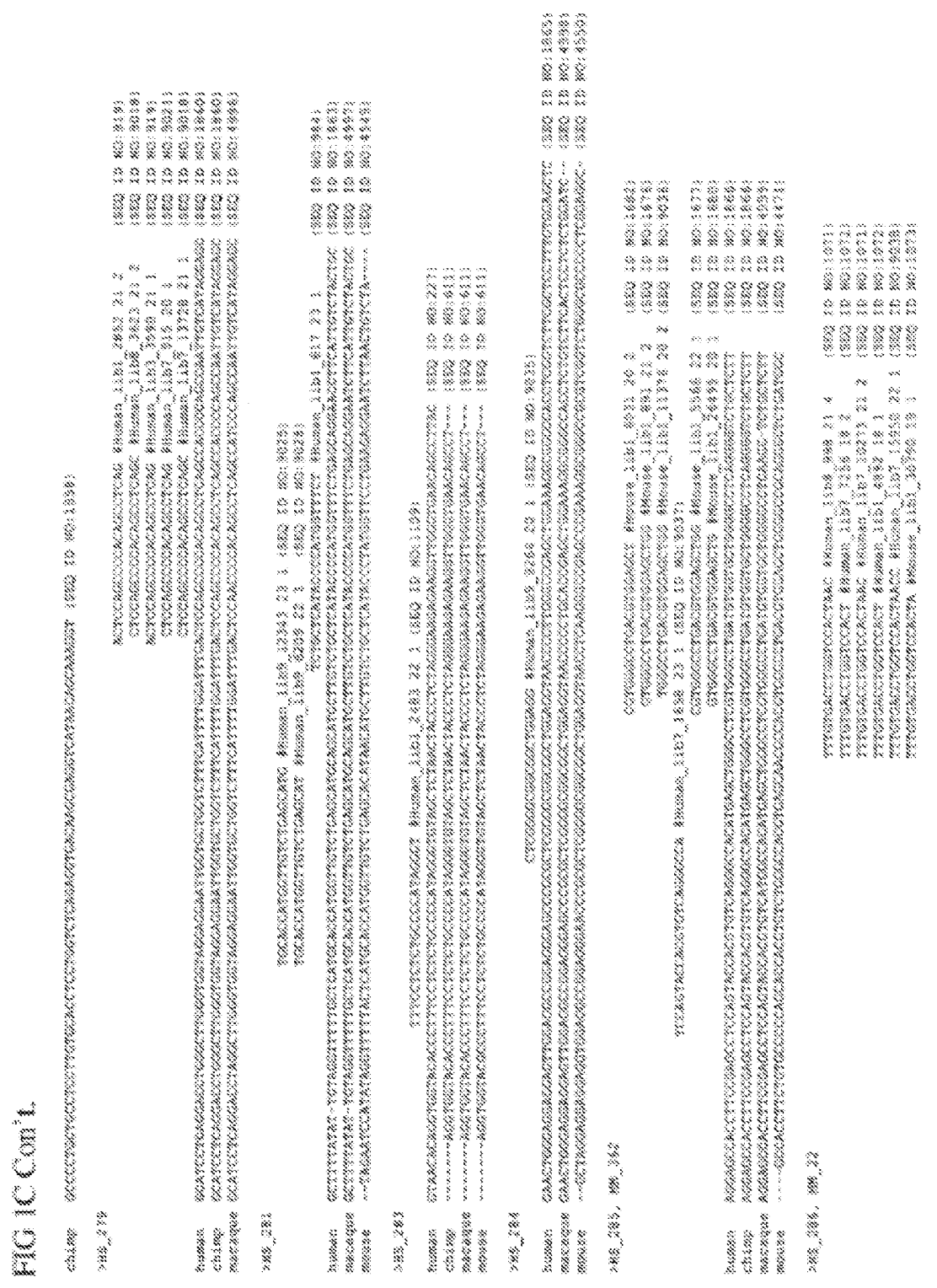
Figure 1C:
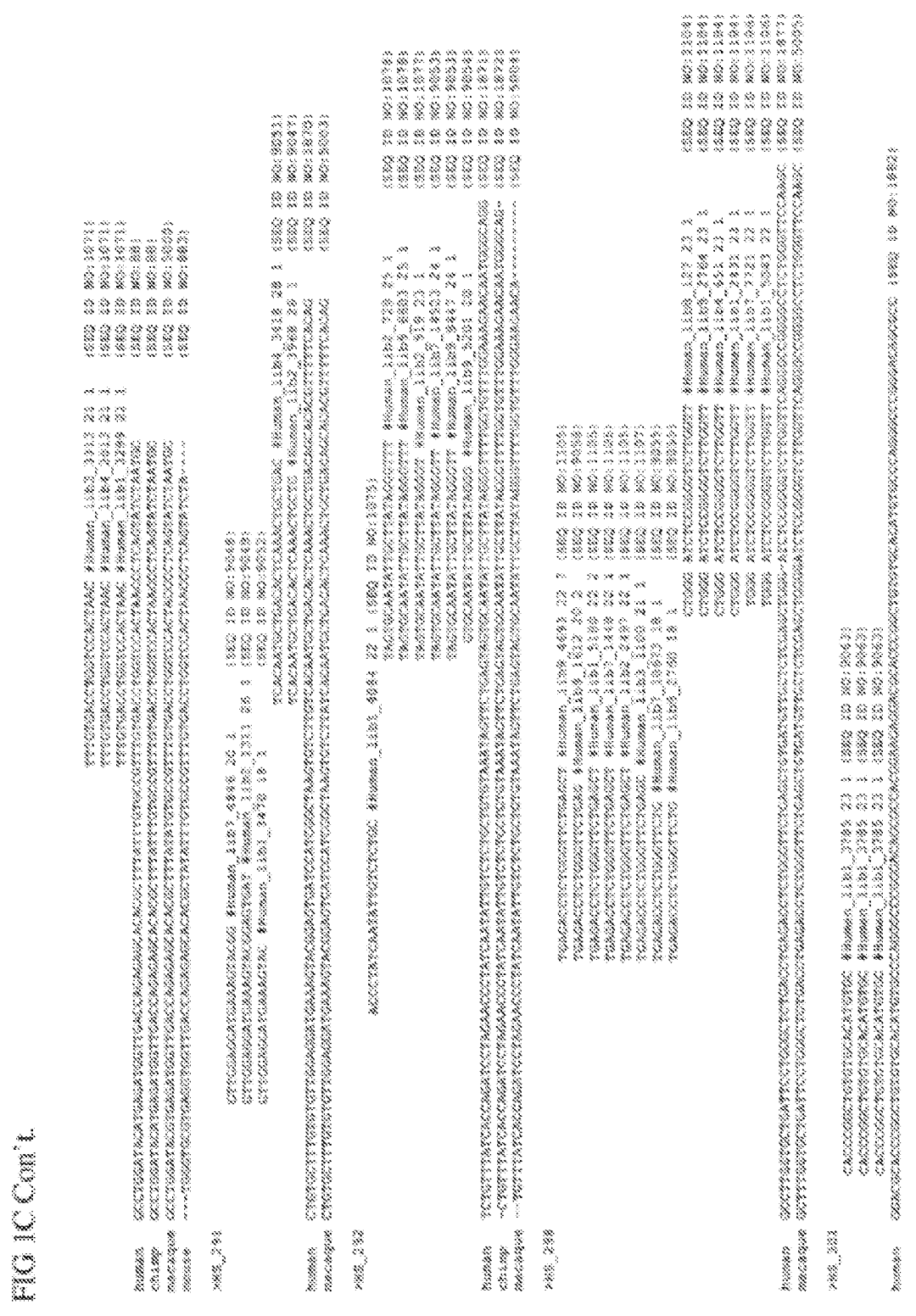
Figure 1C:
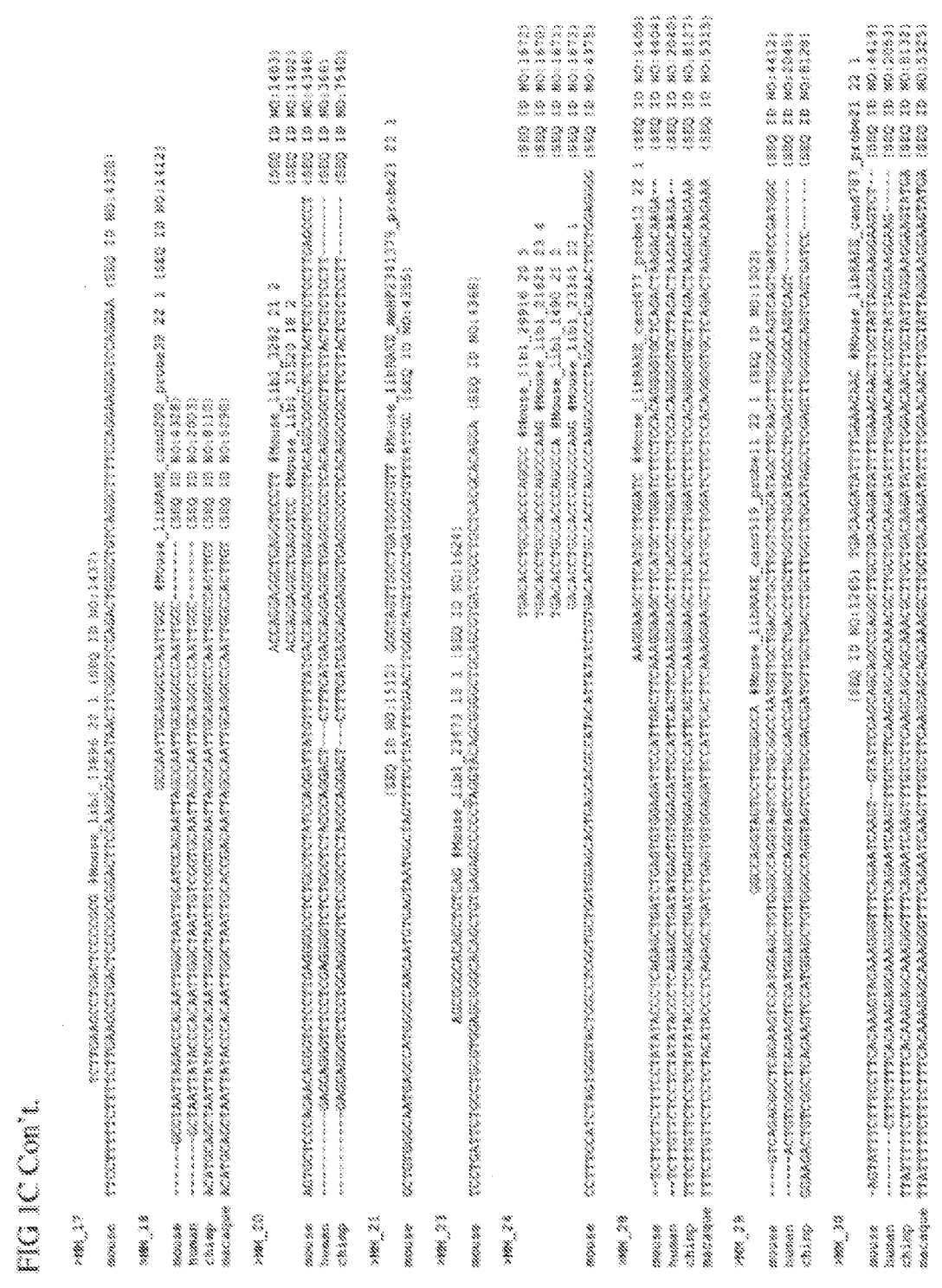
Figure 1C:
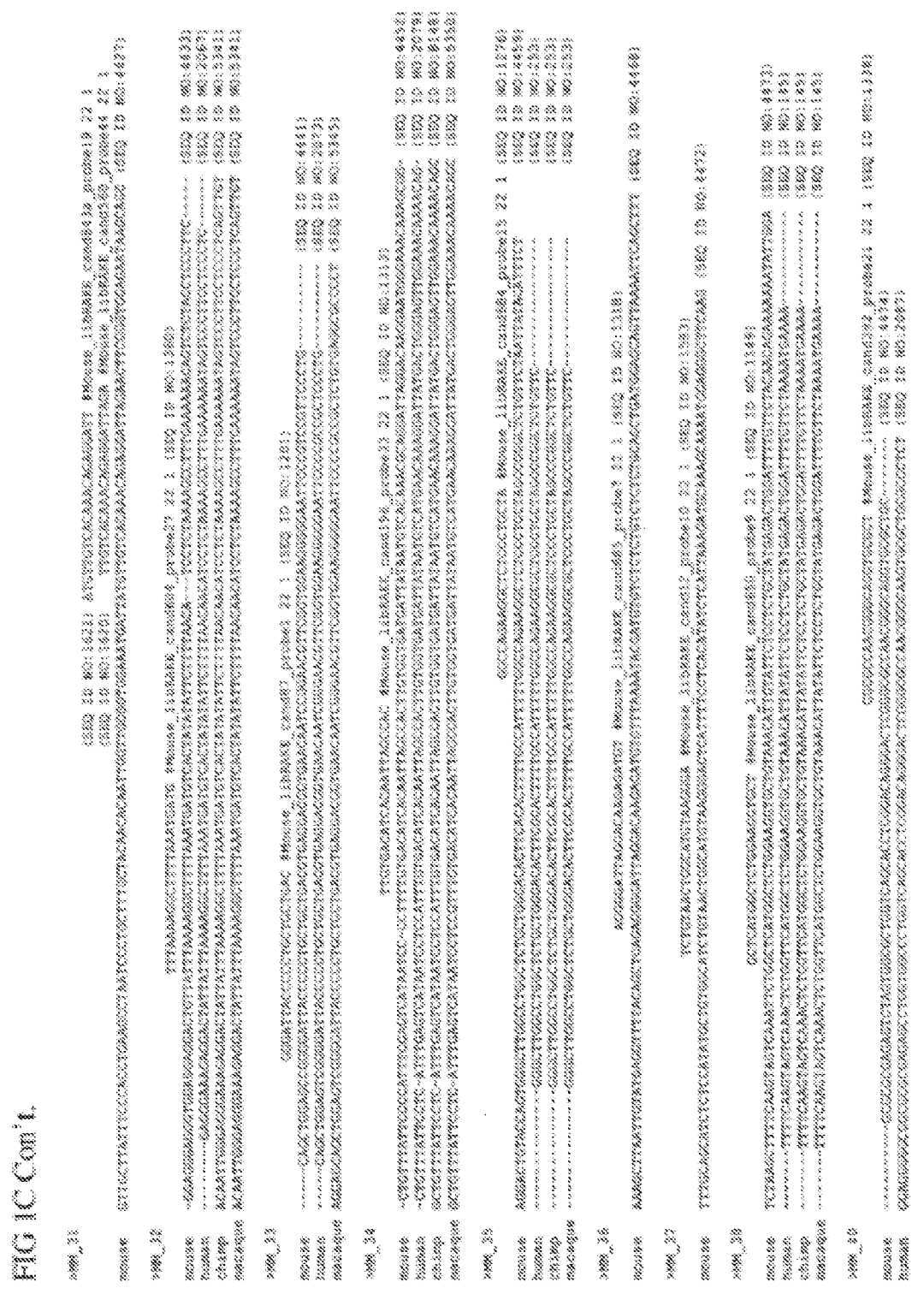
Figure 1C:
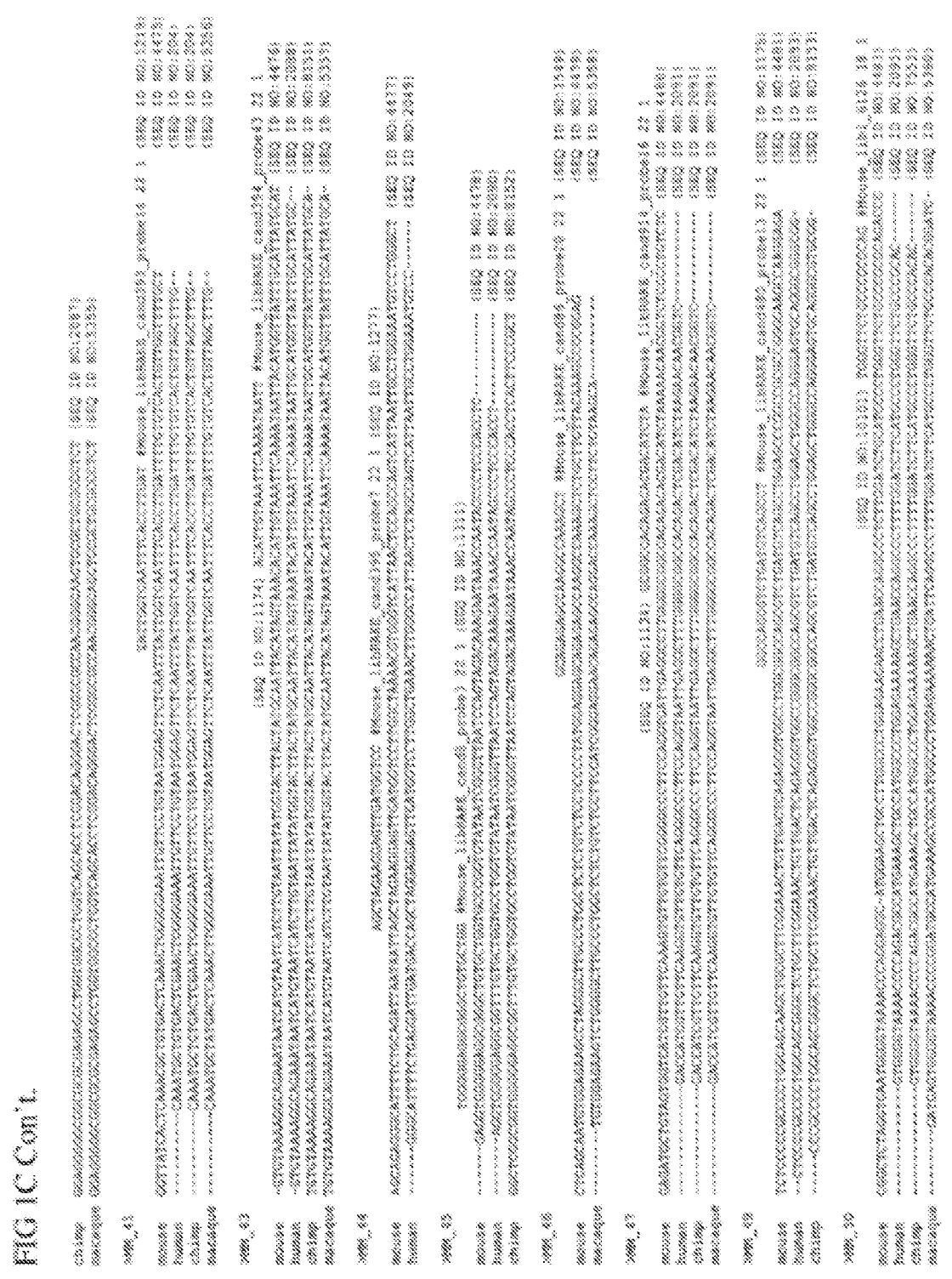
Figure 1C:
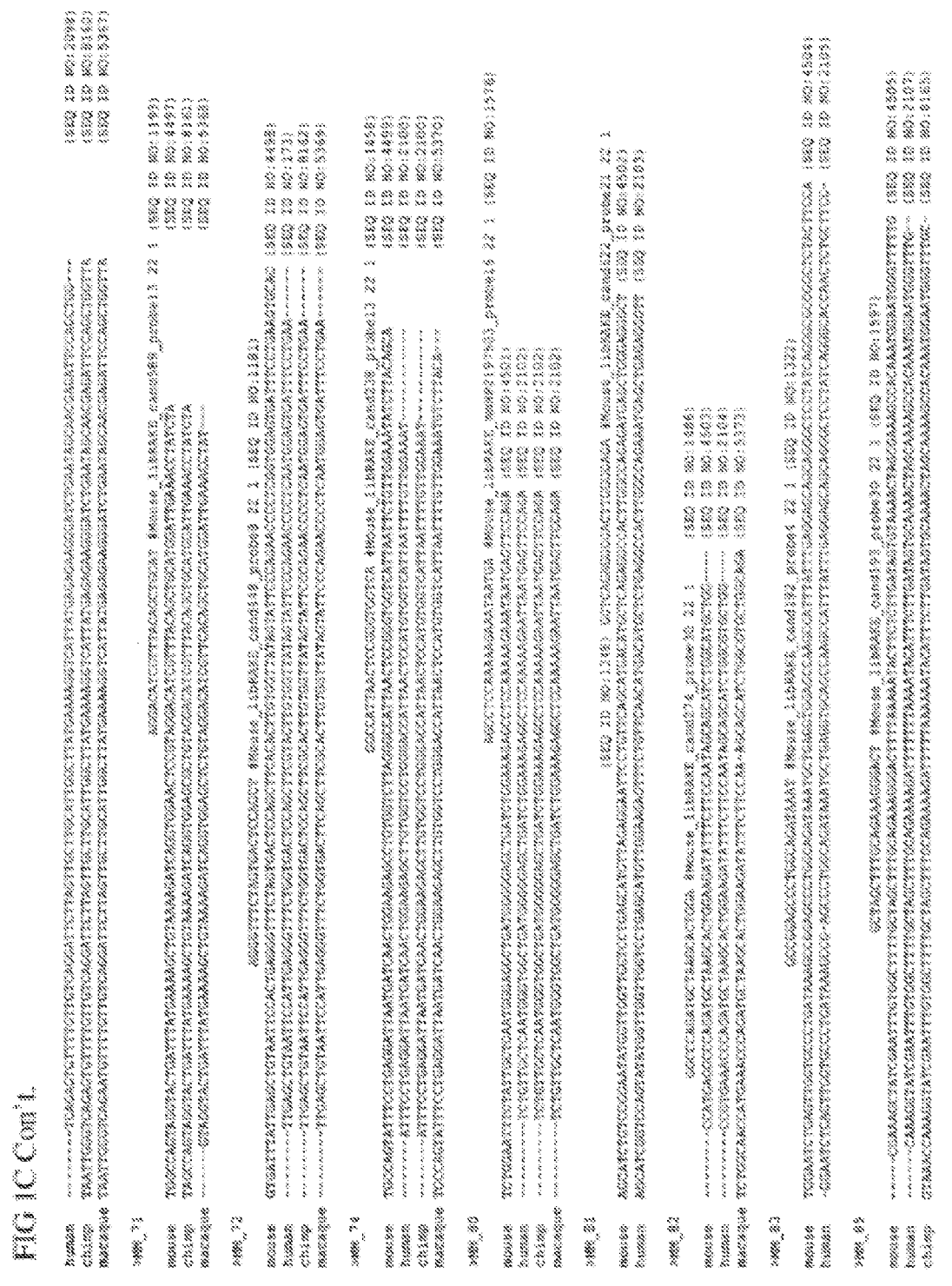
Figure 1C:
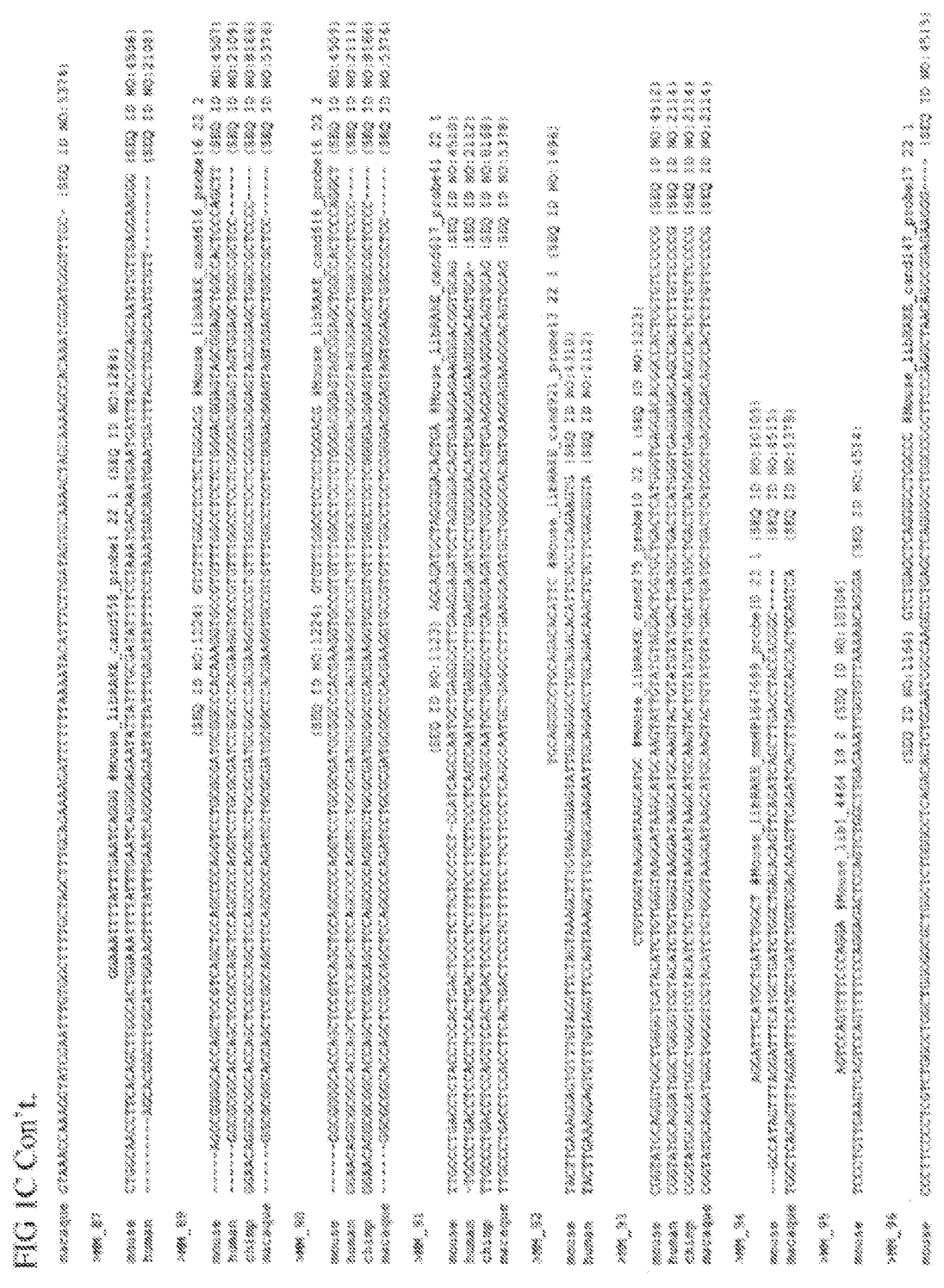
Figure 1C:
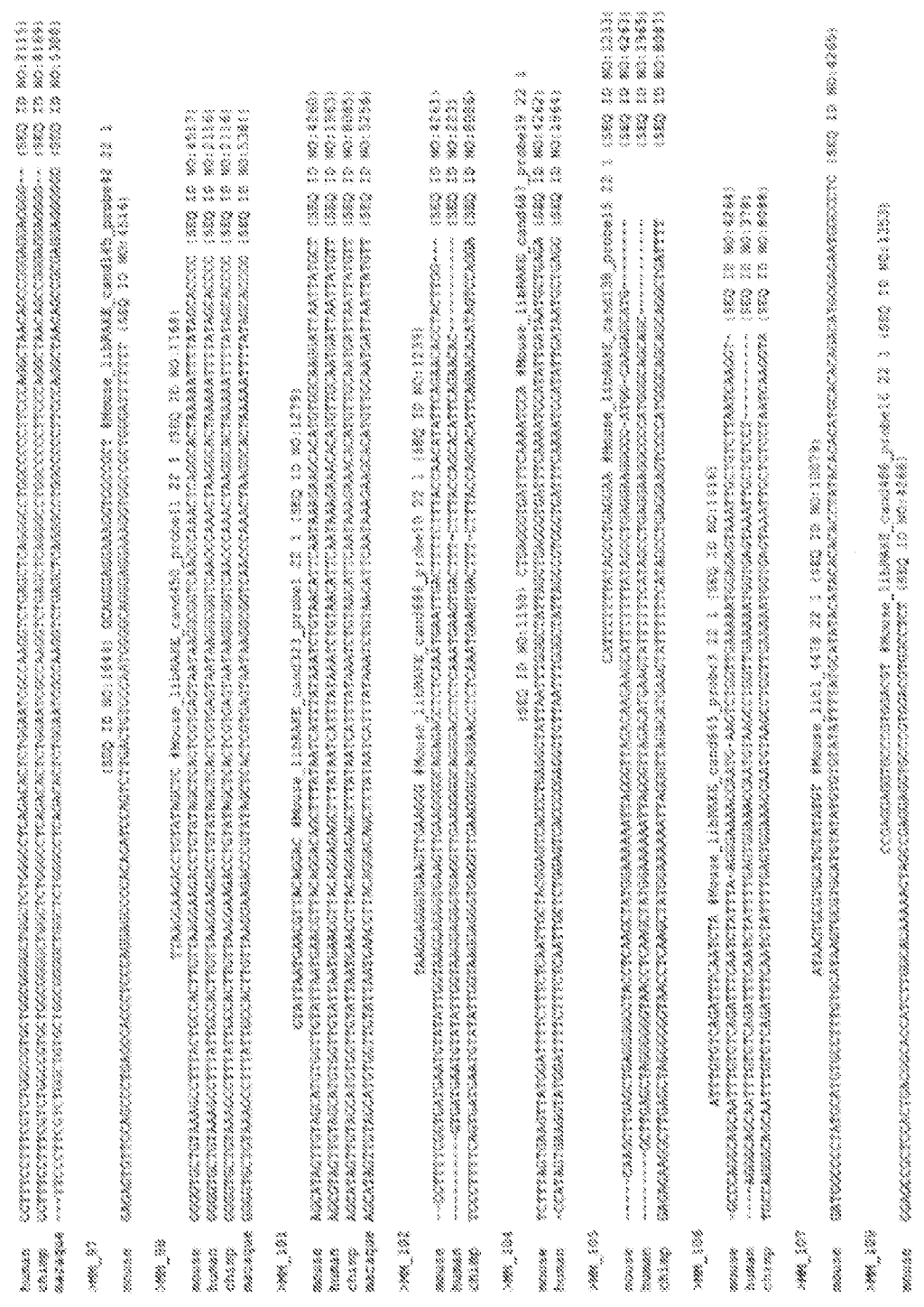
Figure 1C:
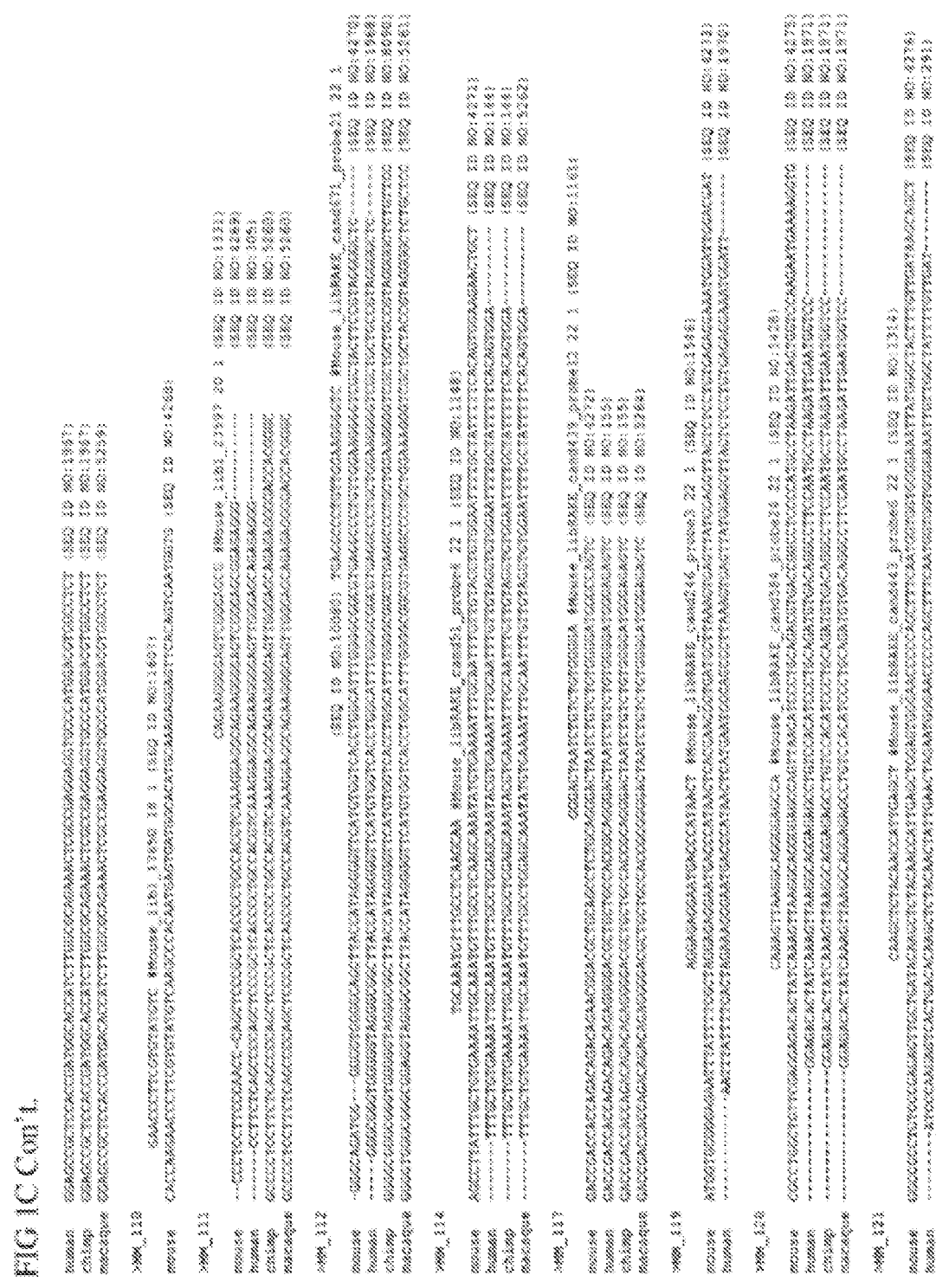
Figure 1C:
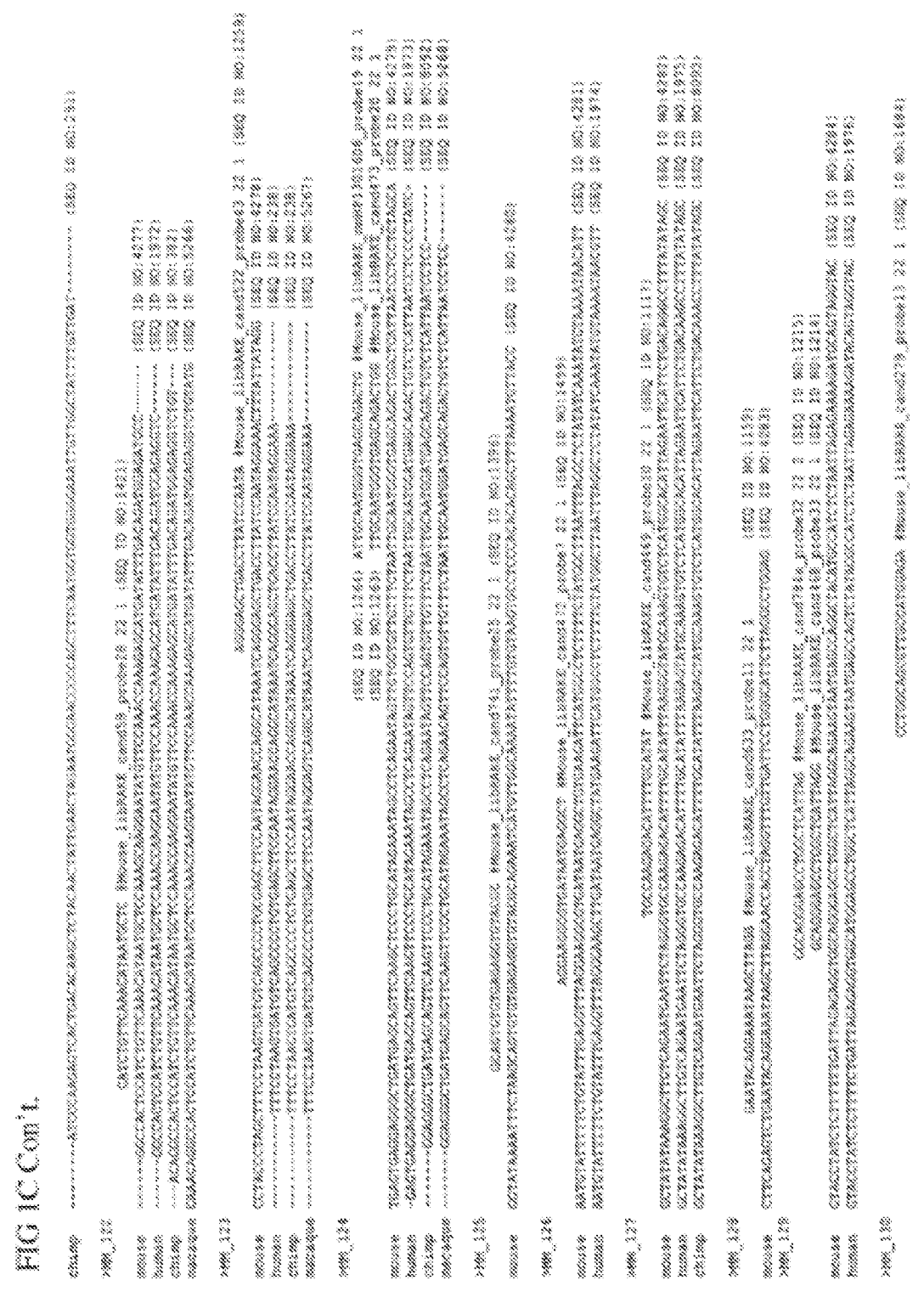
Figure 1C:
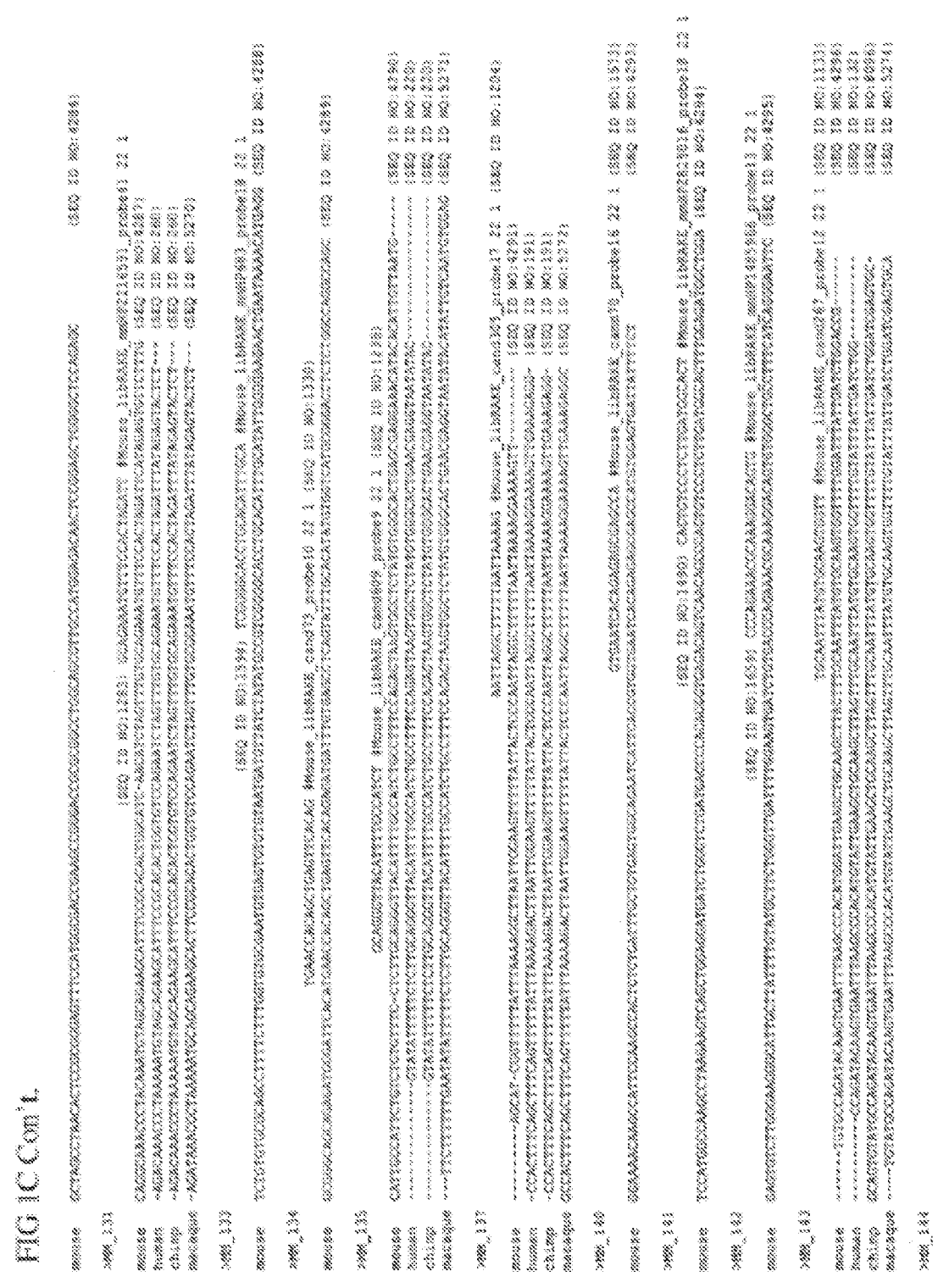
Figure 1C:
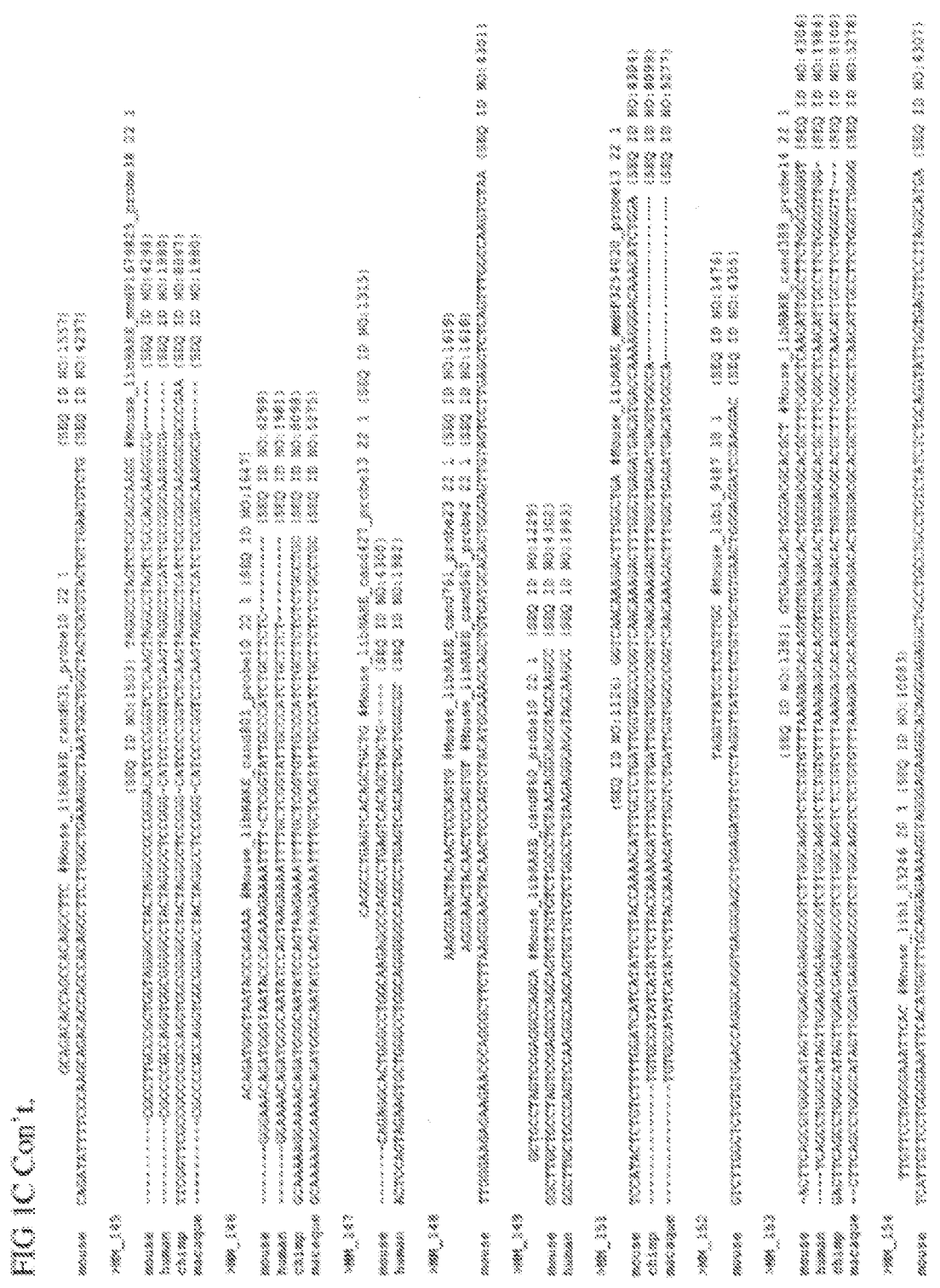
Figure 1C:
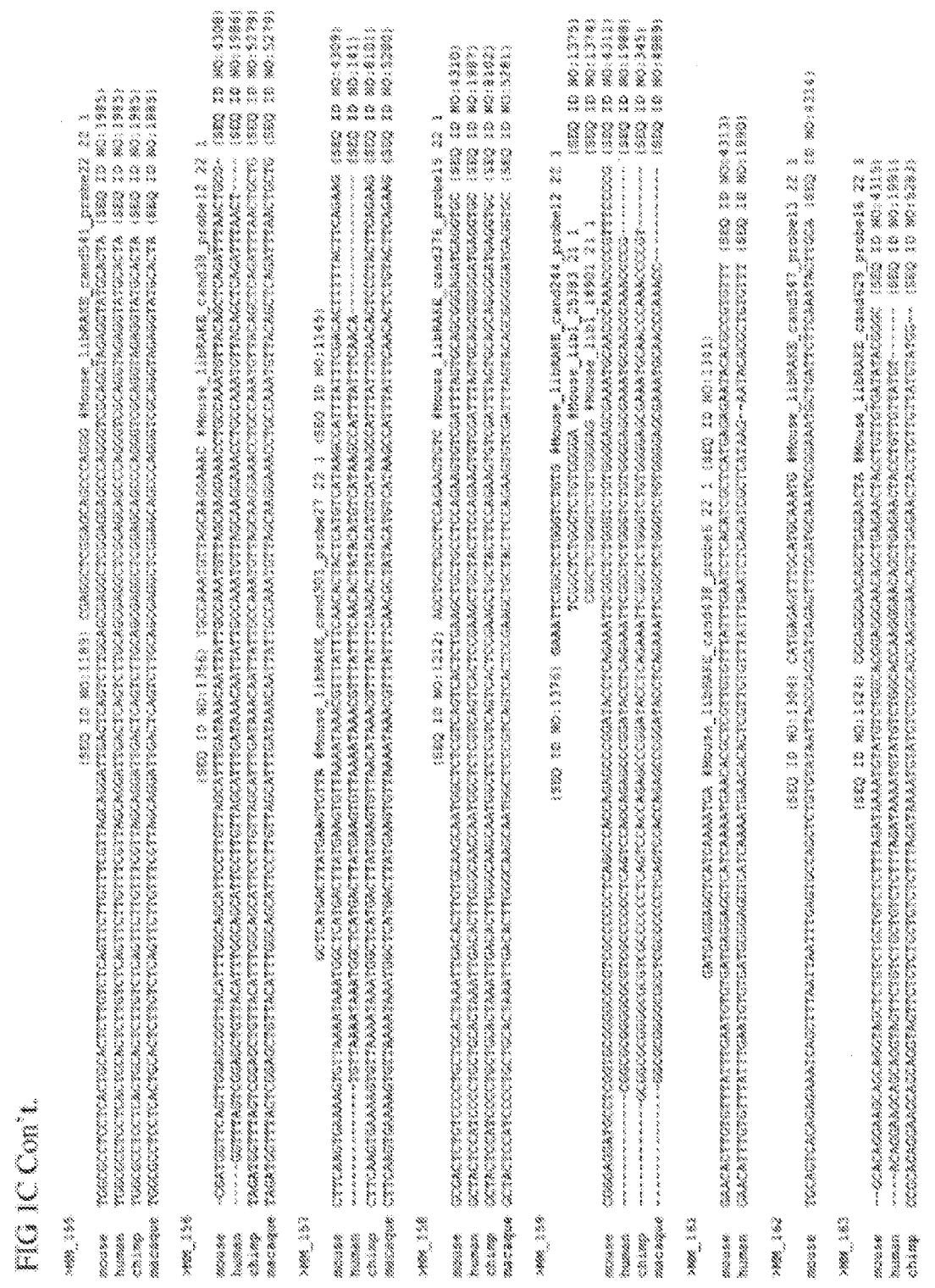
Figure 1C:
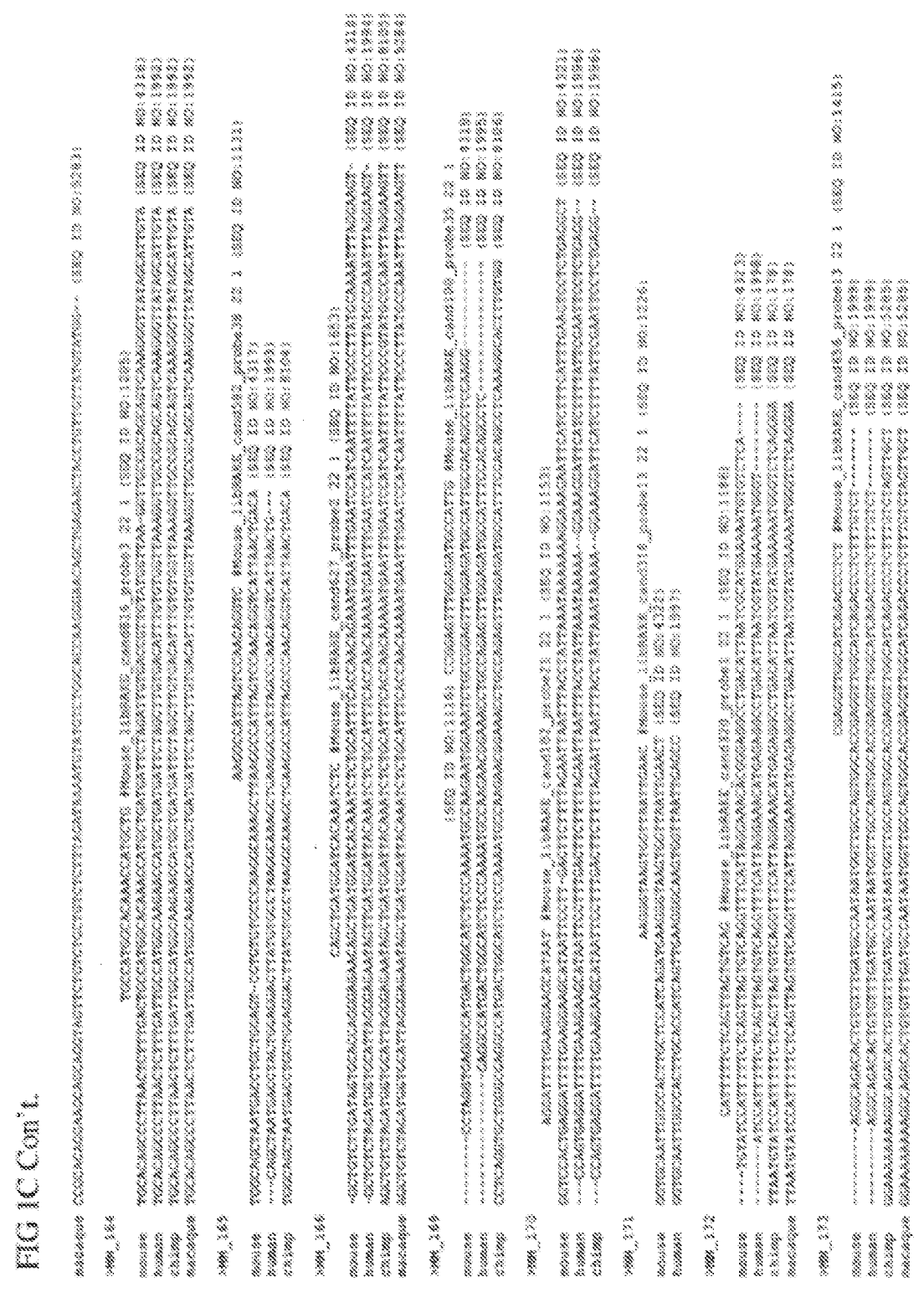
Figure 1C:
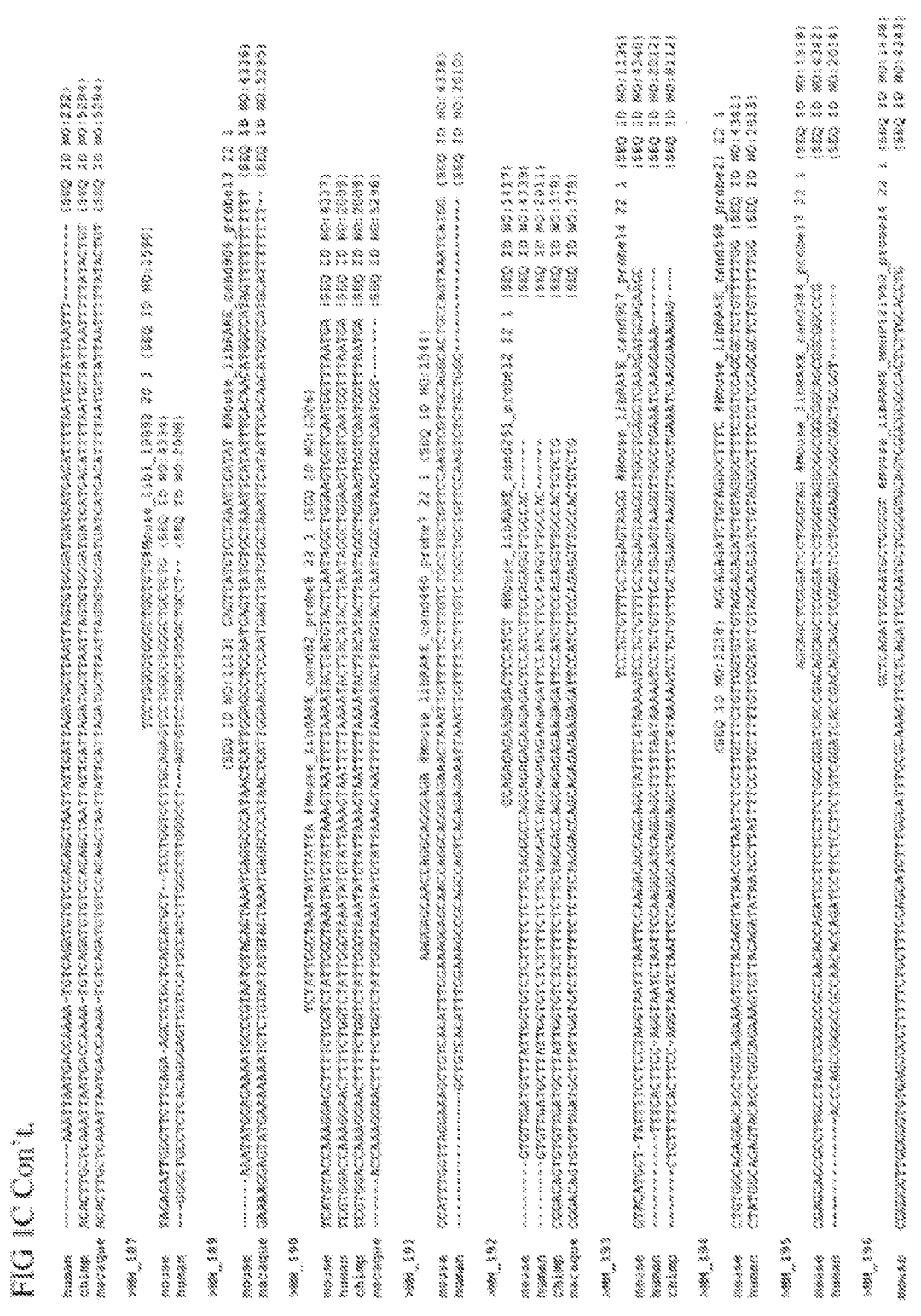
Figure 1C:
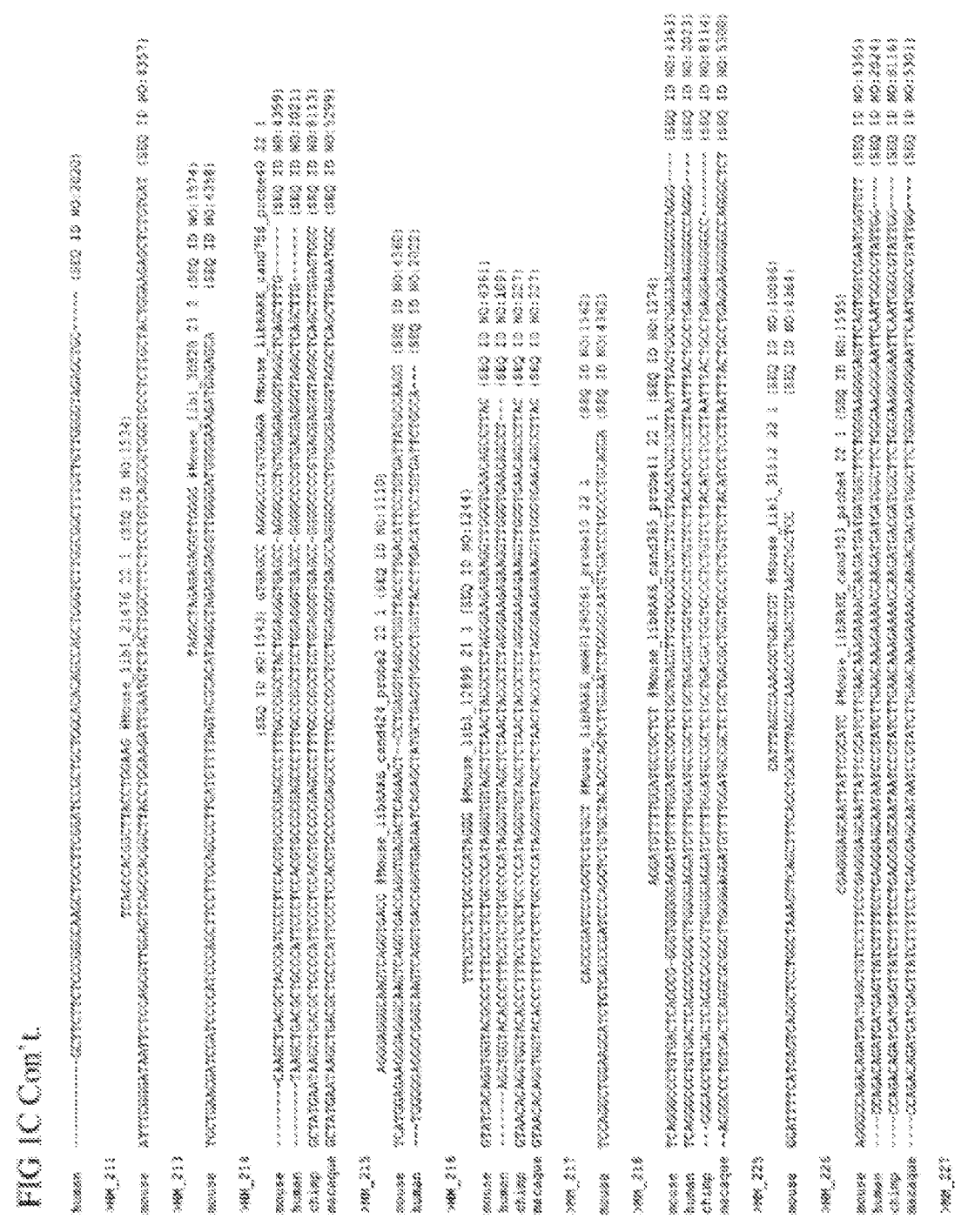
Figure 1C:
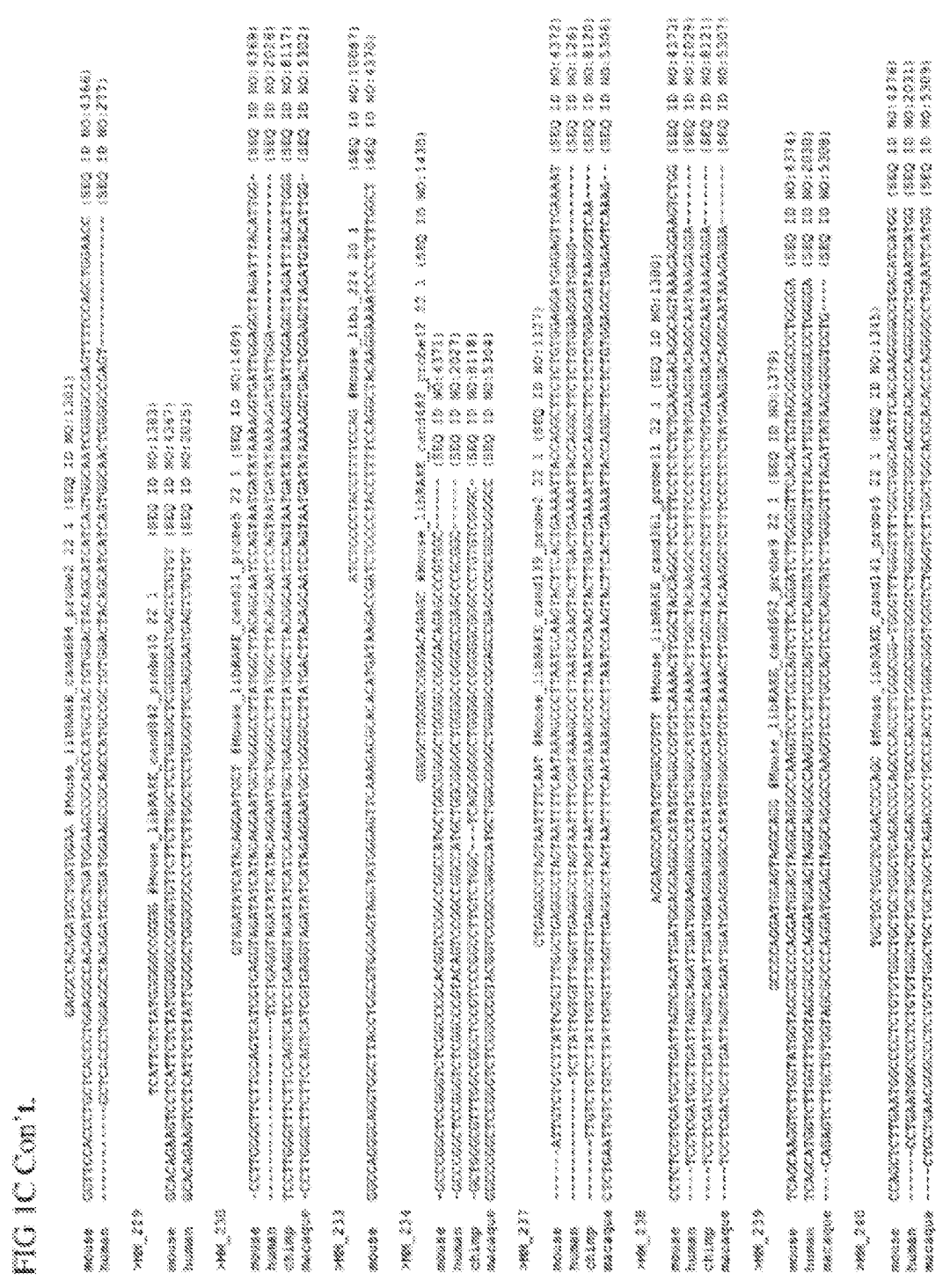
Figure 1C:
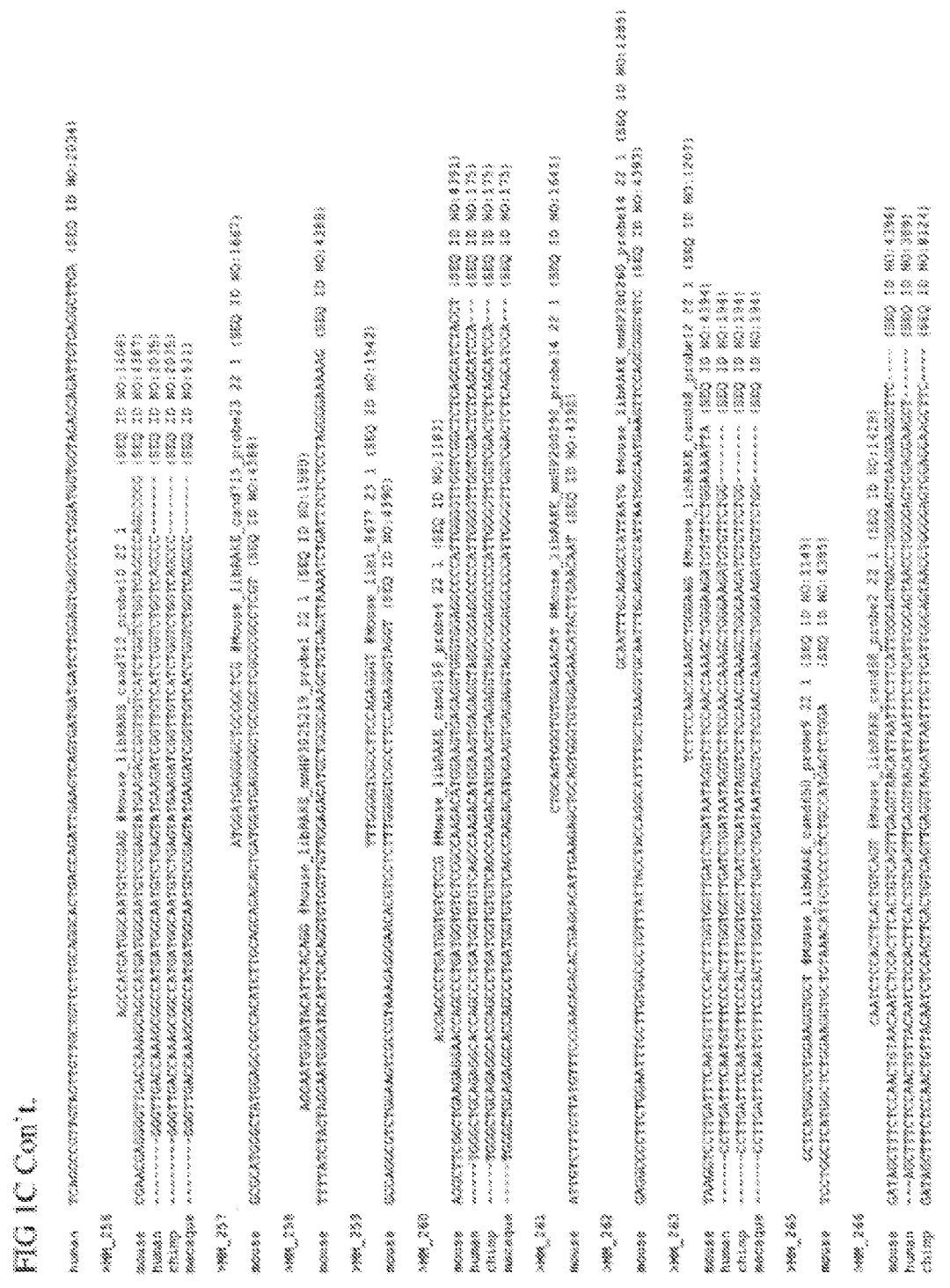
Figure 1C:
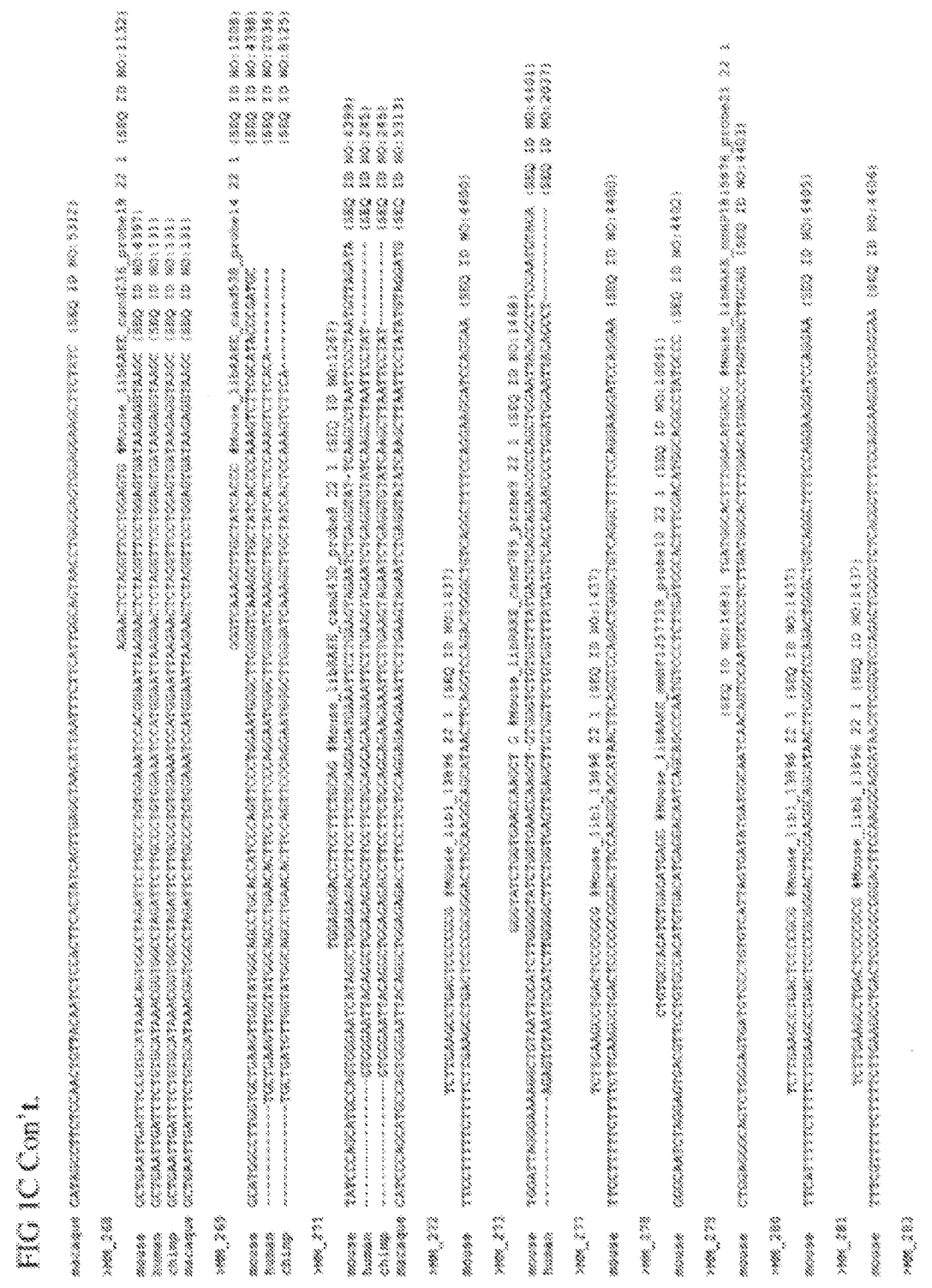
Figure 1C:
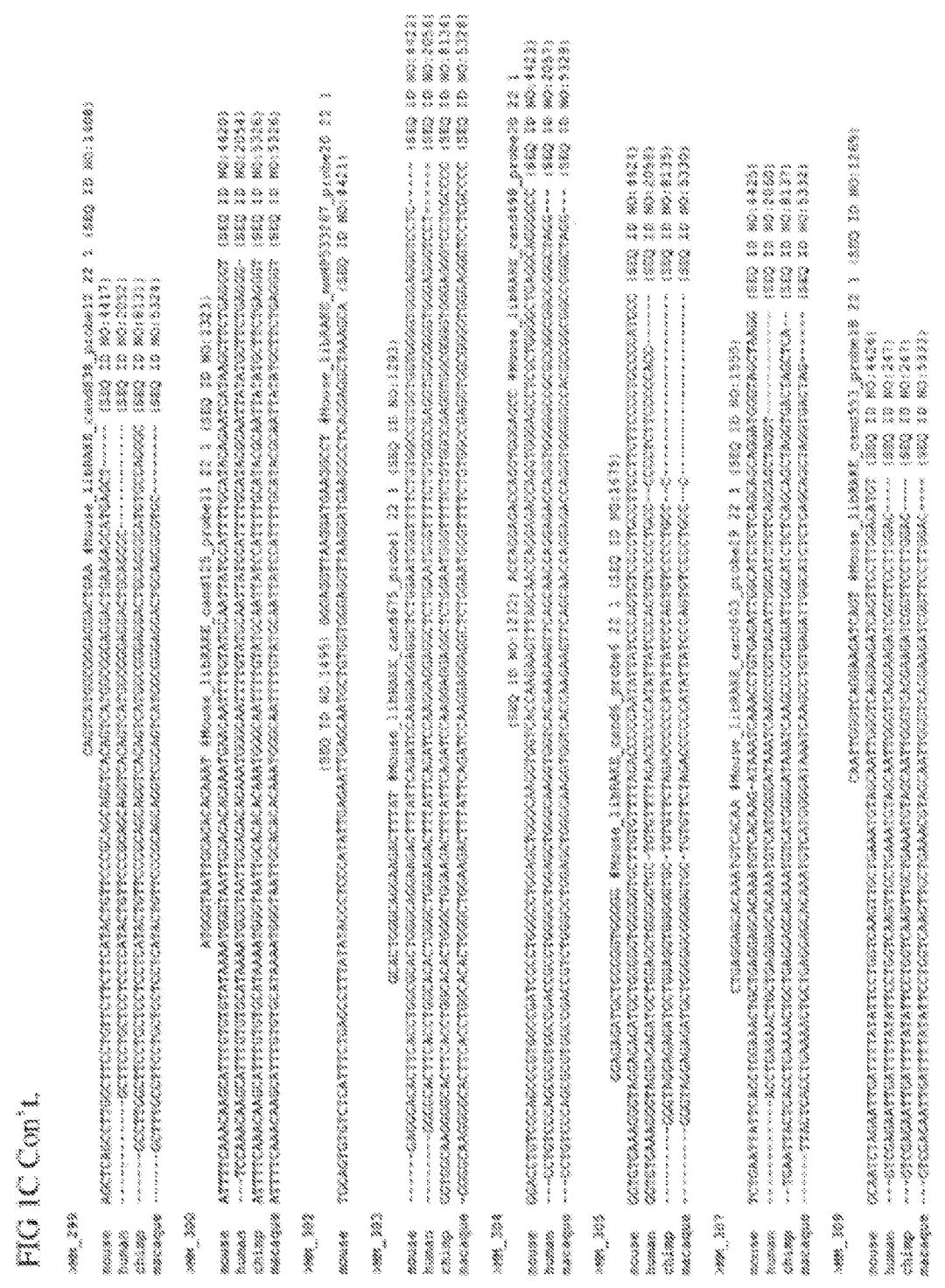
Figure 1C:
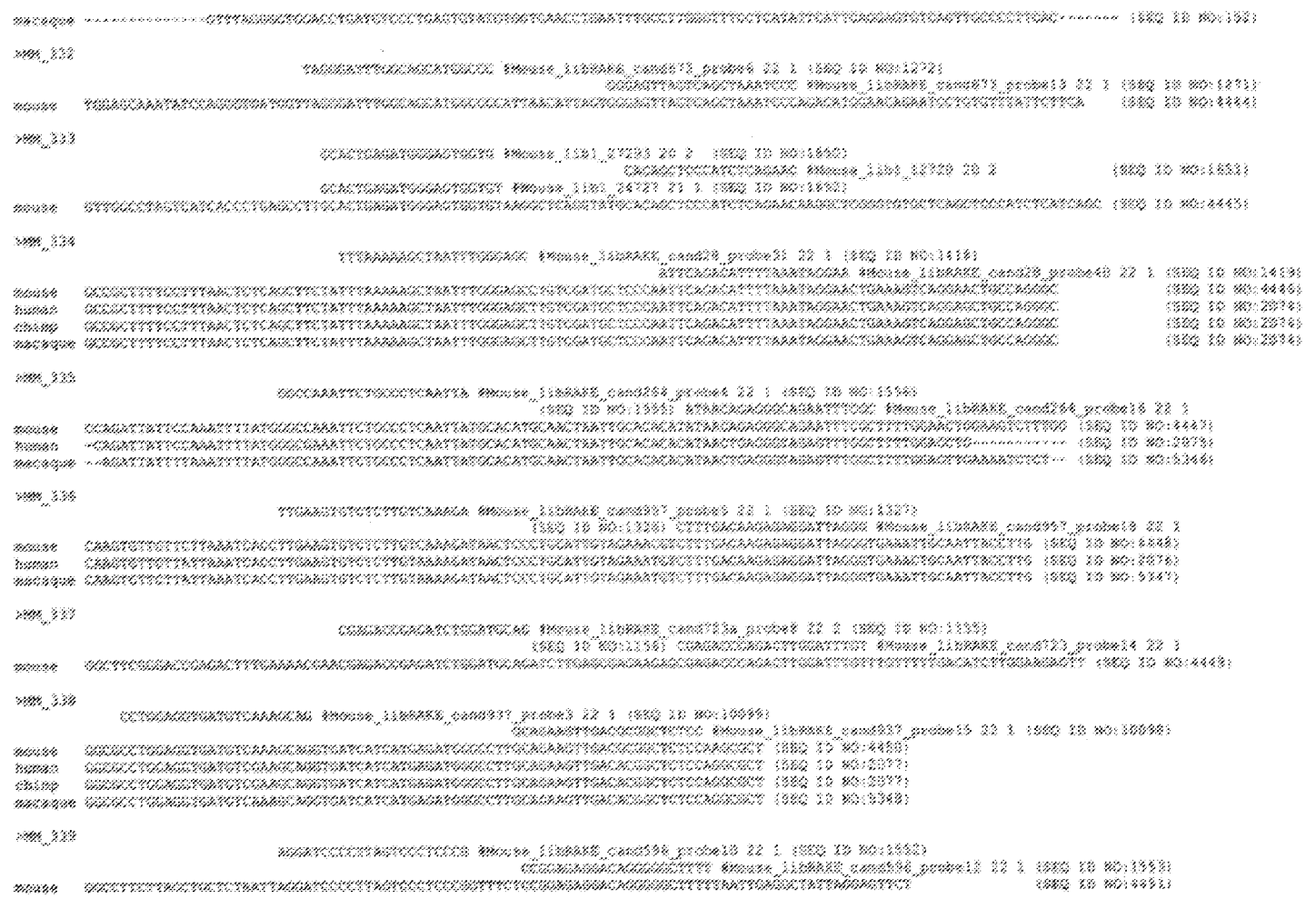
Figure 1C:
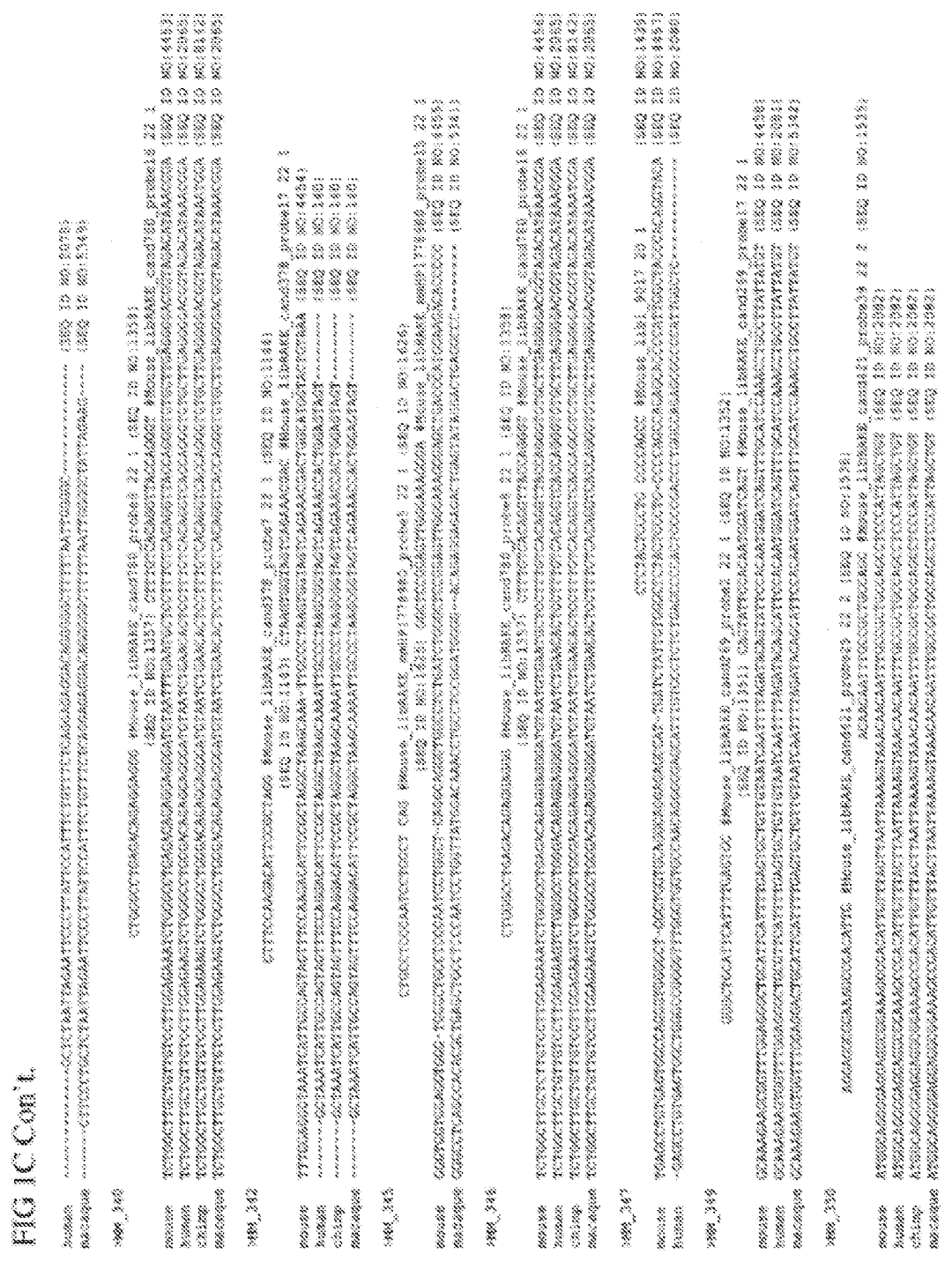
Figure 1C:
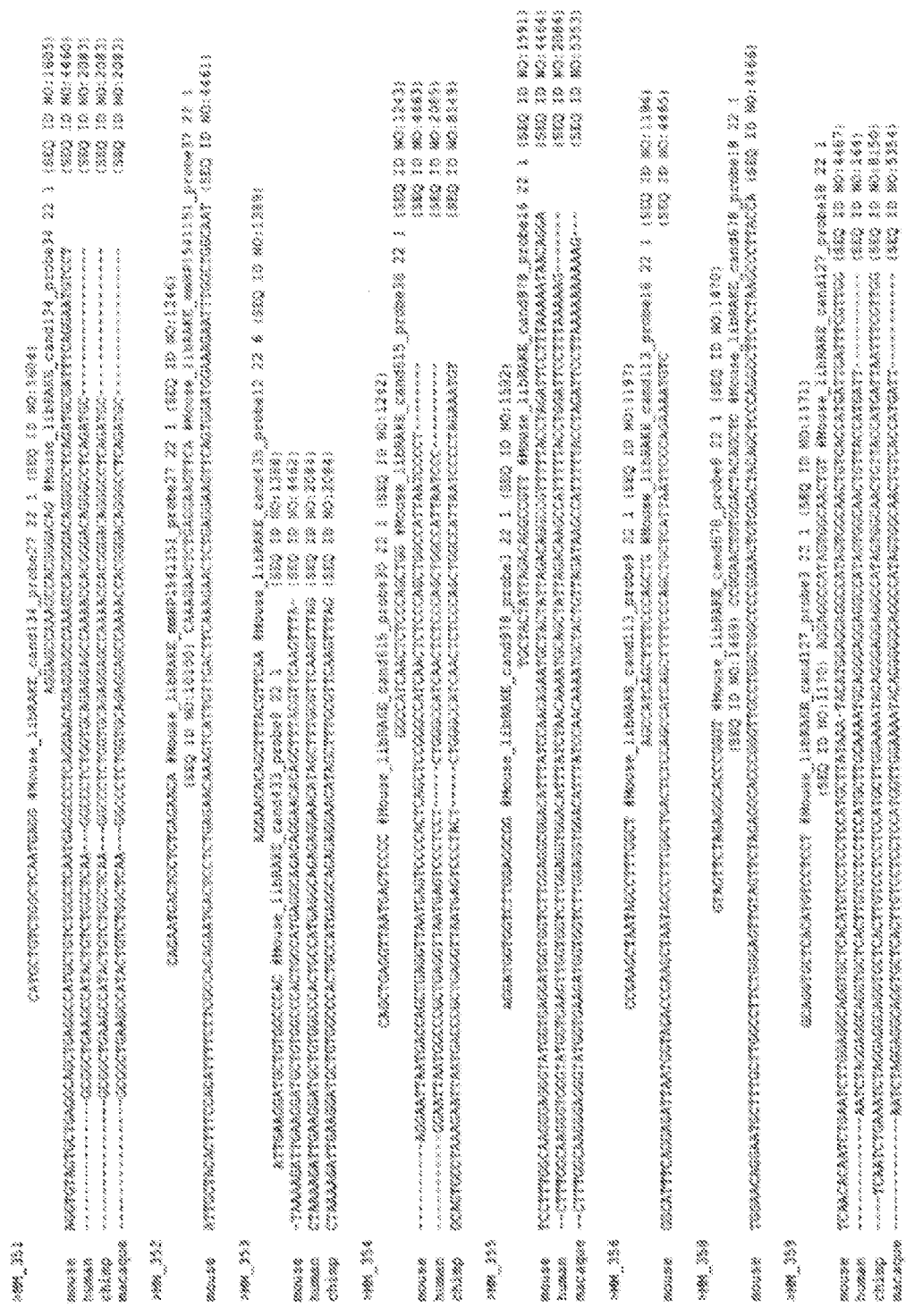
Figure 1C:
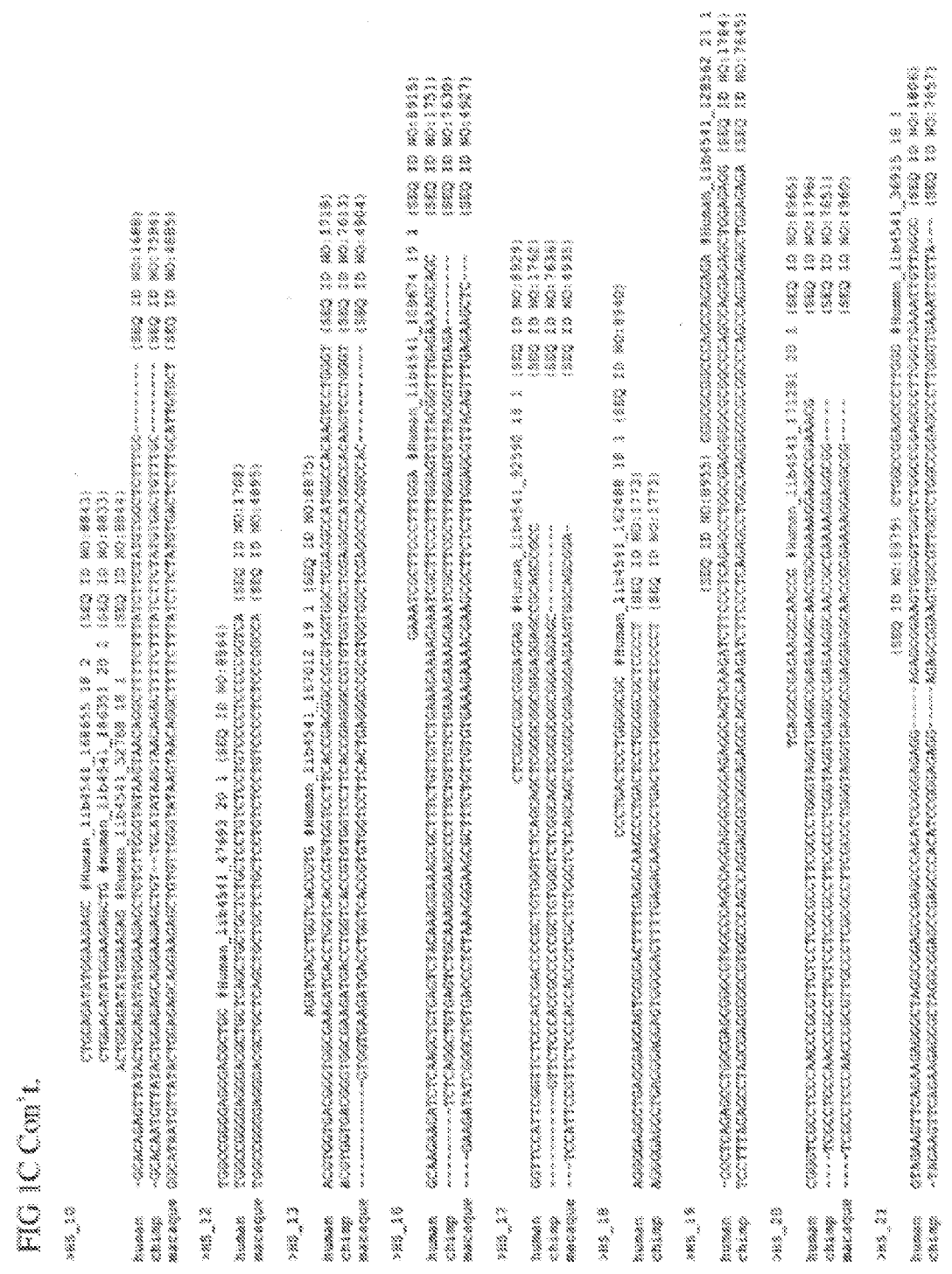
Figure 1C:
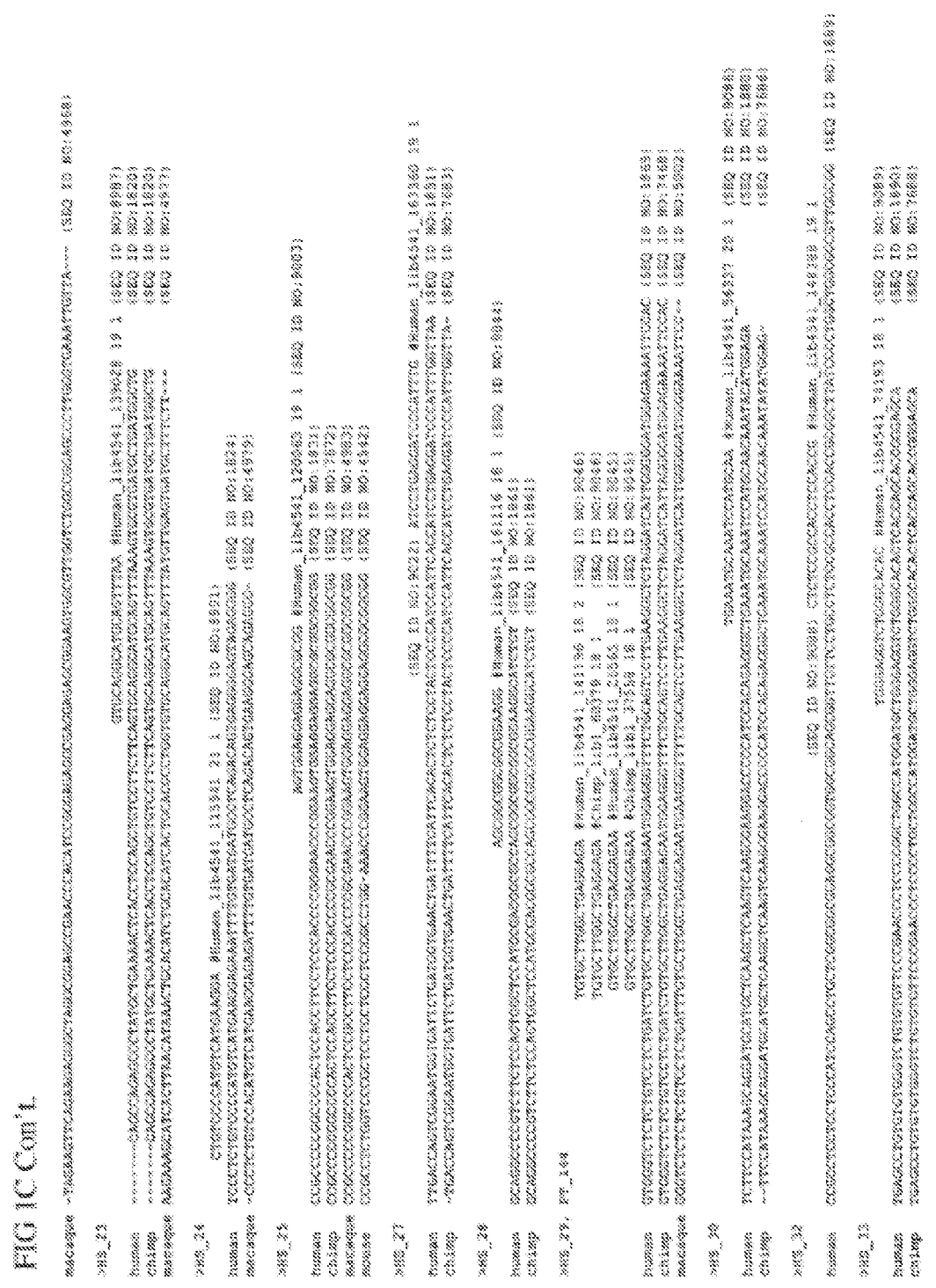
Figure 1C:
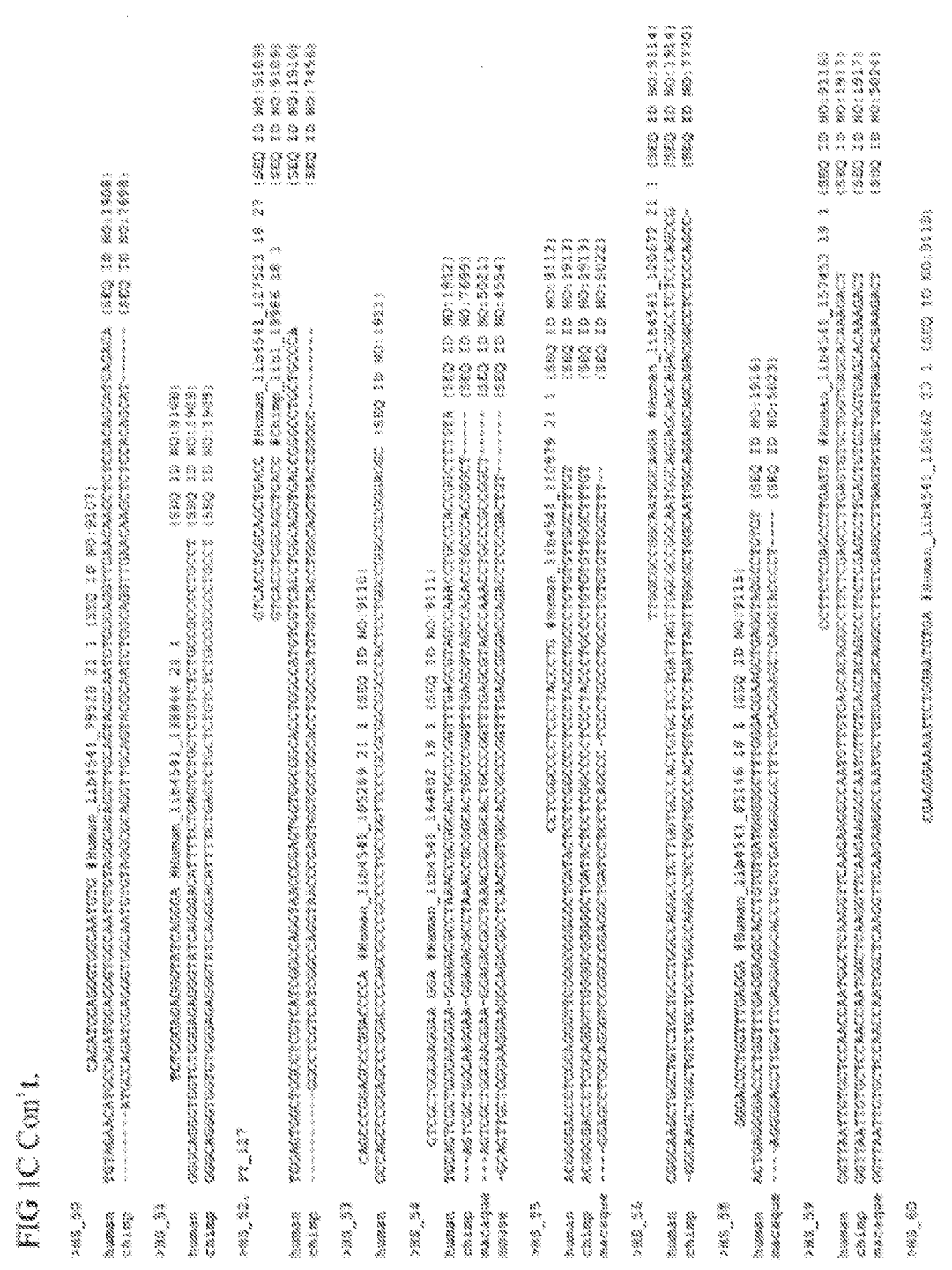
Figure 1C:
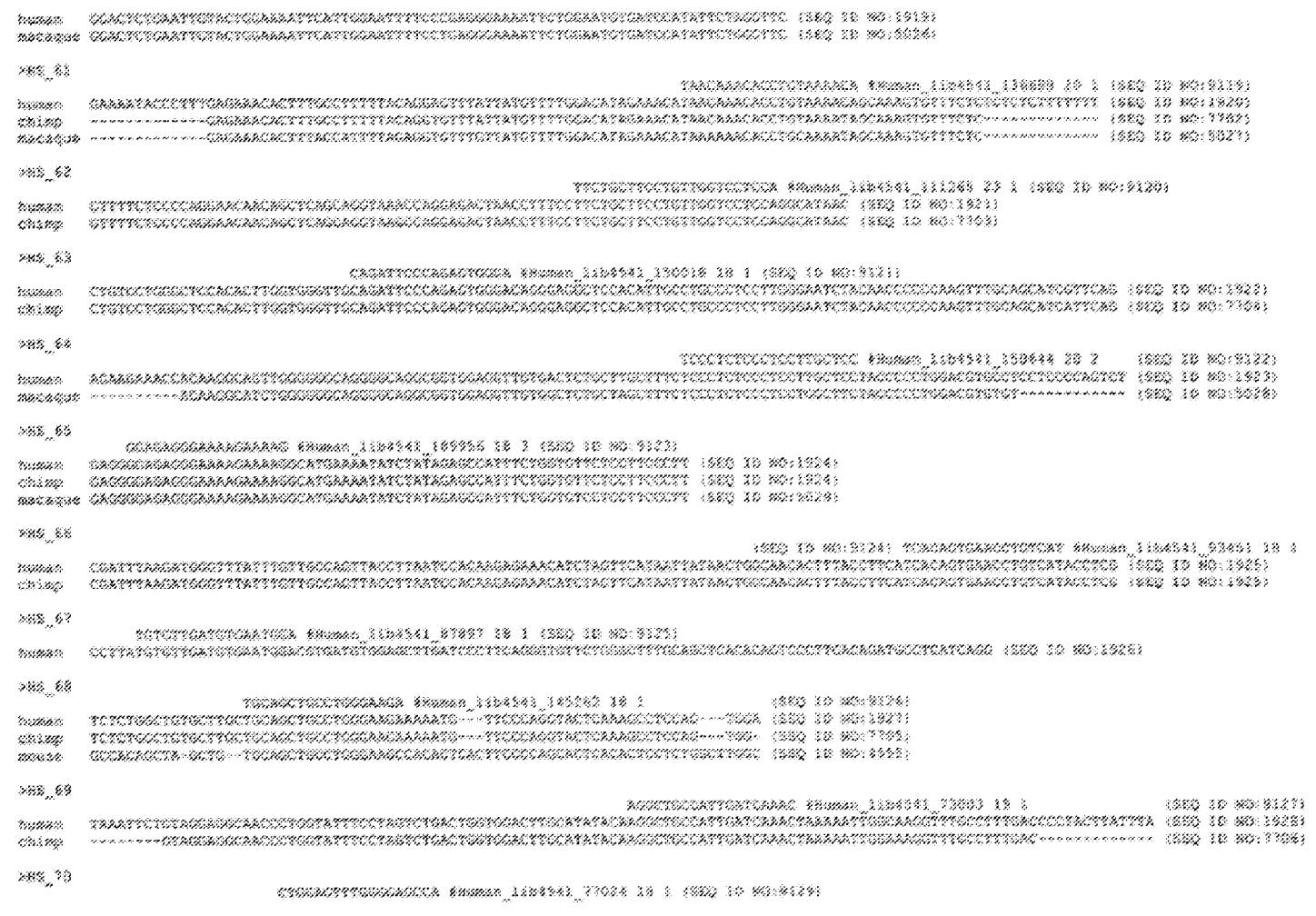
Figure 1C:
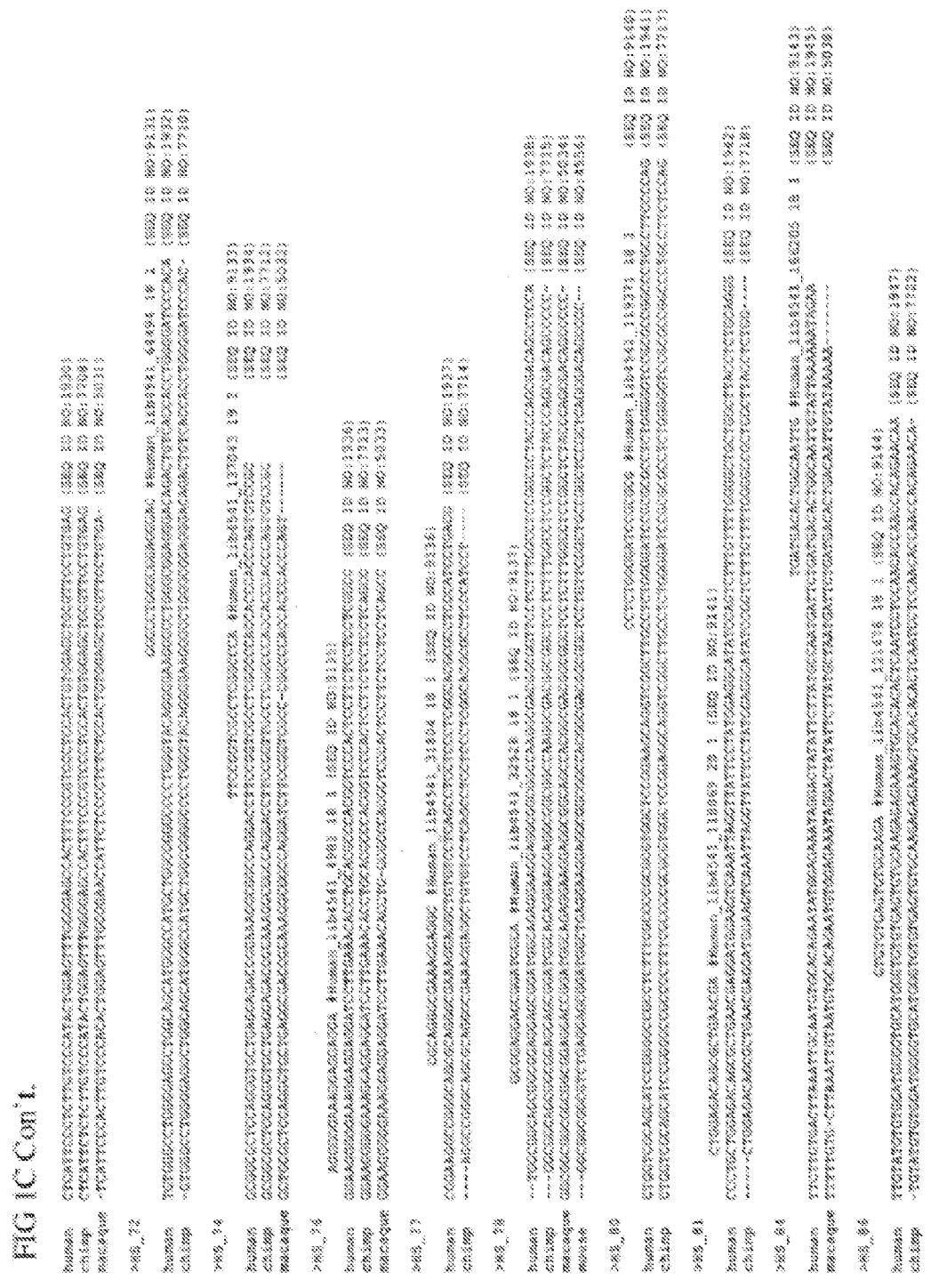
Figure 1C:
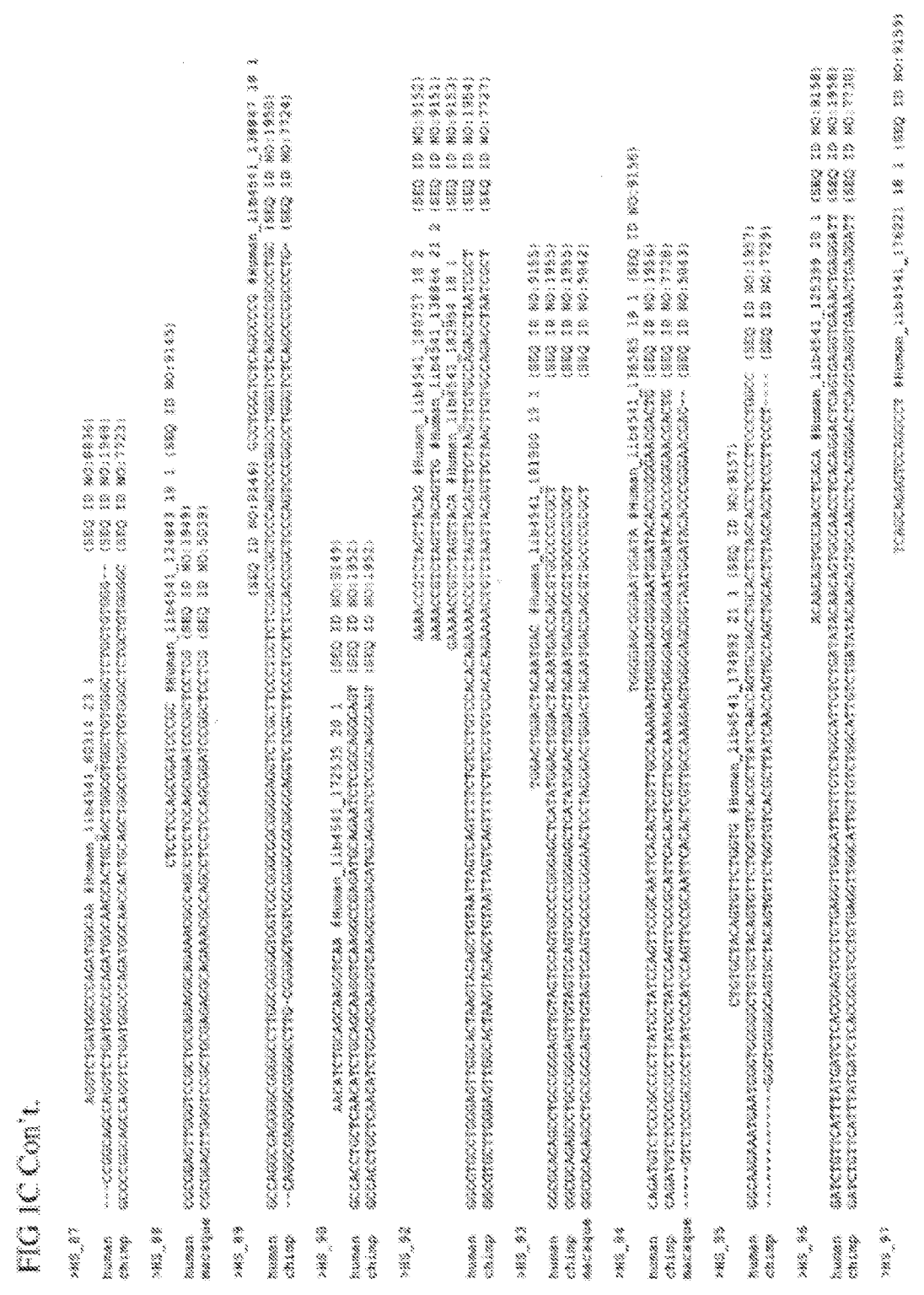
Figure 1C:
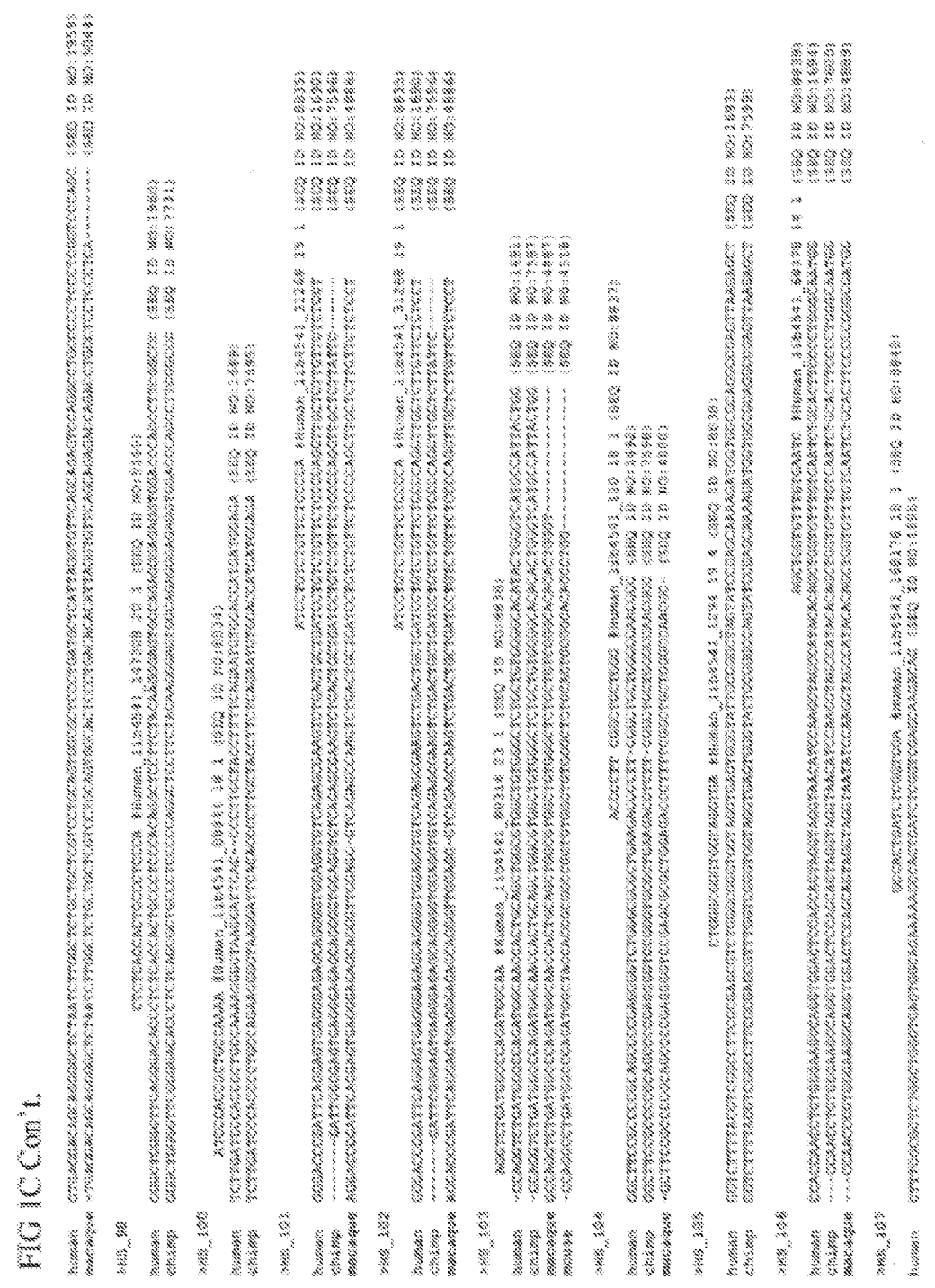
Figure 1C:
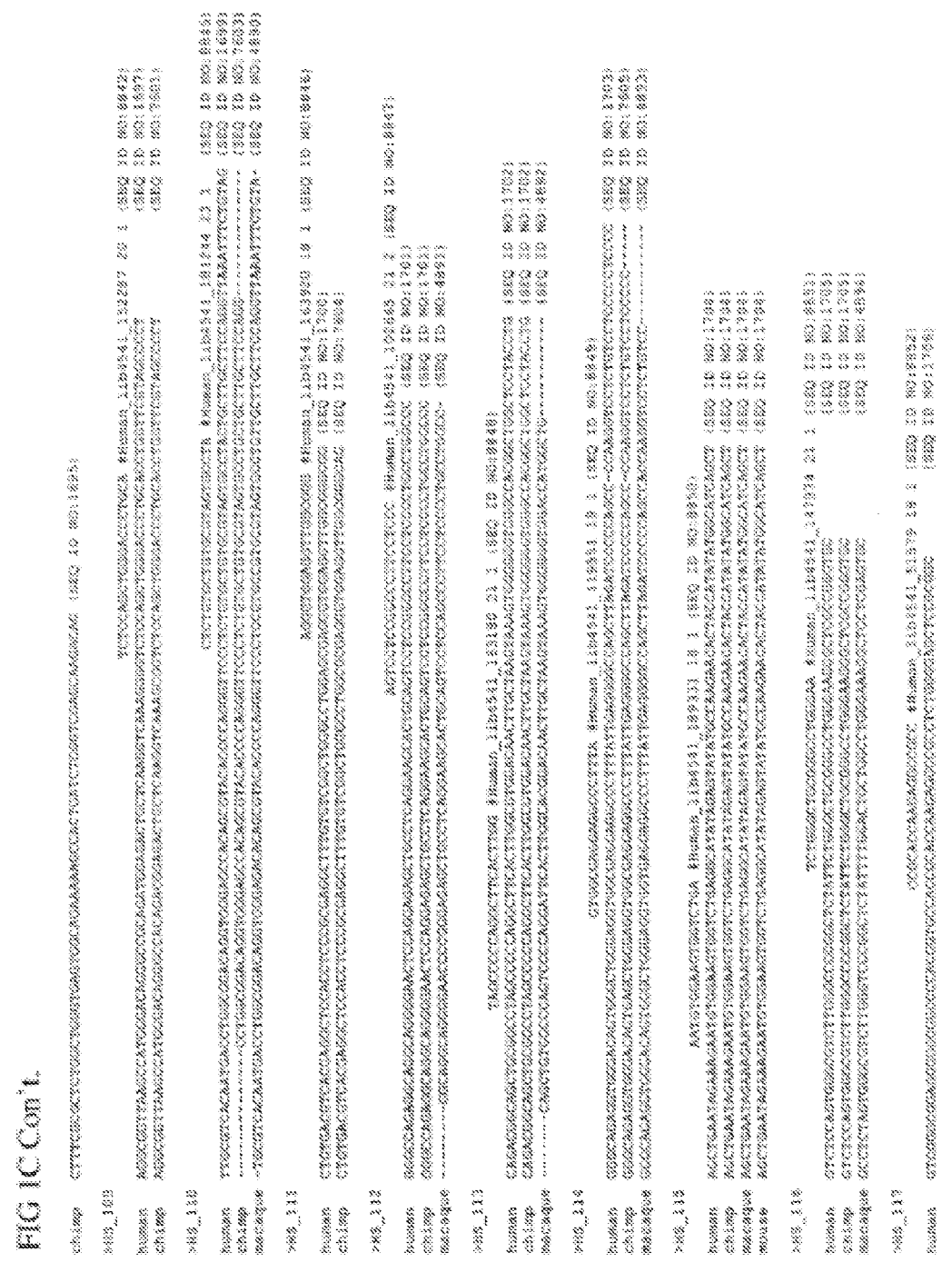
Figure 1C:
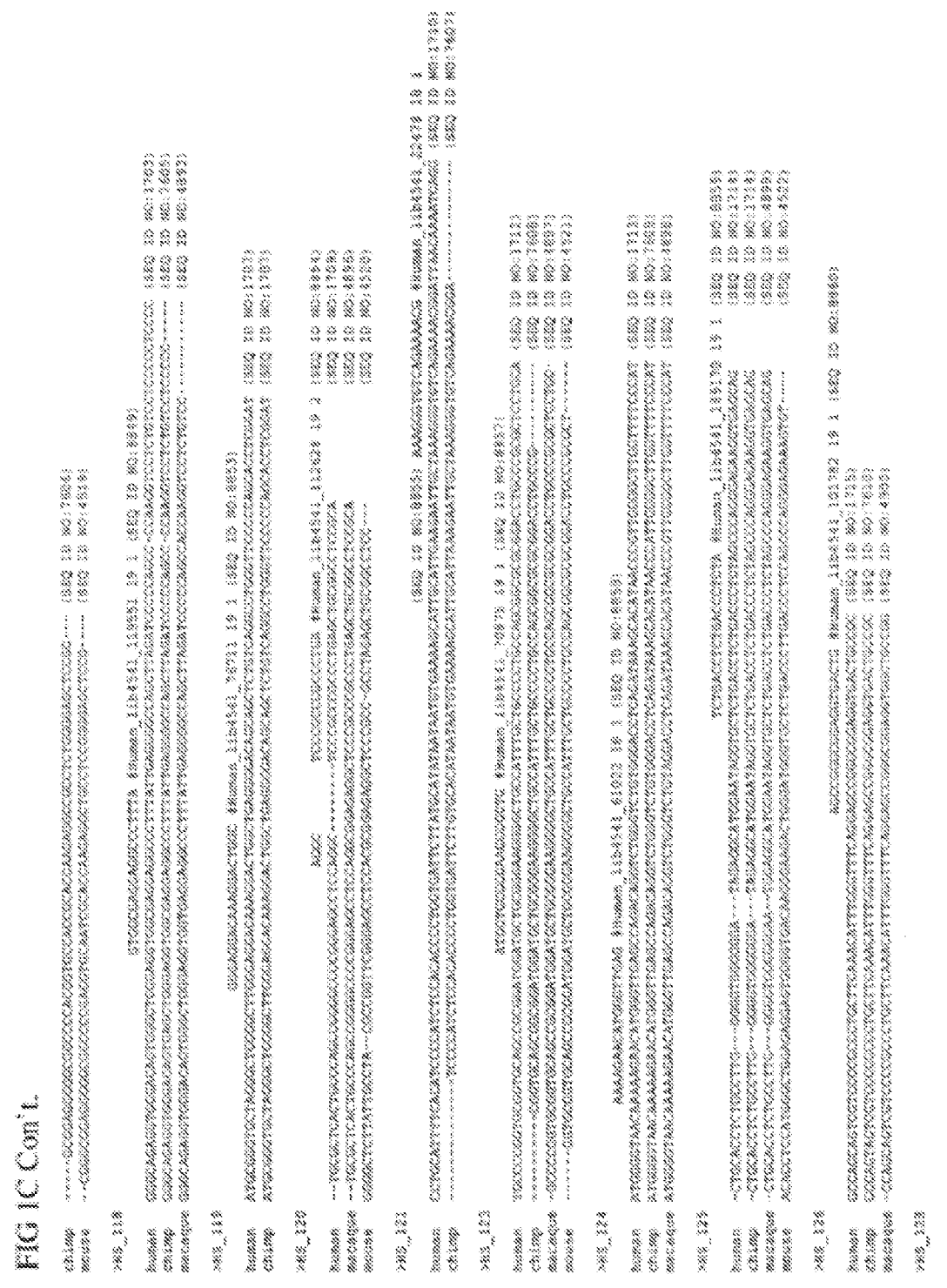
Figure 1C:
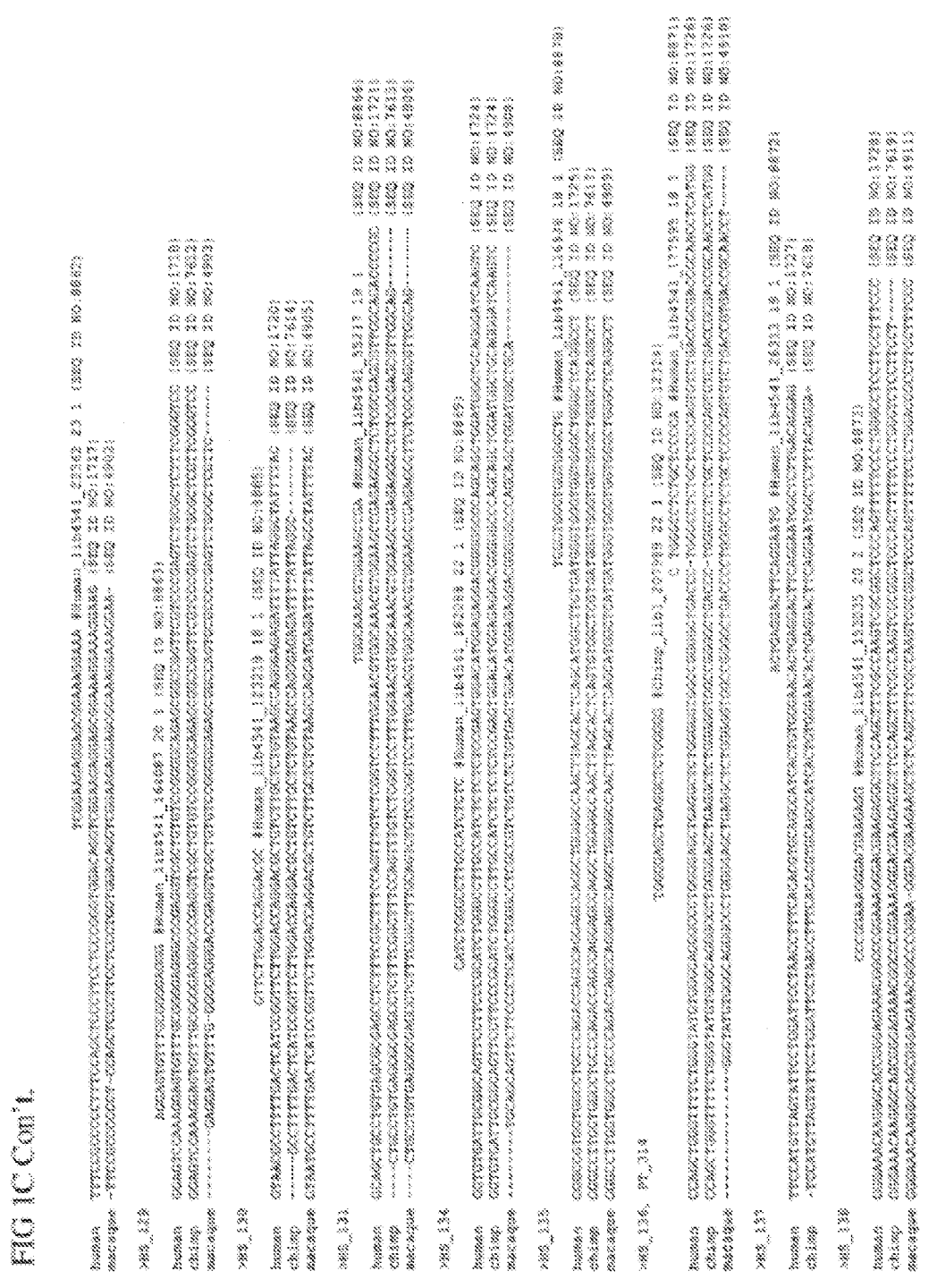
Figure 1C:
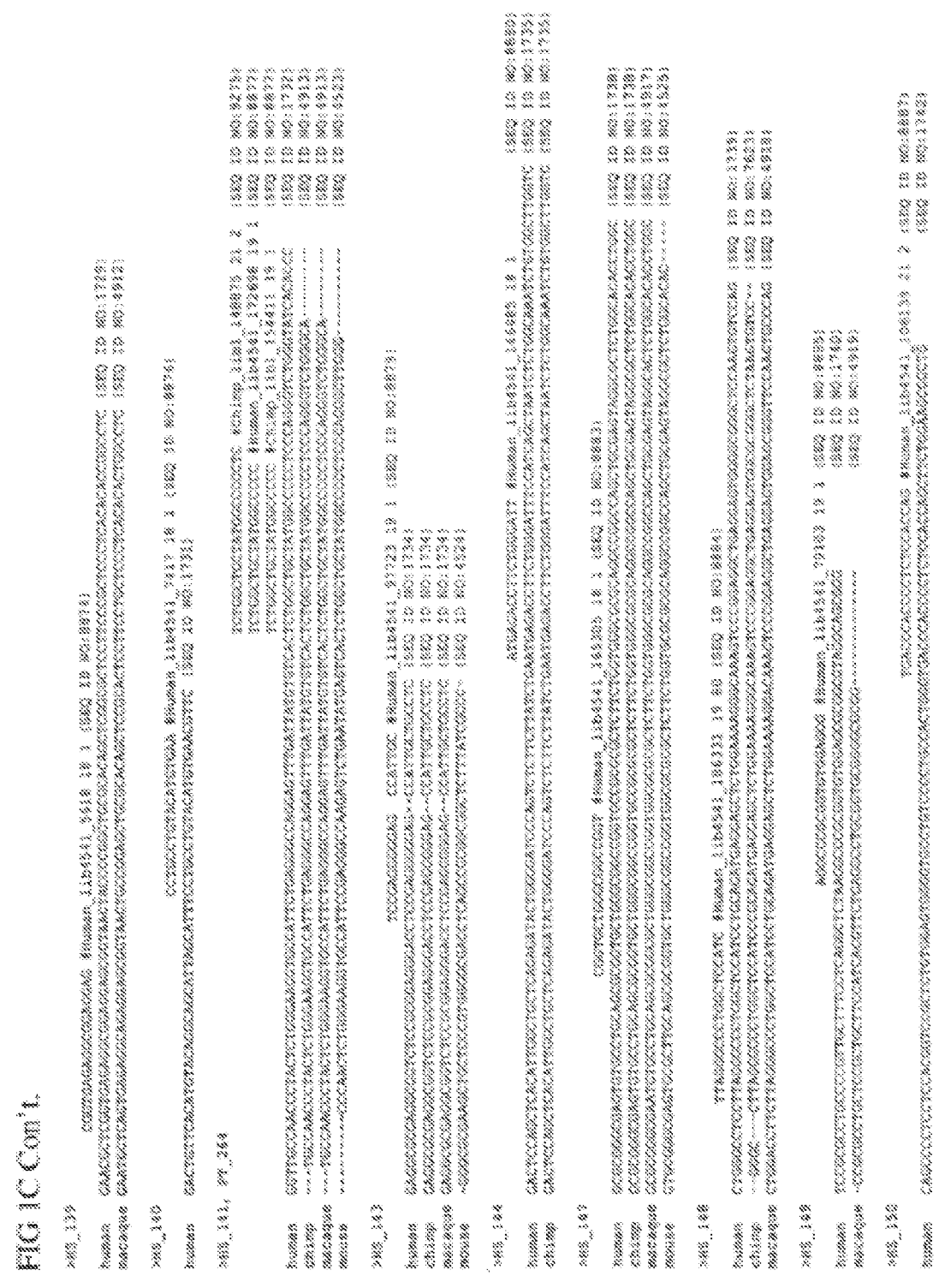
Figure 1C:
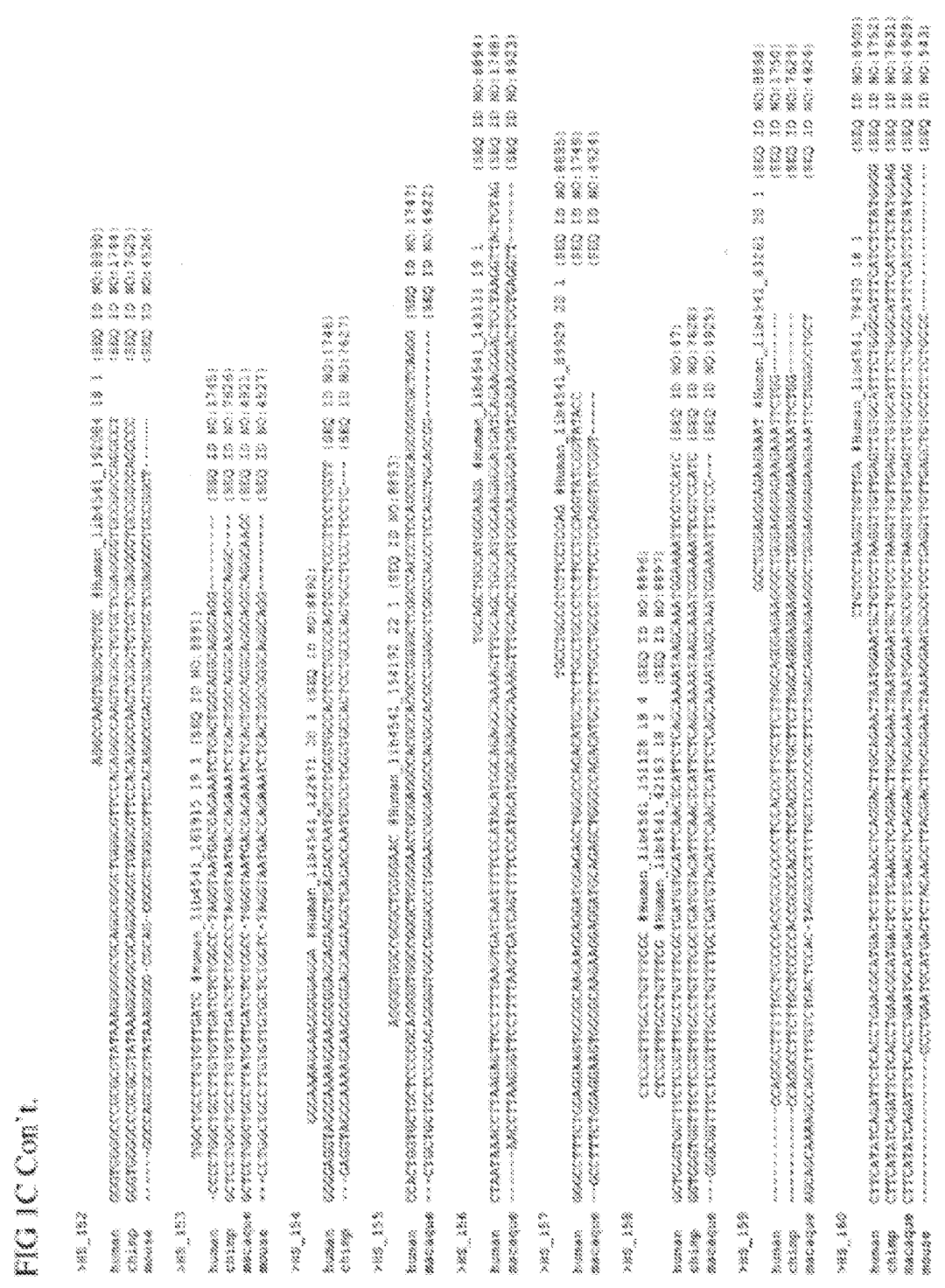
Figure 1C:
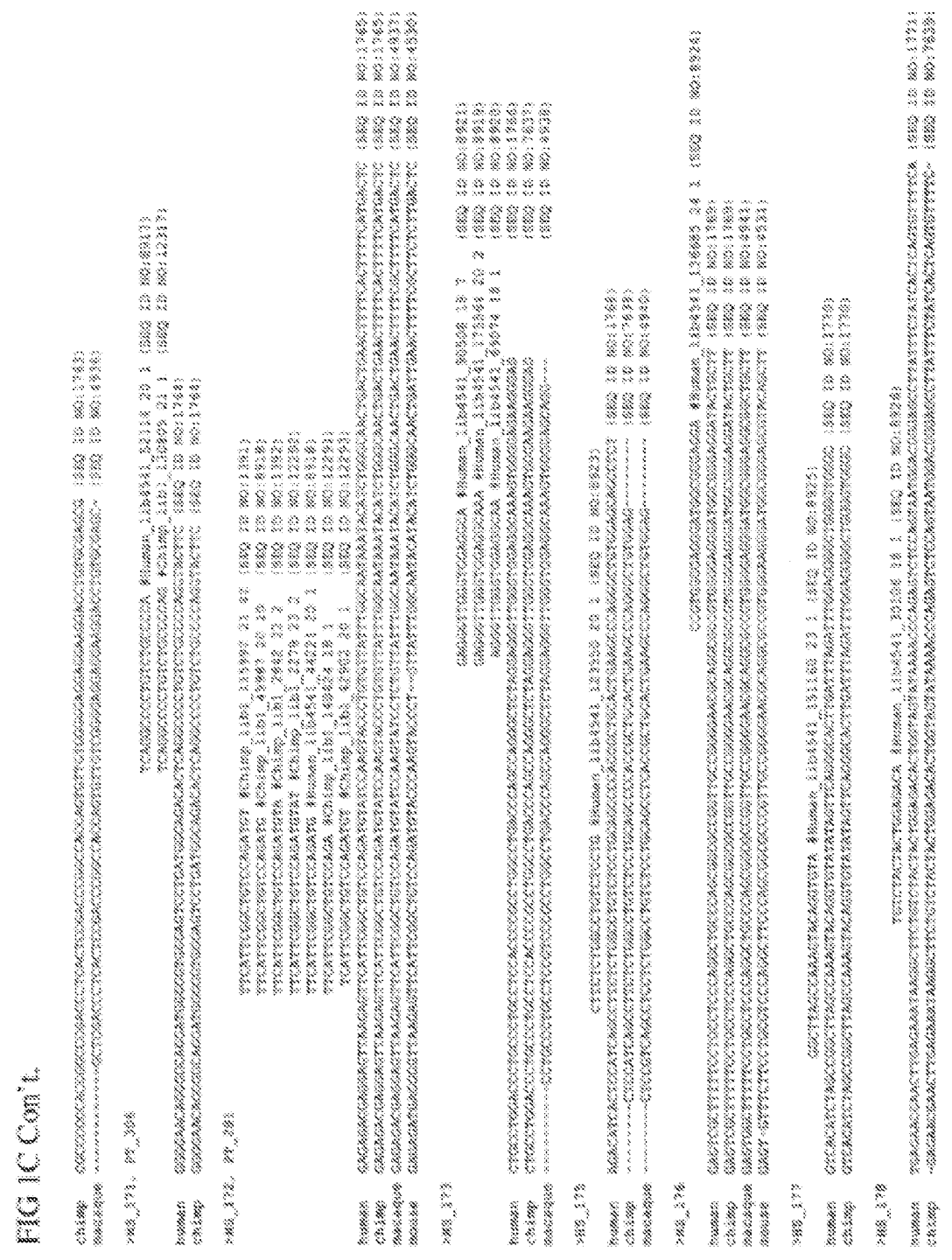
Figure 1C:
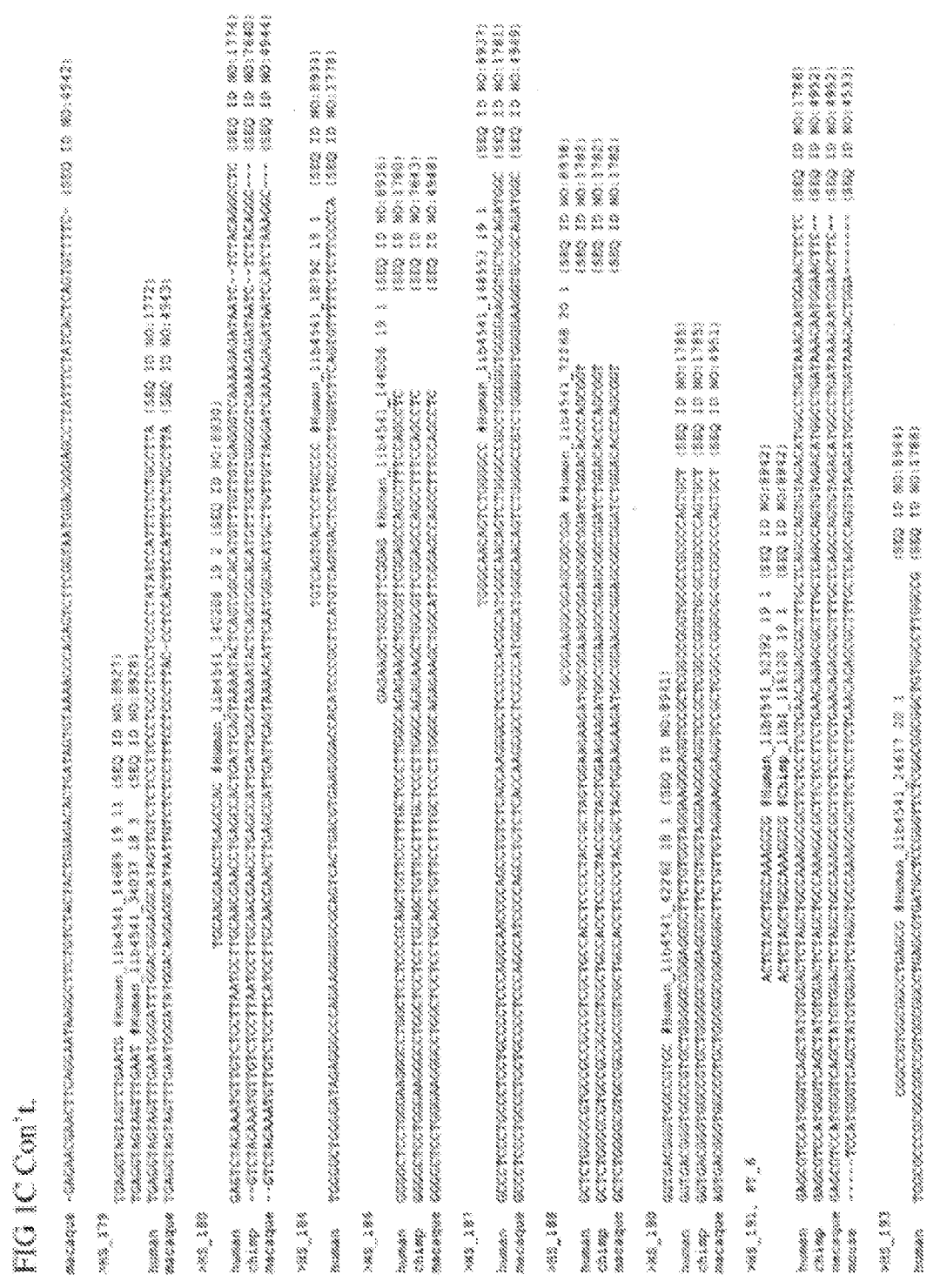
Figure 1C:
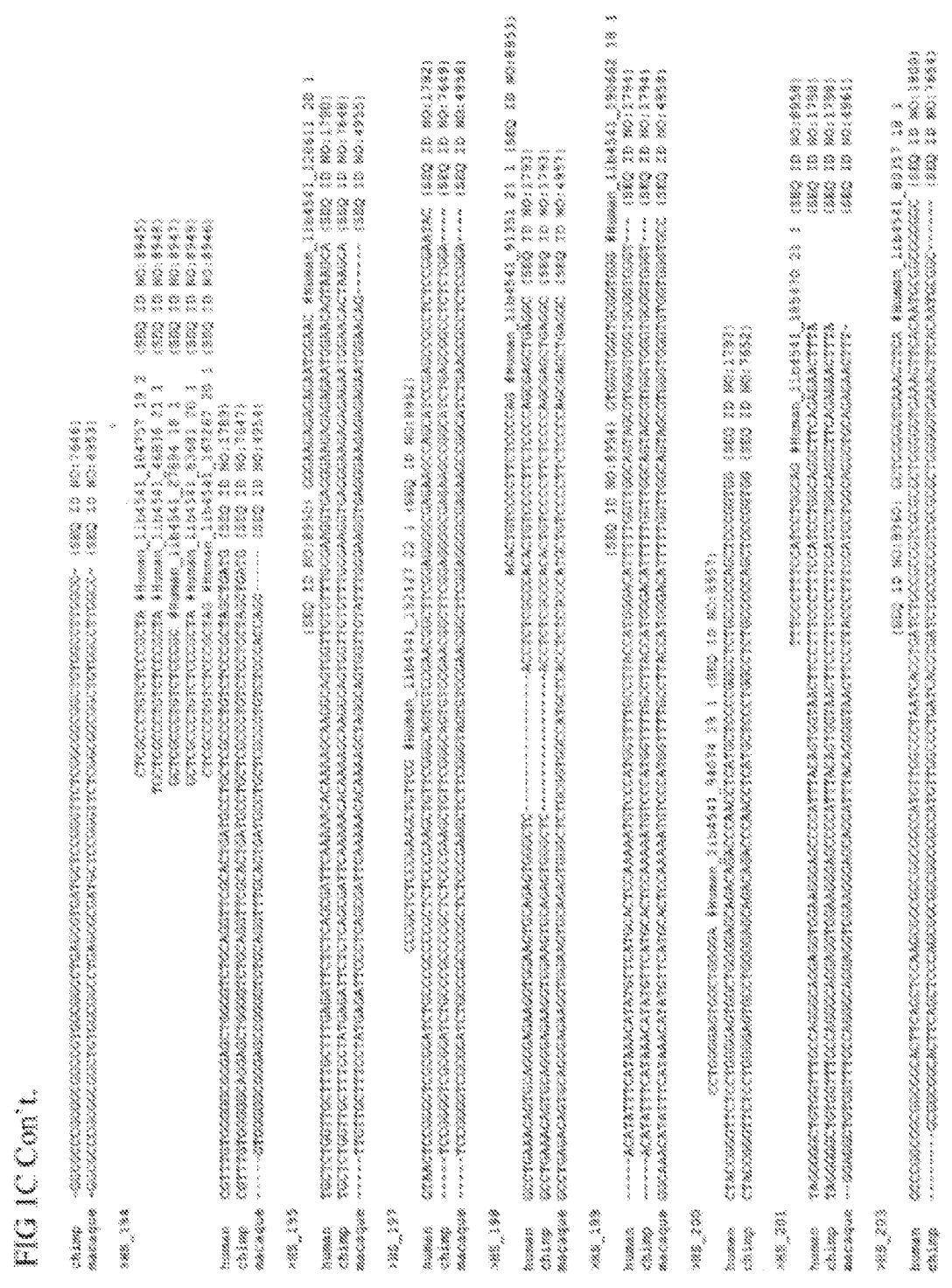
Figure 1C:
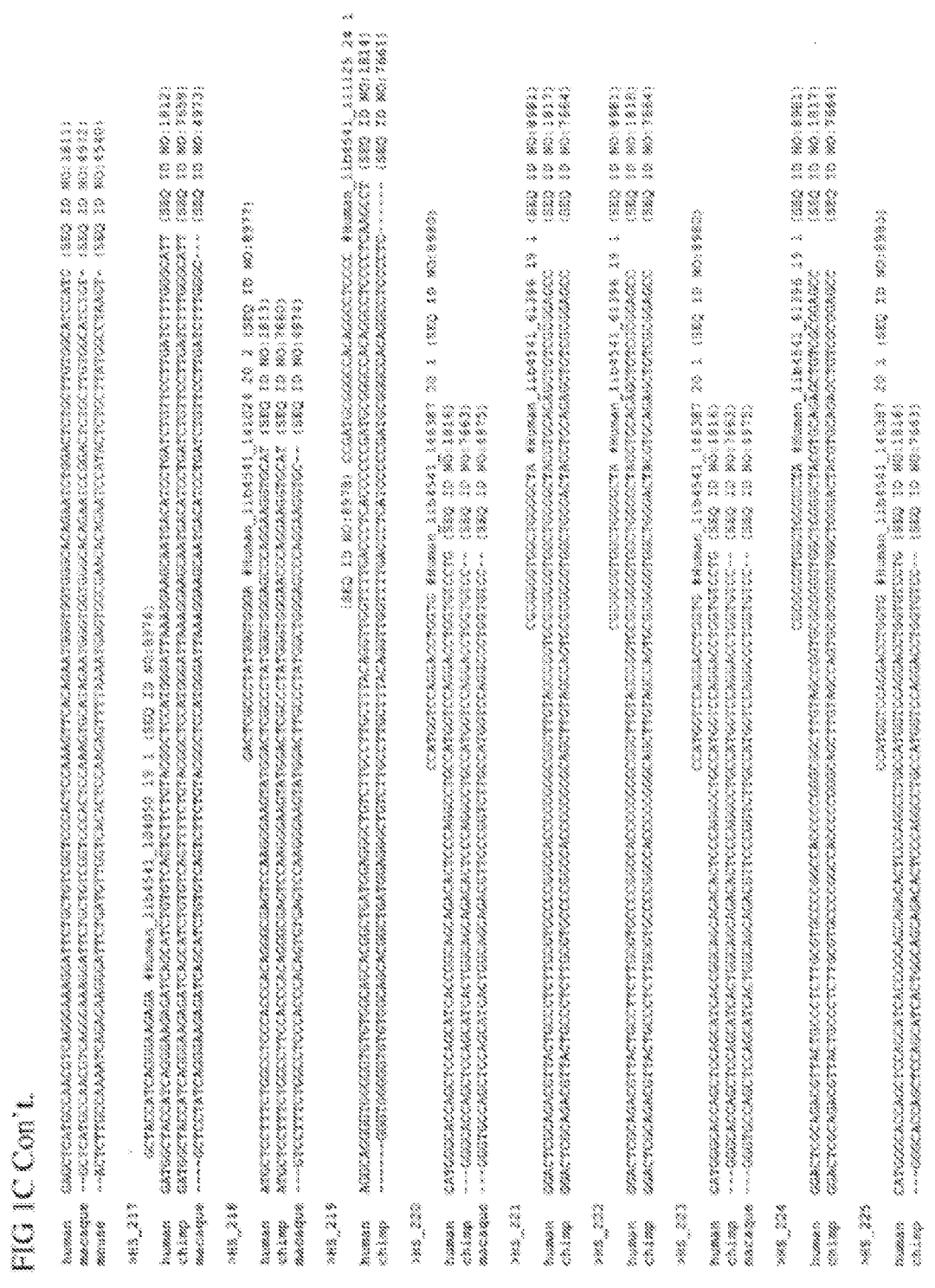
Figure 1C:
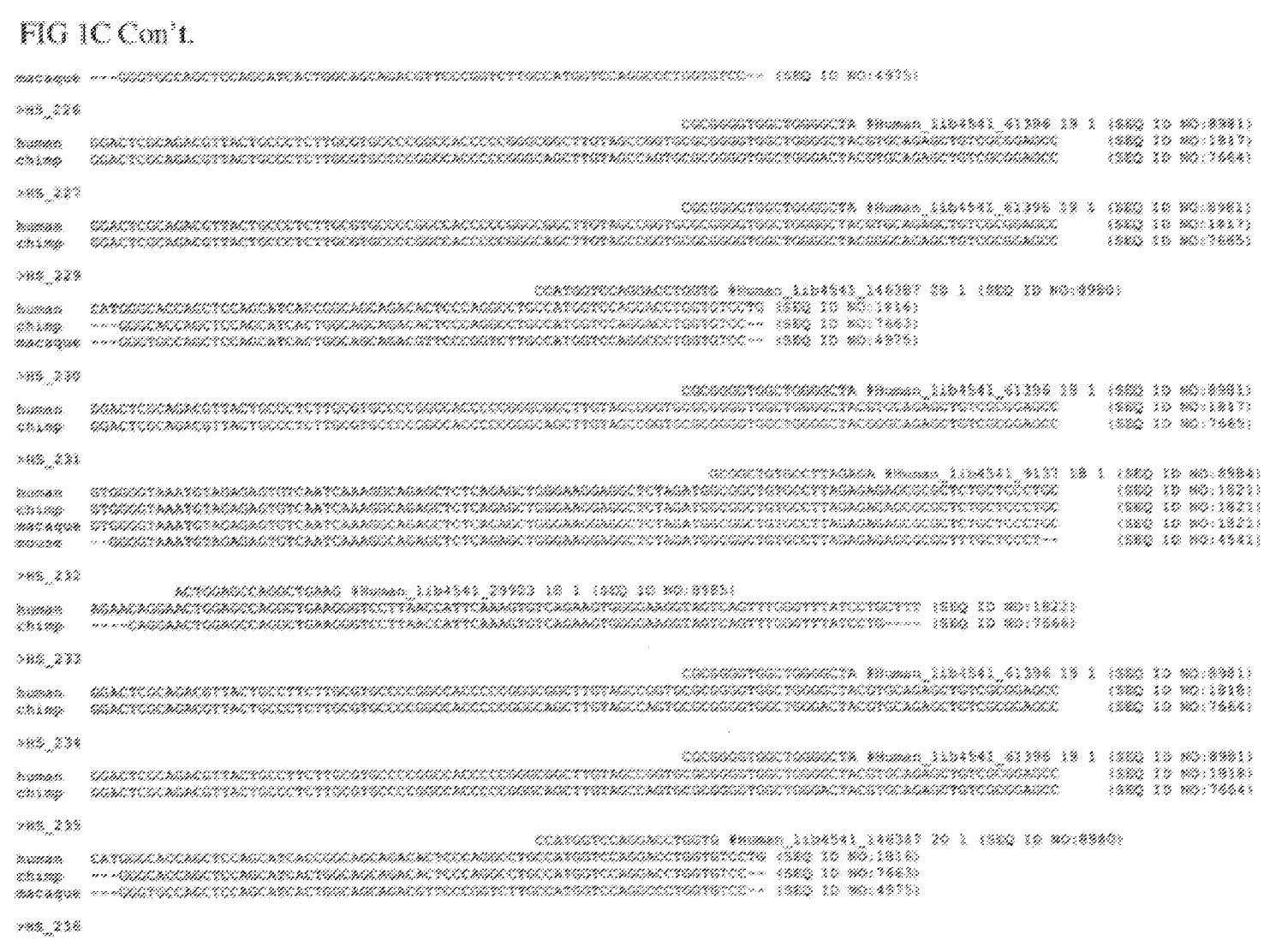
Figure 1C:
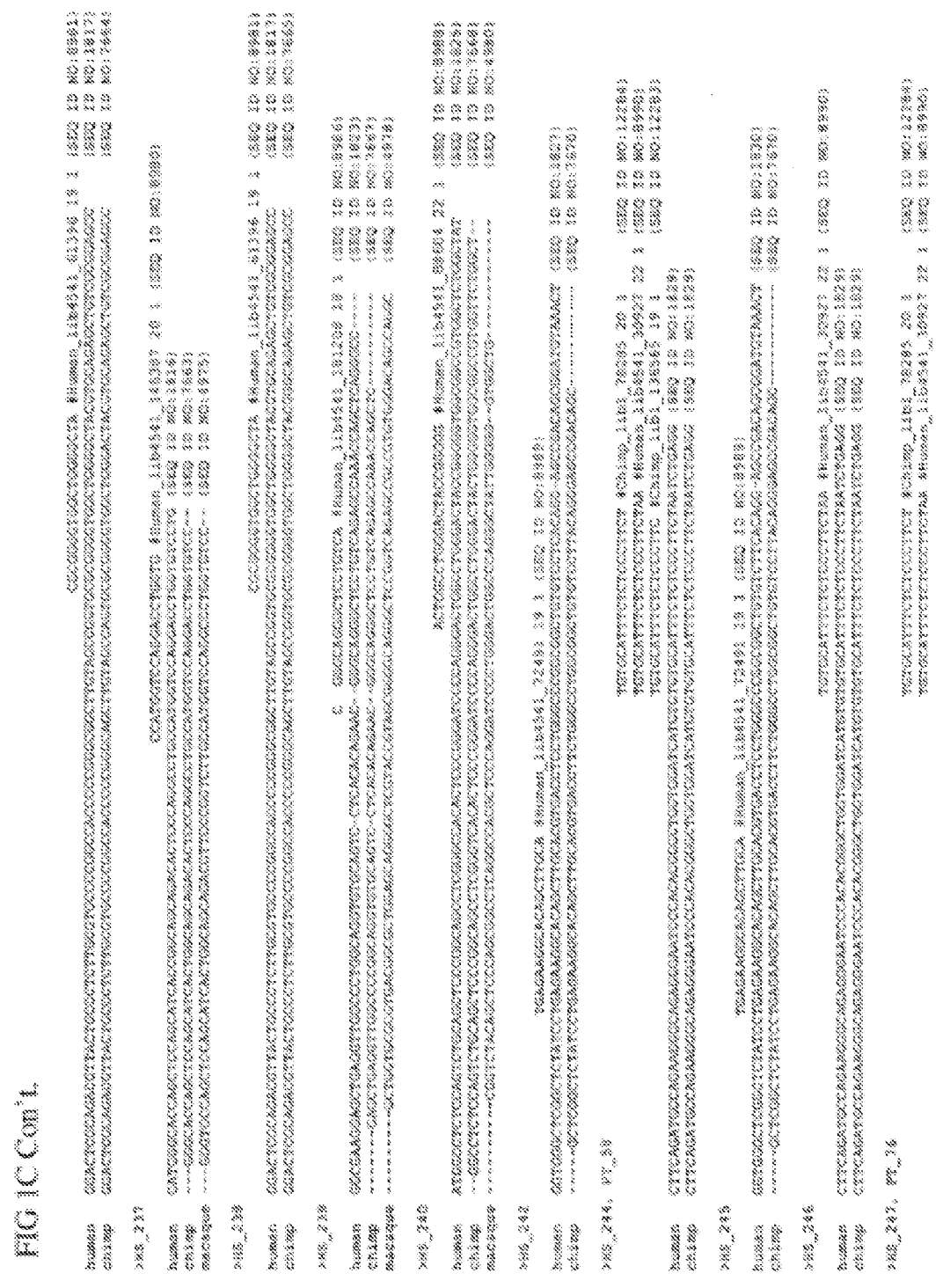
Figure 1C:
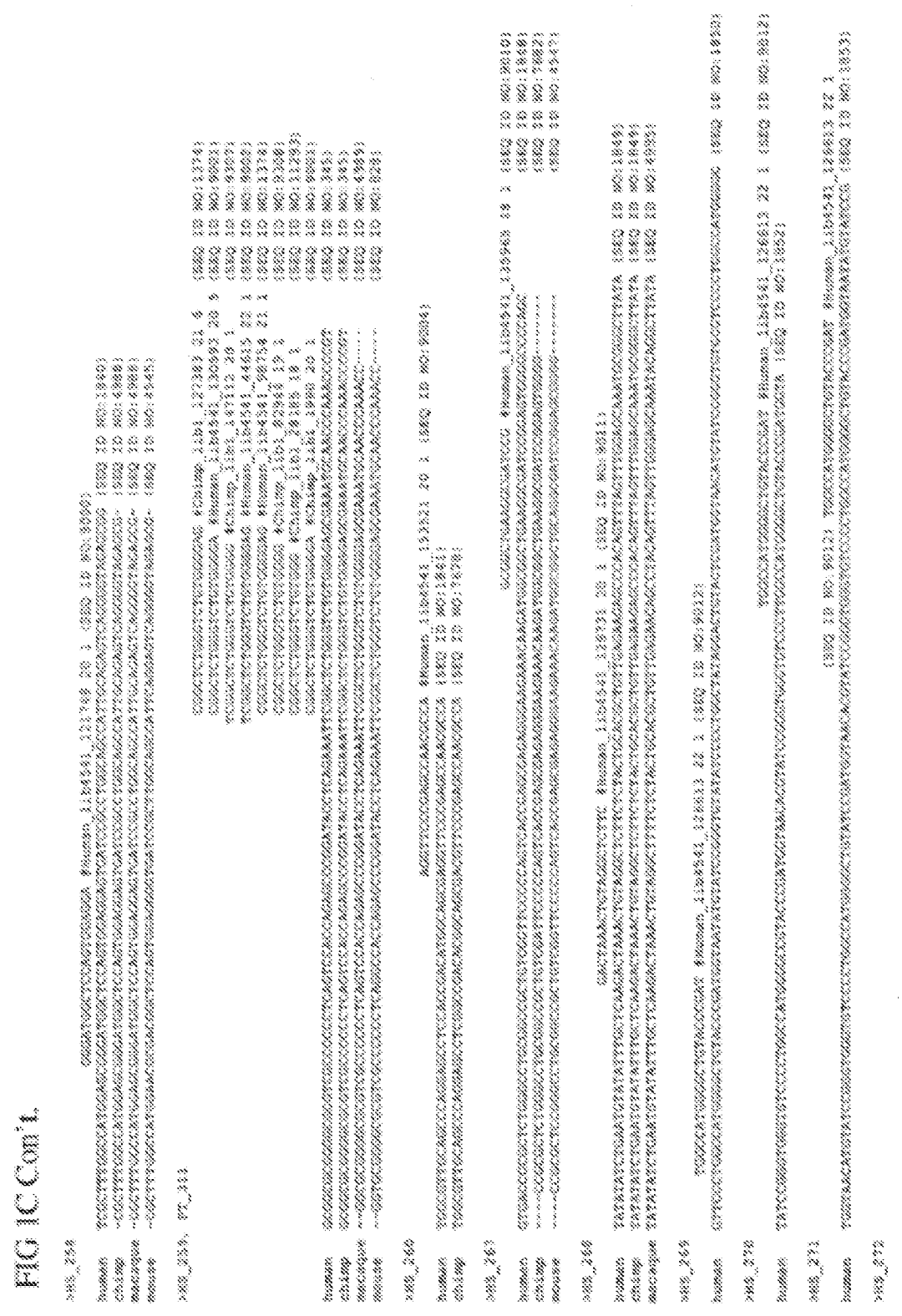
Figure 1C:
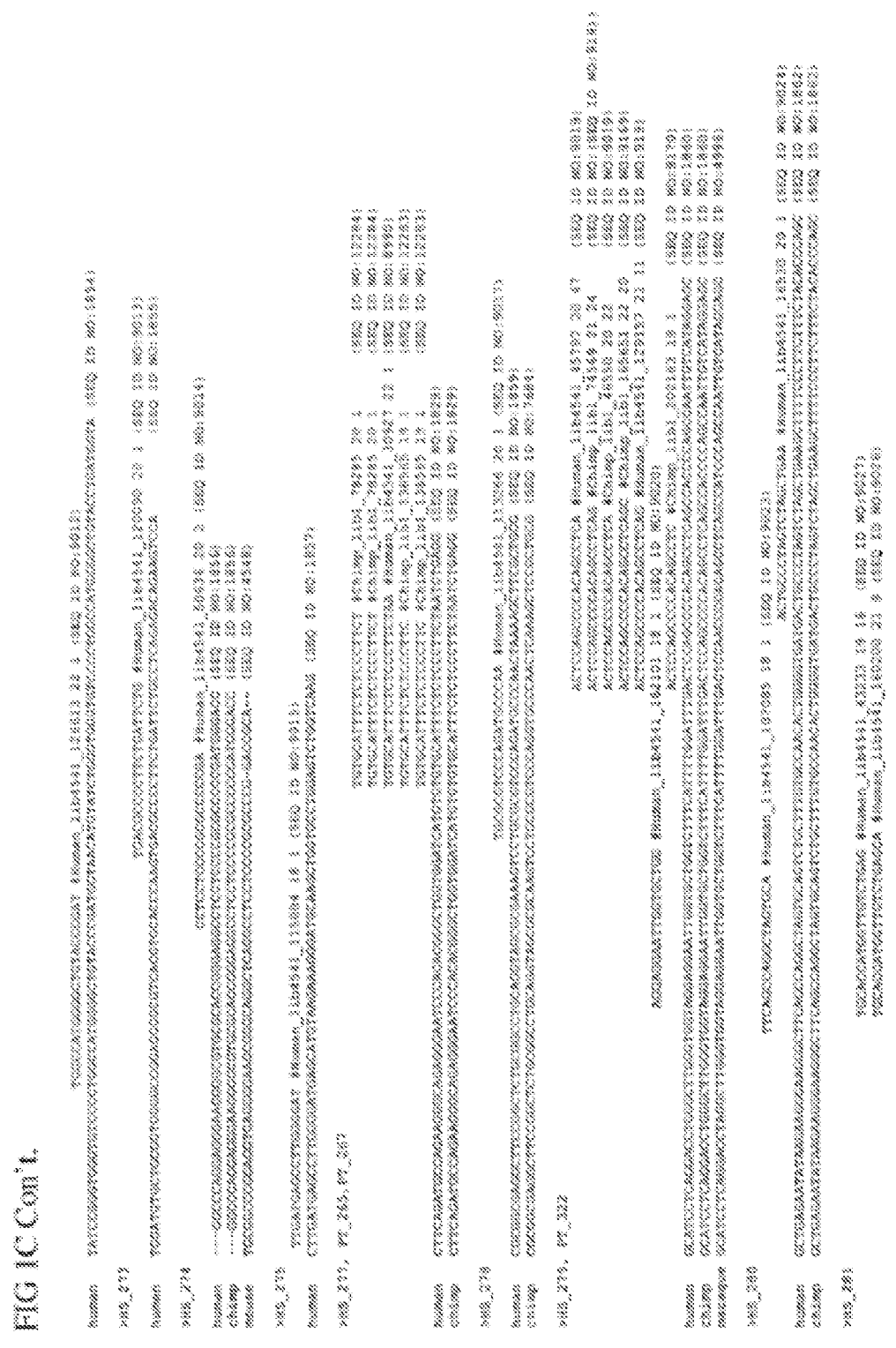
Figure 1C:
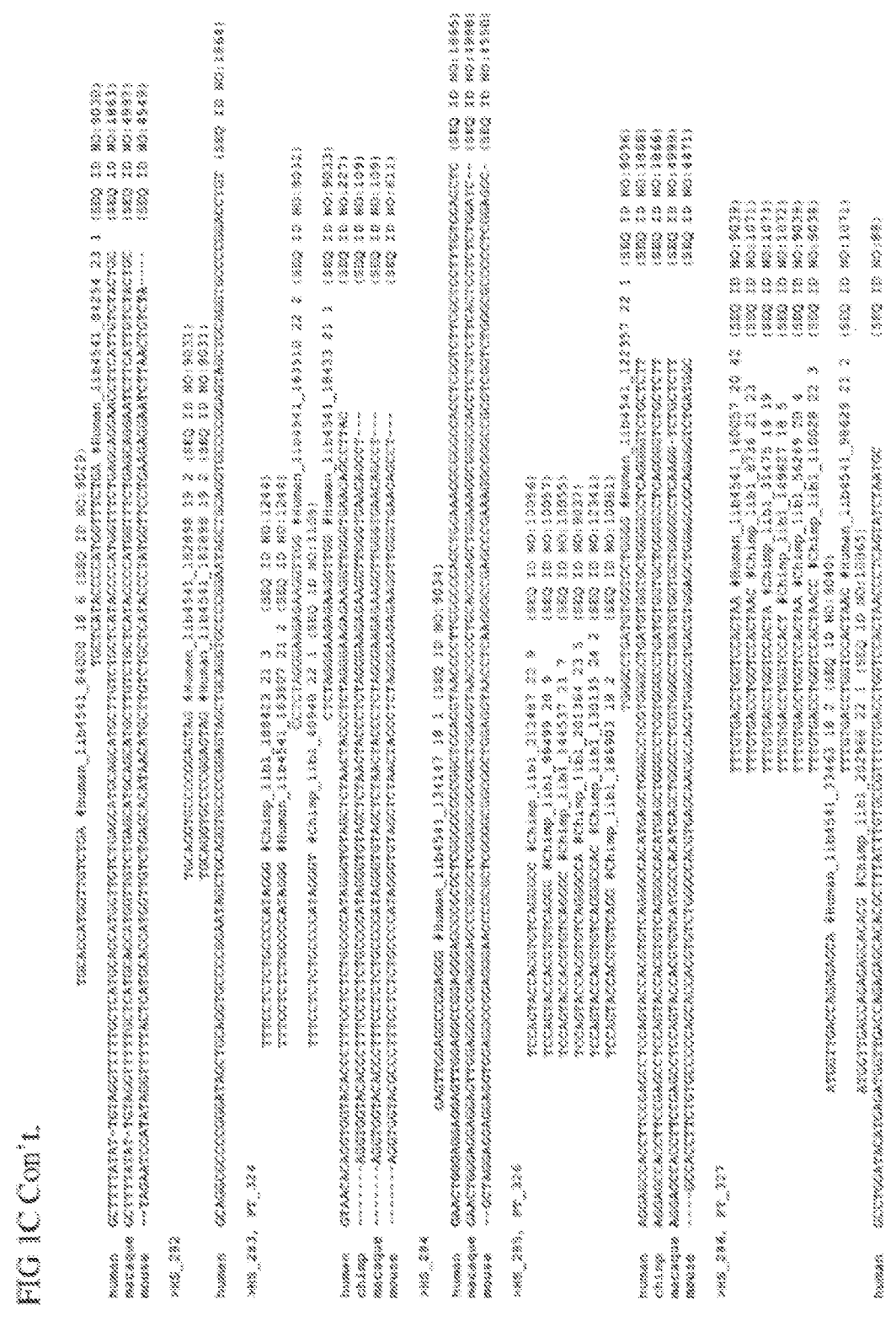
Figure 1C:
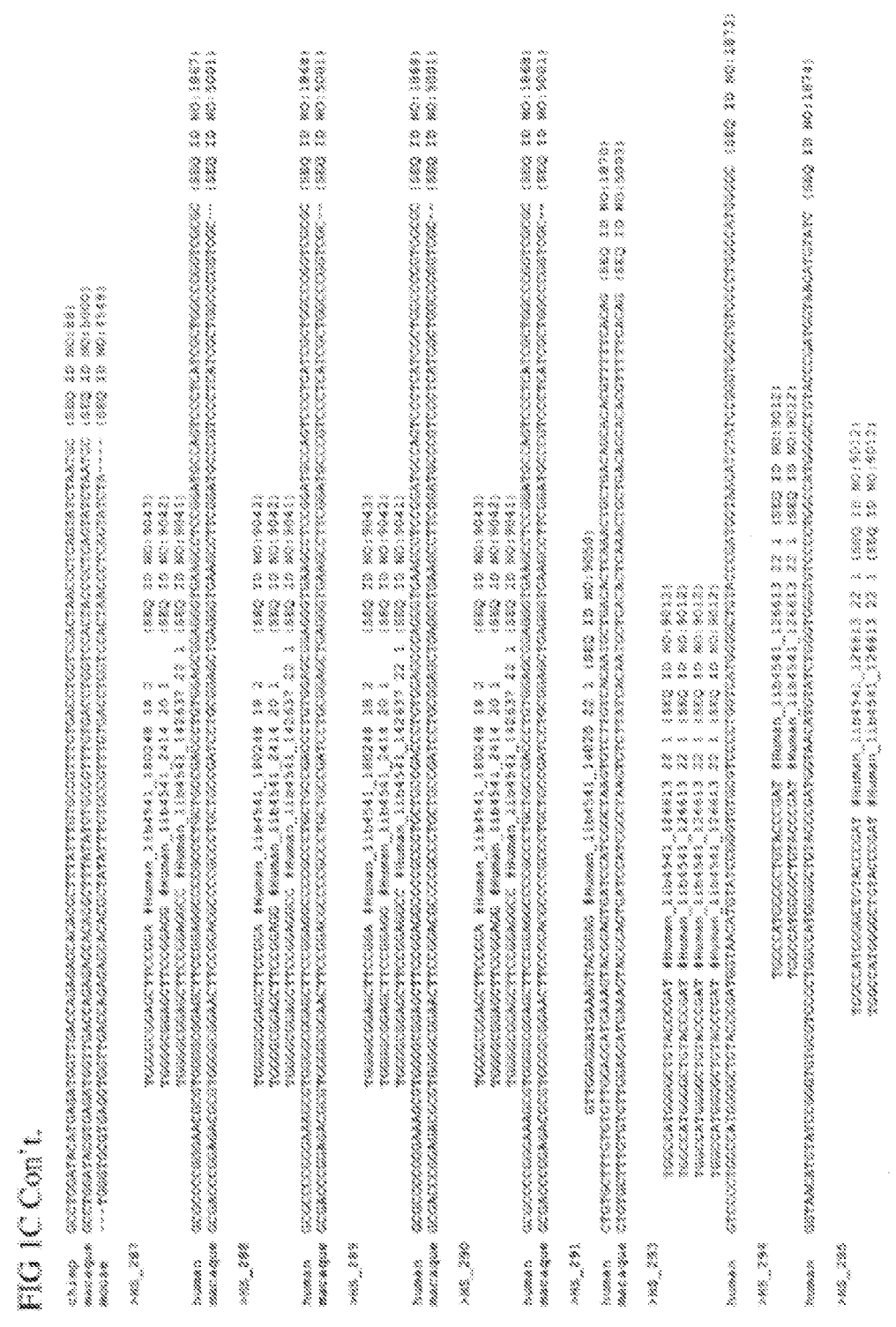
Figure 1C:
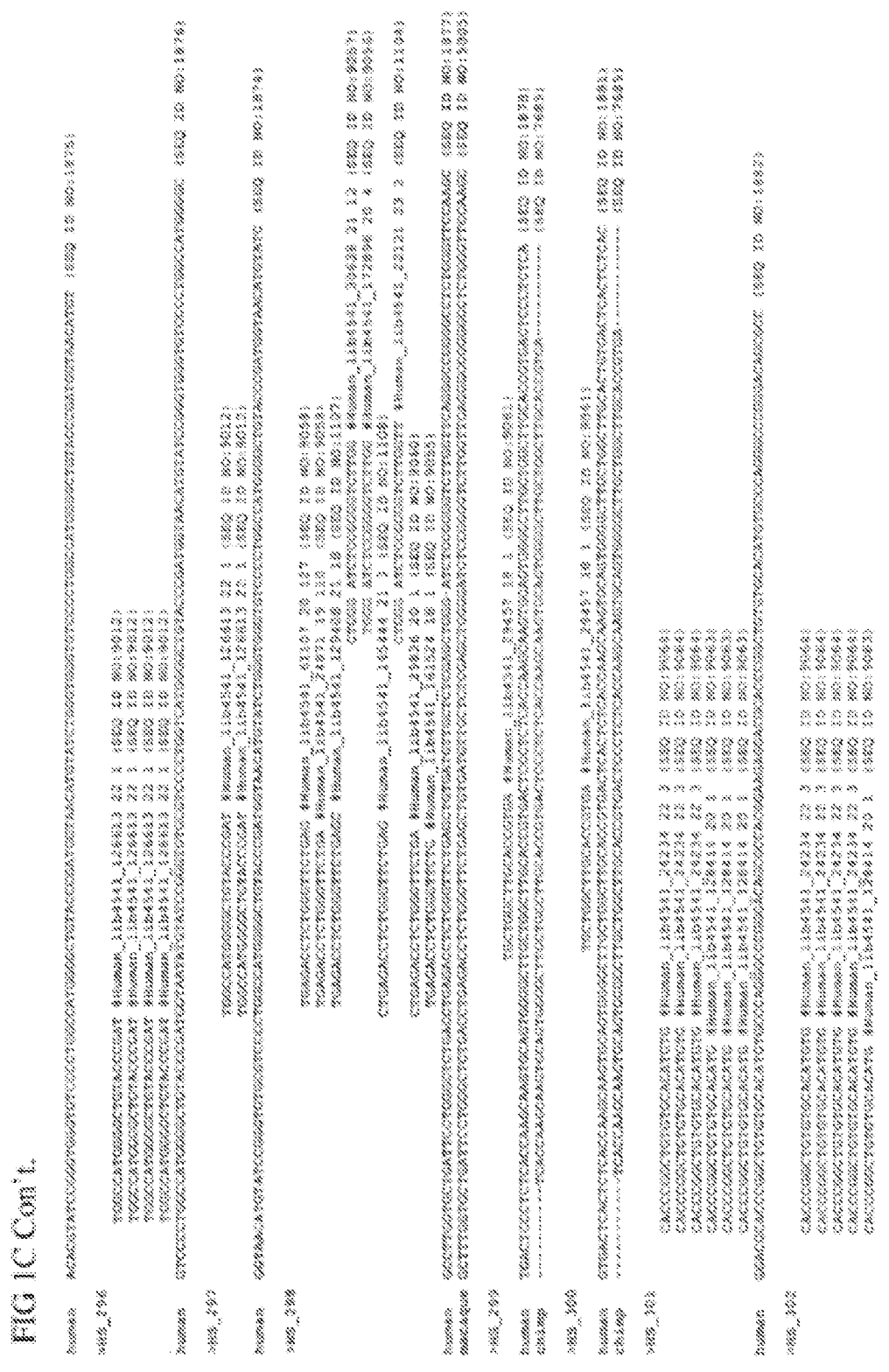
Figure 1C:
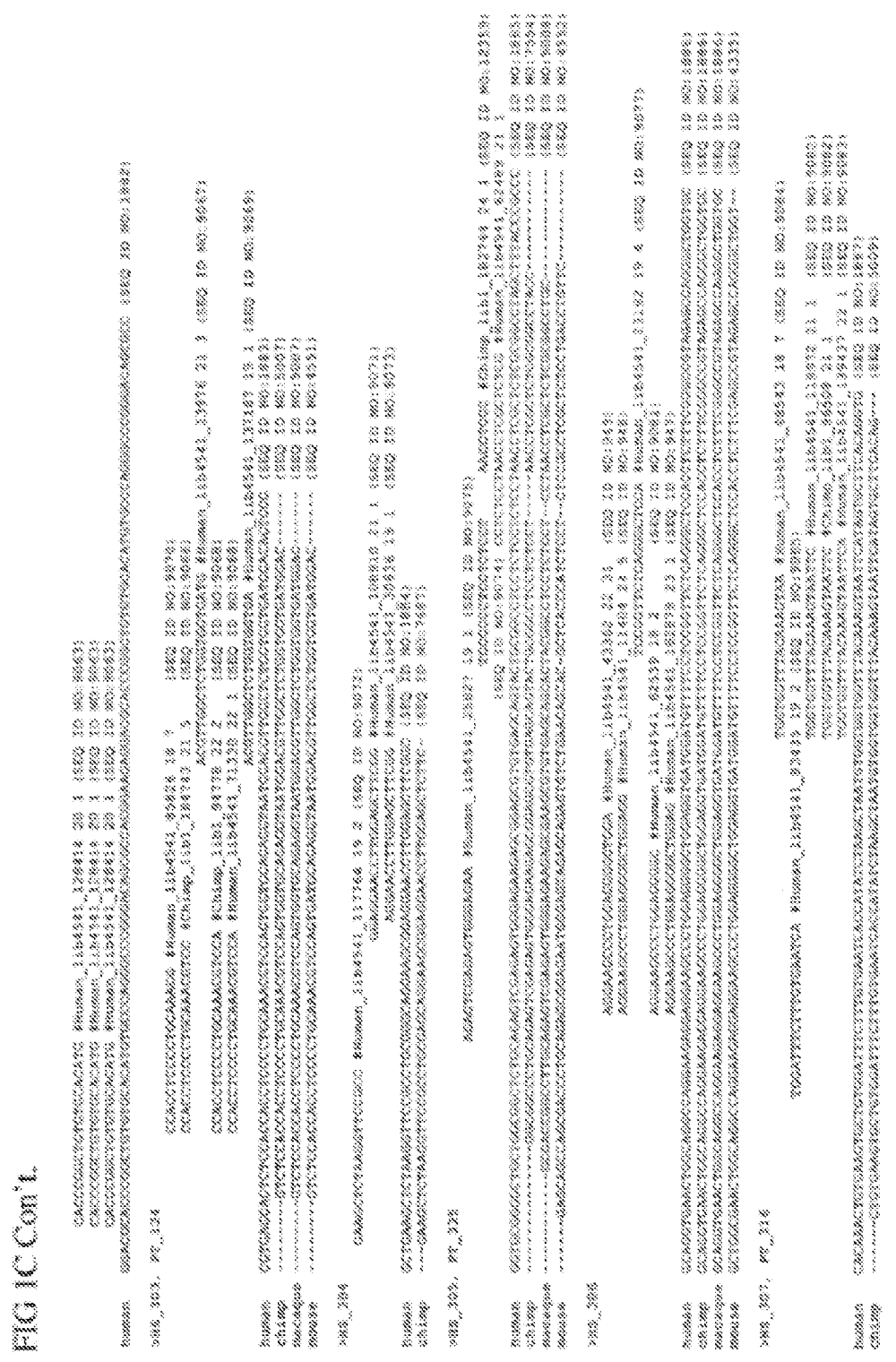
Figure 1C:
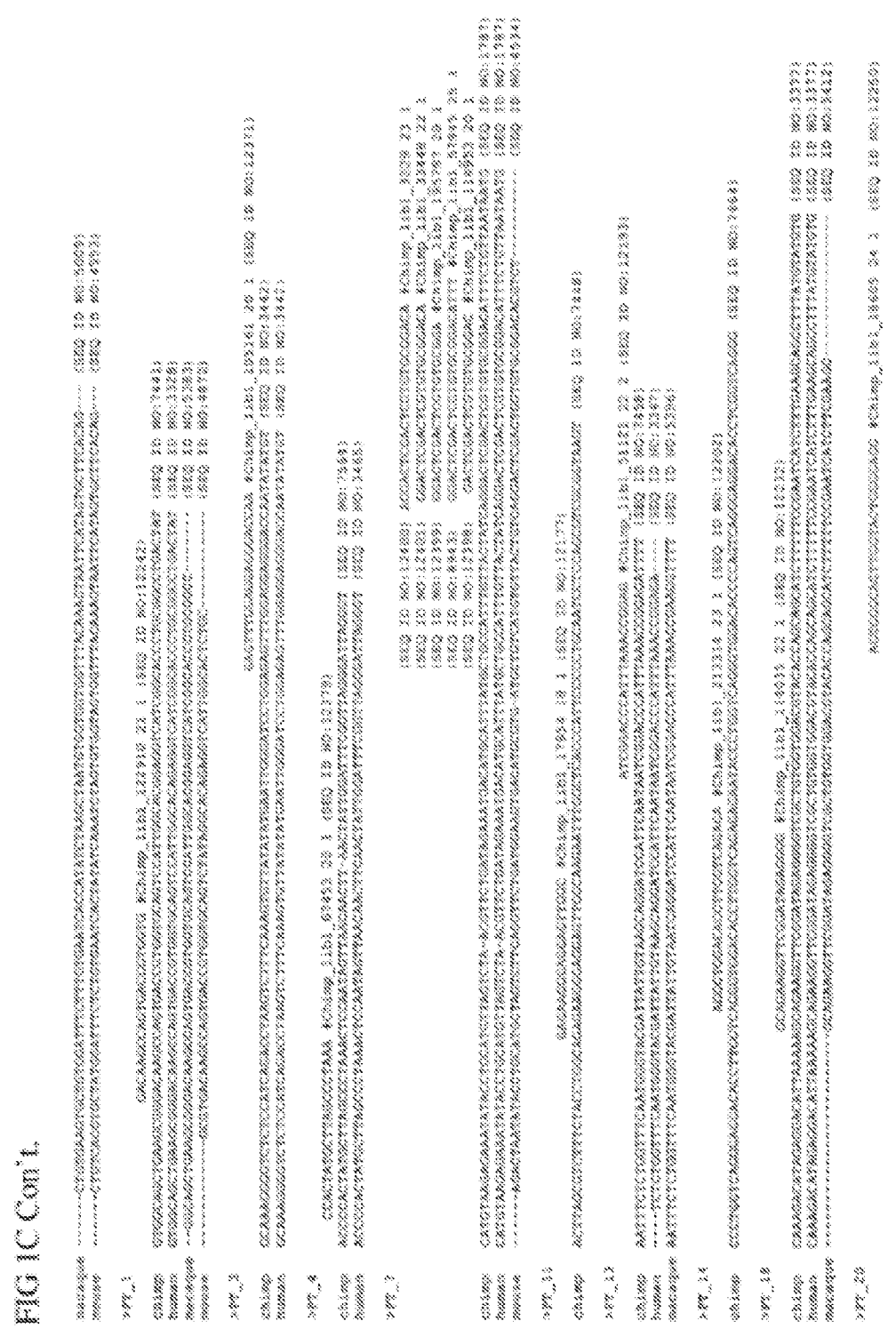
Figure 1C:
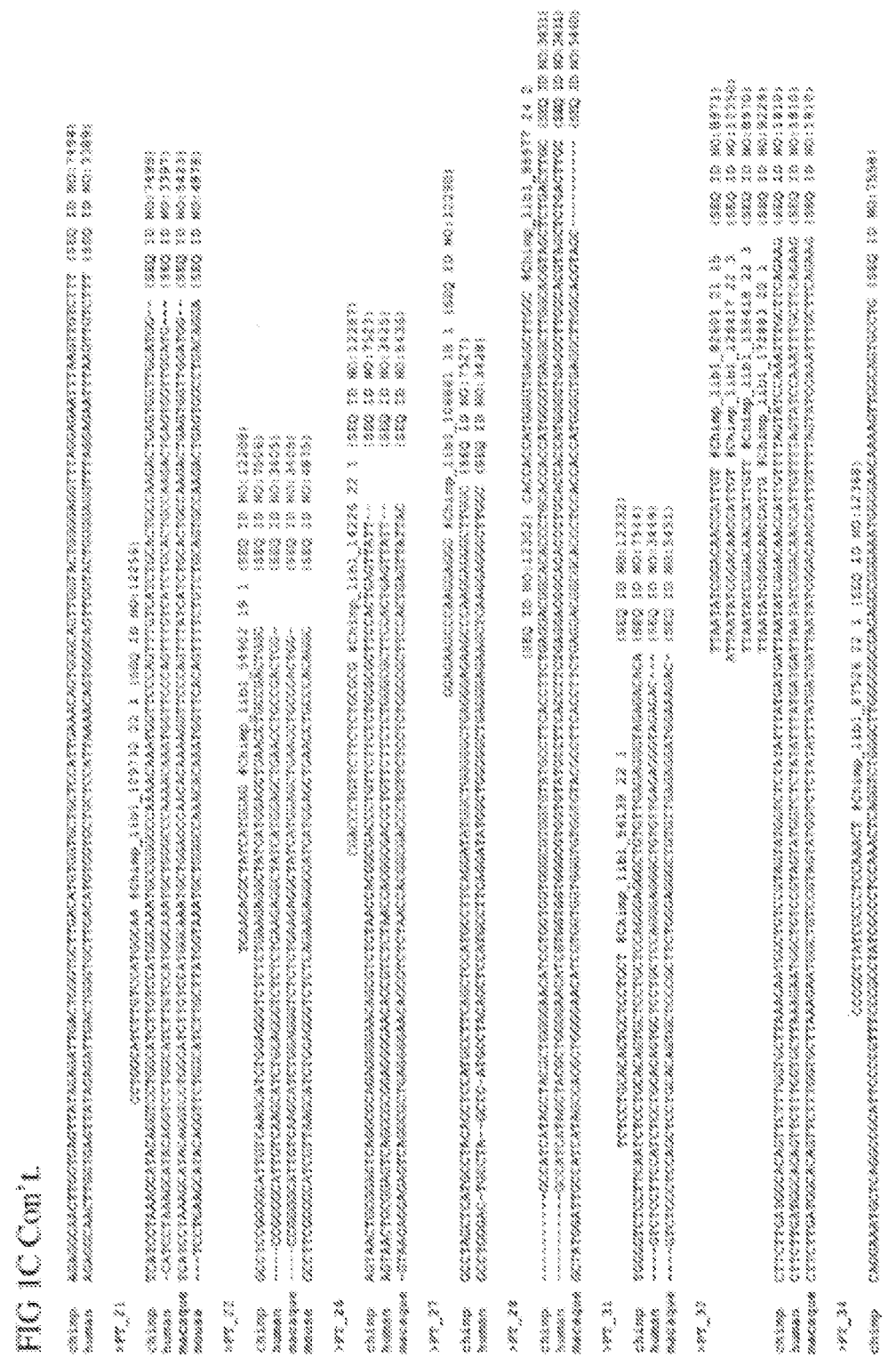
Figure 1C:
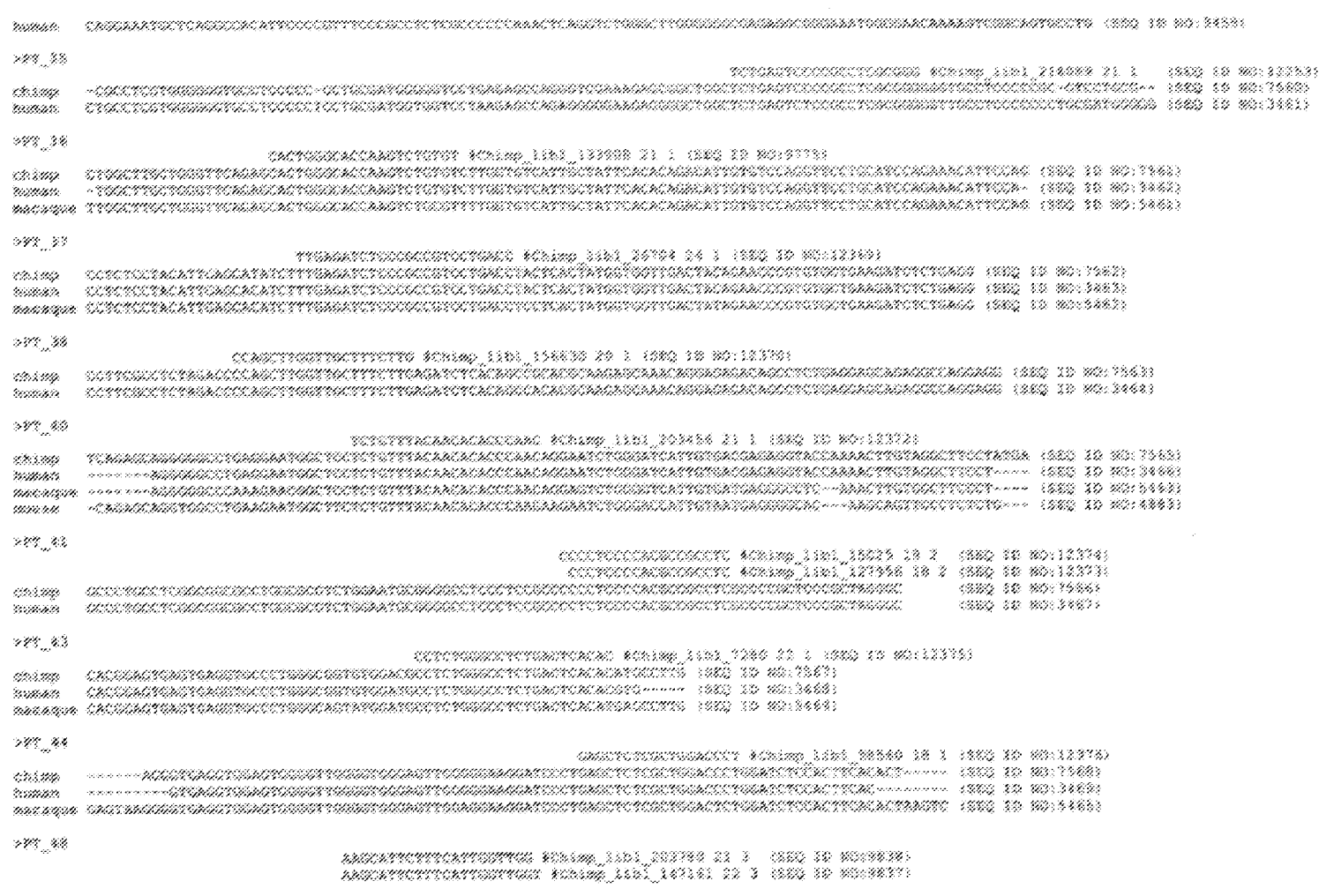
Figure 1C:
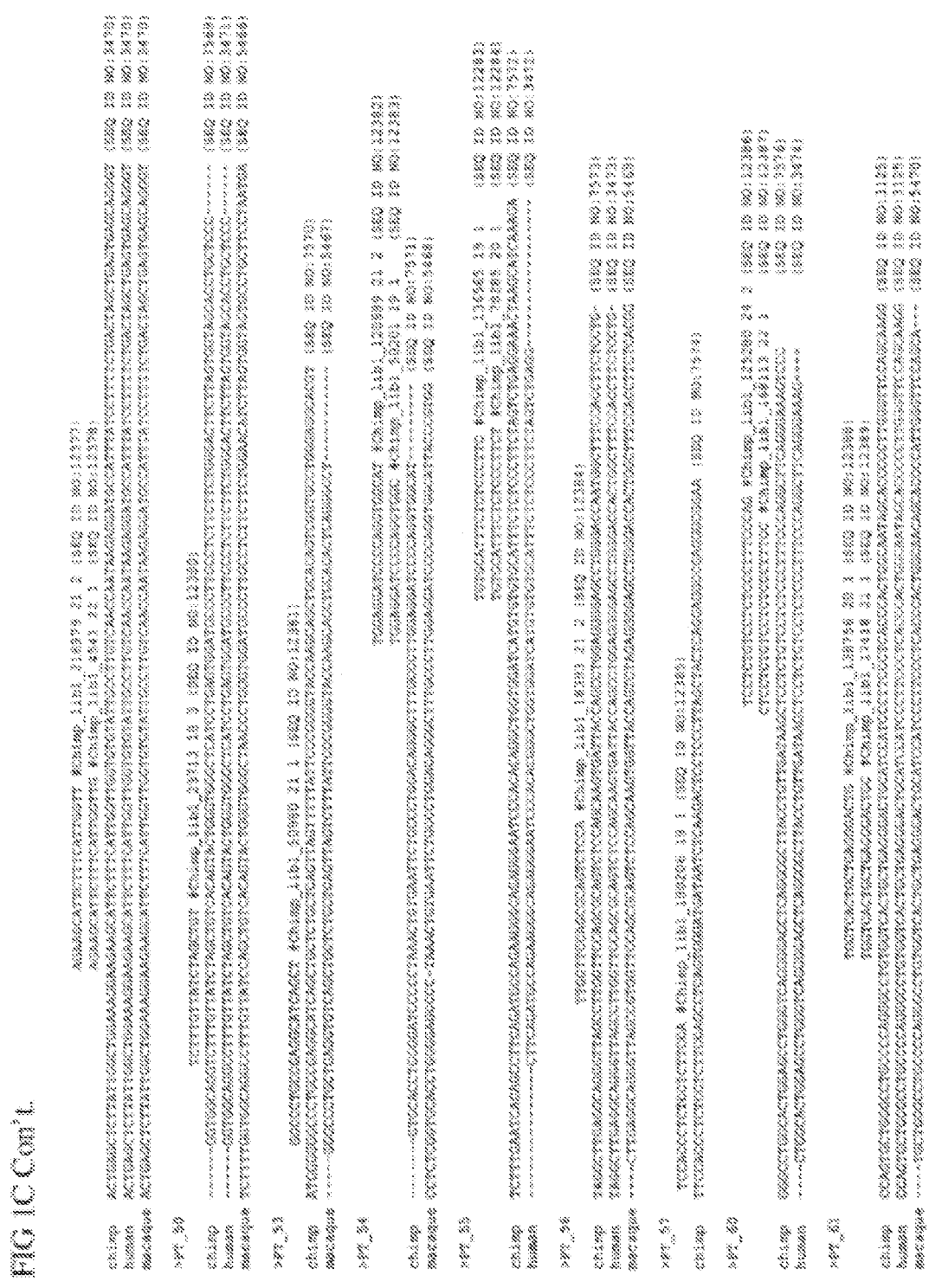
Figure 1C:
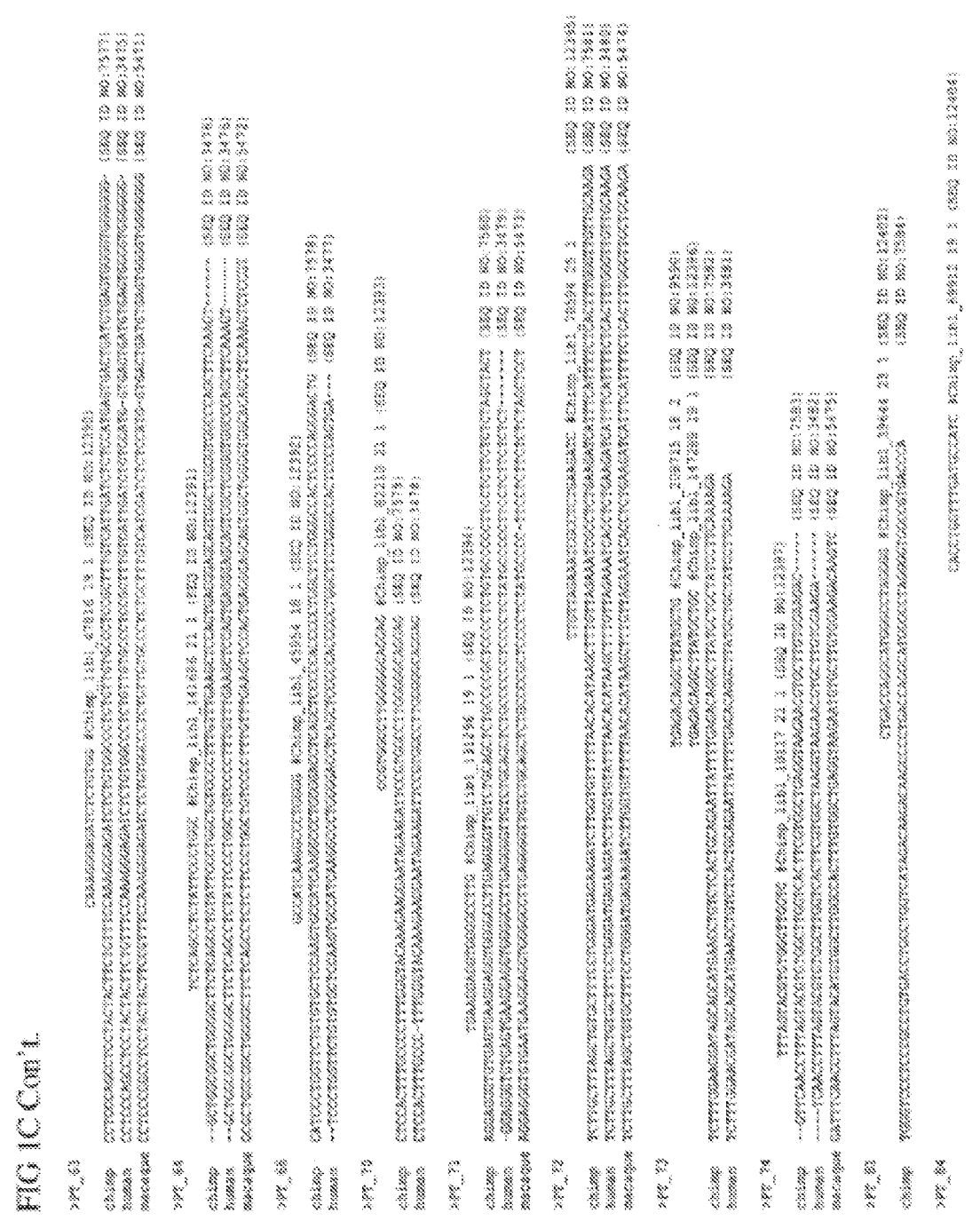
Figure 1C:
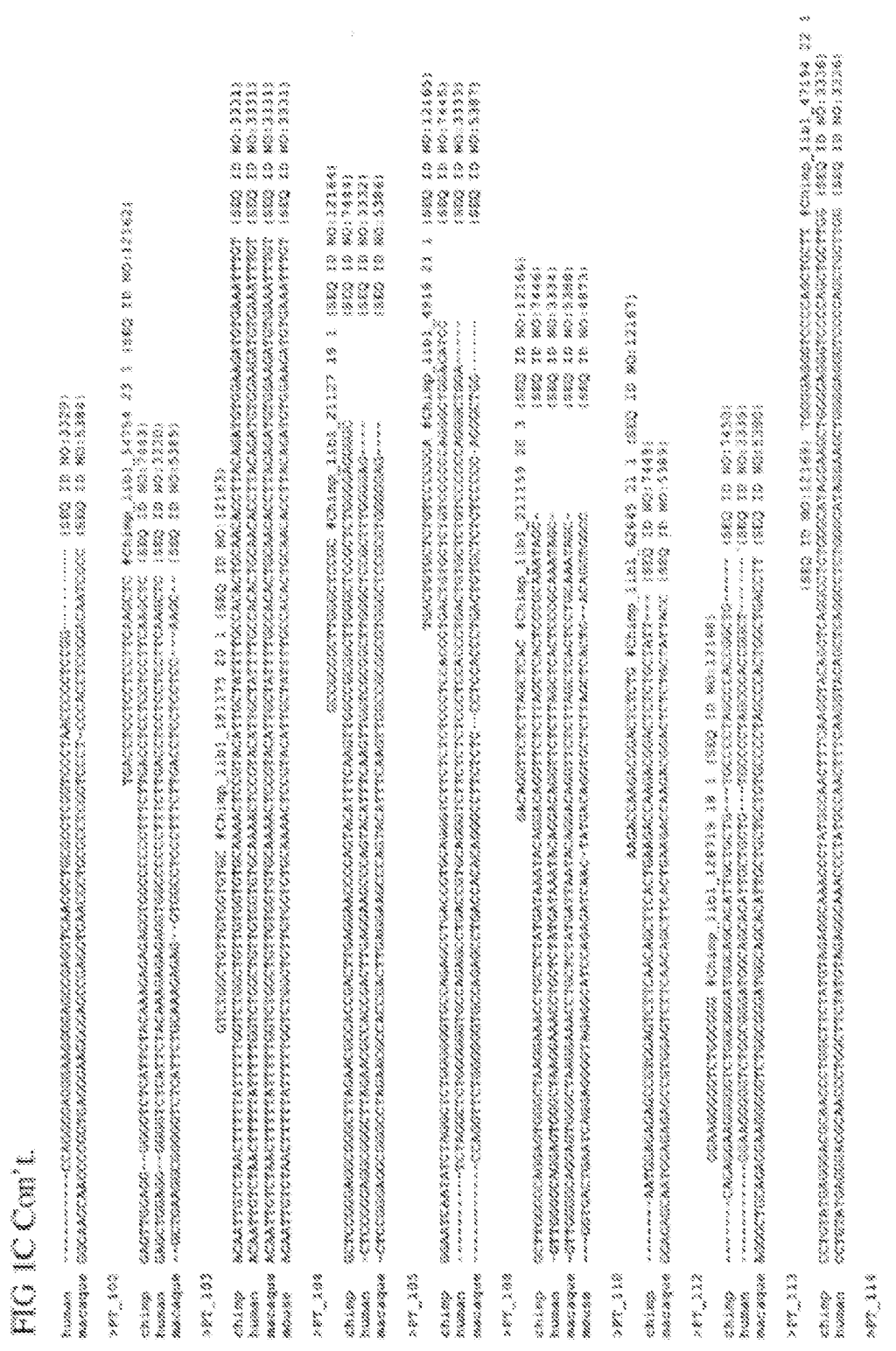
Figure 1C:
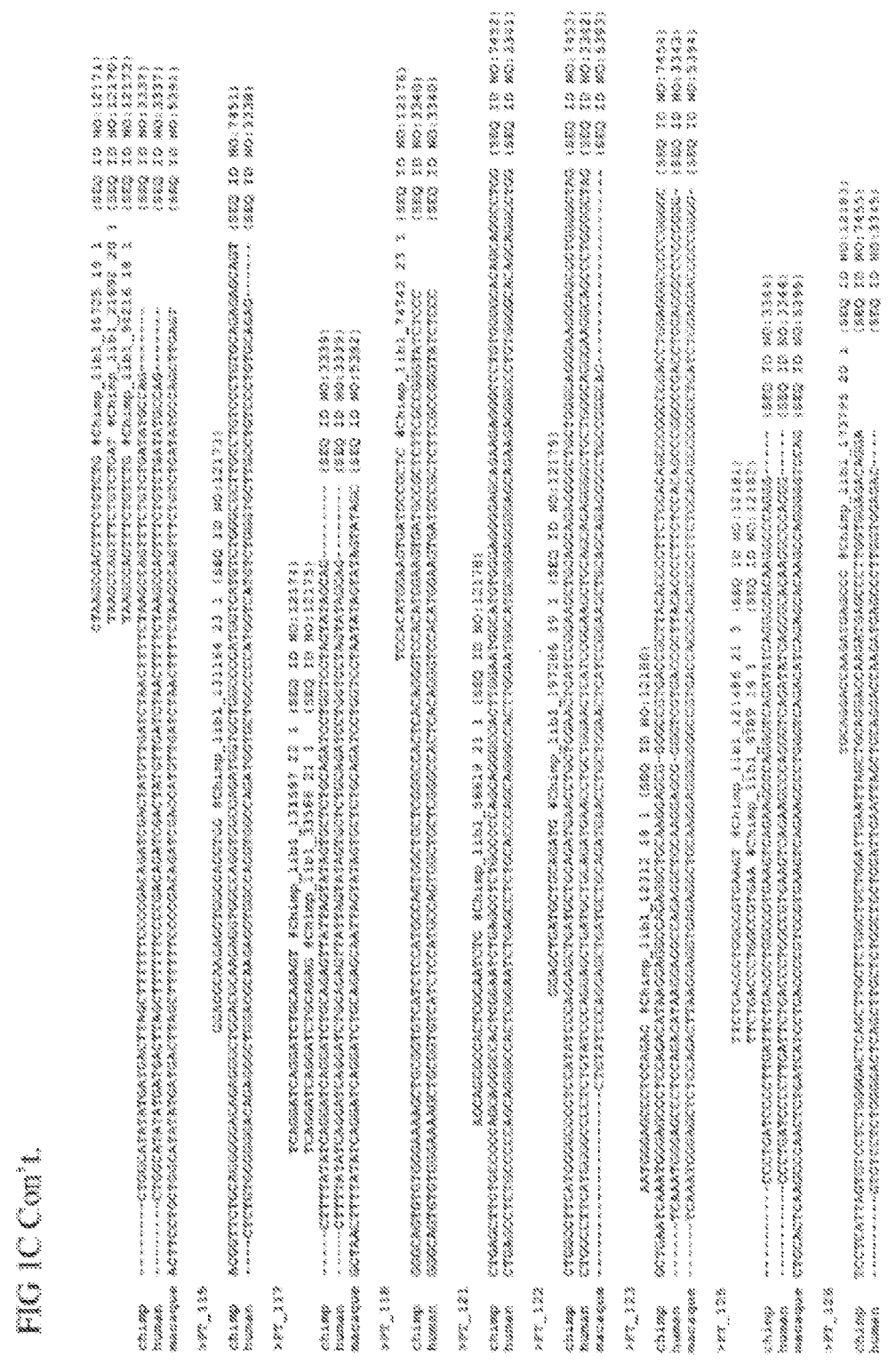
Figure 1C:
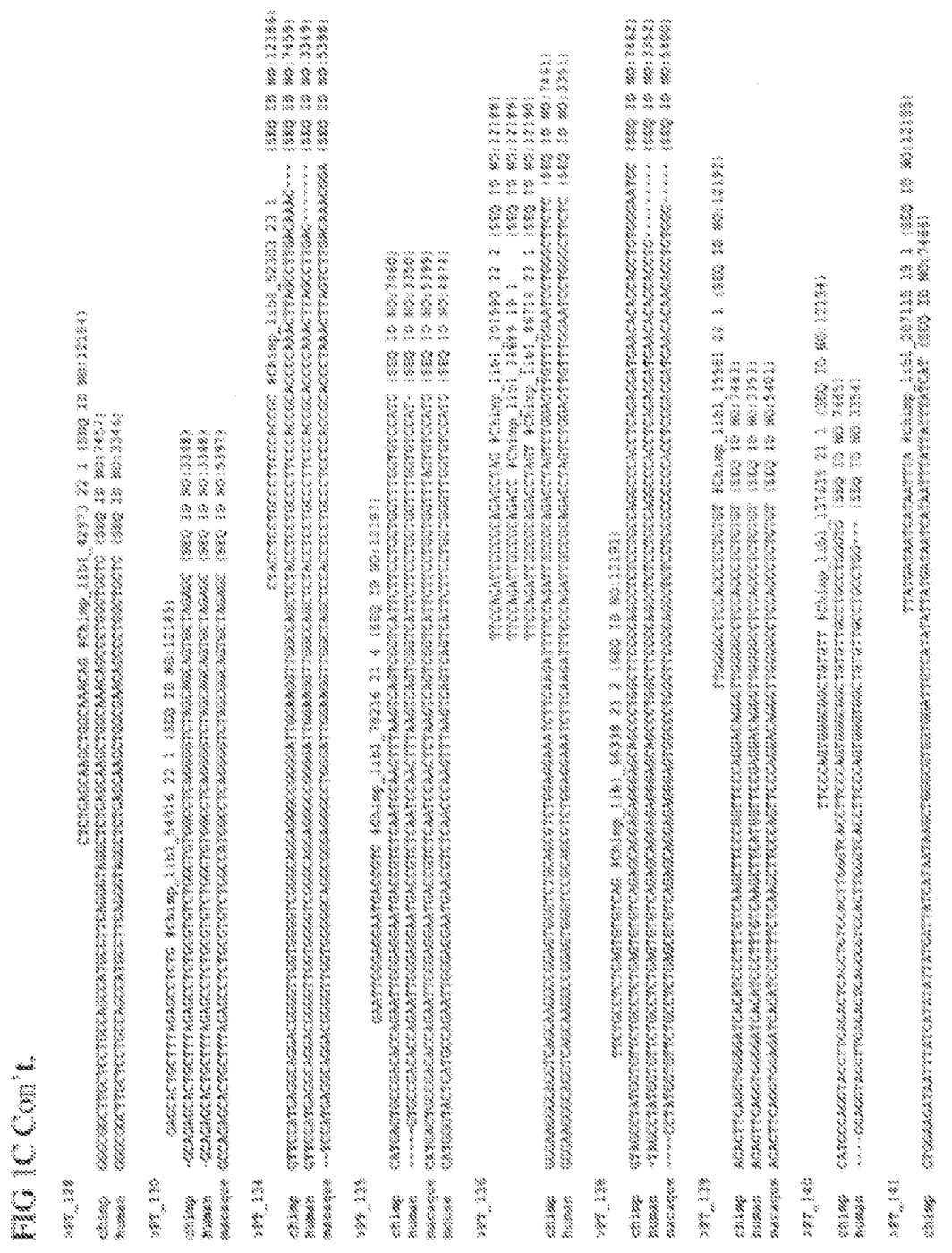
Figure 1C:
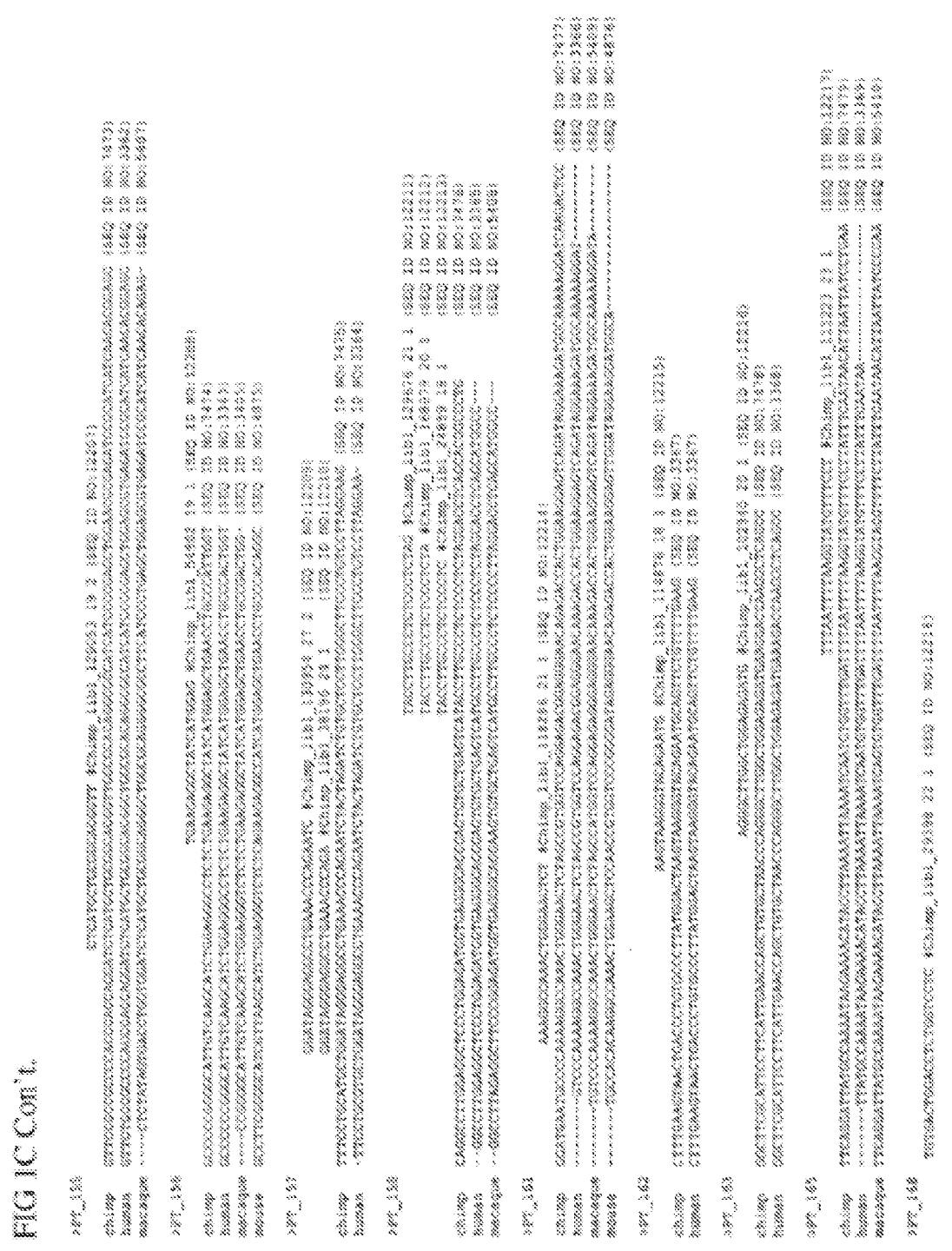
Figure 1C:
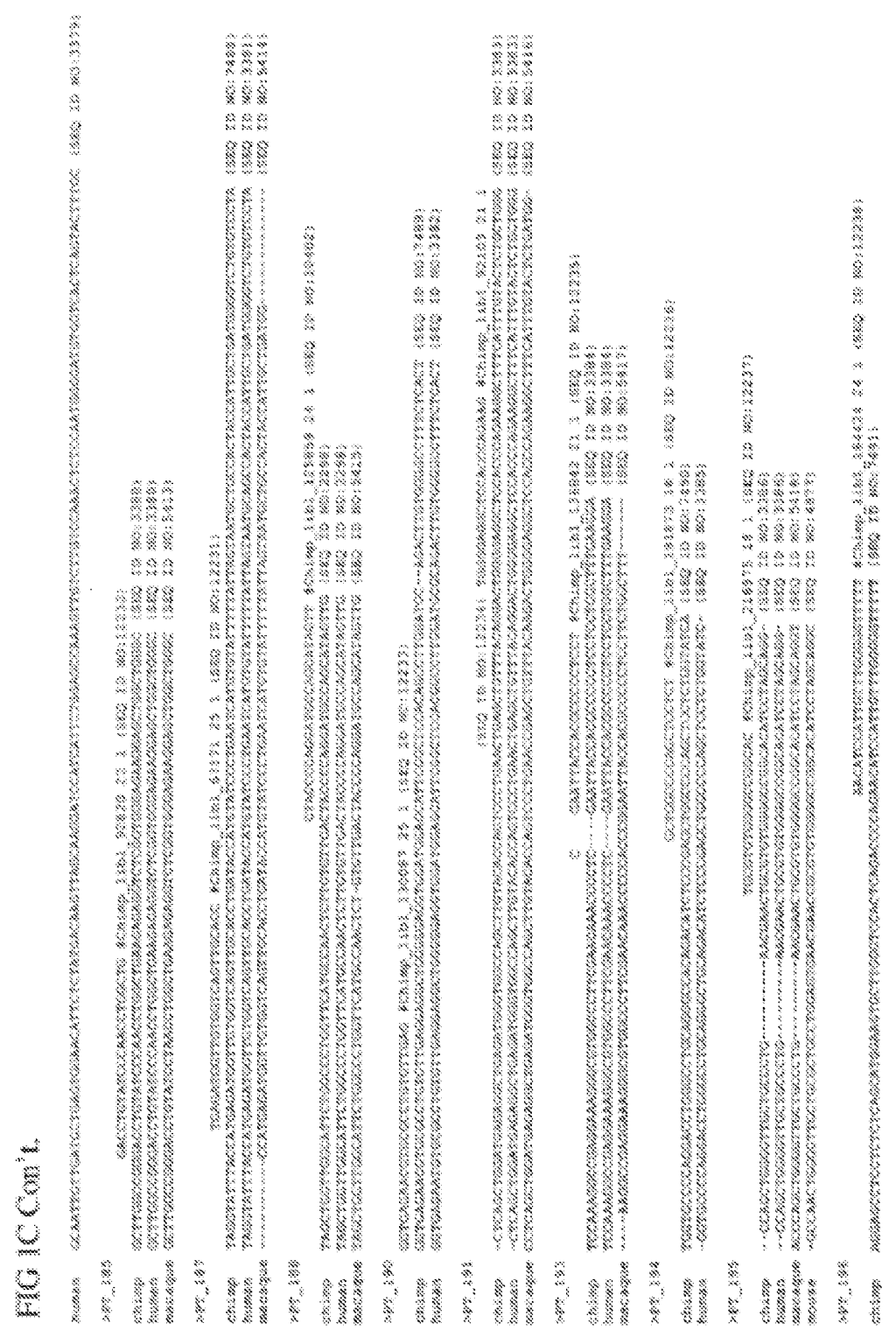
Figure 1C:
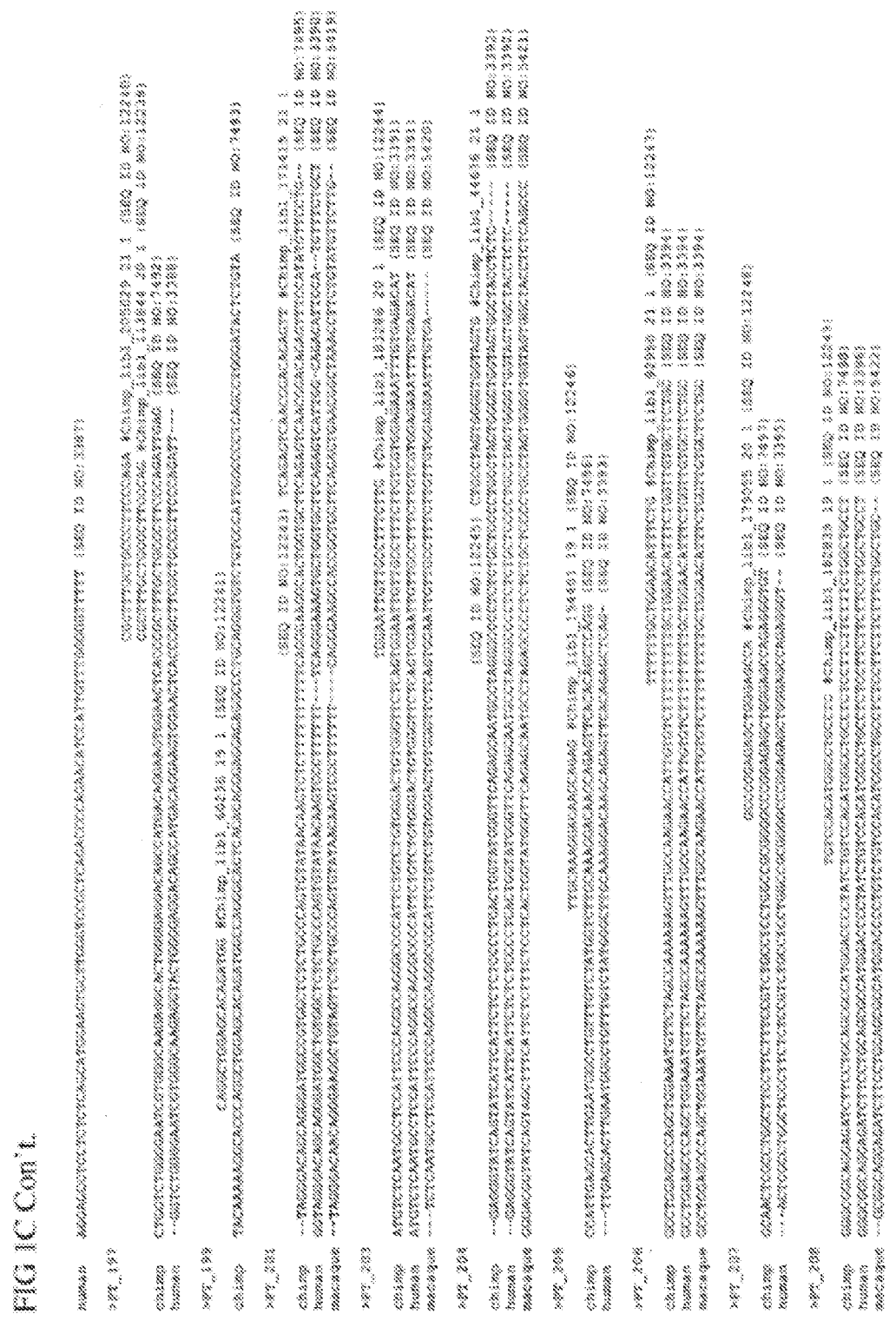
Figure 1C:
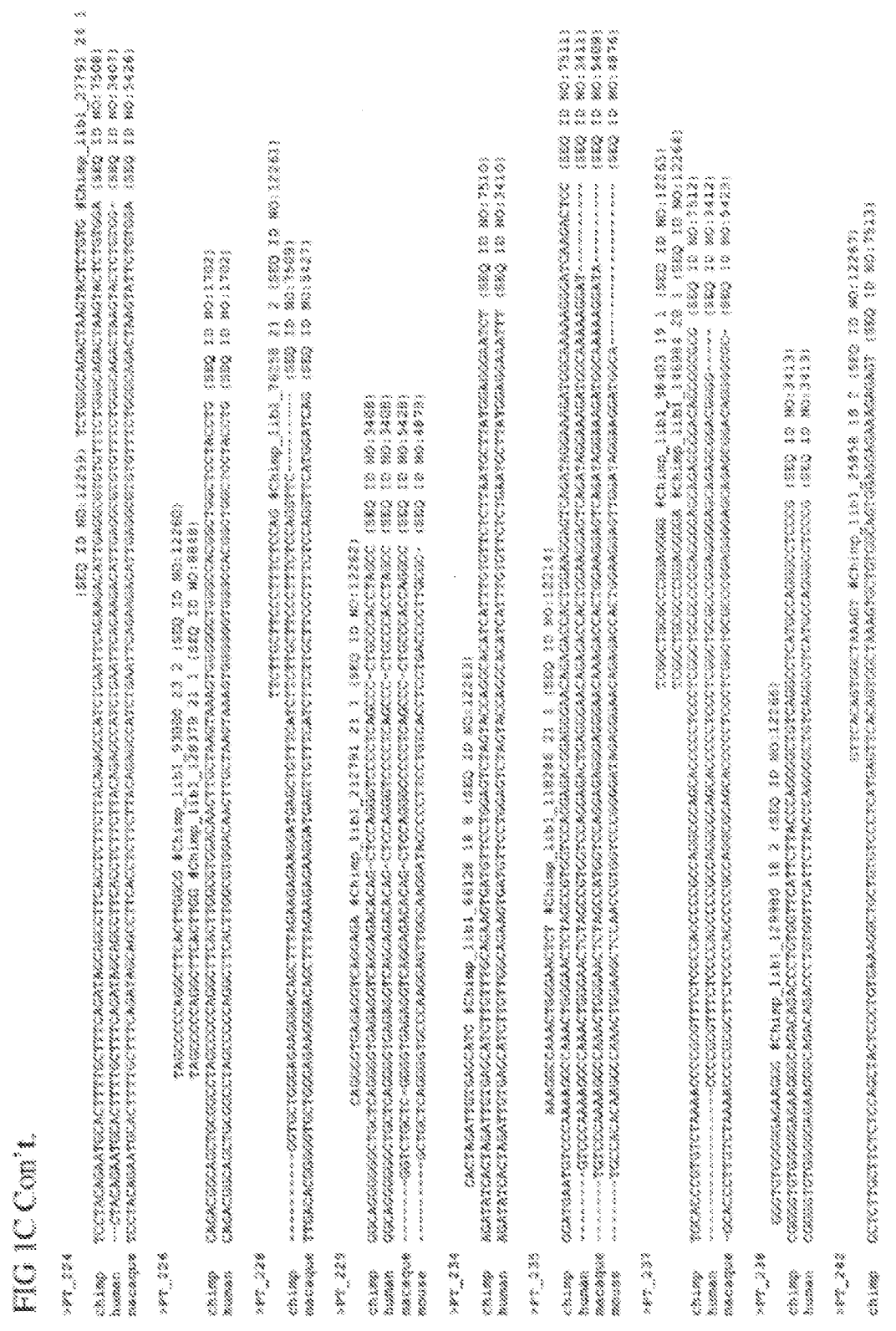
Figure 1C:
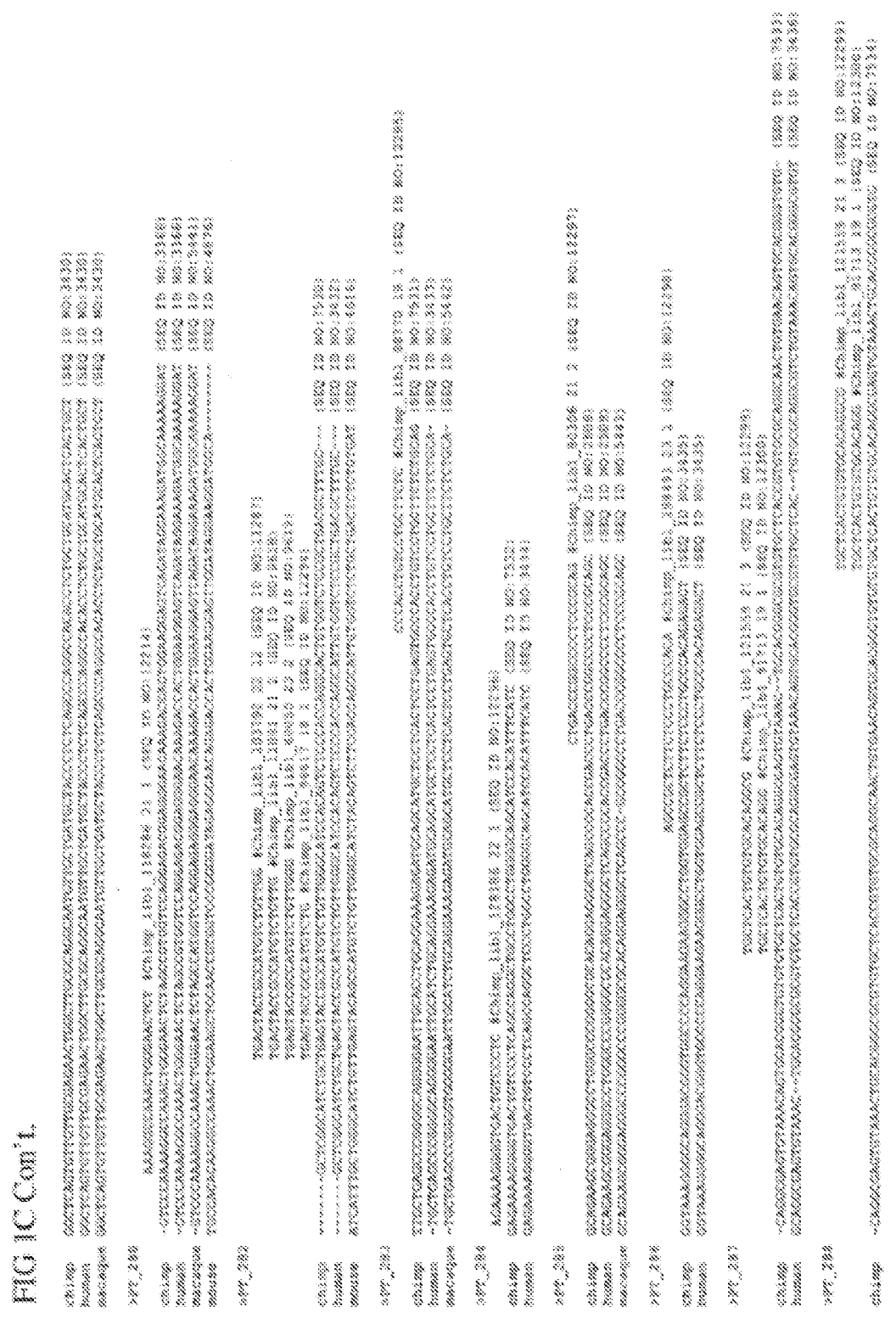
Figure 1C:
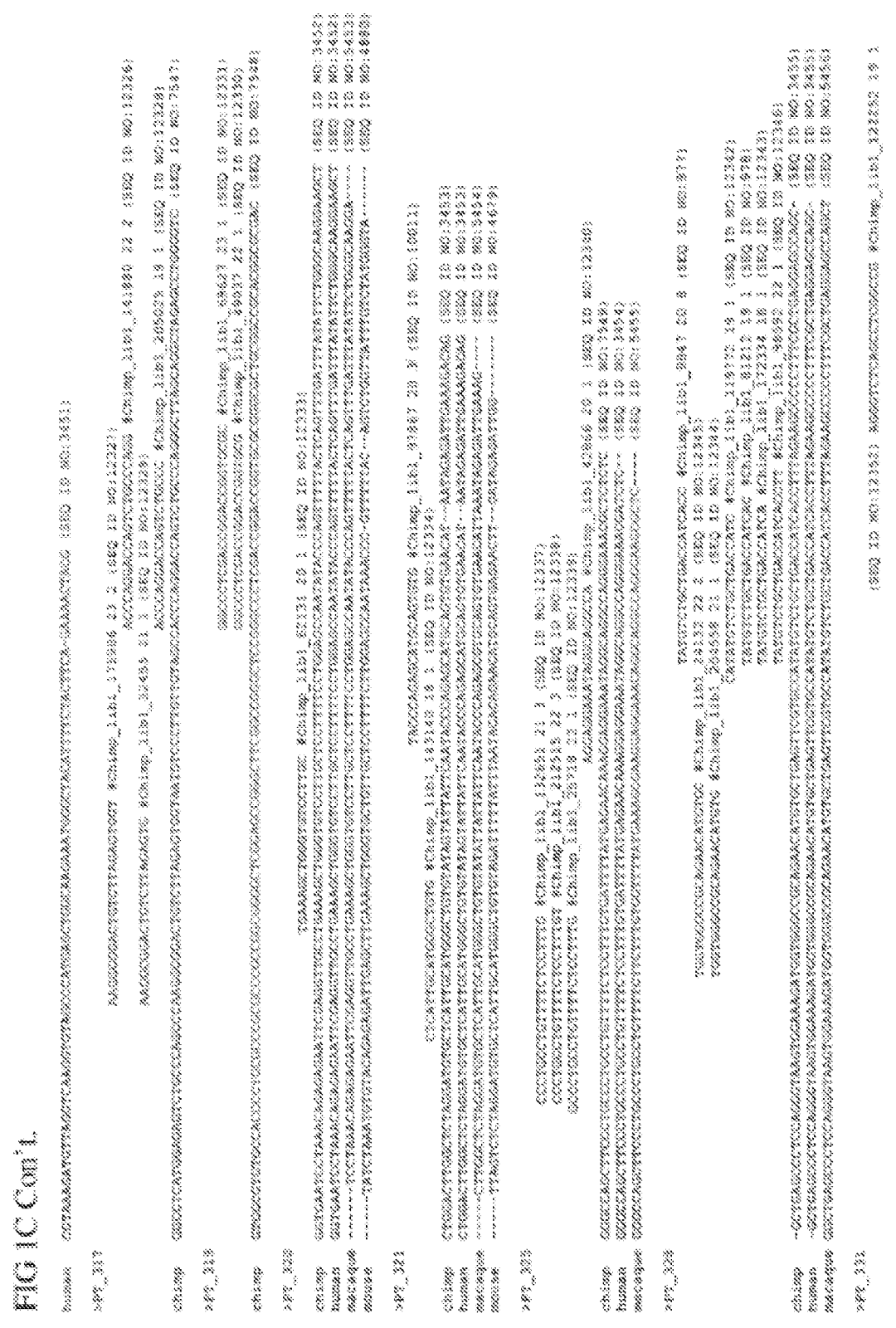
Figure 1C:
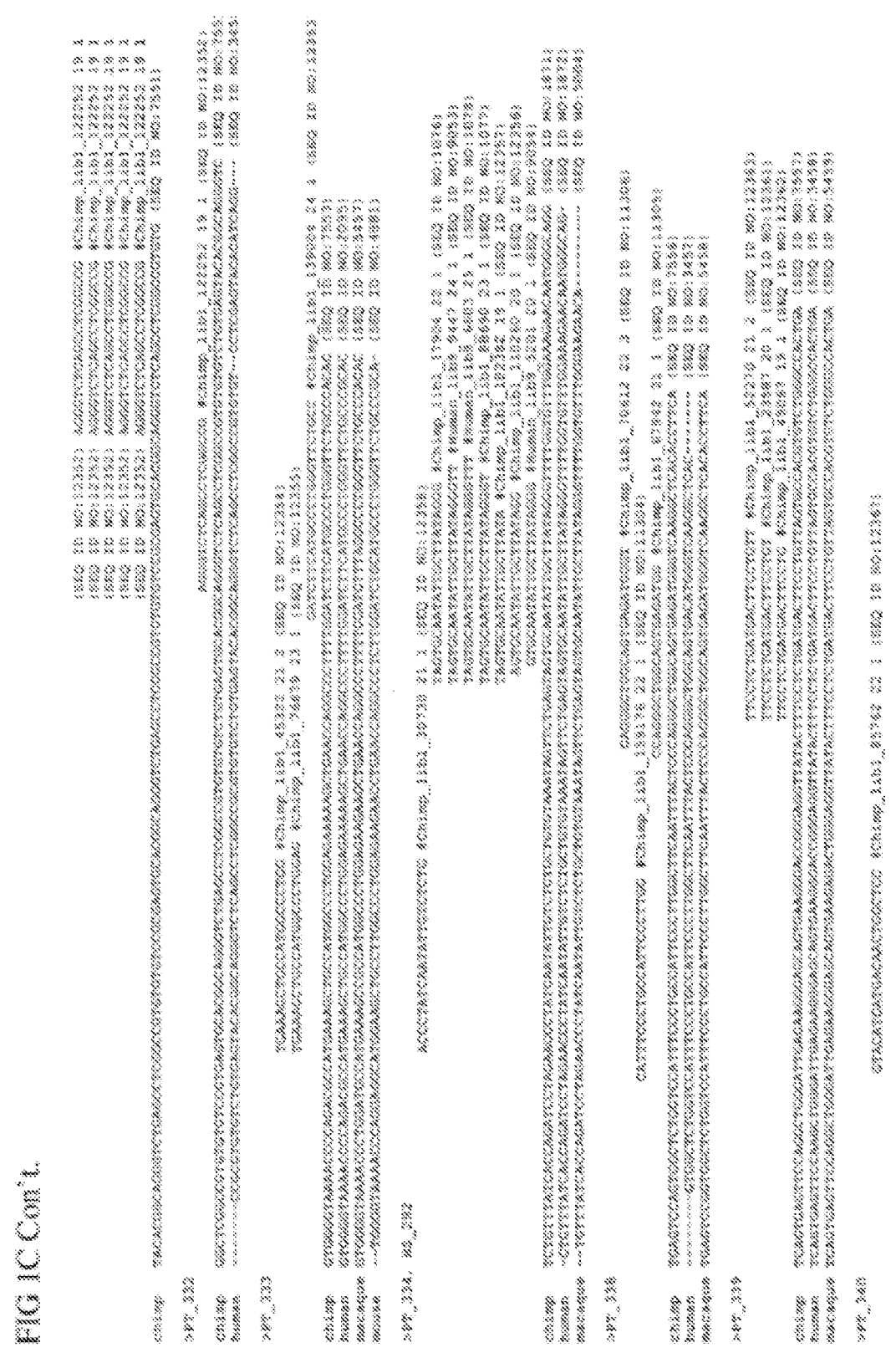
Figure 1C:
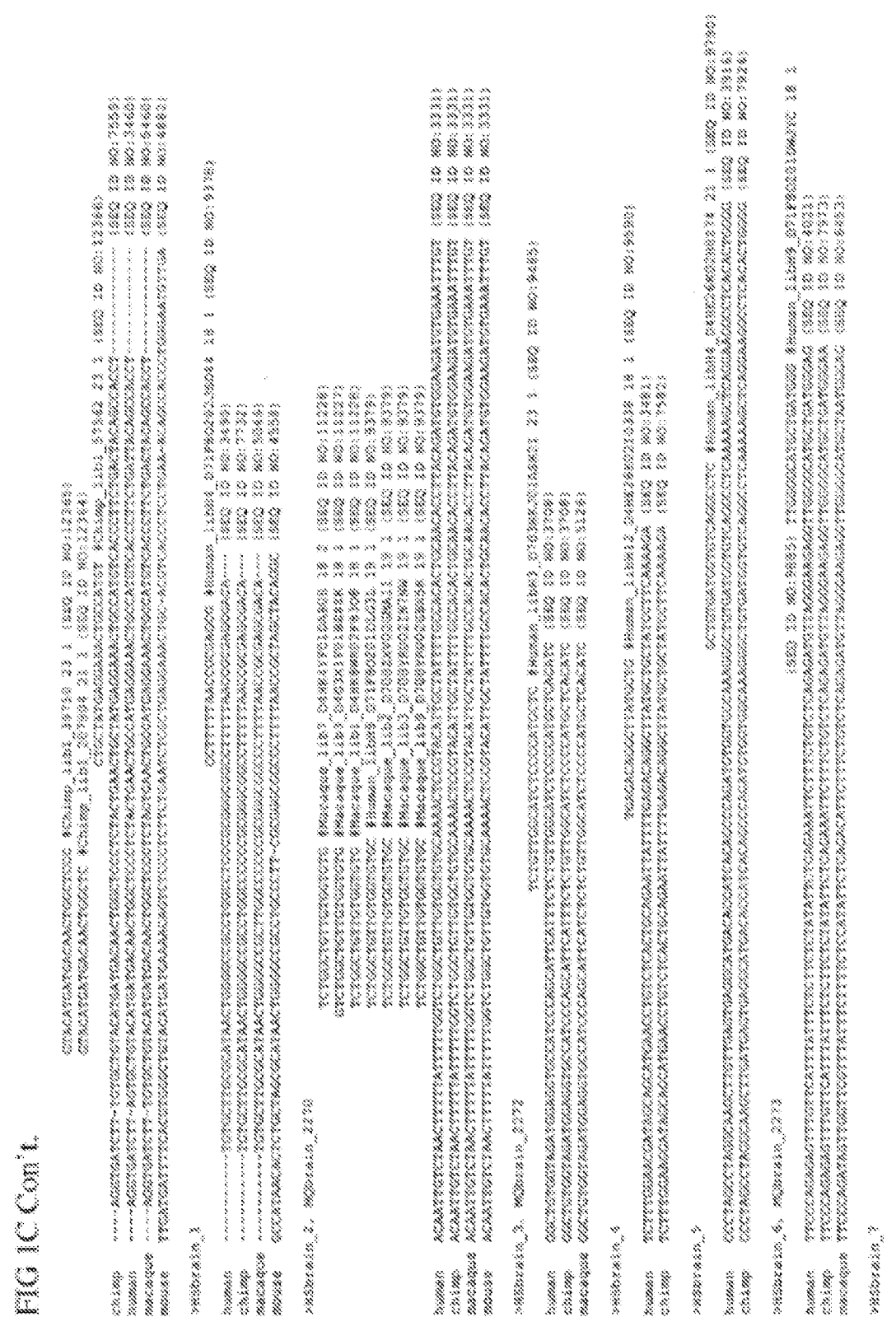
Figure 1C:
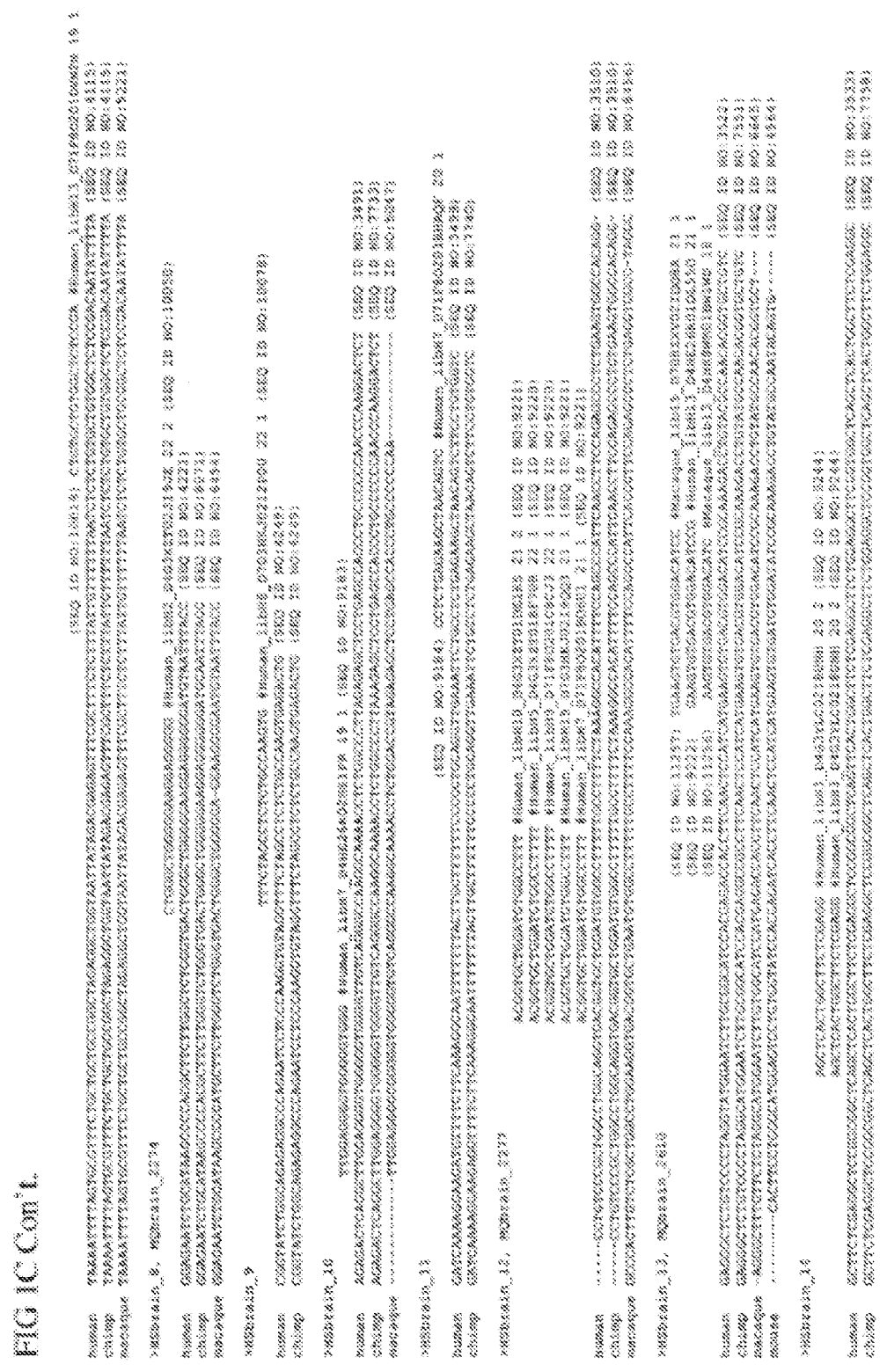
Figure 1C:
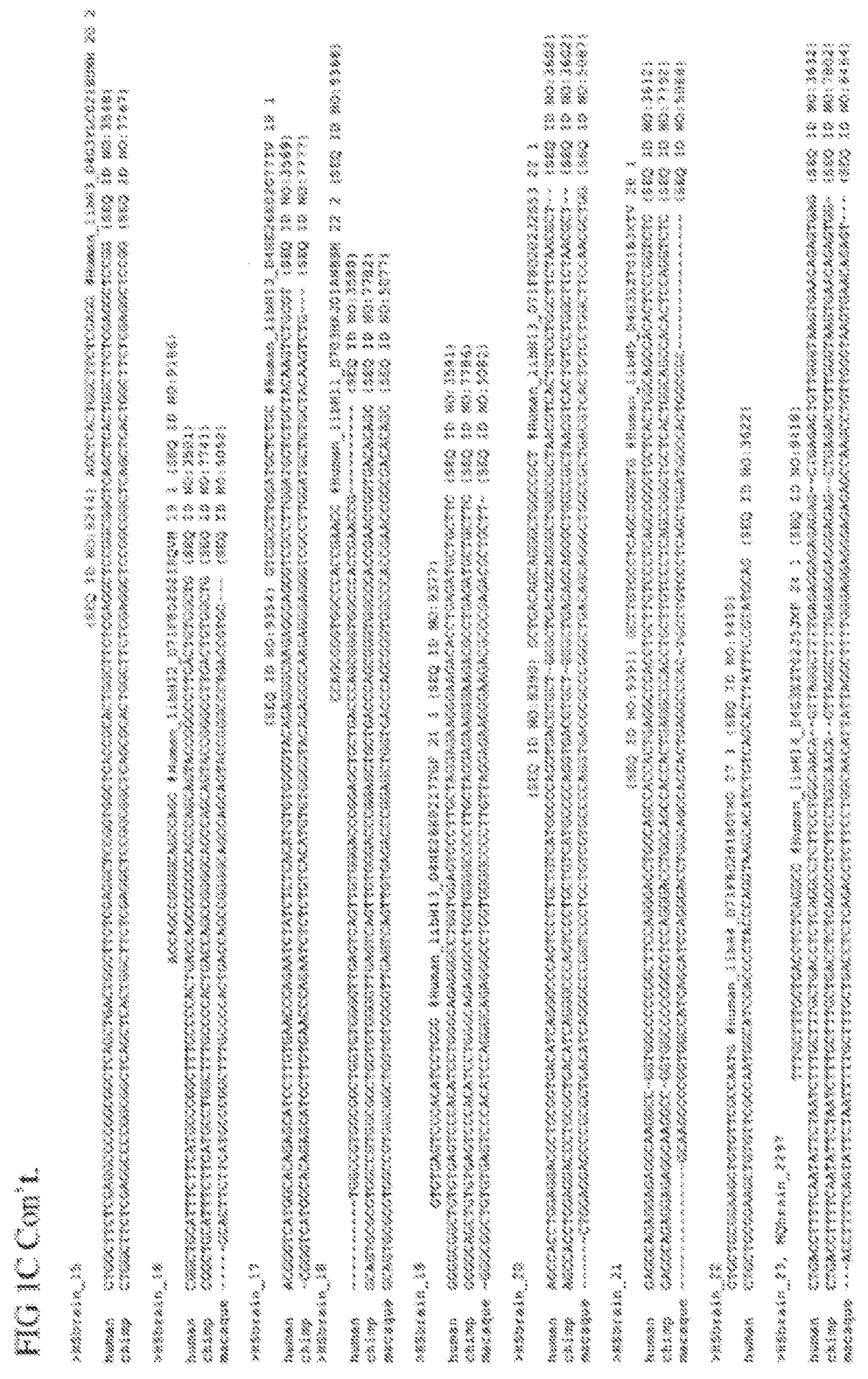
Figure 1C:
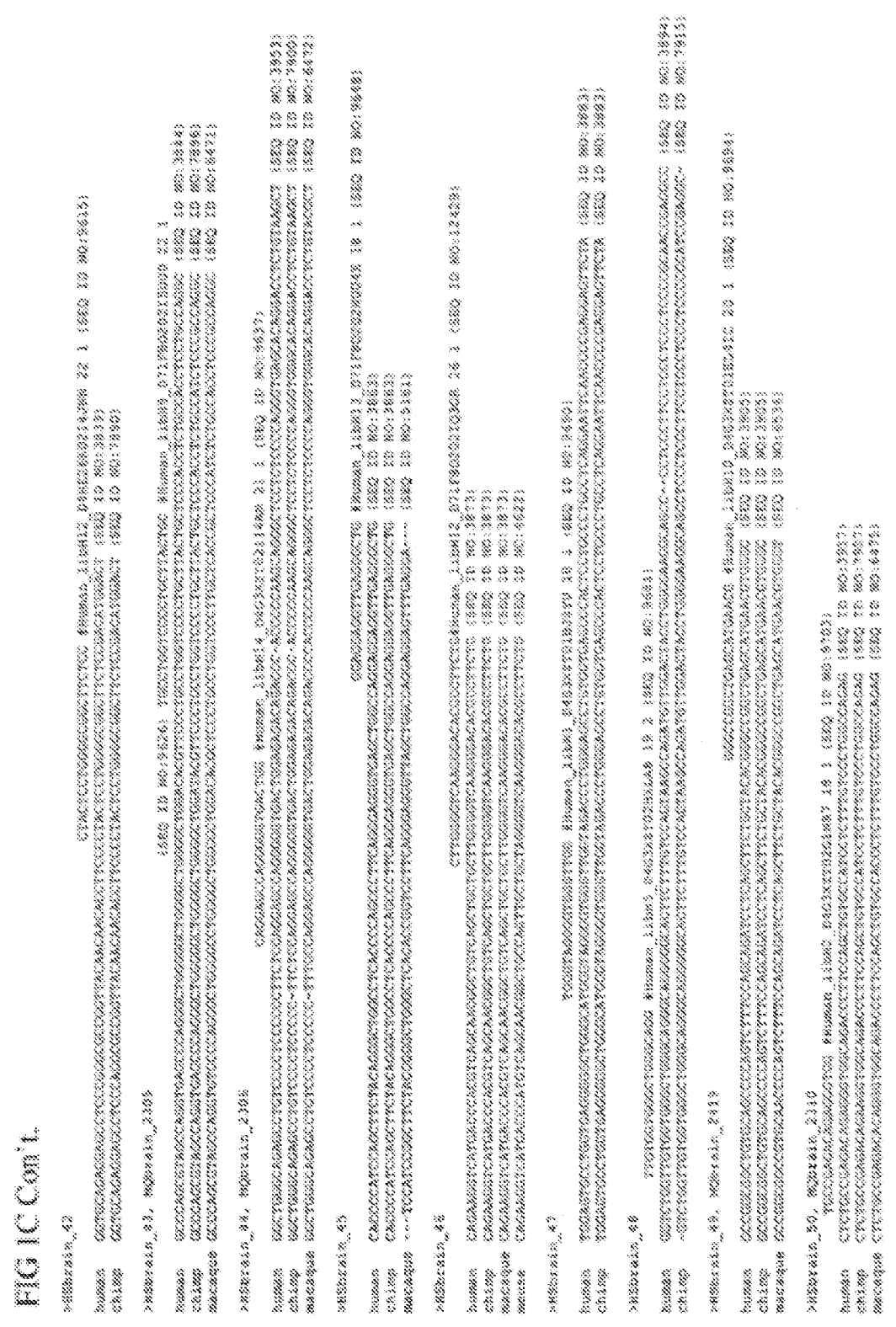
Figure 1C:
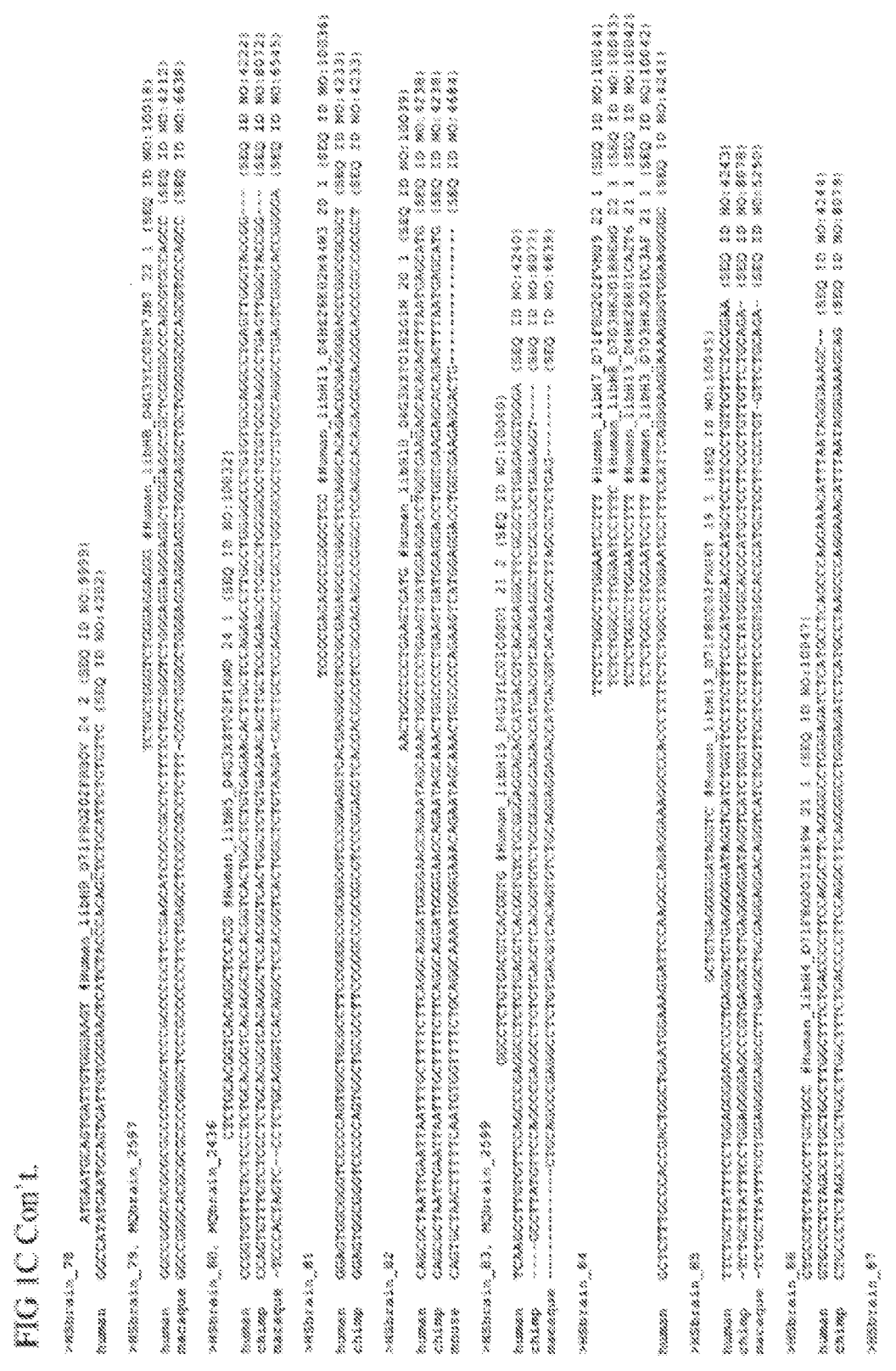
Figure 1C:
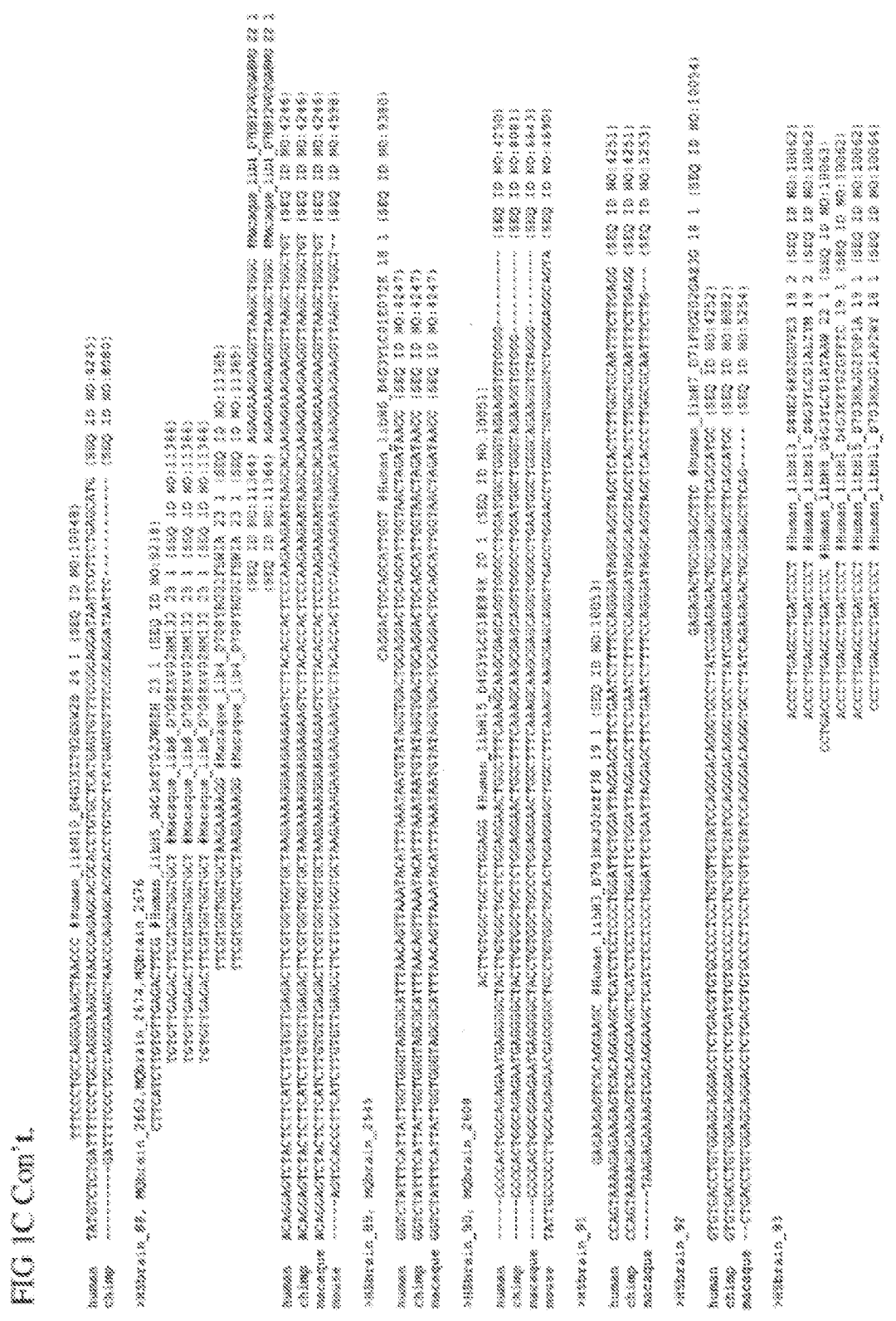
Figure 1C:
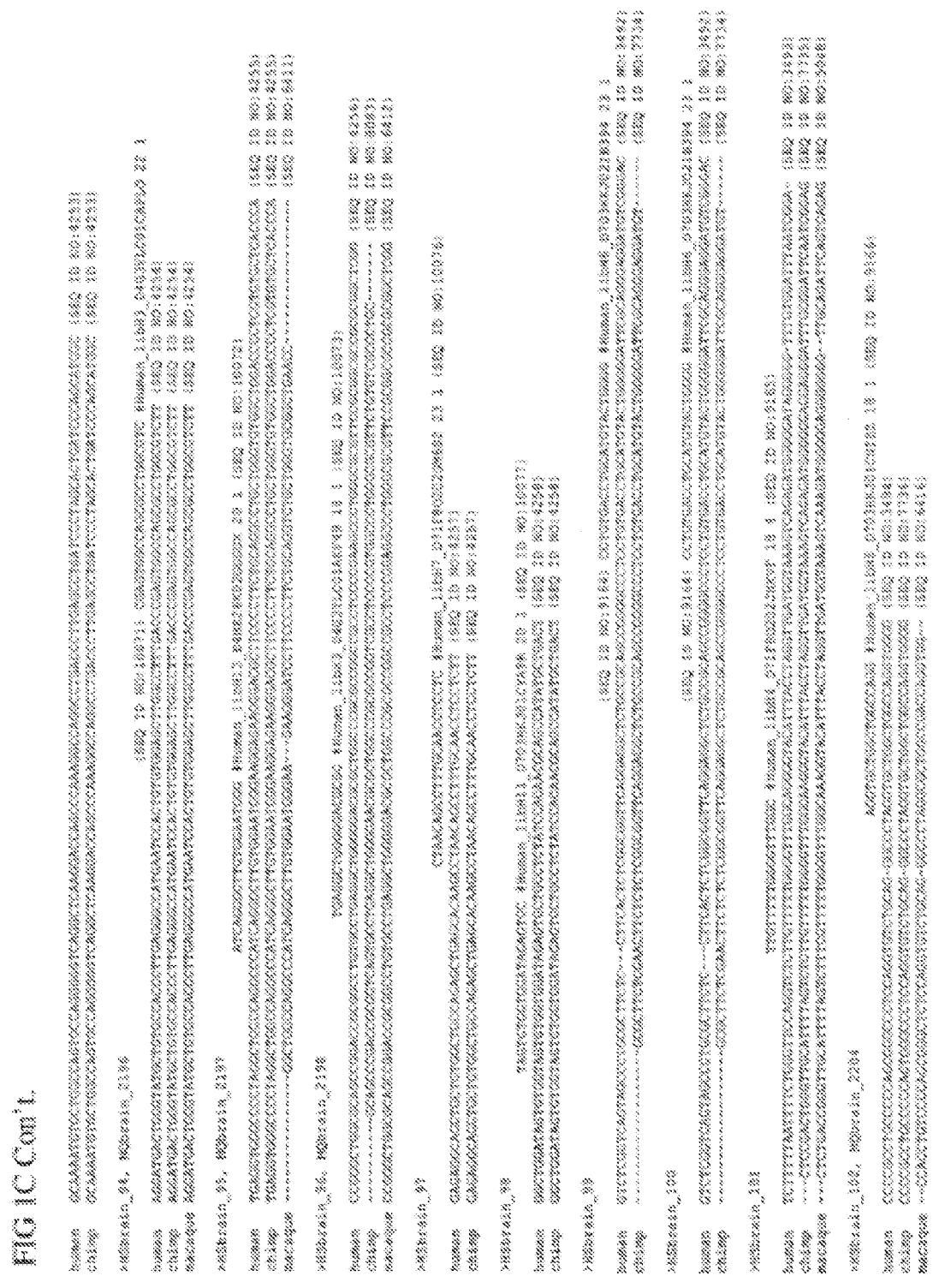
Figure 1C:
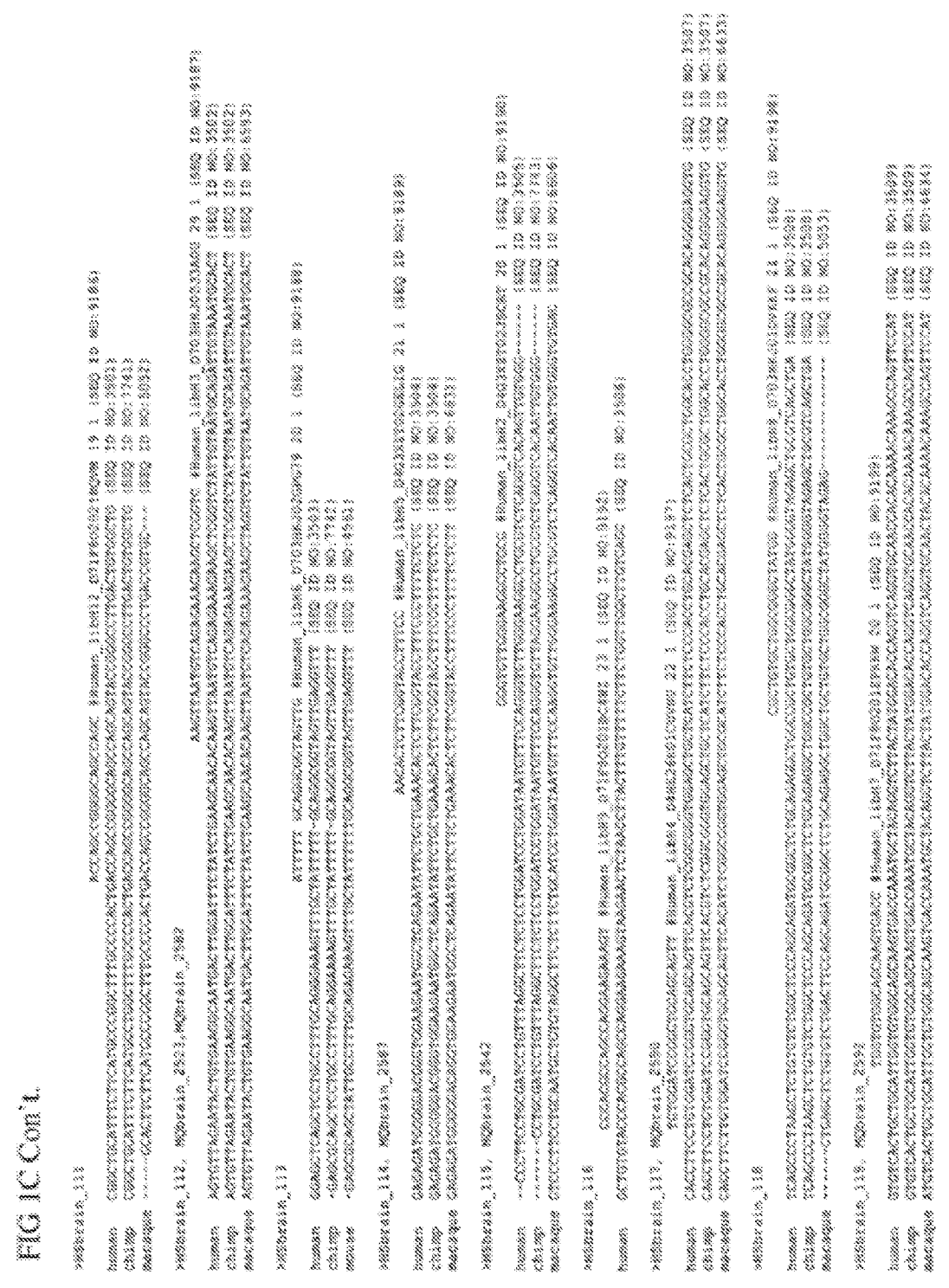
Figure 1C:
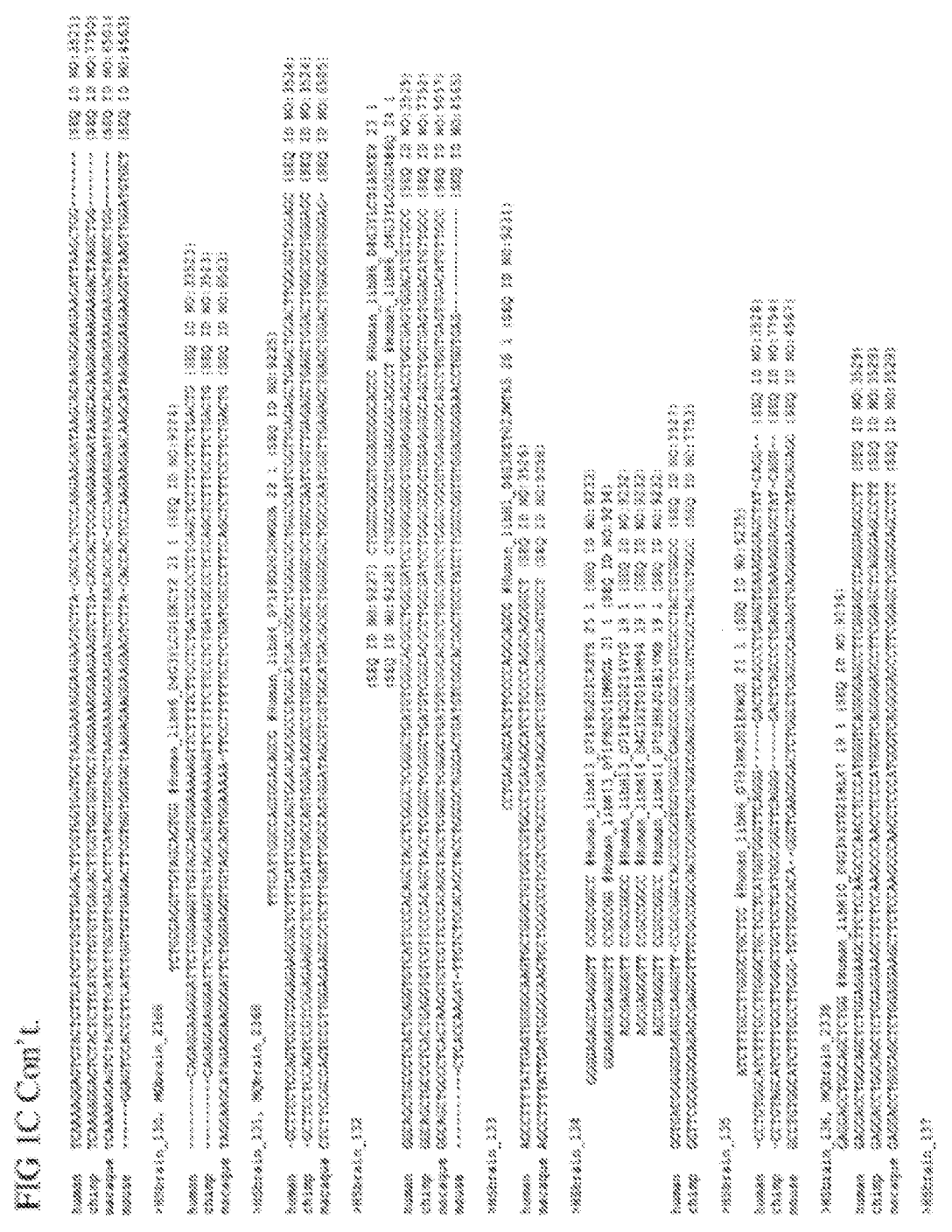
Figure 1C:
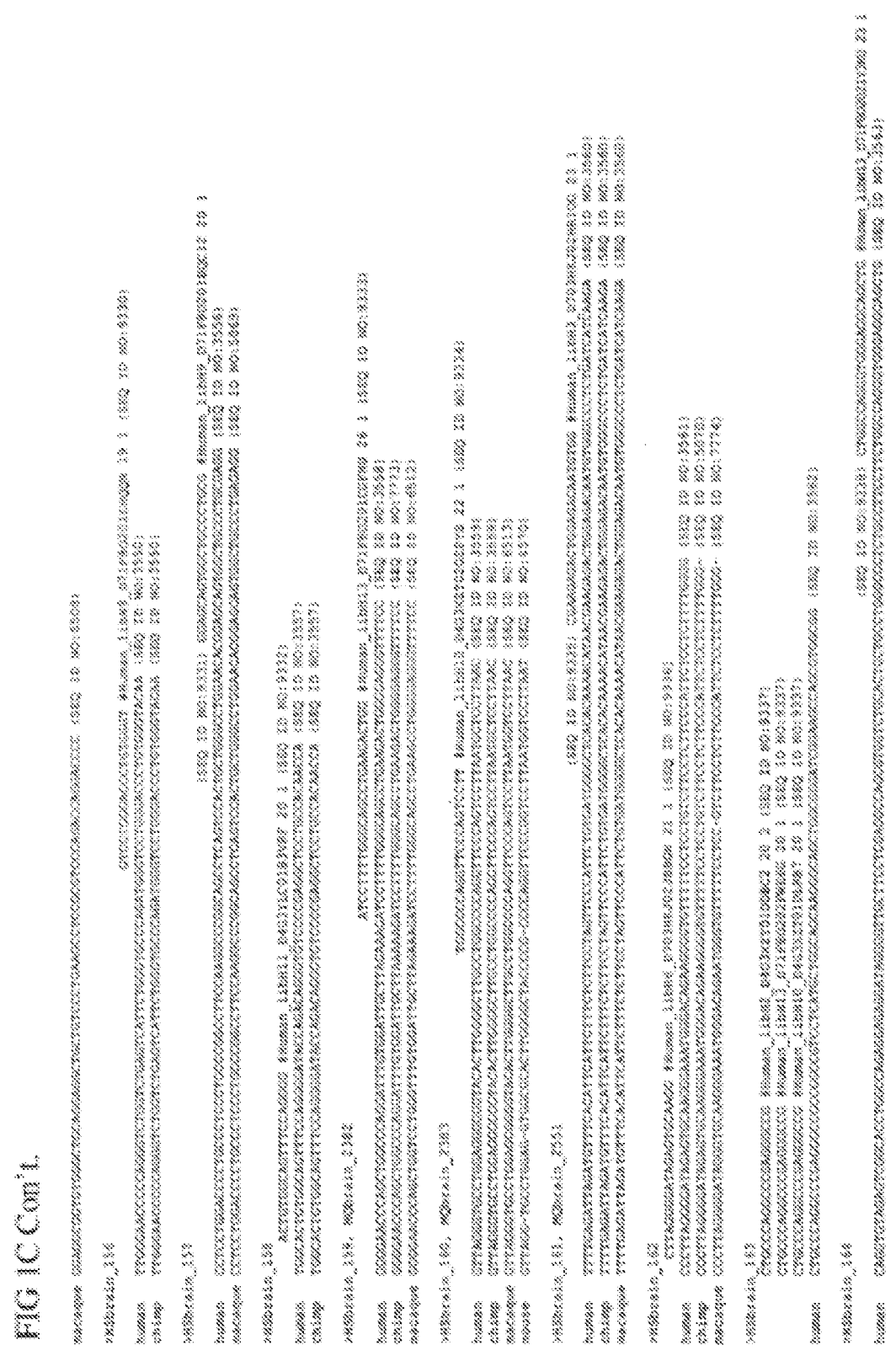
Figure 1C:
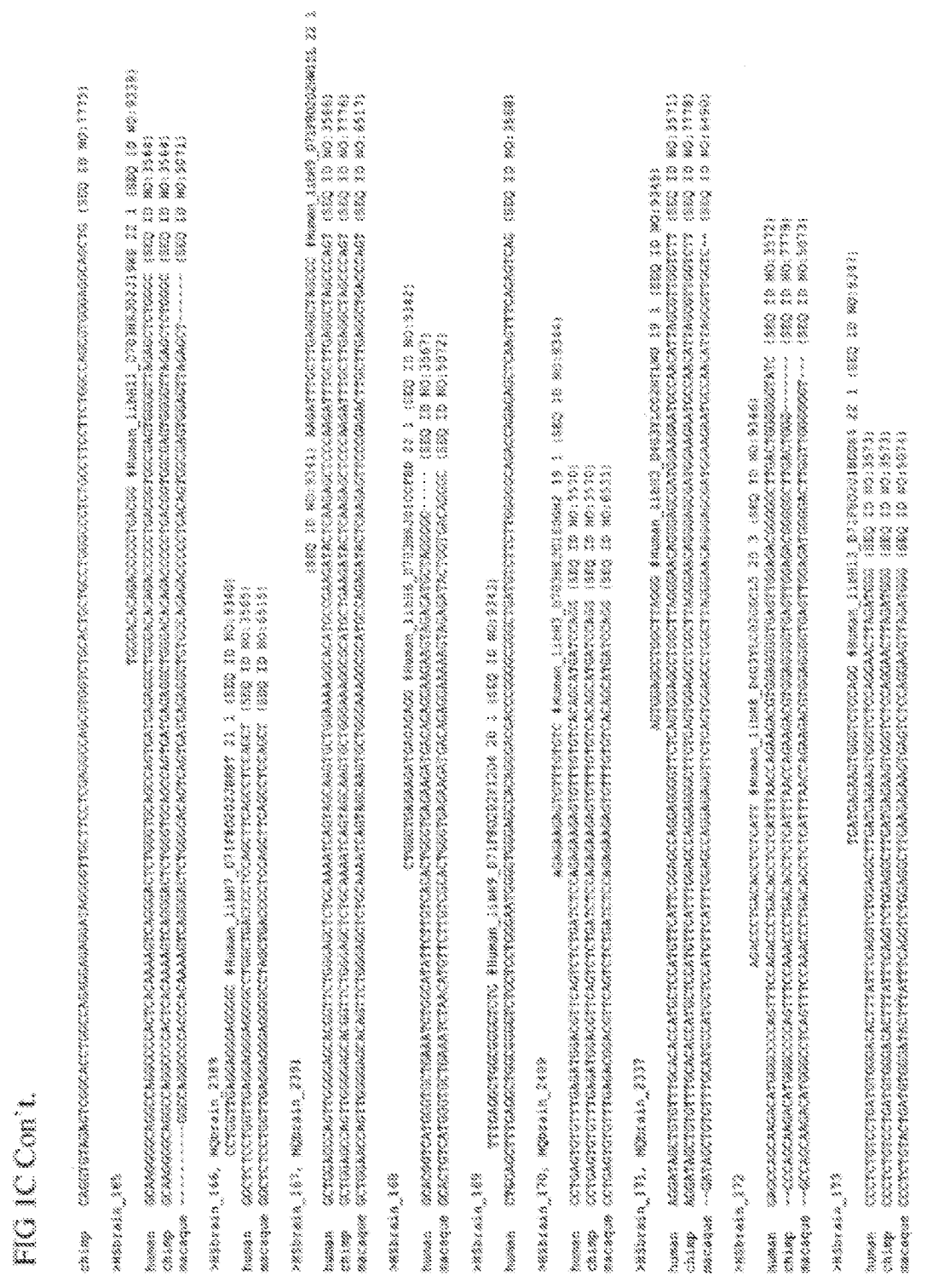
Figure 1C:
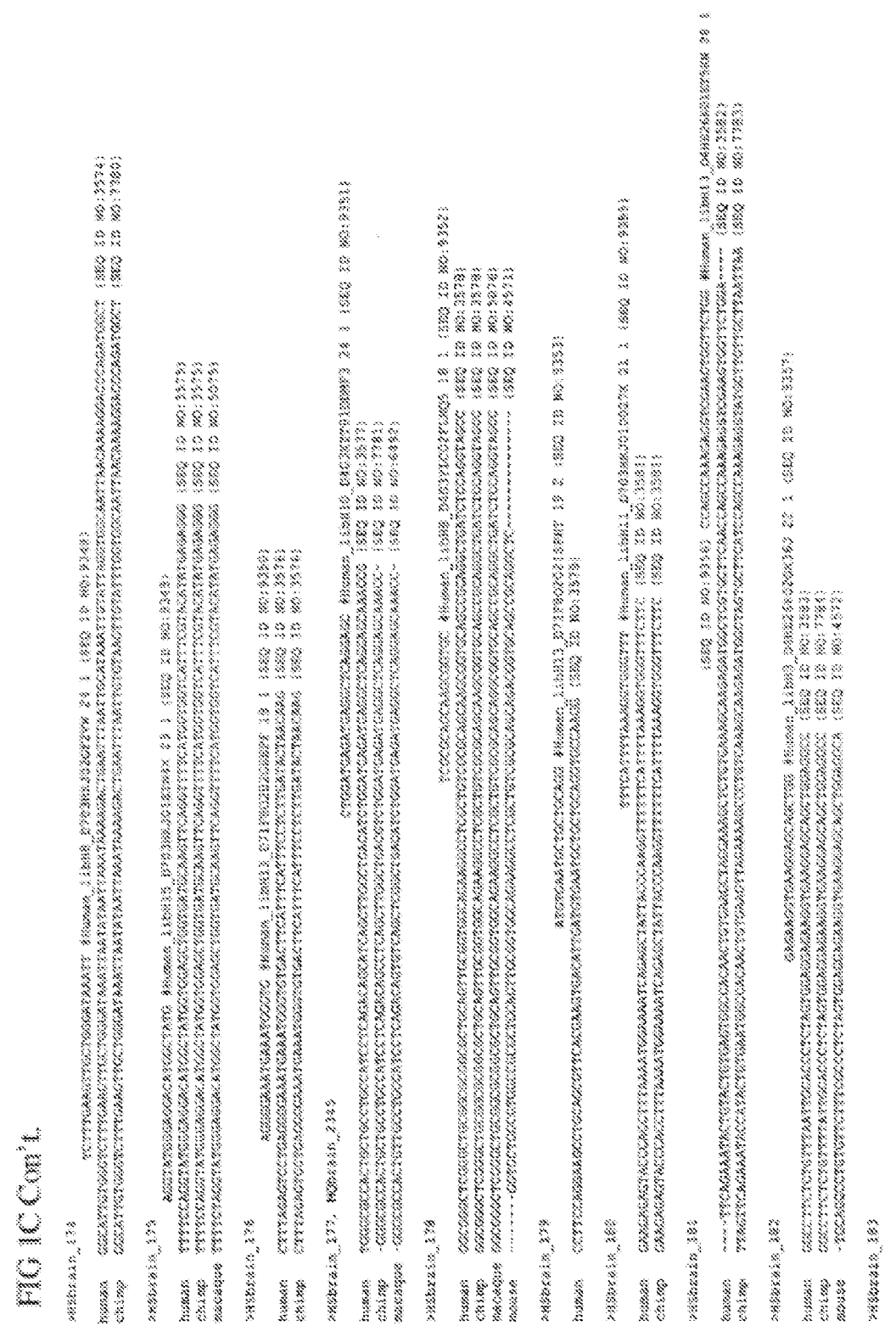
Figure 1C:
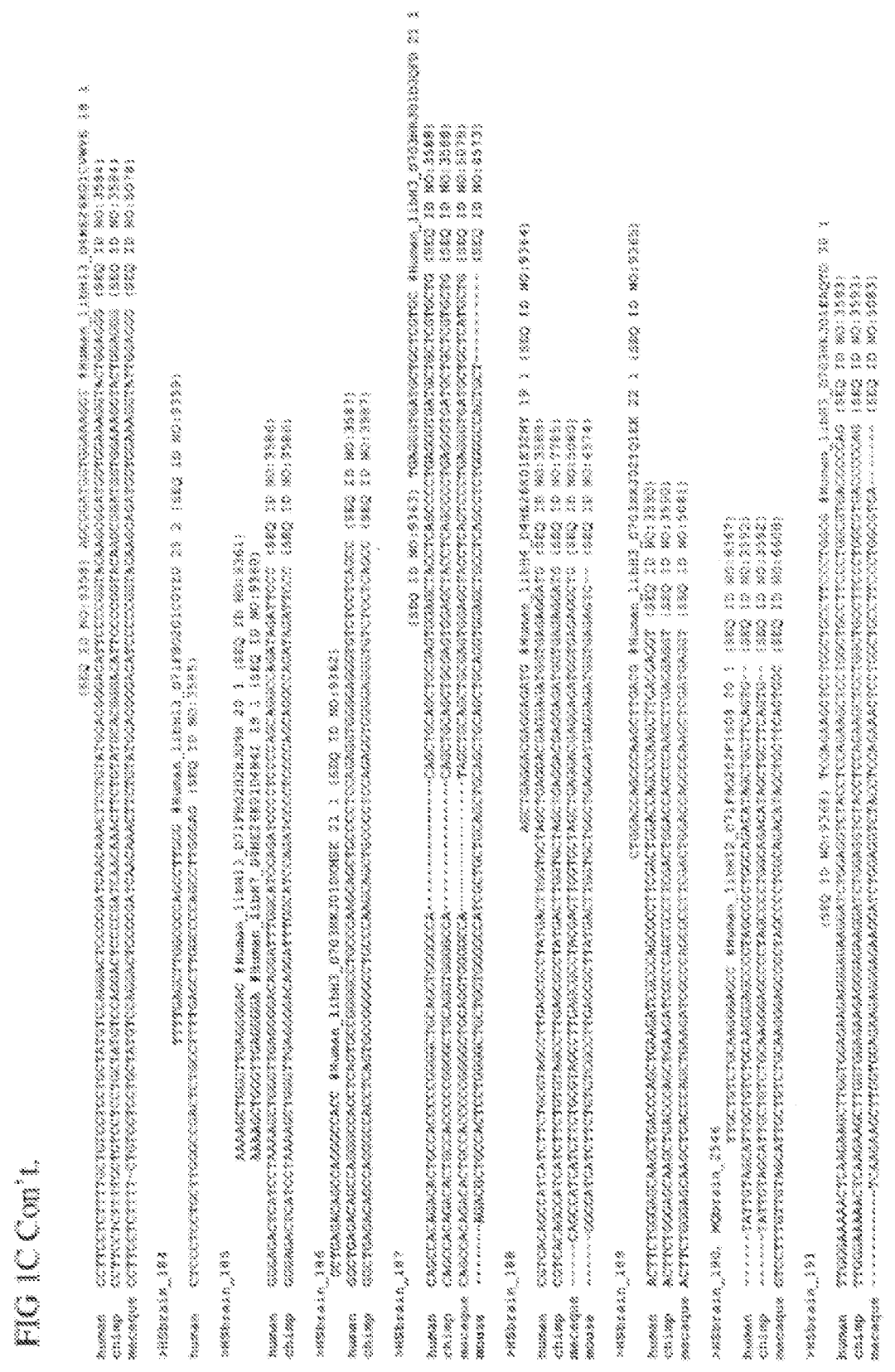
Figure 1C:
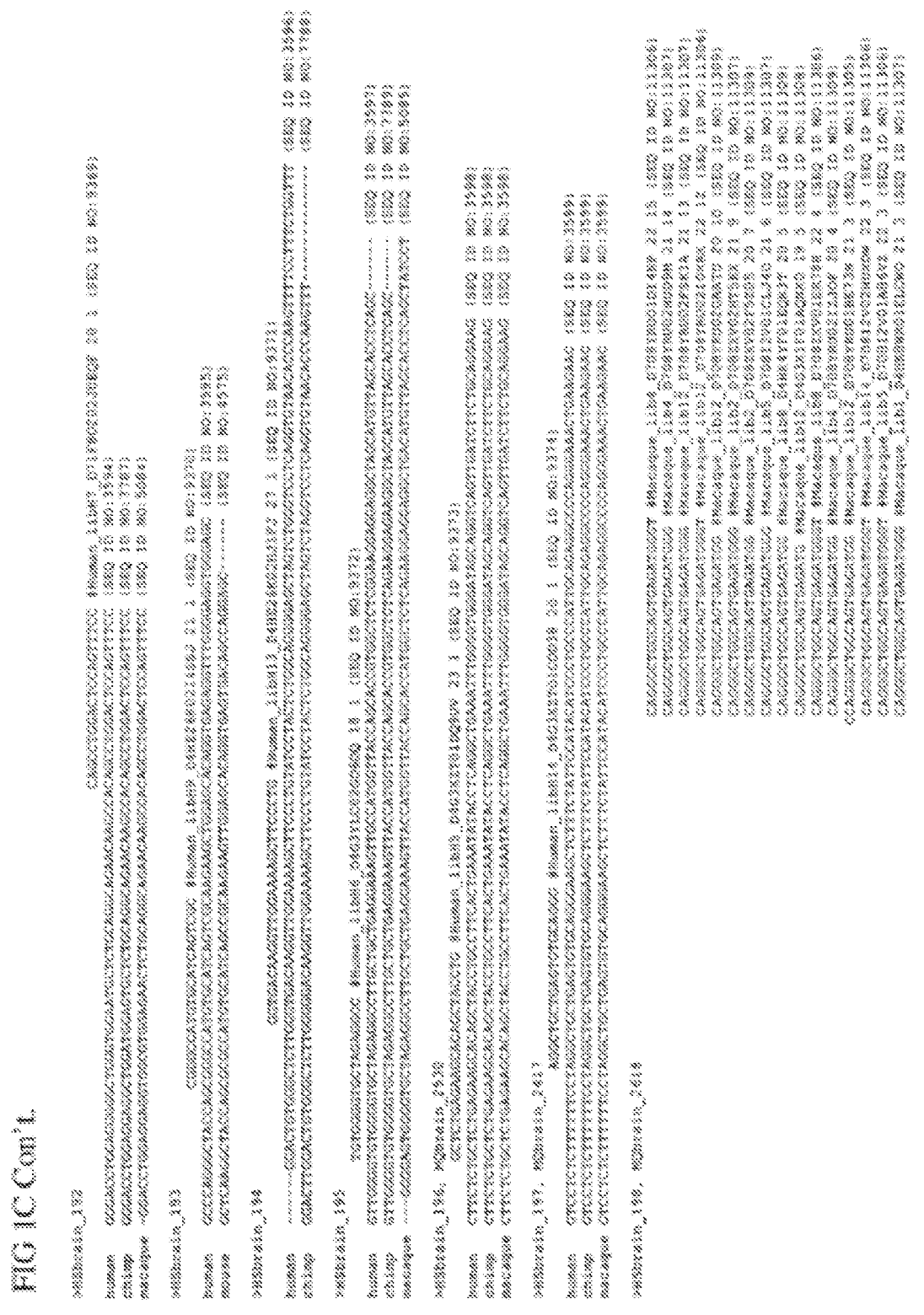
Figure 1C:
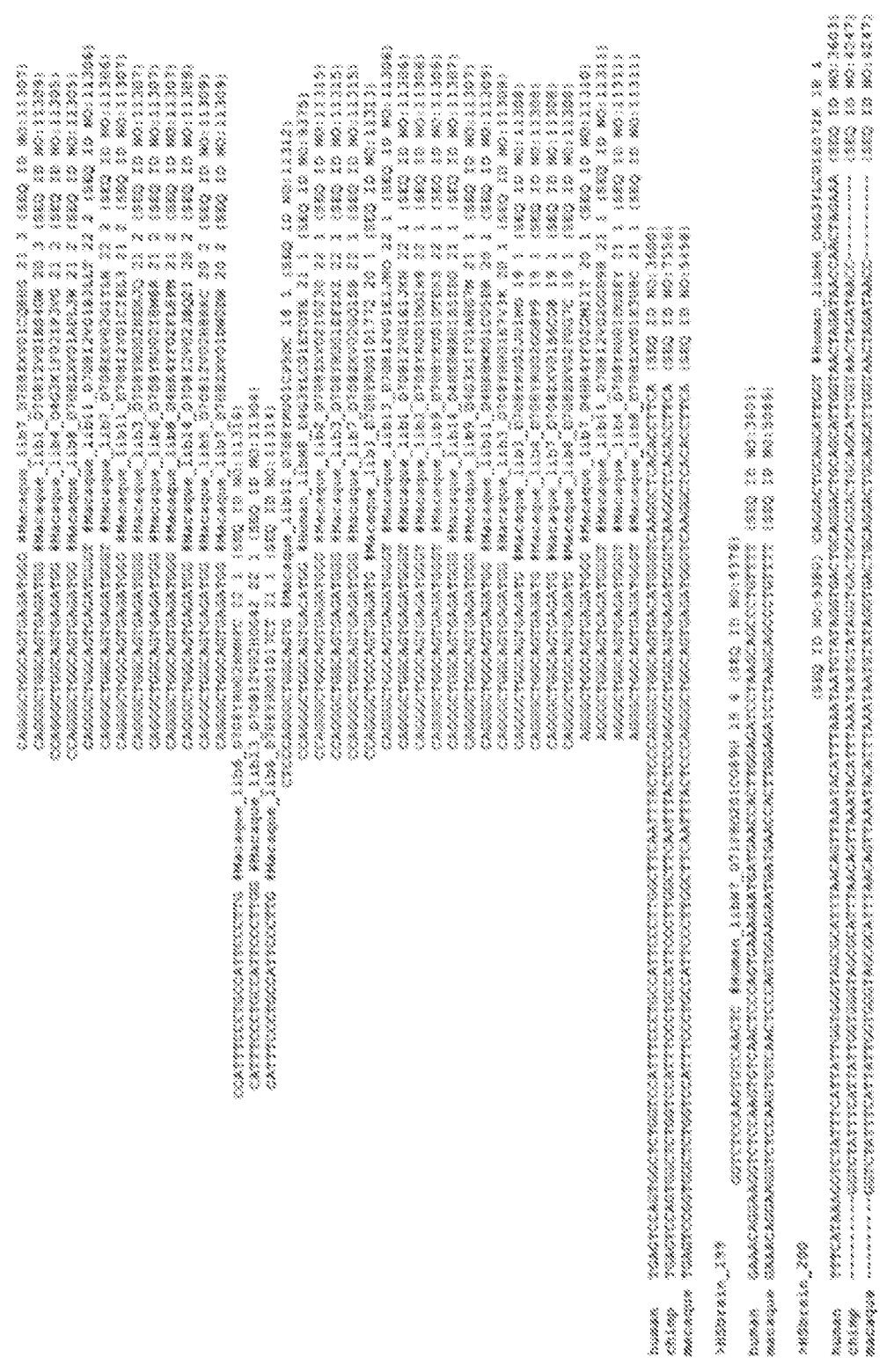
Figure 1C:
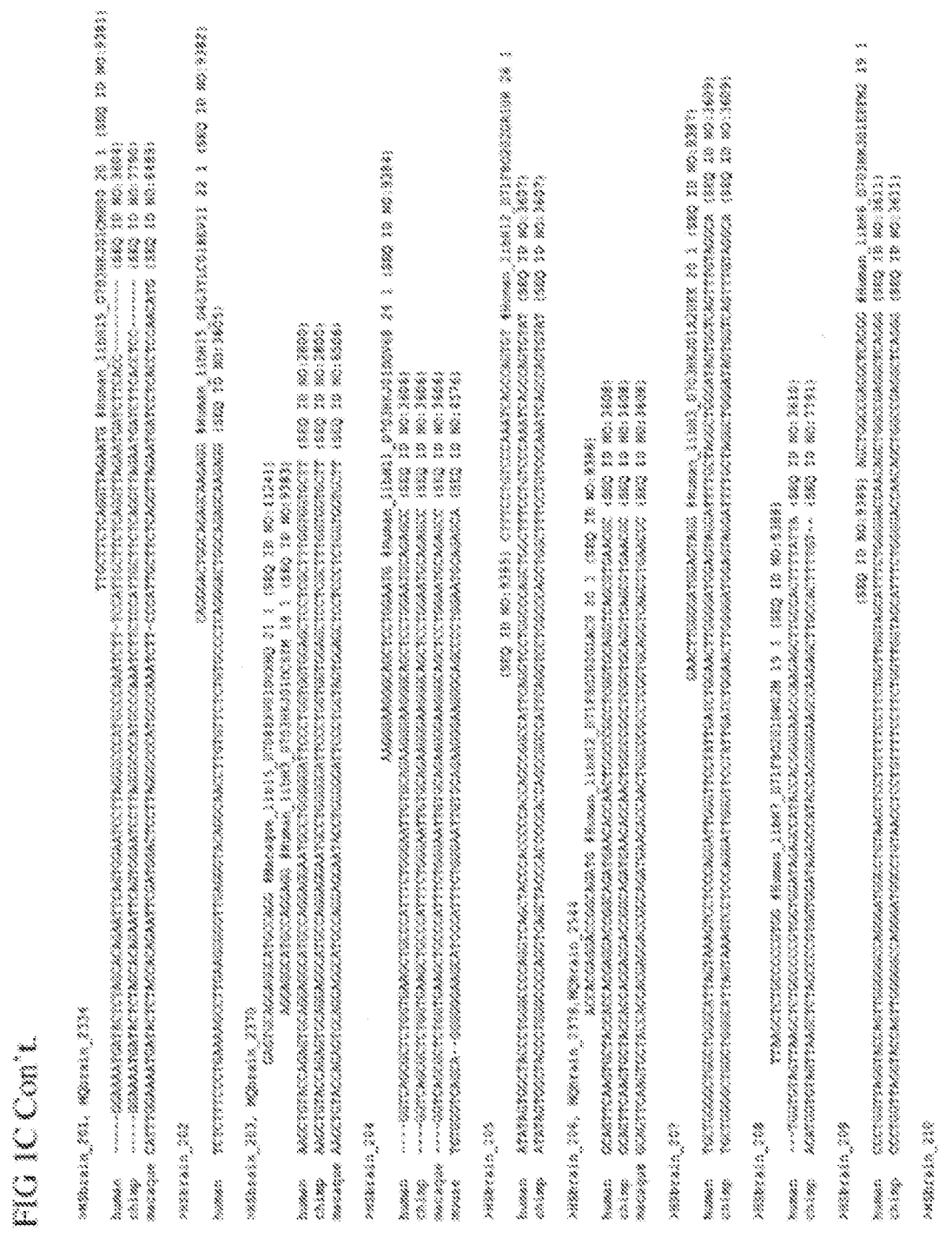
Figure 1C:
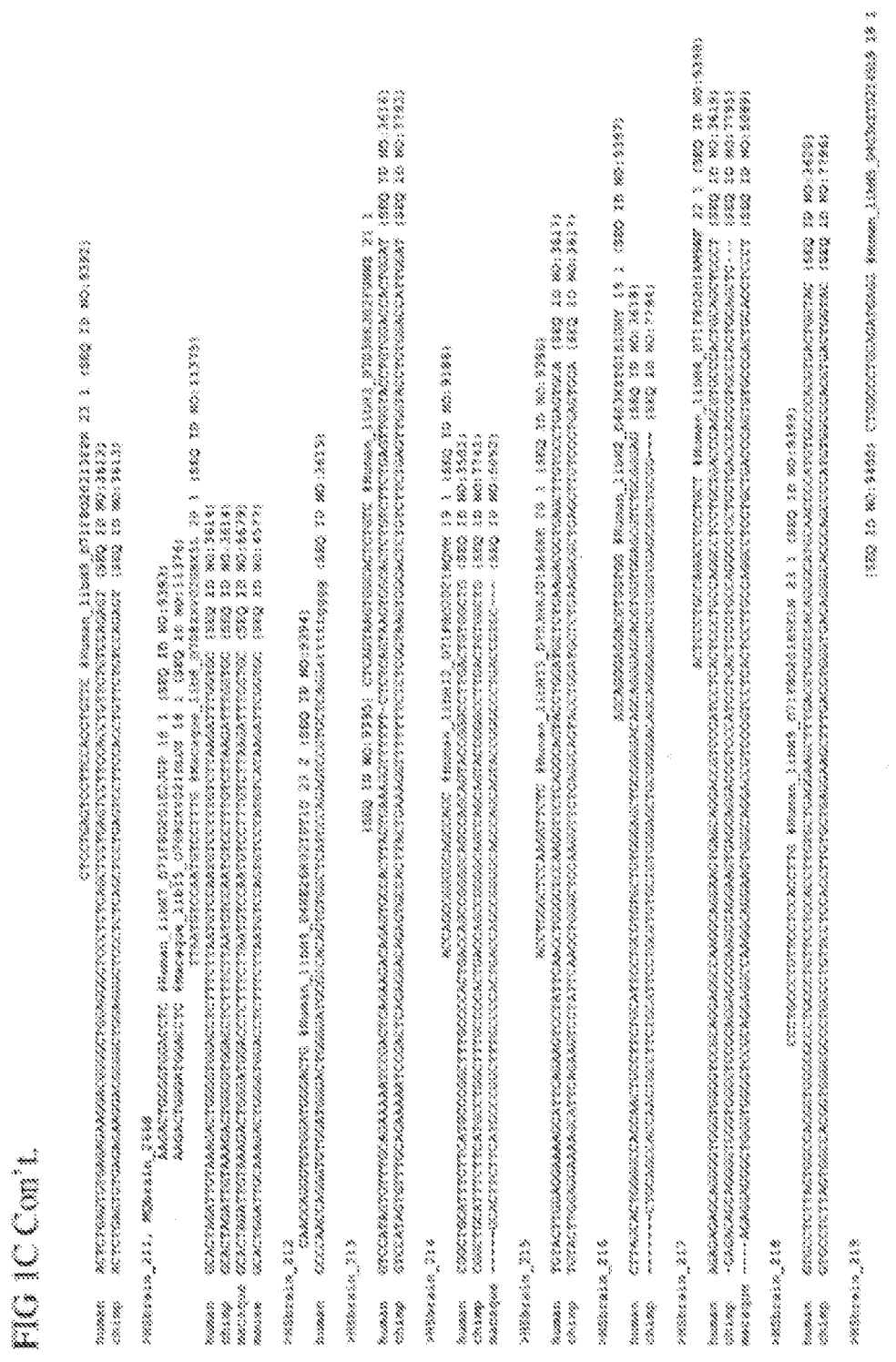
Figure 1C:
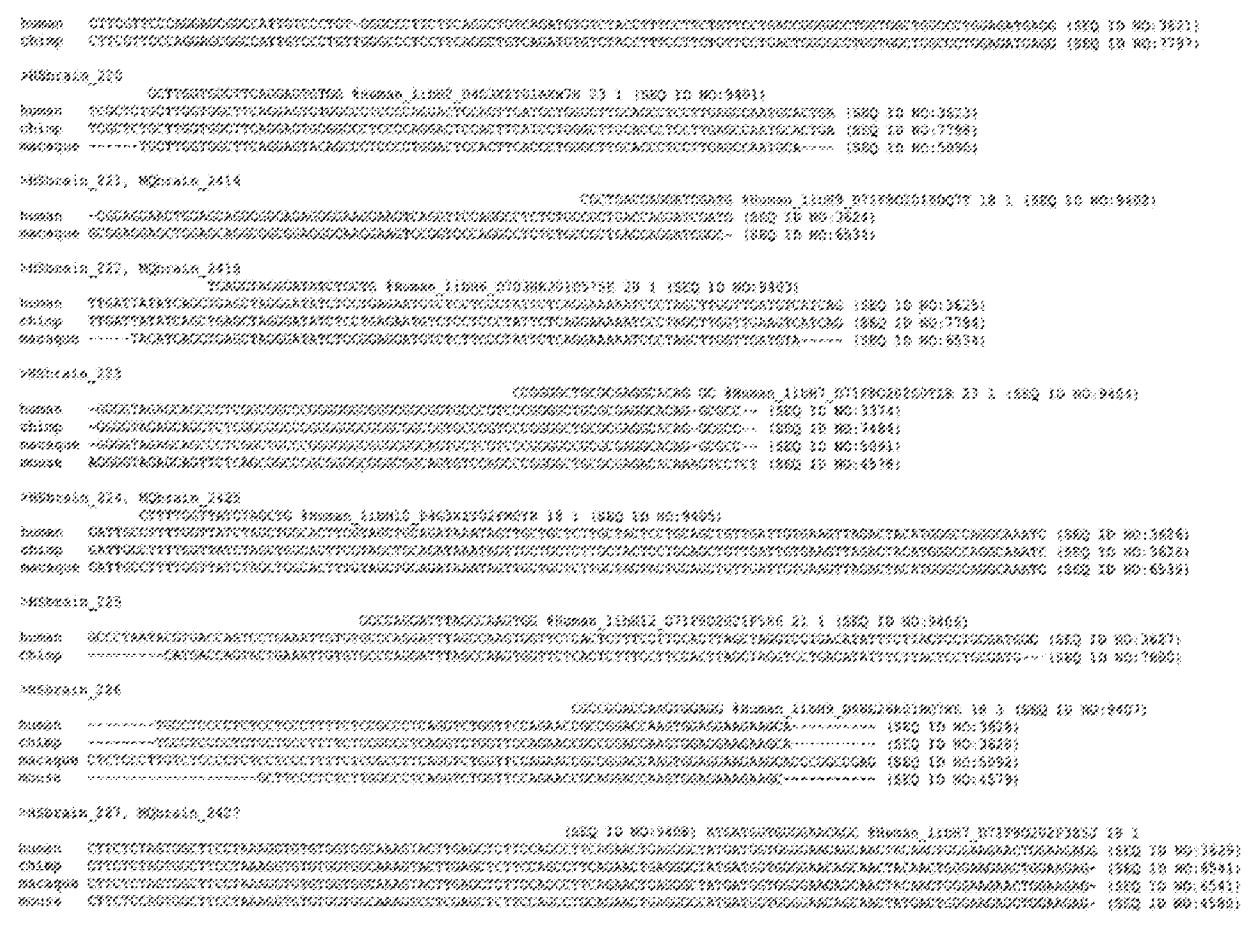
Figure 1C:
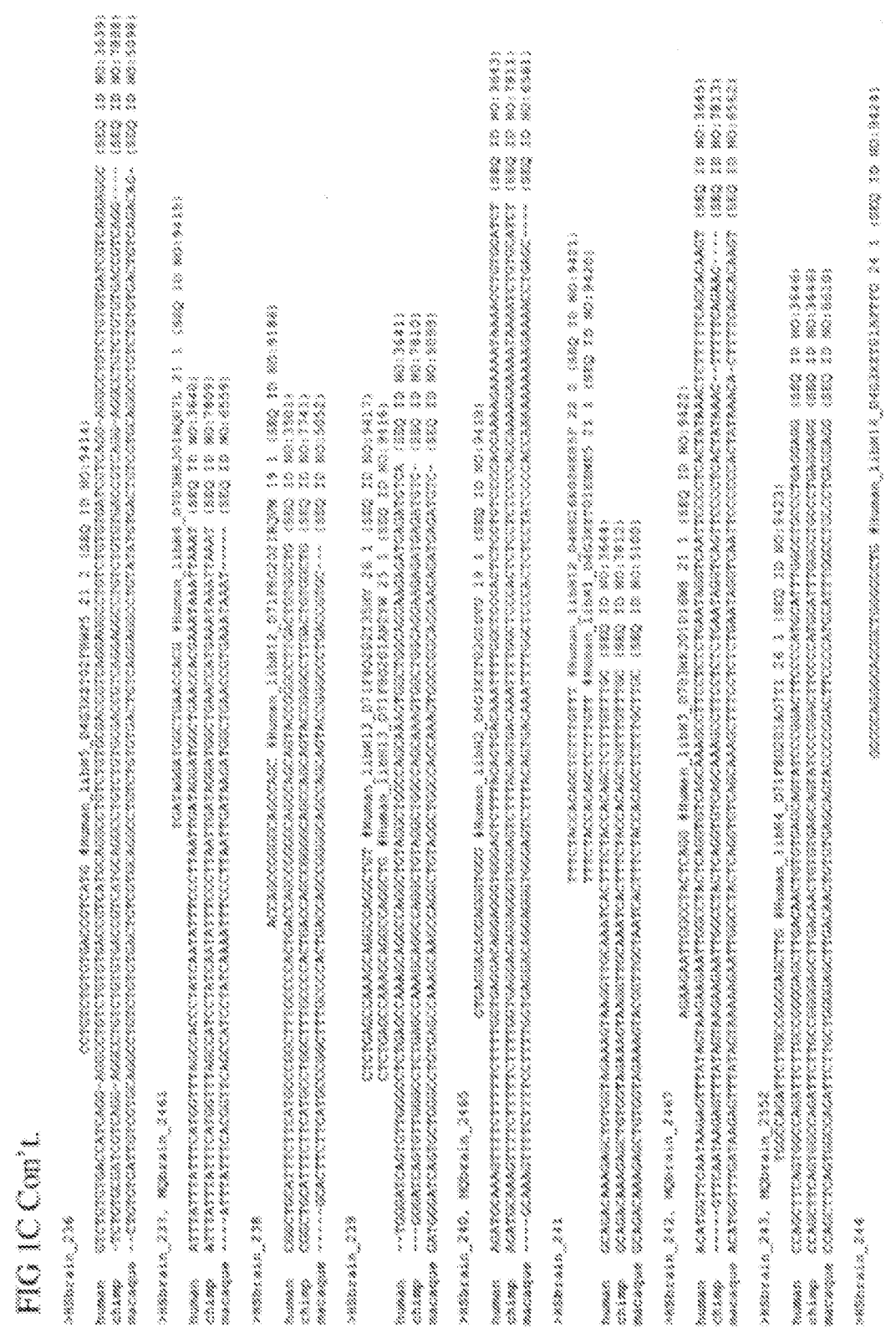
Figure 1C:
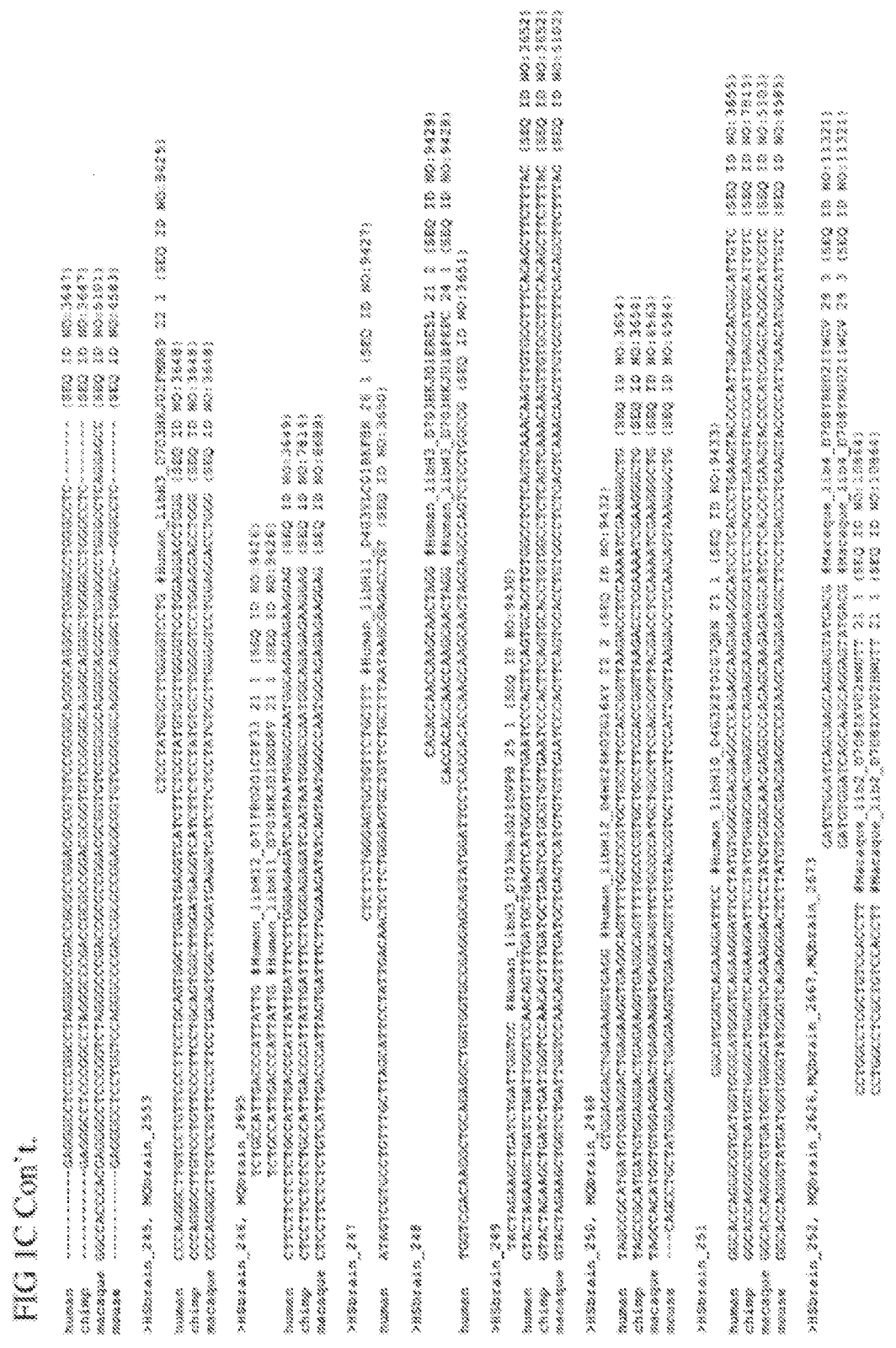
Figure 1C:
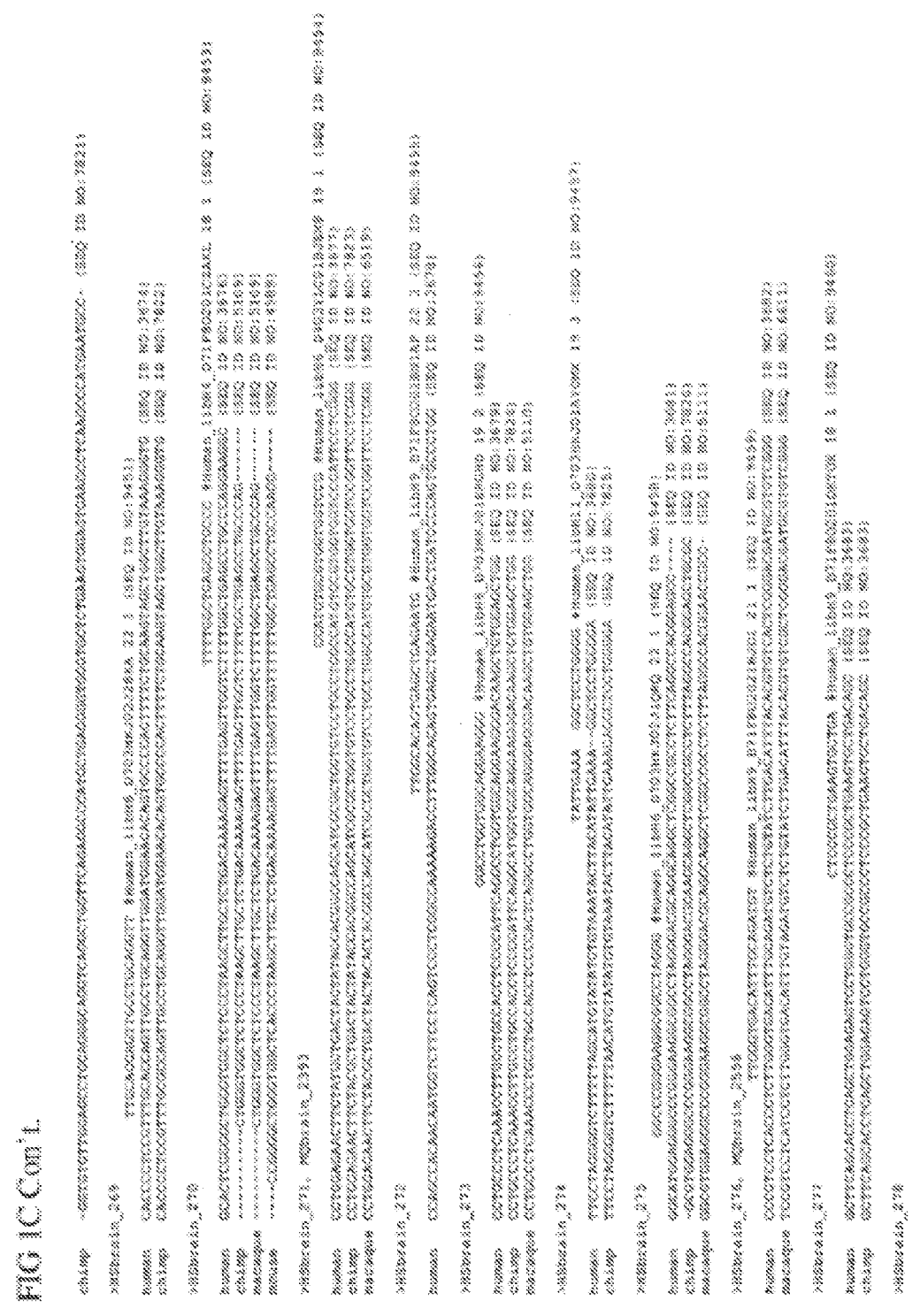
Figure 1C:
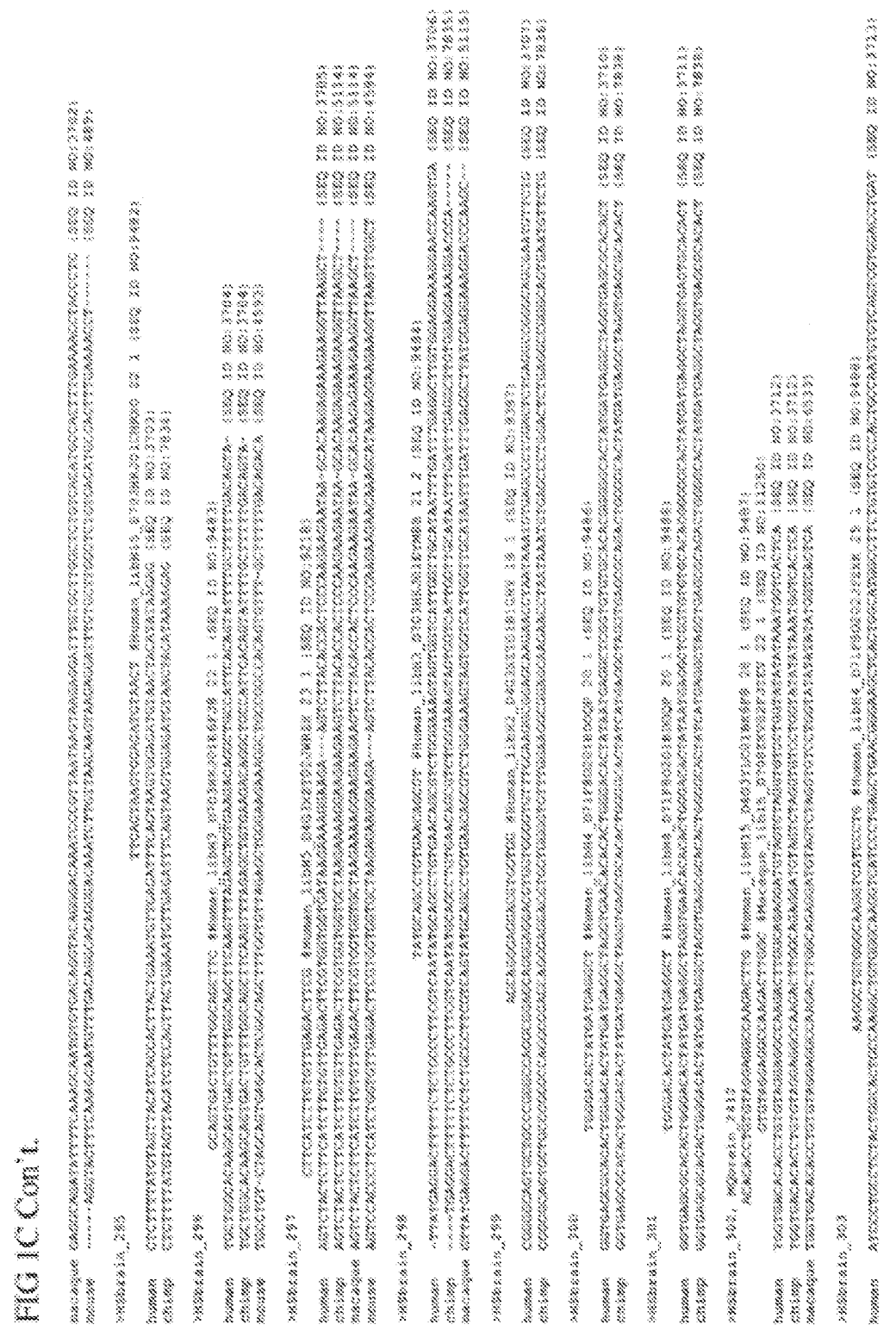
Figure 1C:
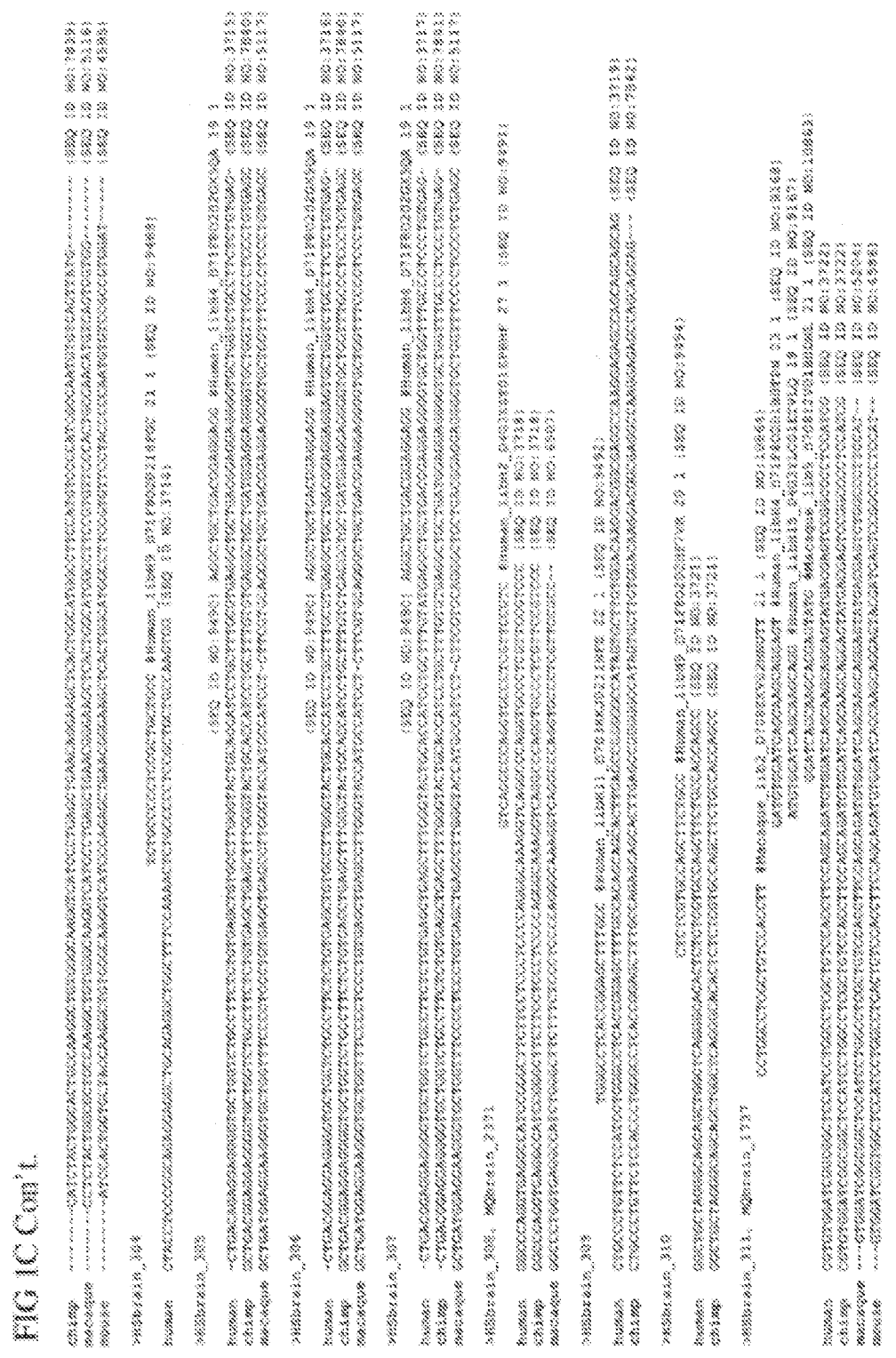
Figure 1C:
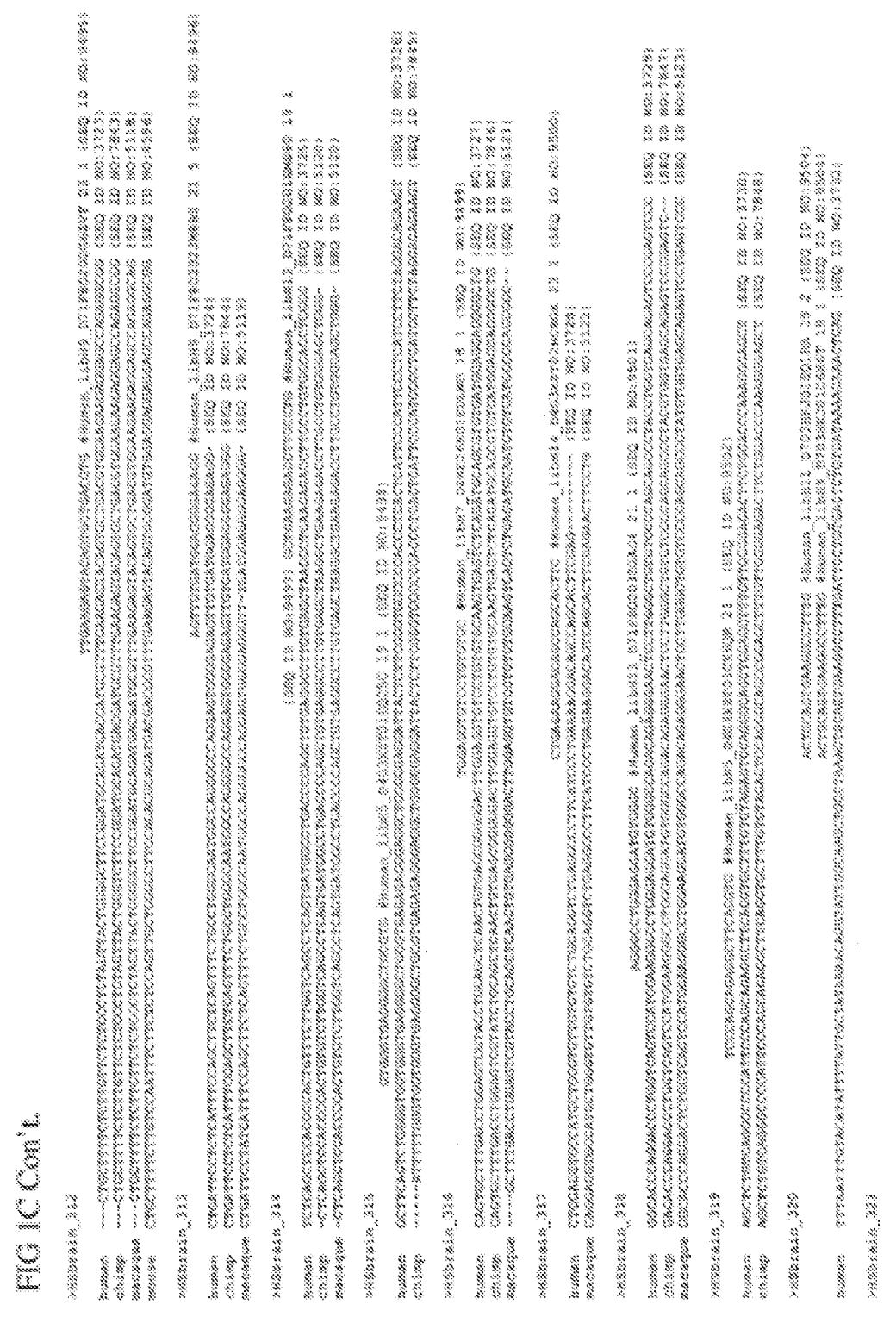
Figure 1C:
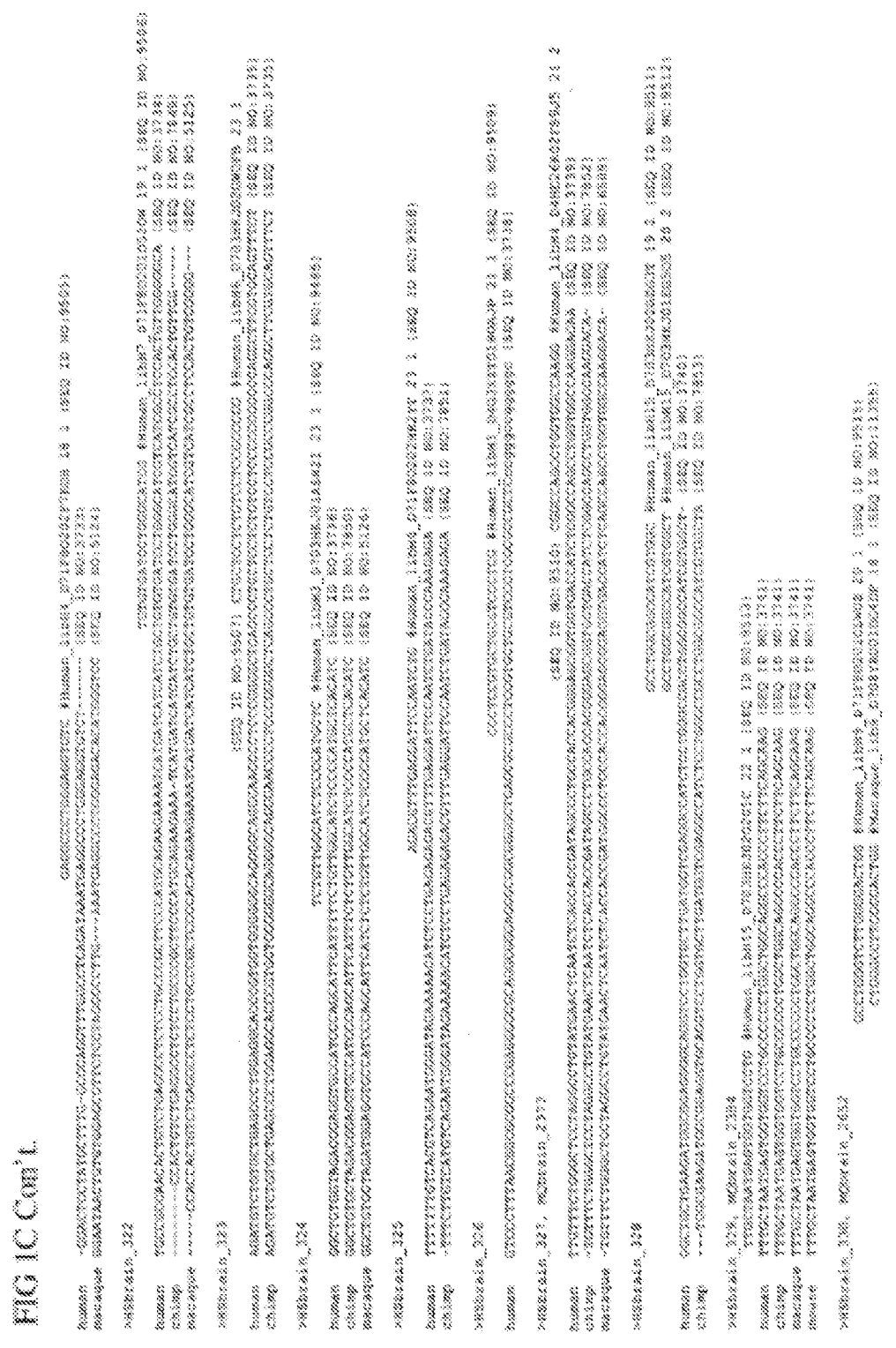
Figure 1C:
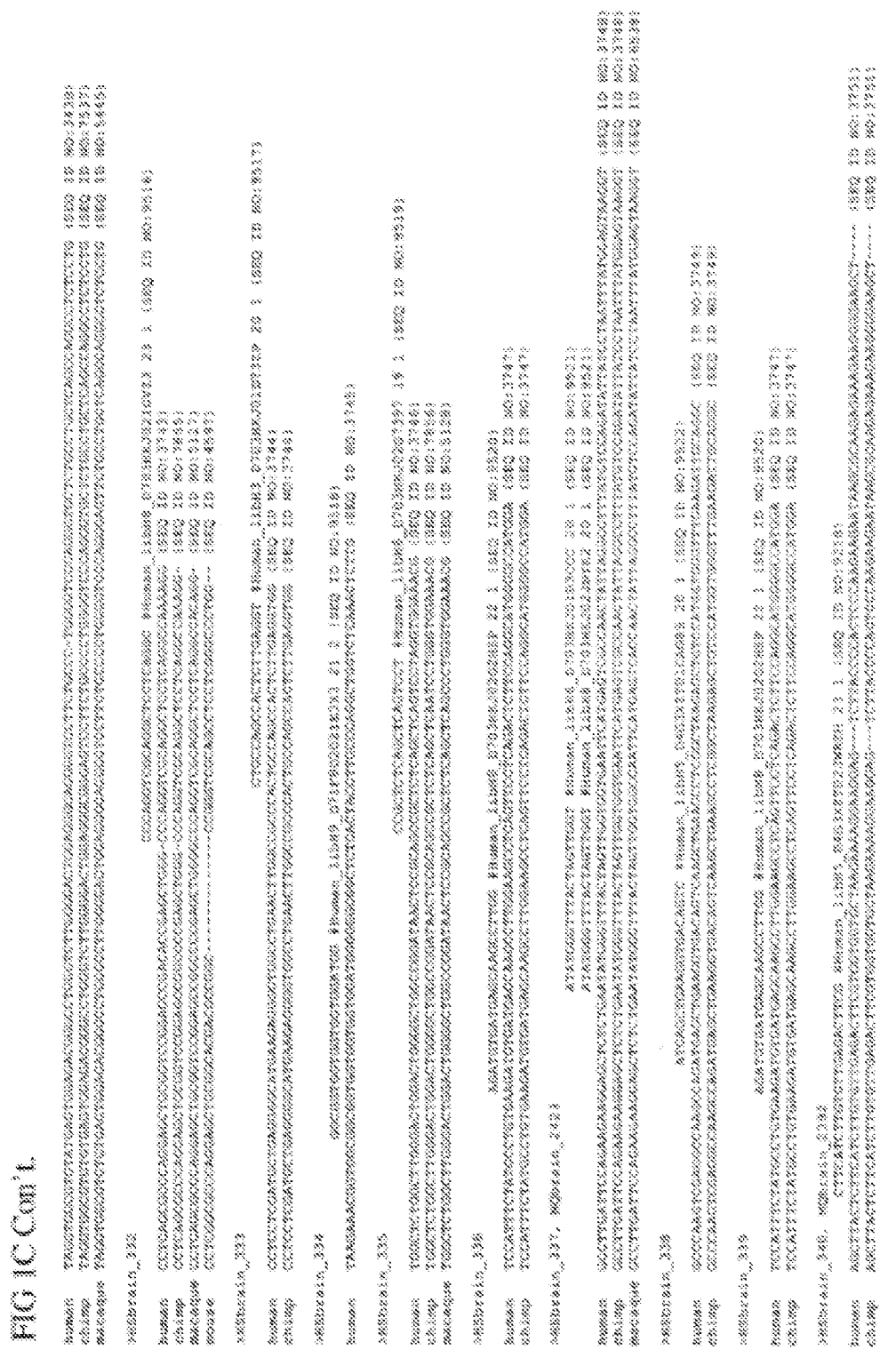
Figure 1C:
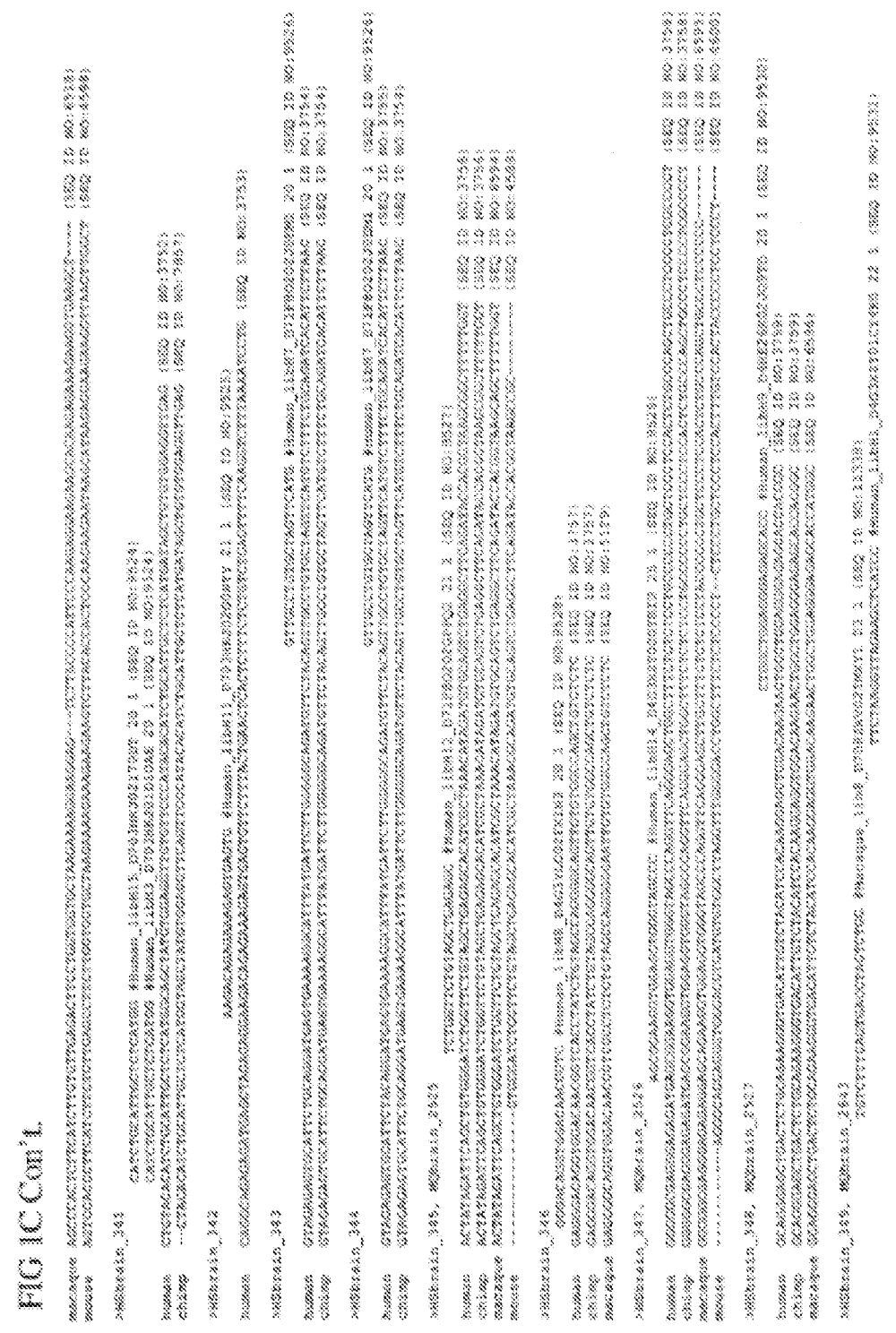
Figure 1C:
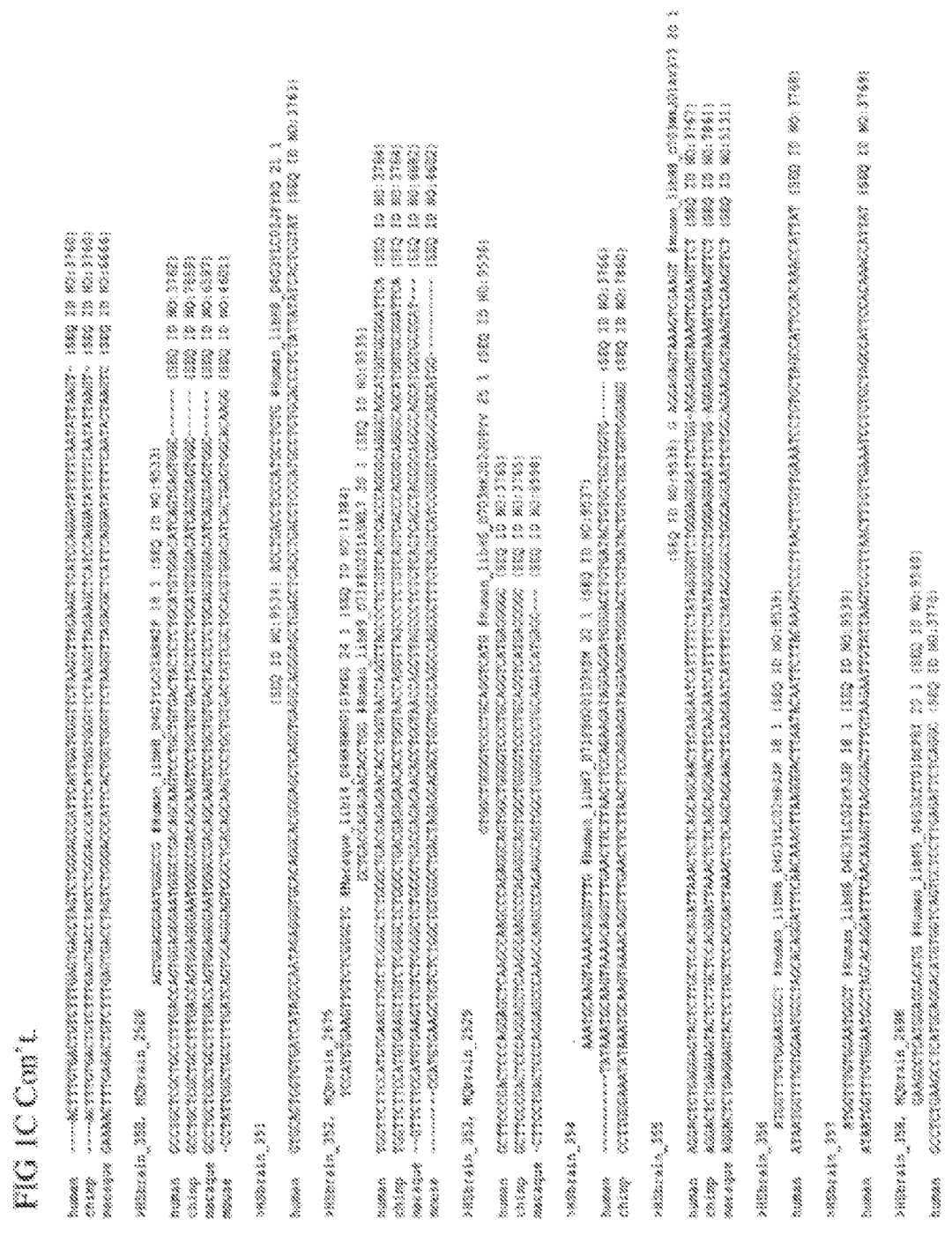
Figure 1C:
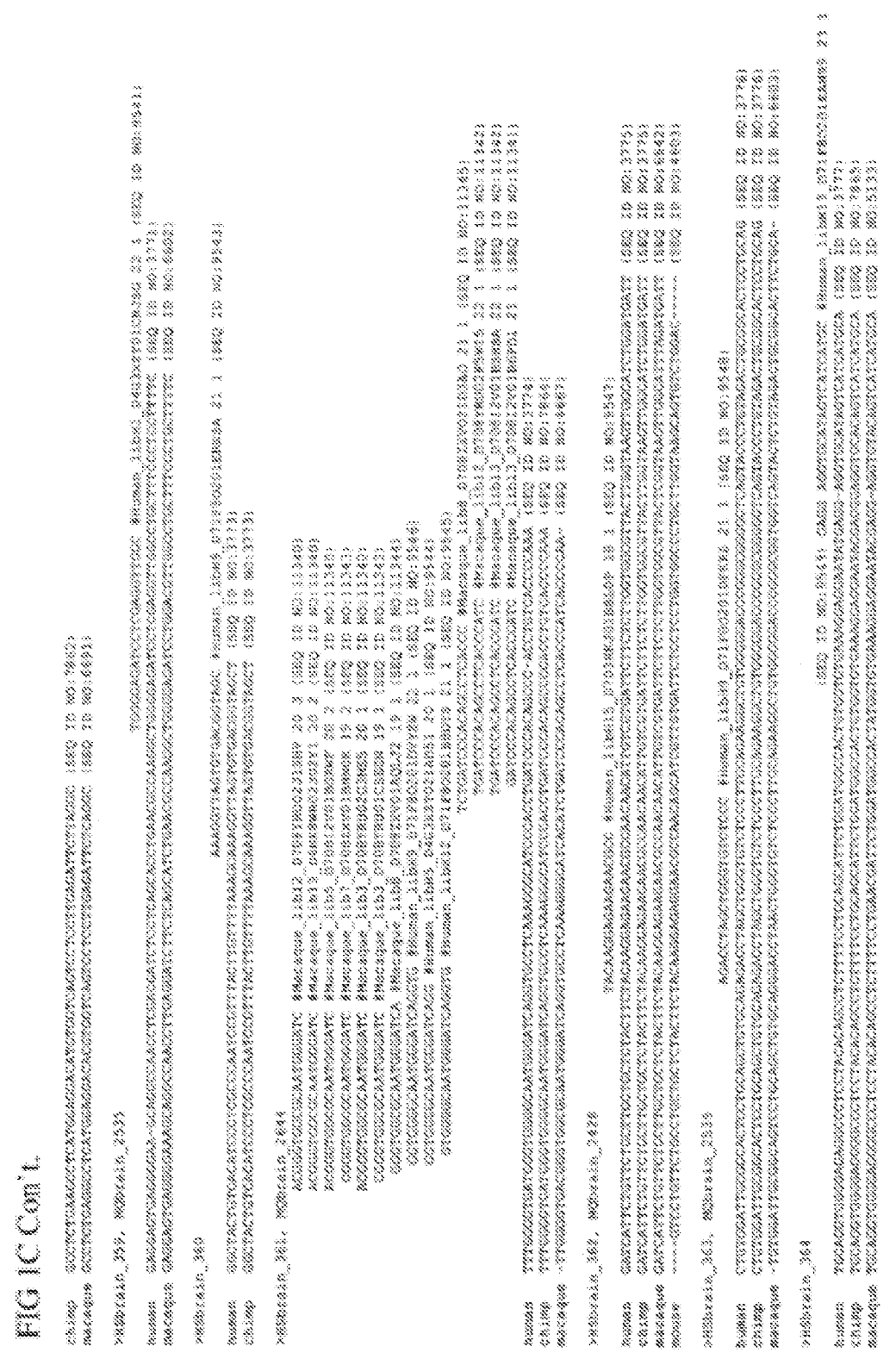
Figure 1C:
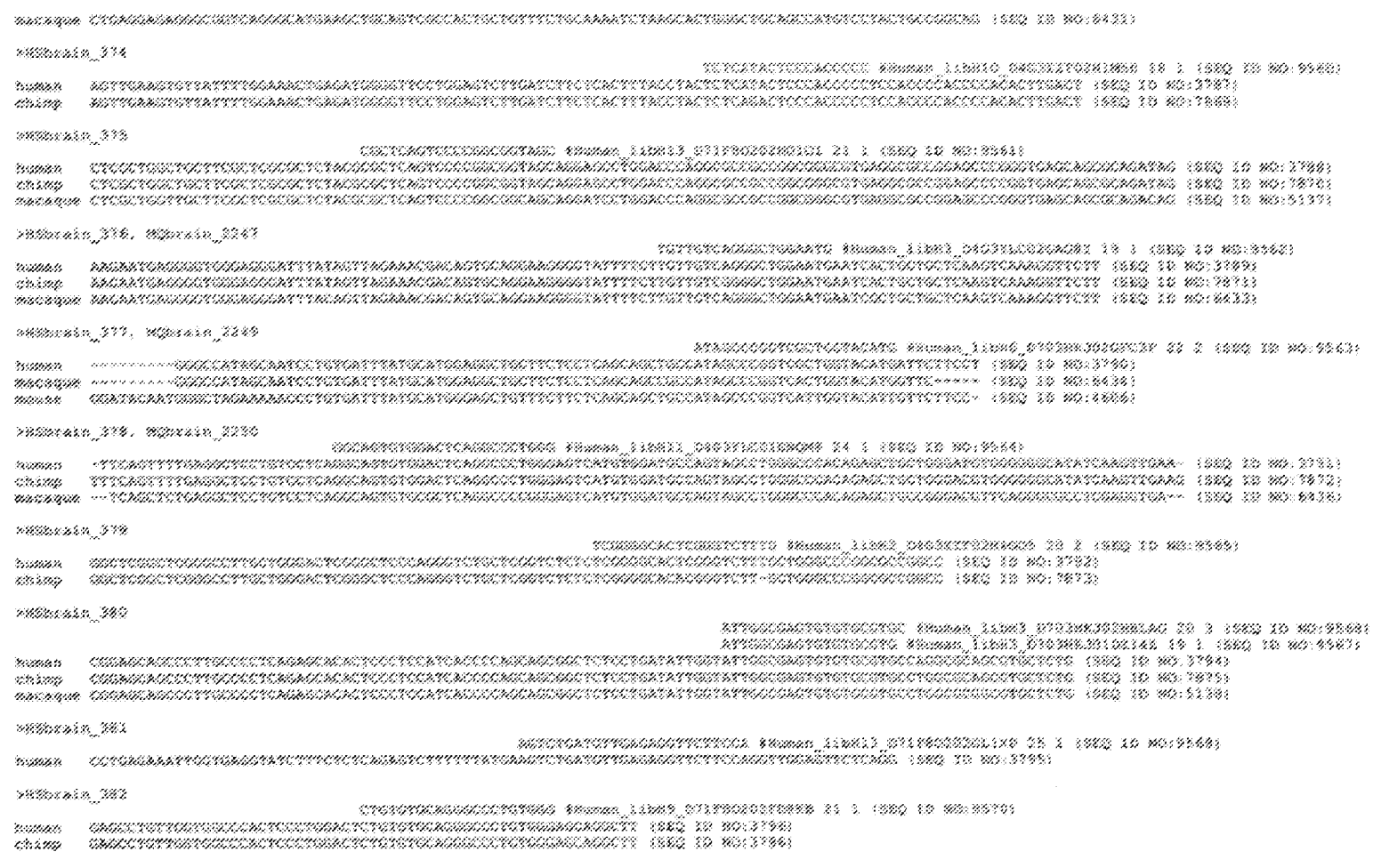
Figure 1C:
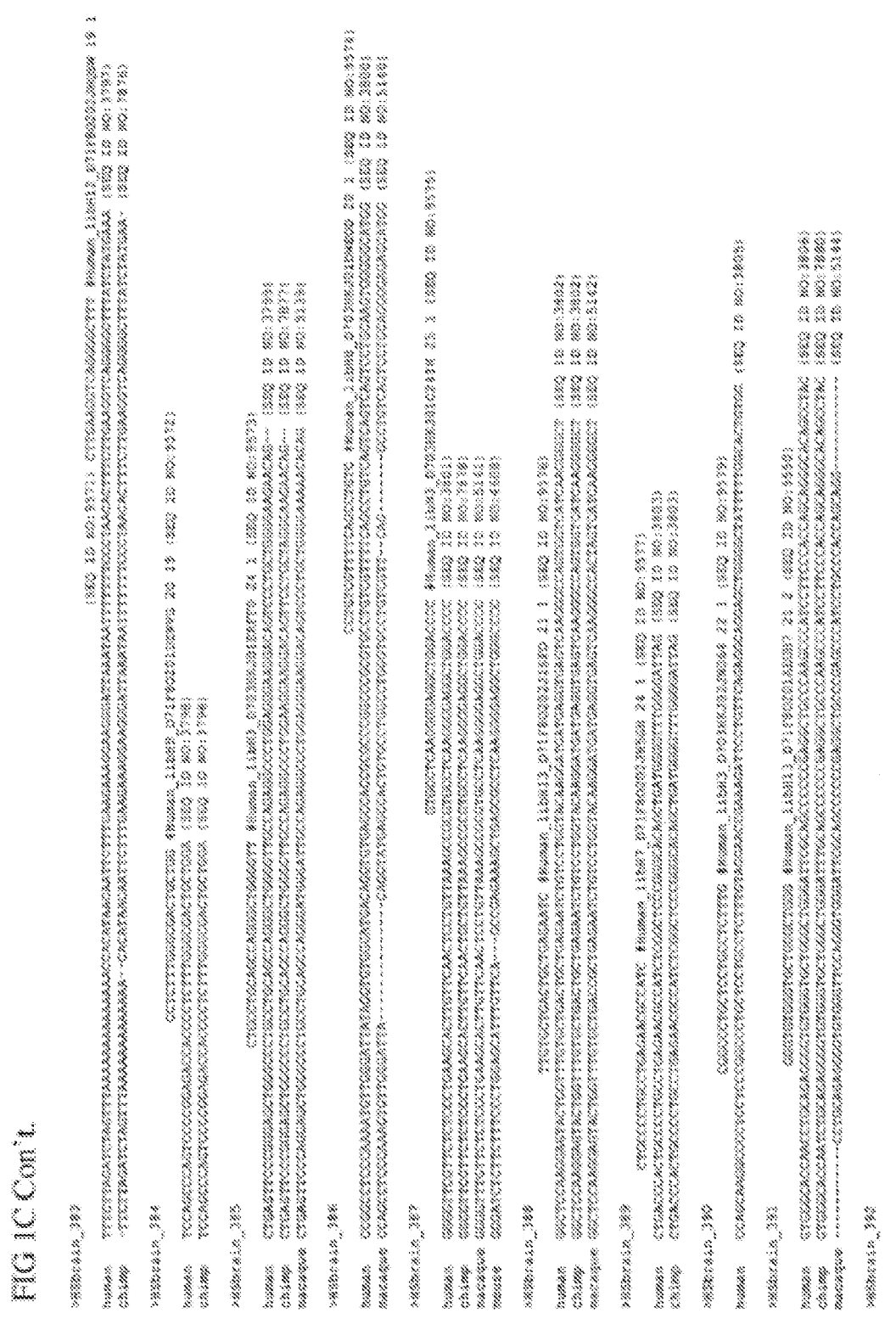
Figure 1C:
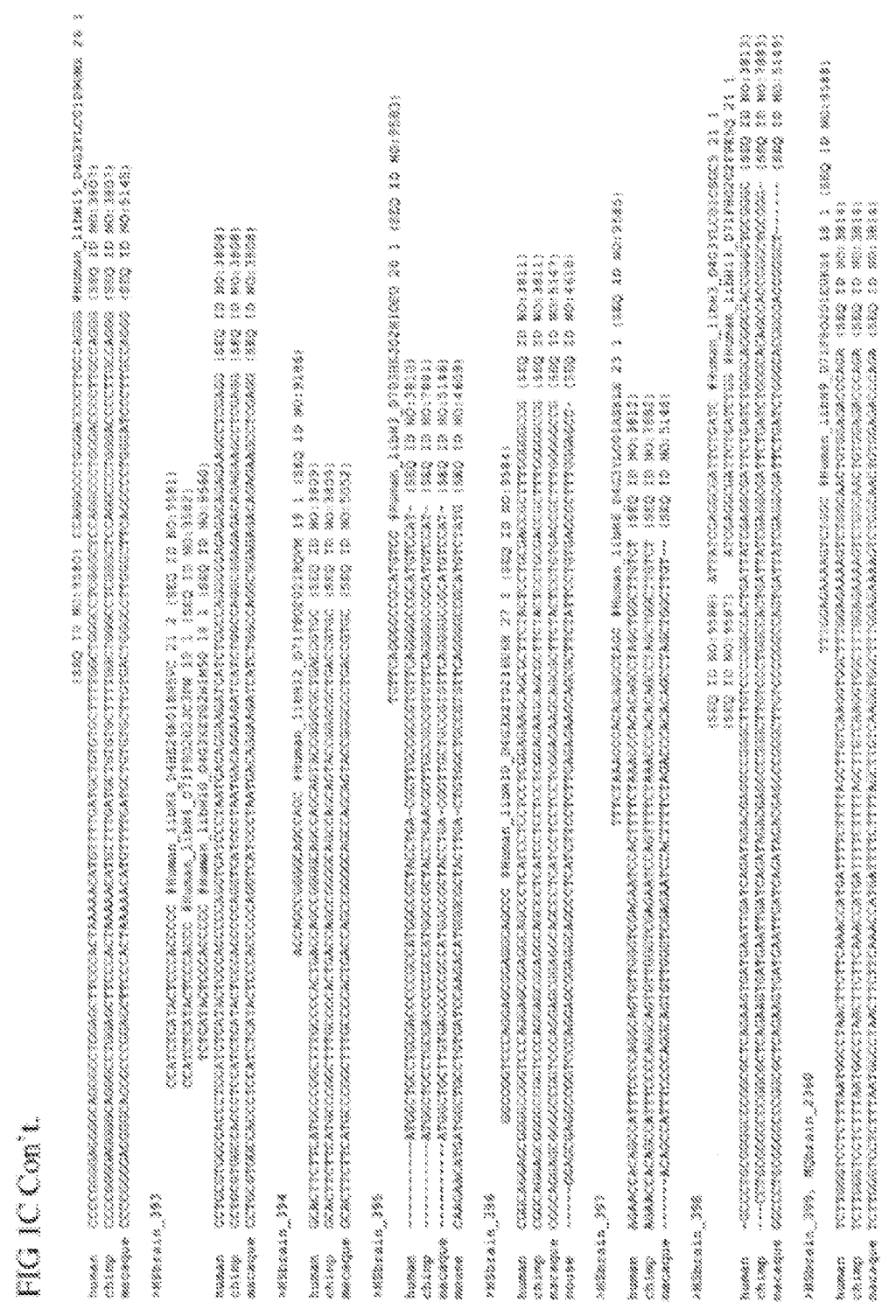
Figure 1C:
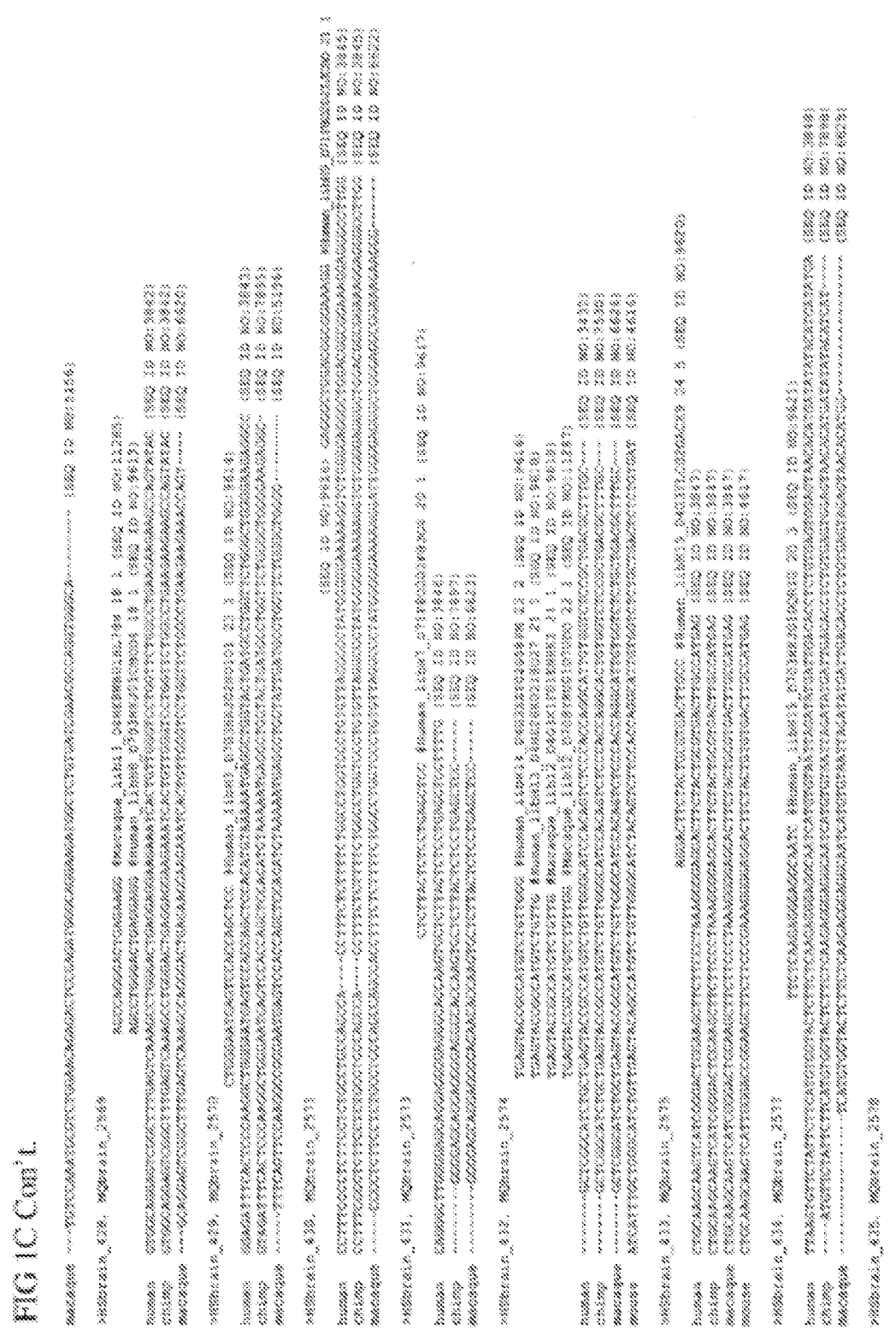
Figure 1C:
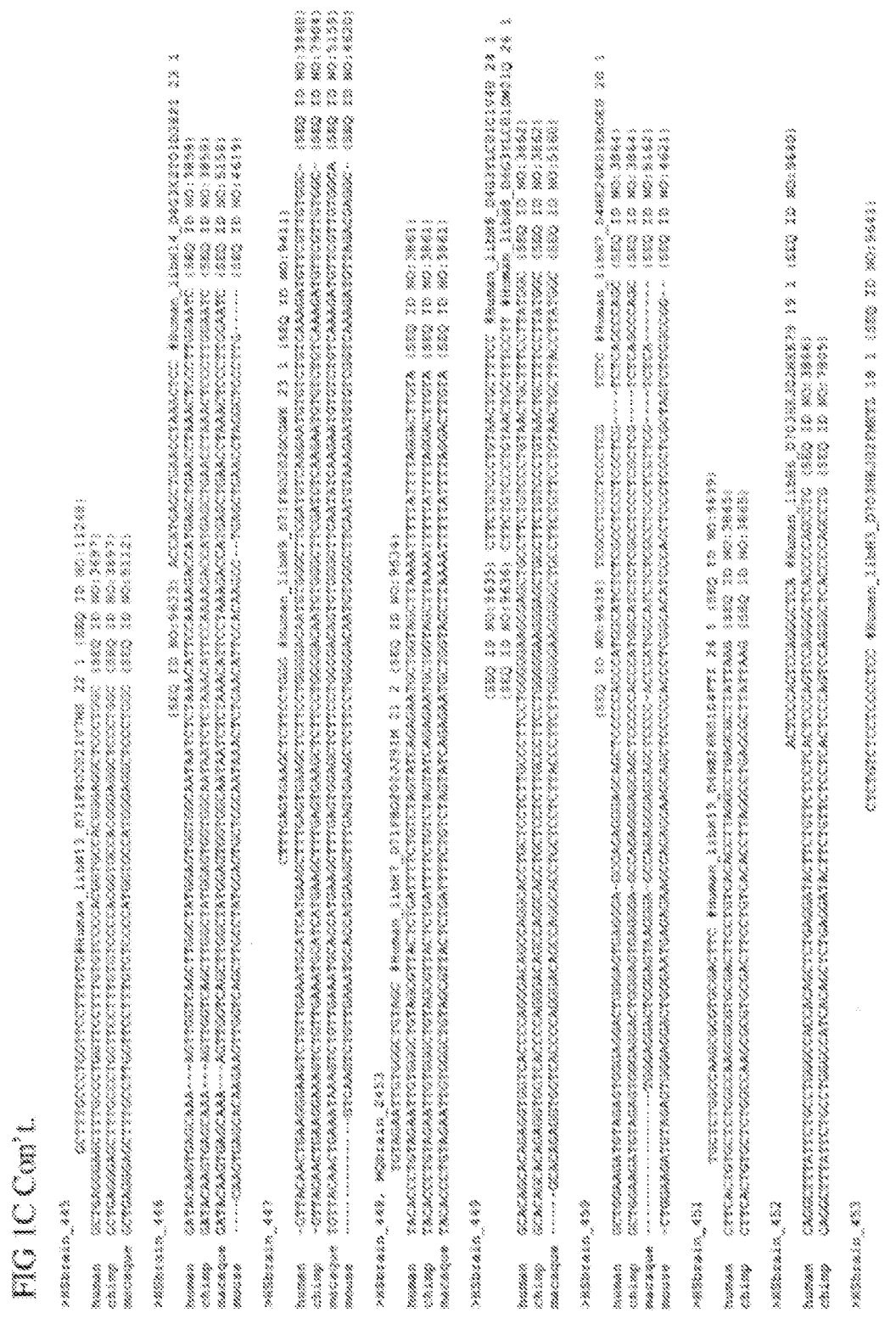
Figure 1C:
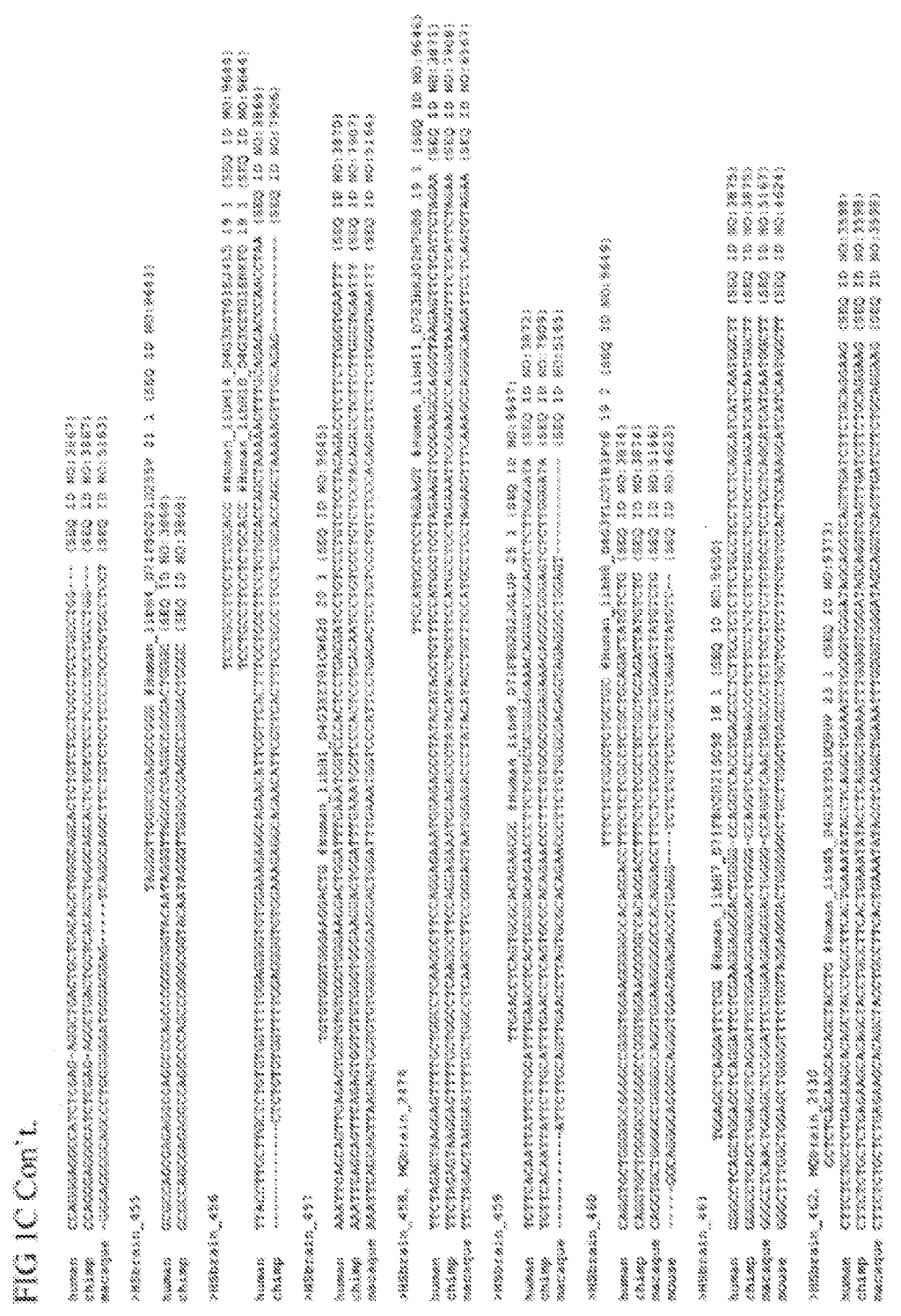
Figure 1C:
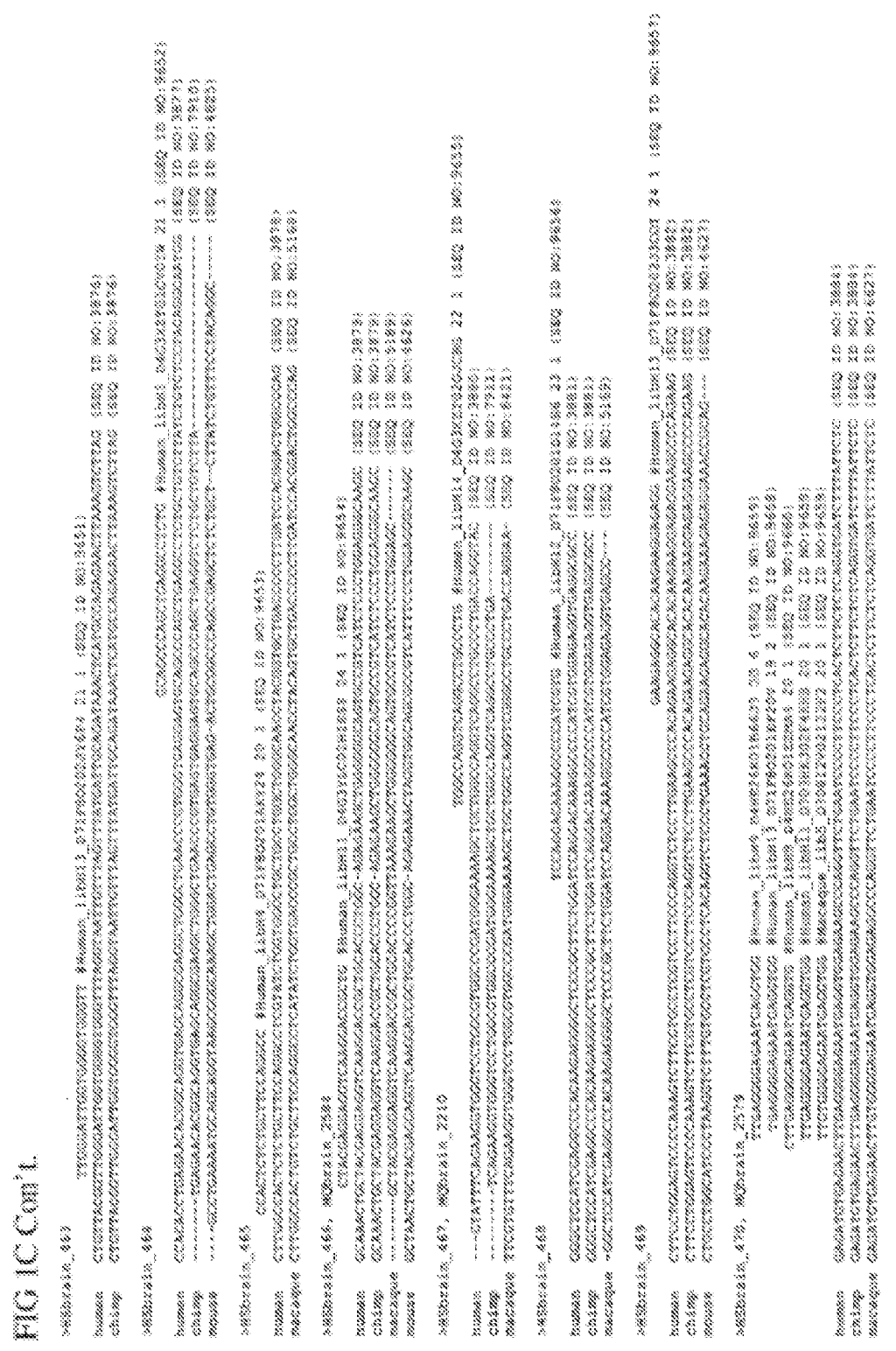
Figure 1C:
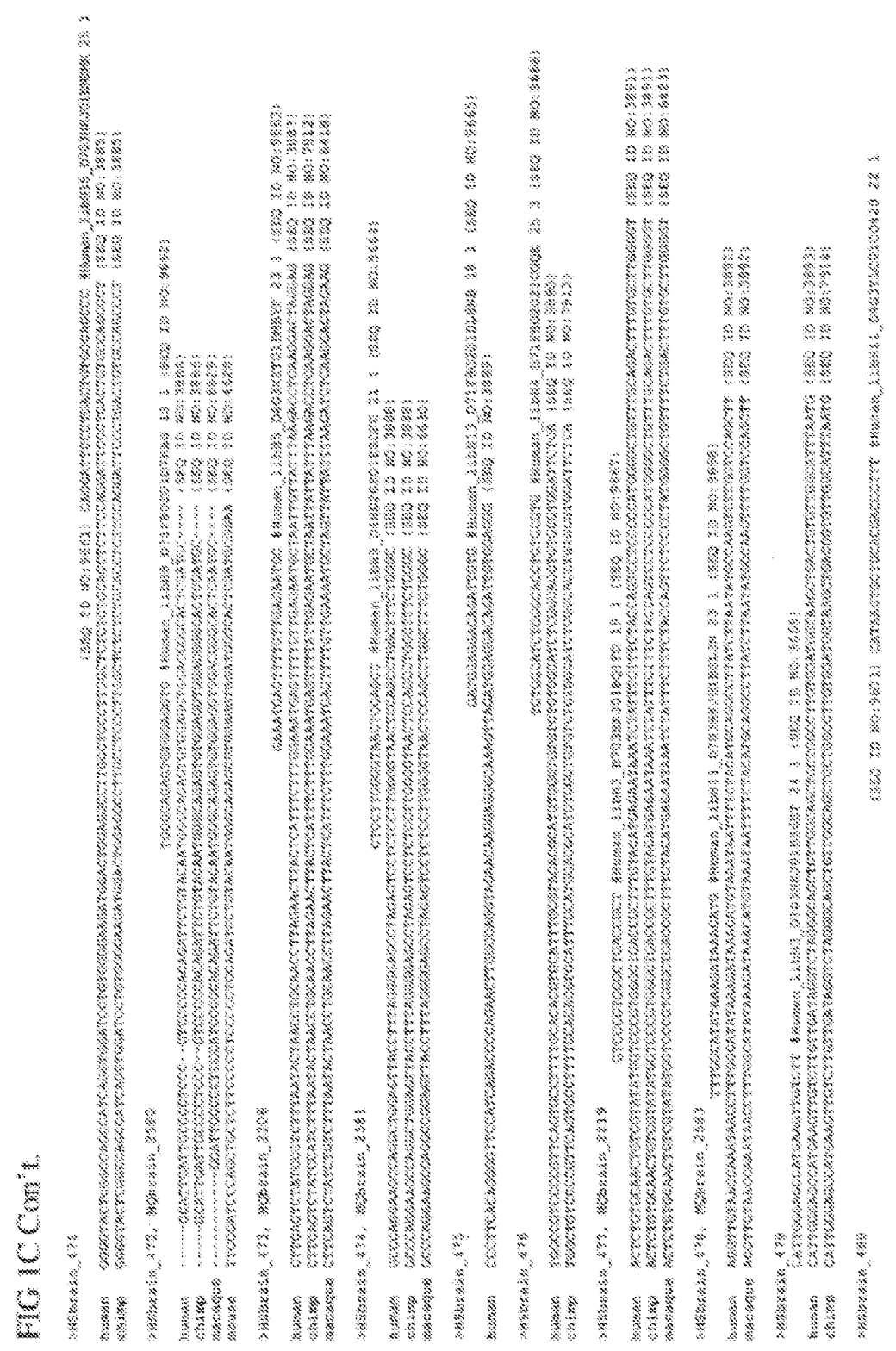
Figure 1C:
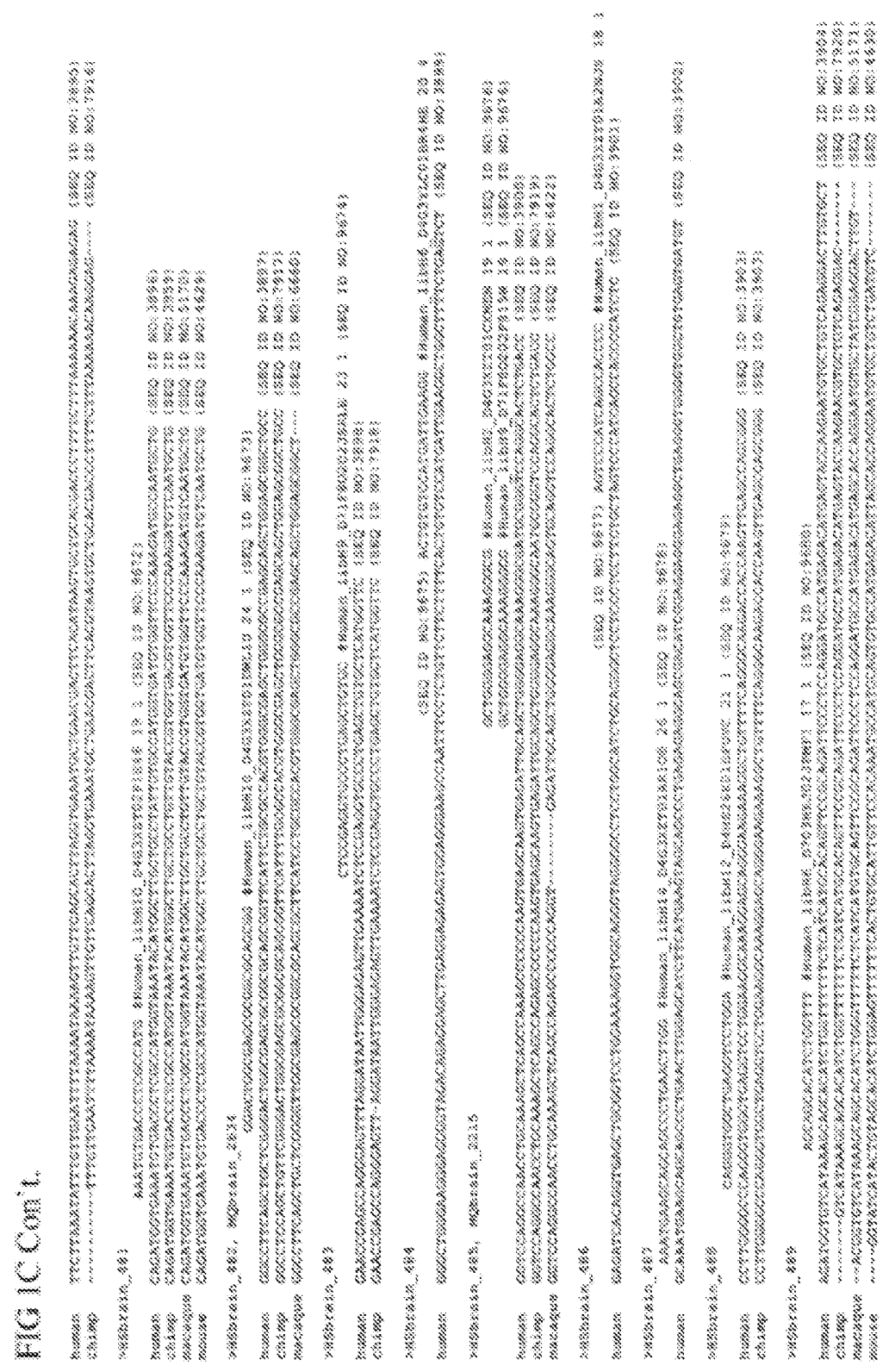
Figure 1C:
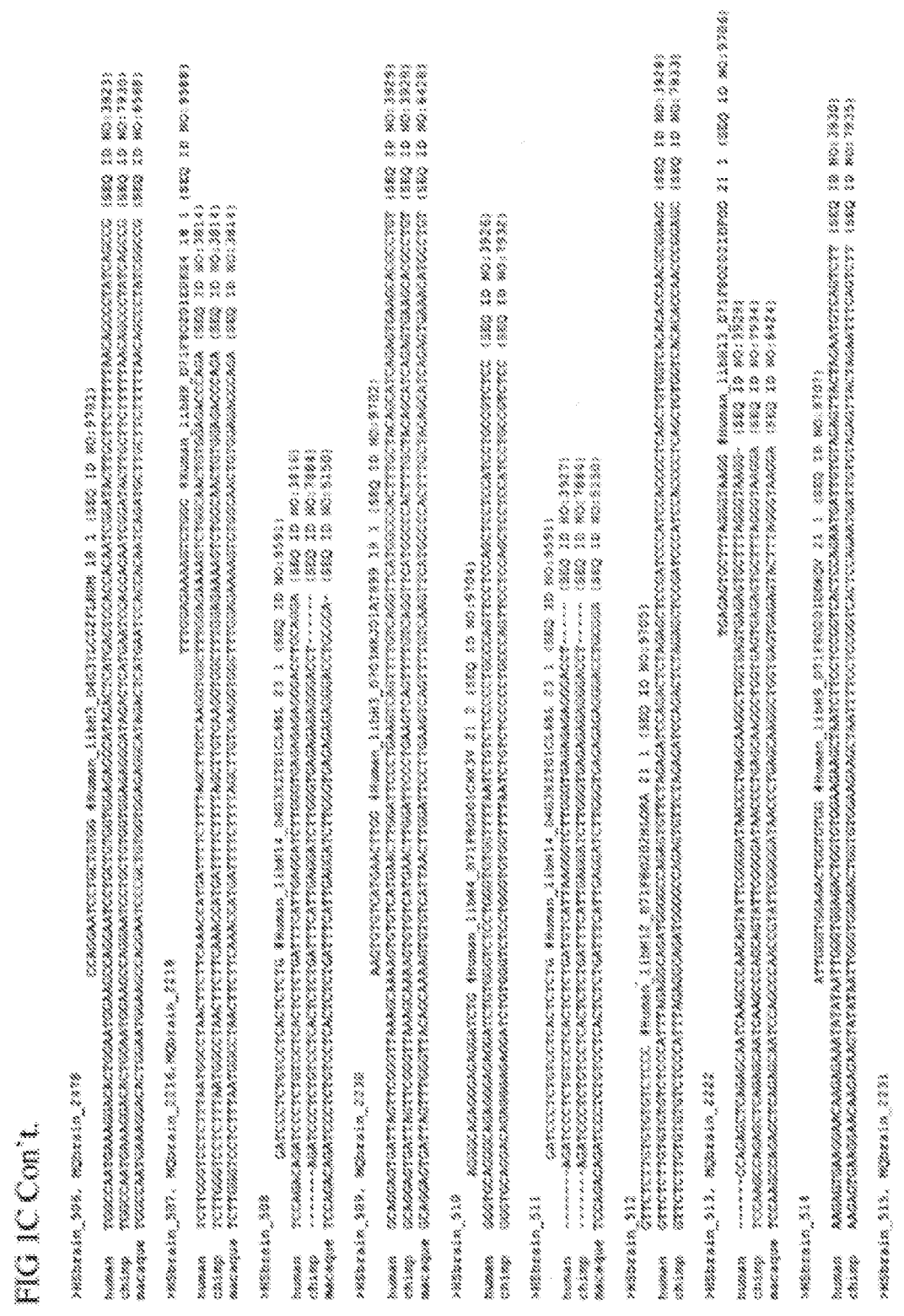
Figure 1C:
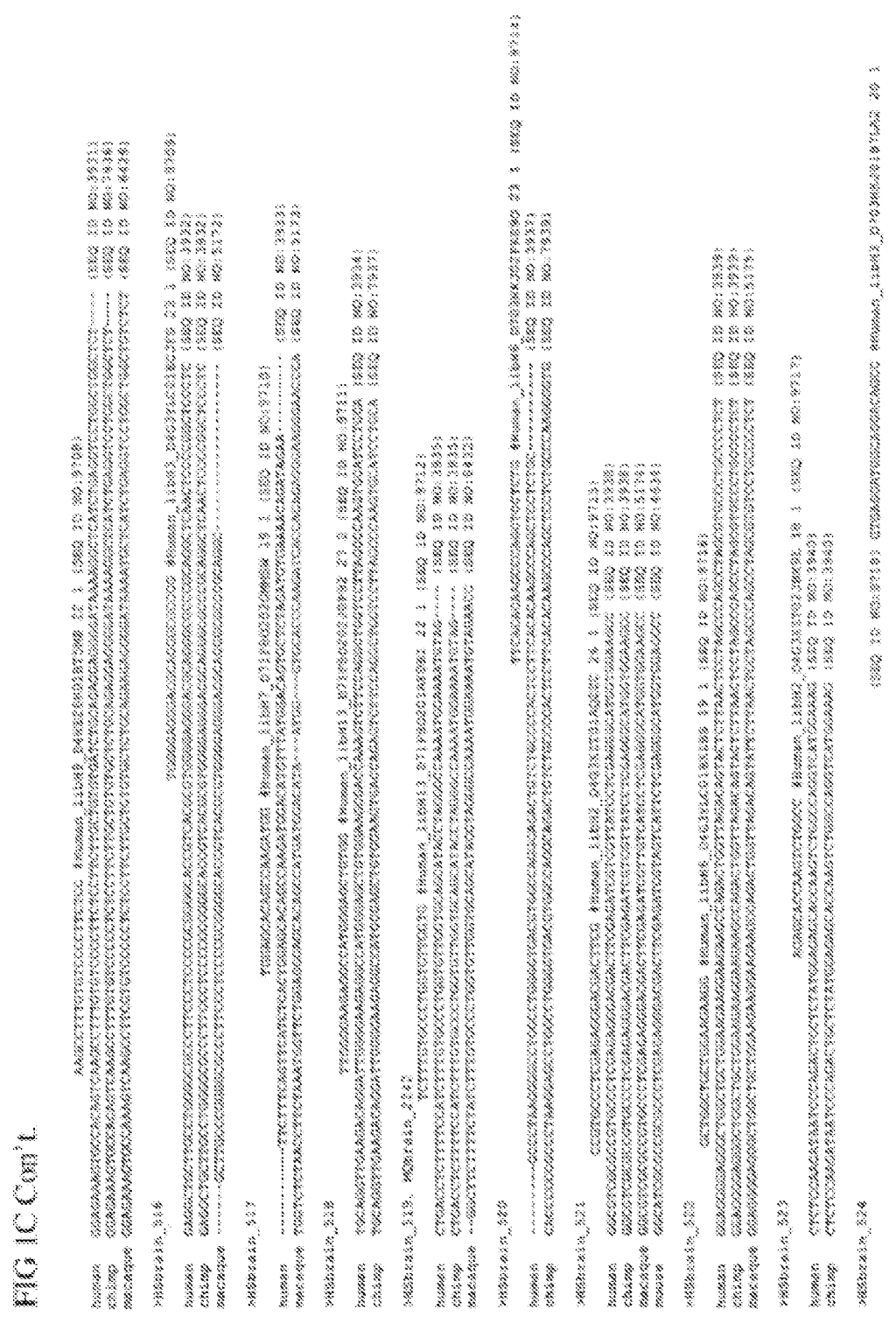
Figure 1C:
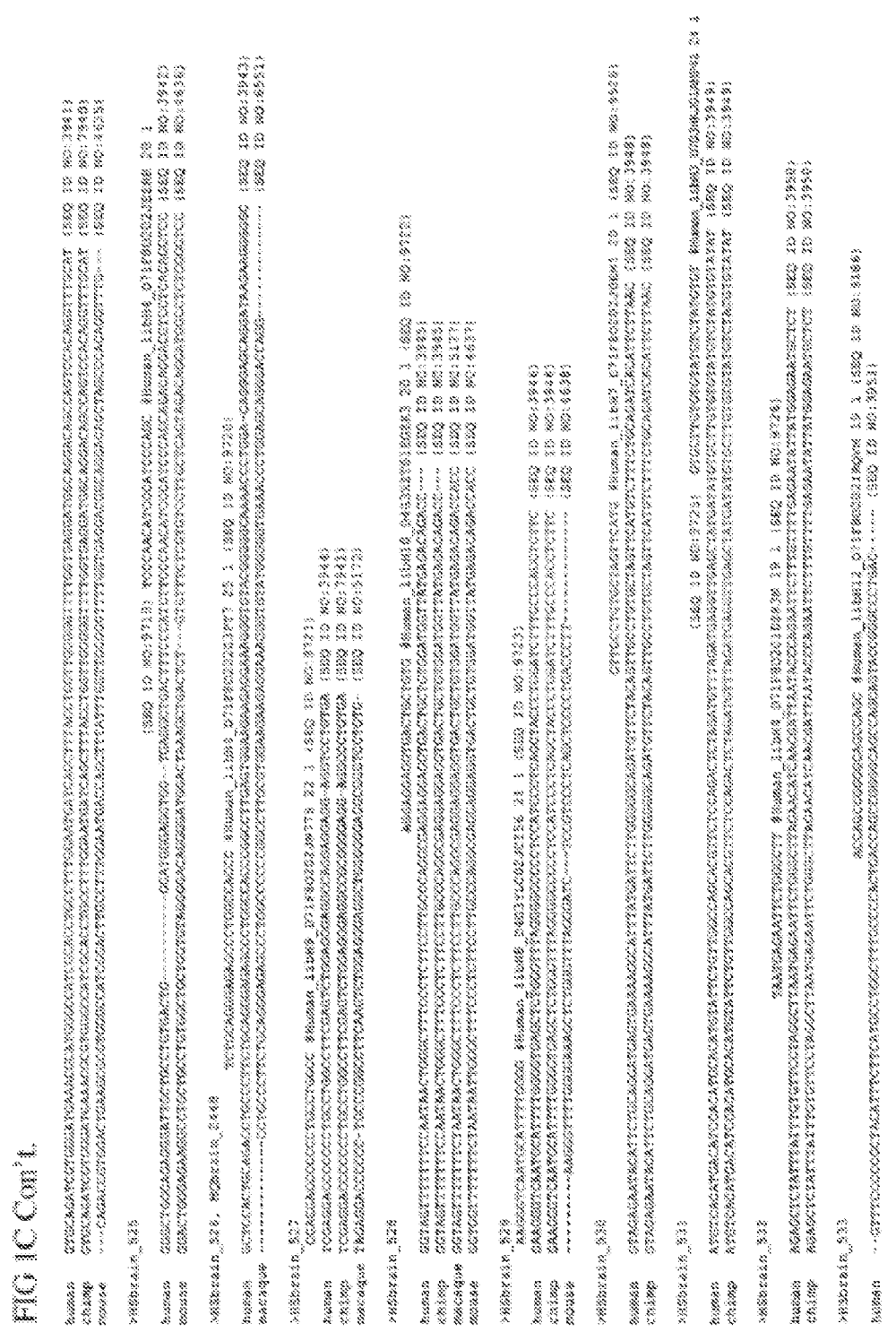
Figure 1C:
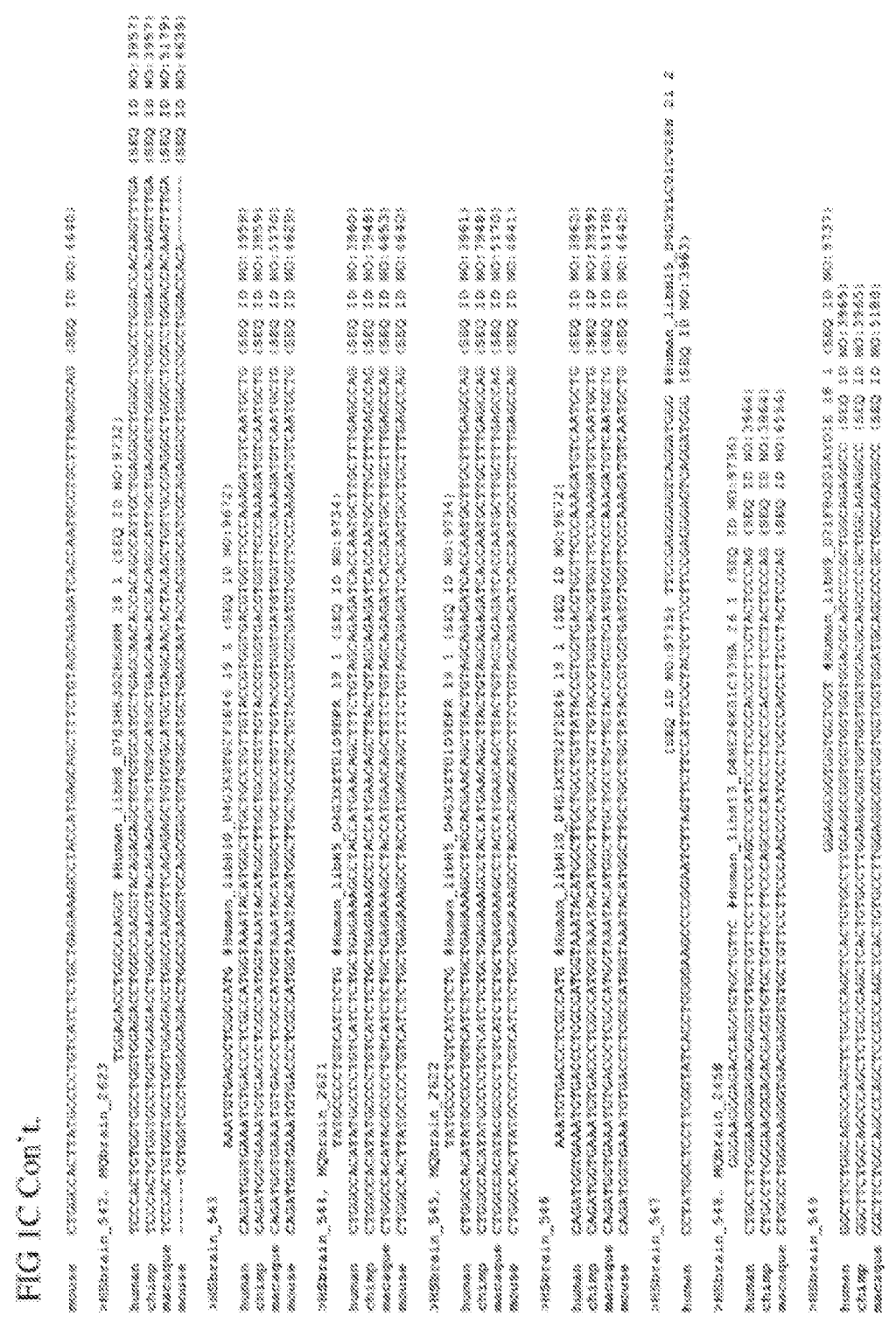
Figure 1C:
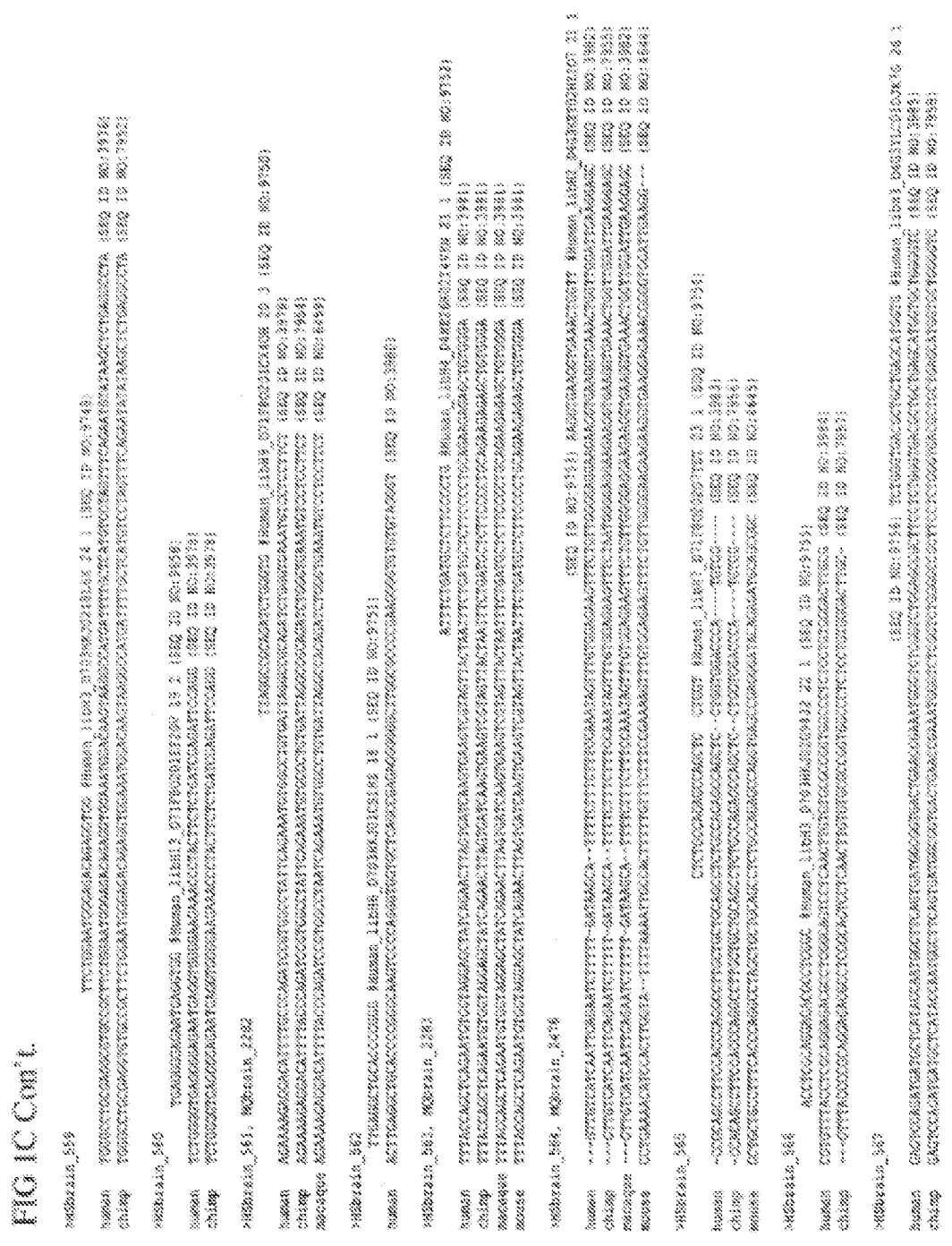
Figure 1C:
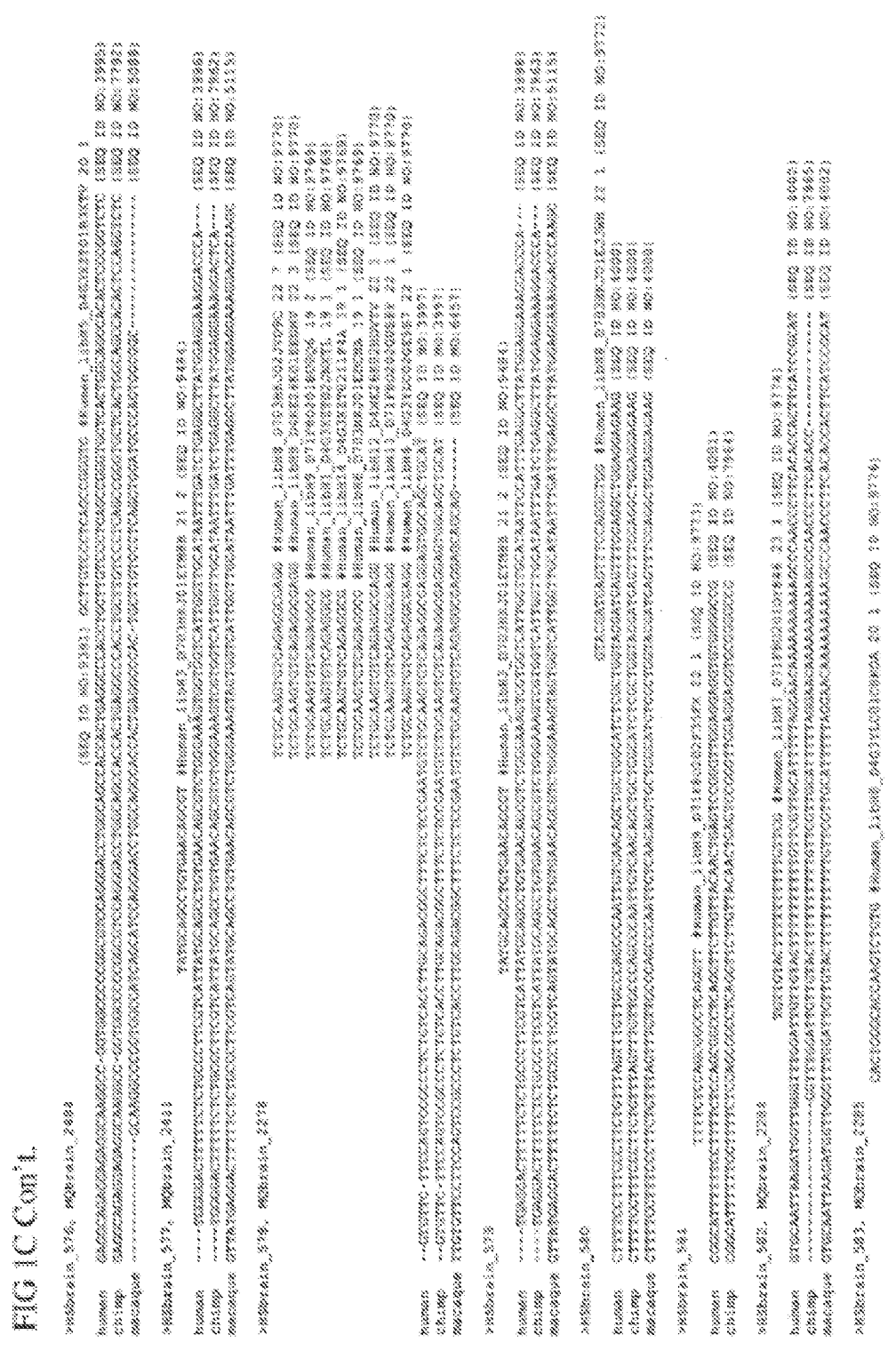
Figure 1C:
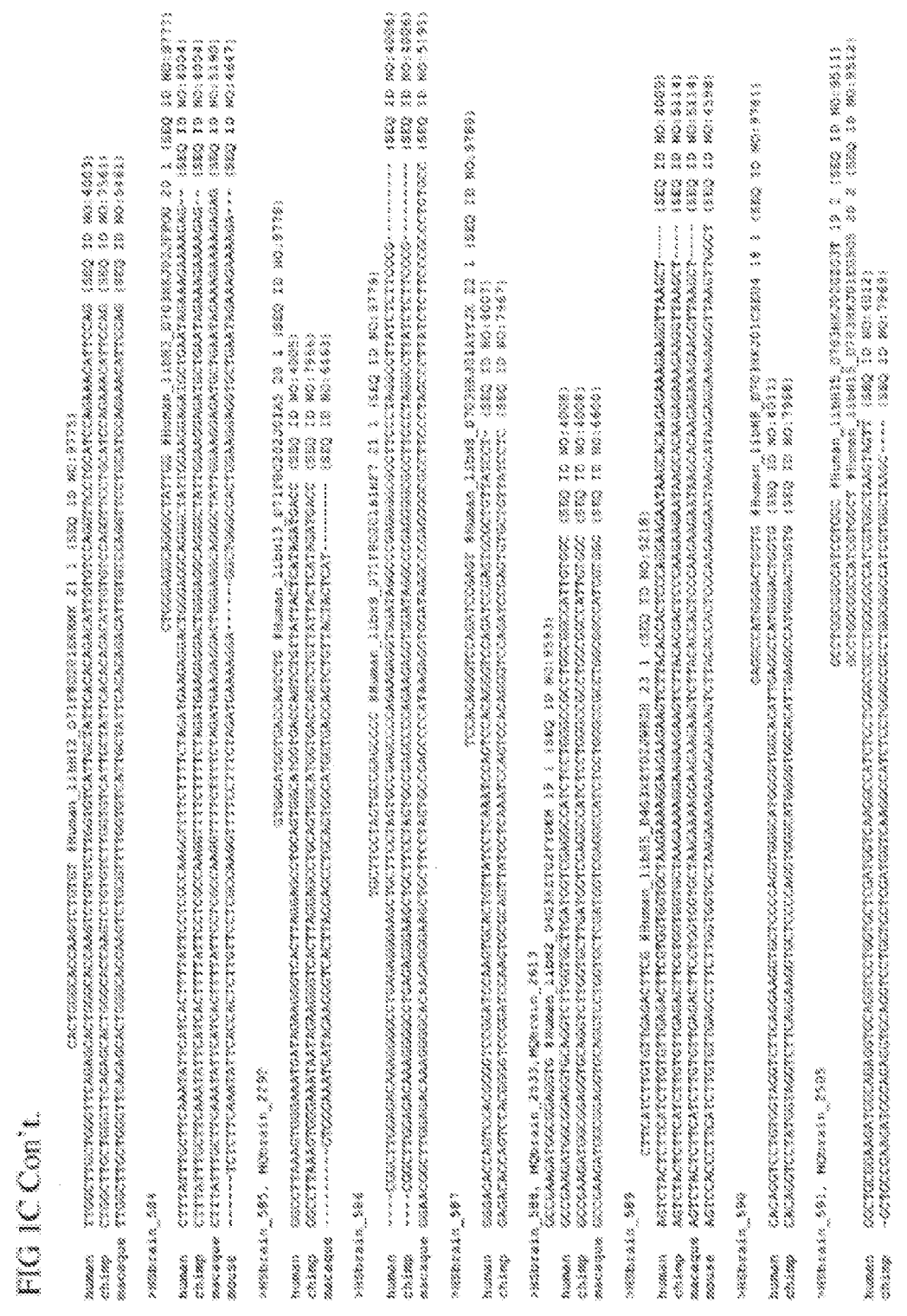
Figure 1C:
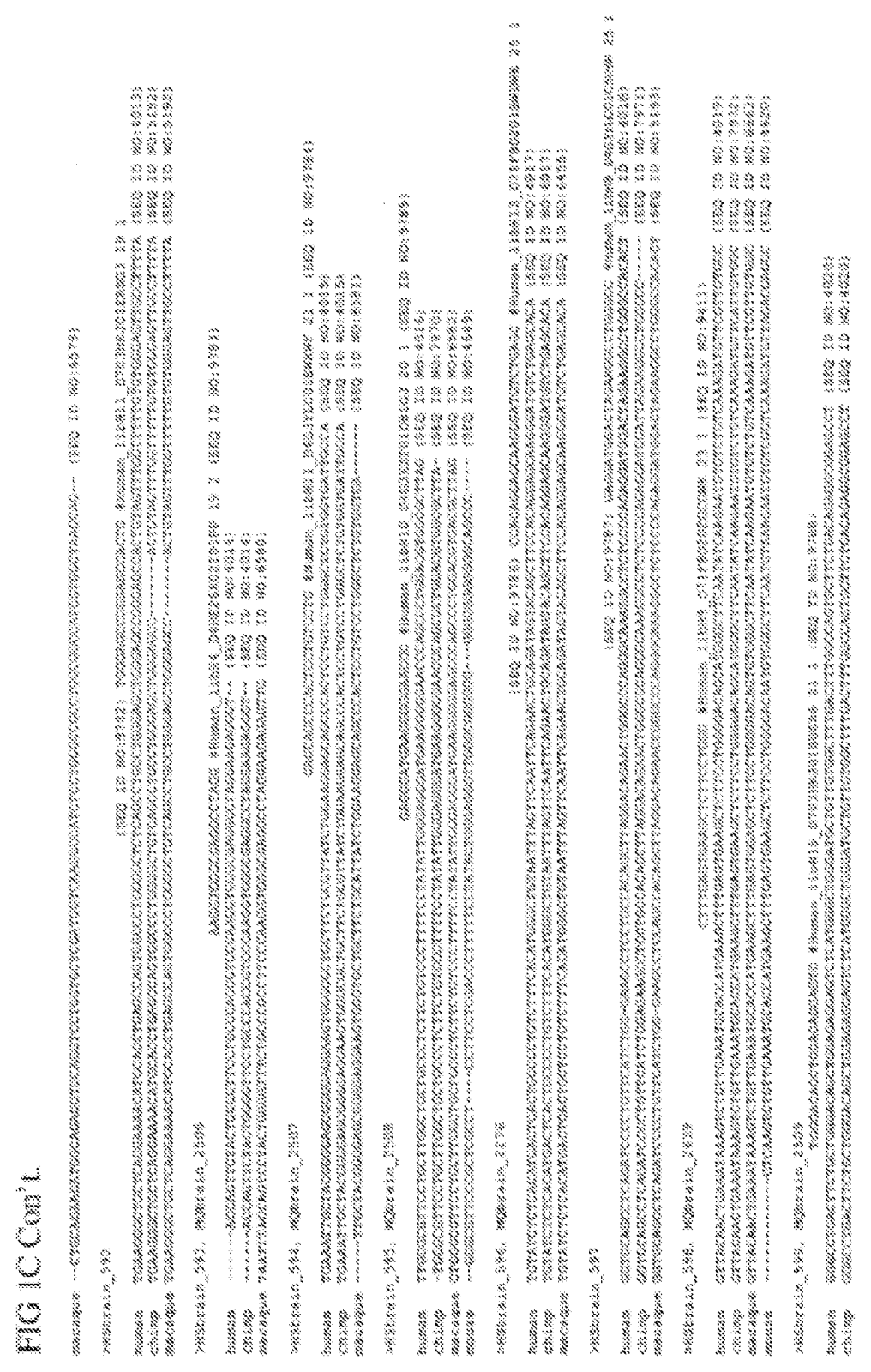
Figure 1C:
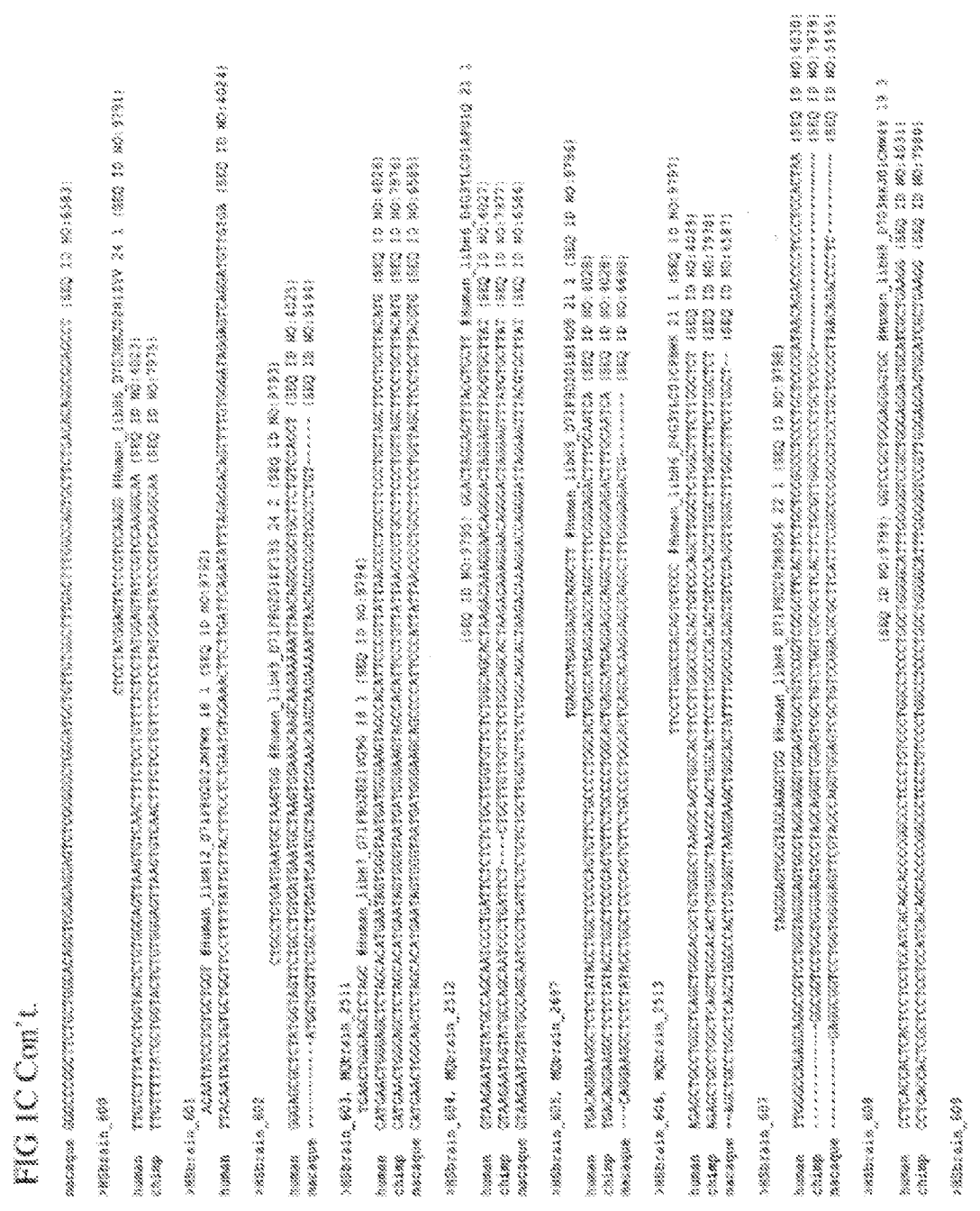
Figure 1C:
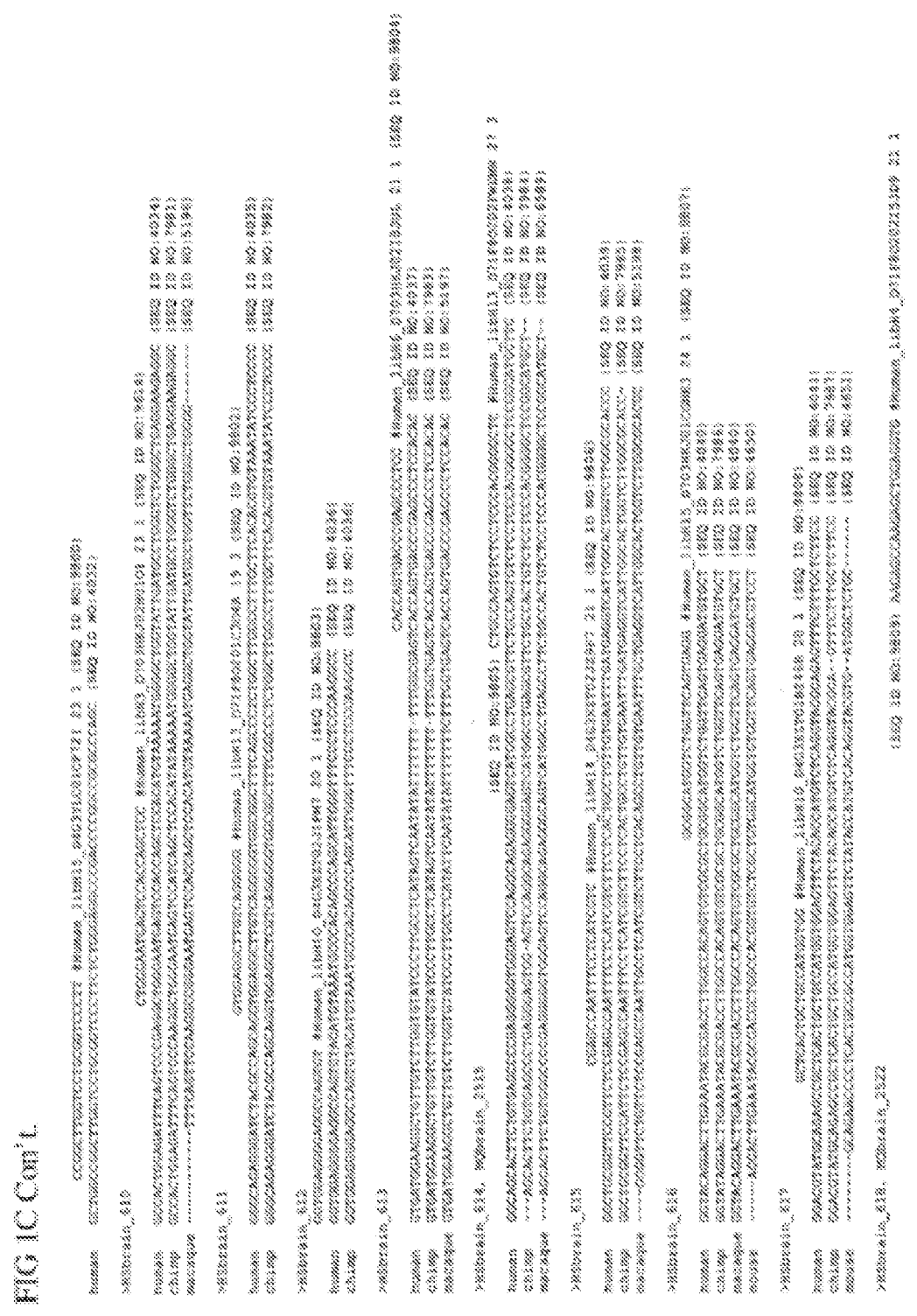
Figure 1C:
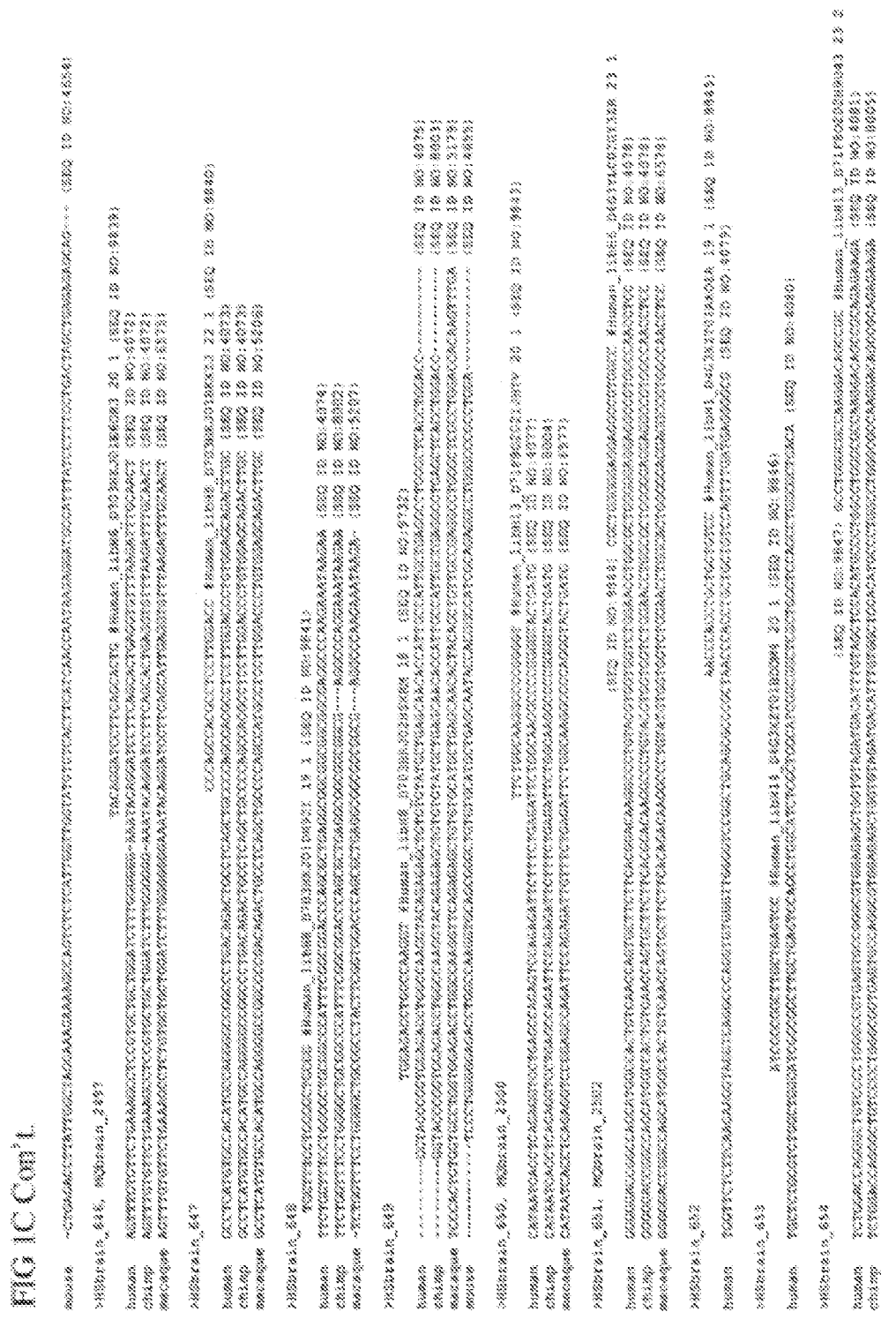
Figure 1C:
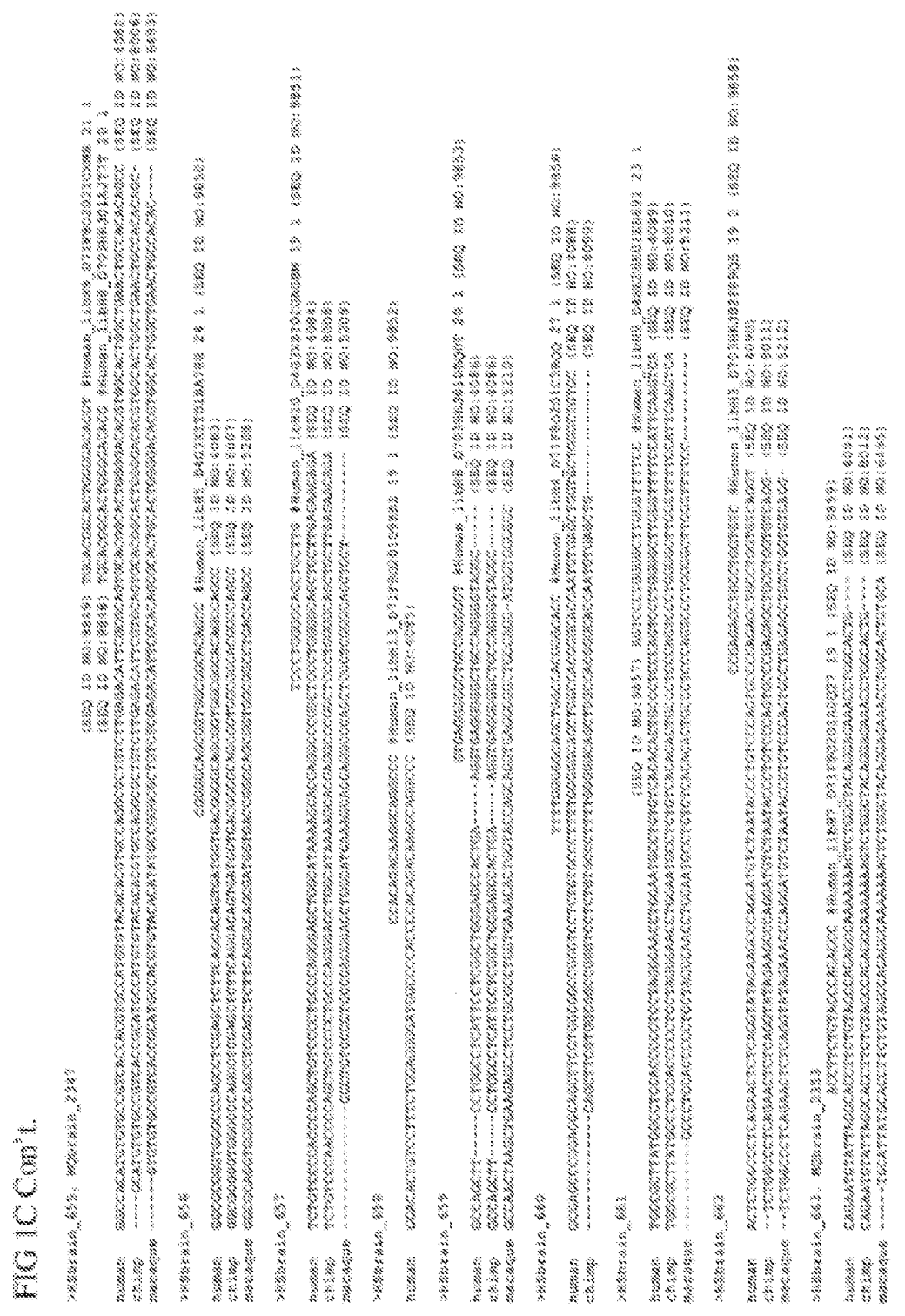
Figure 1C:
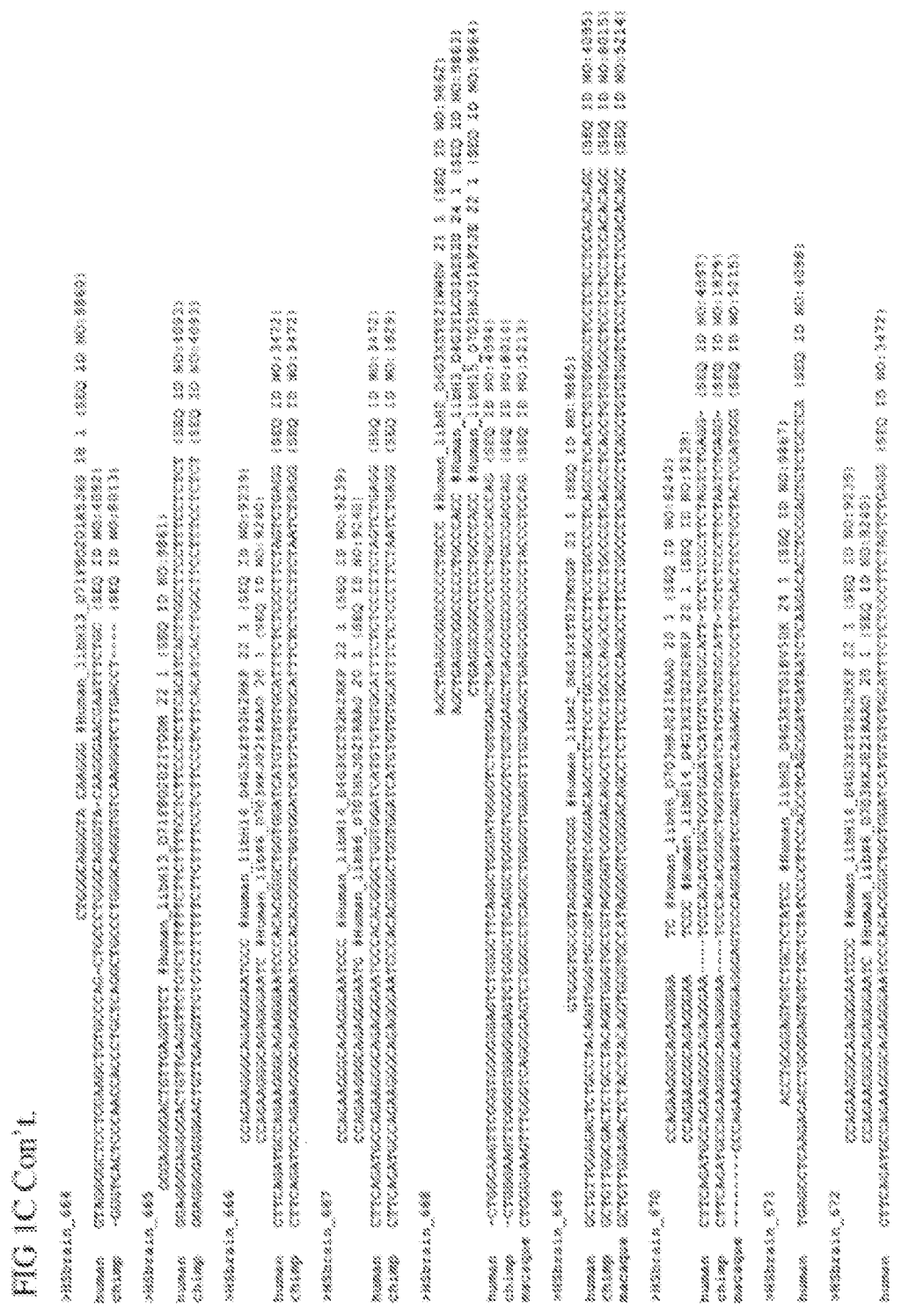
Figure 1C:
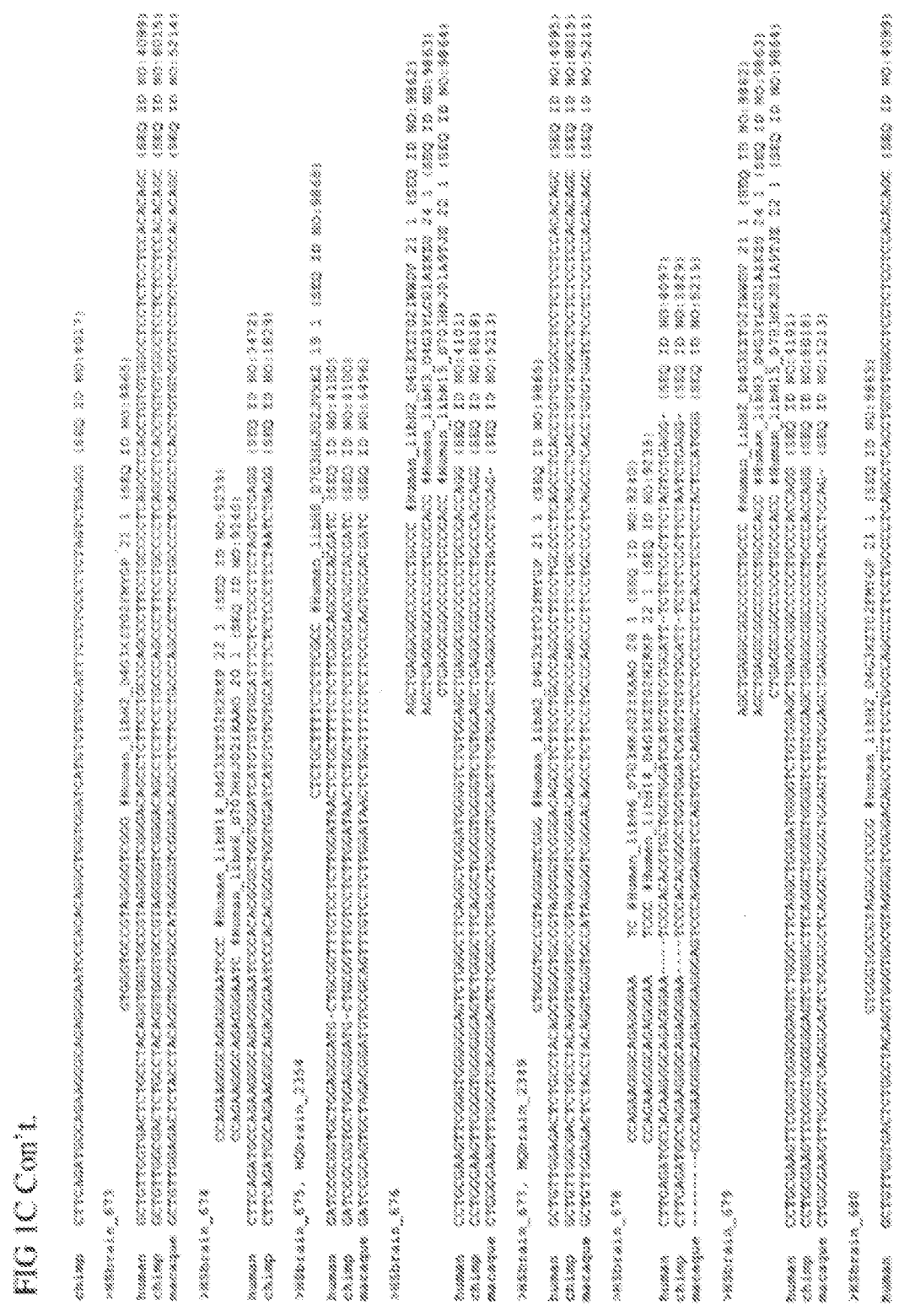
Figure 1C:
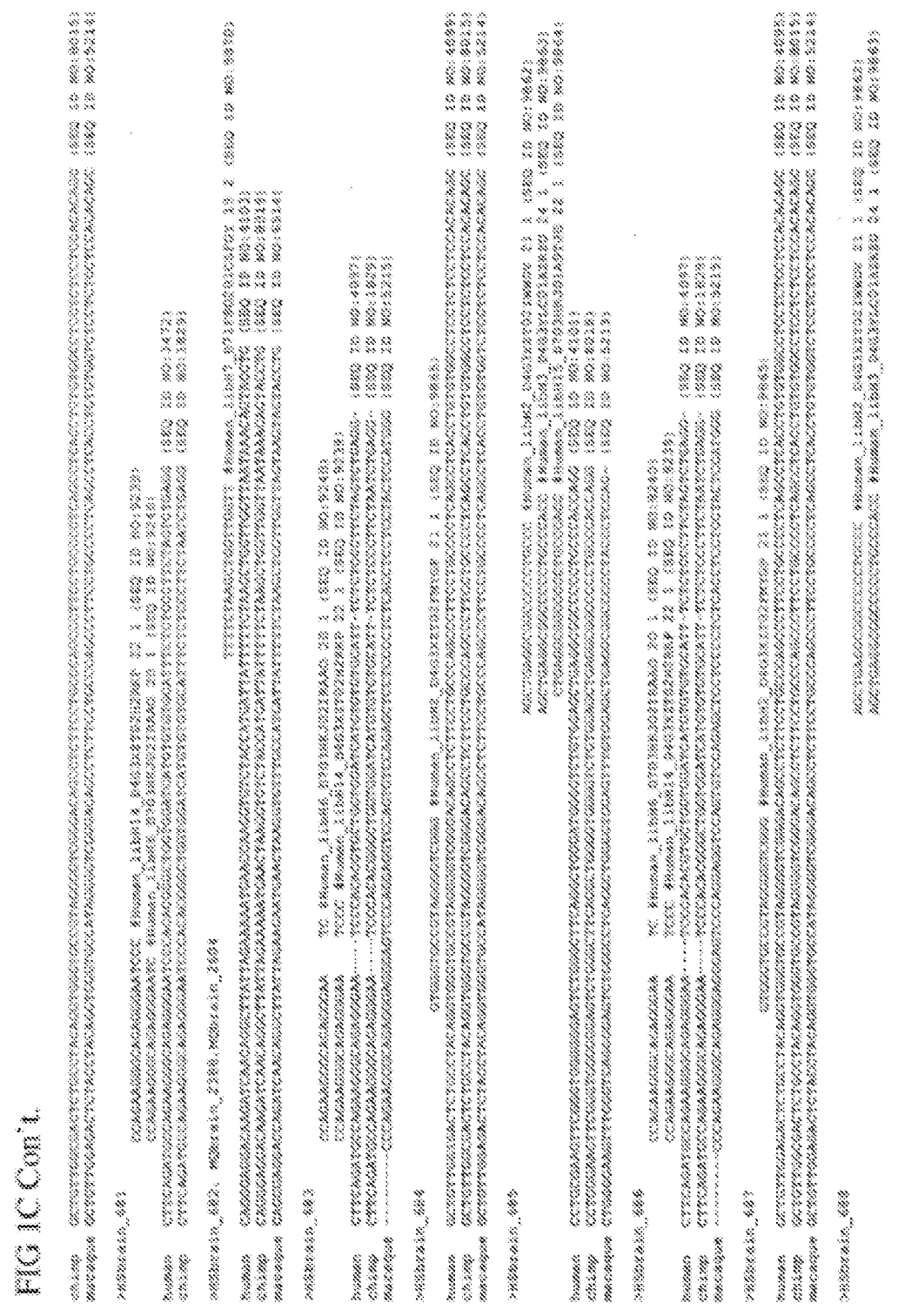
Figure 1C:
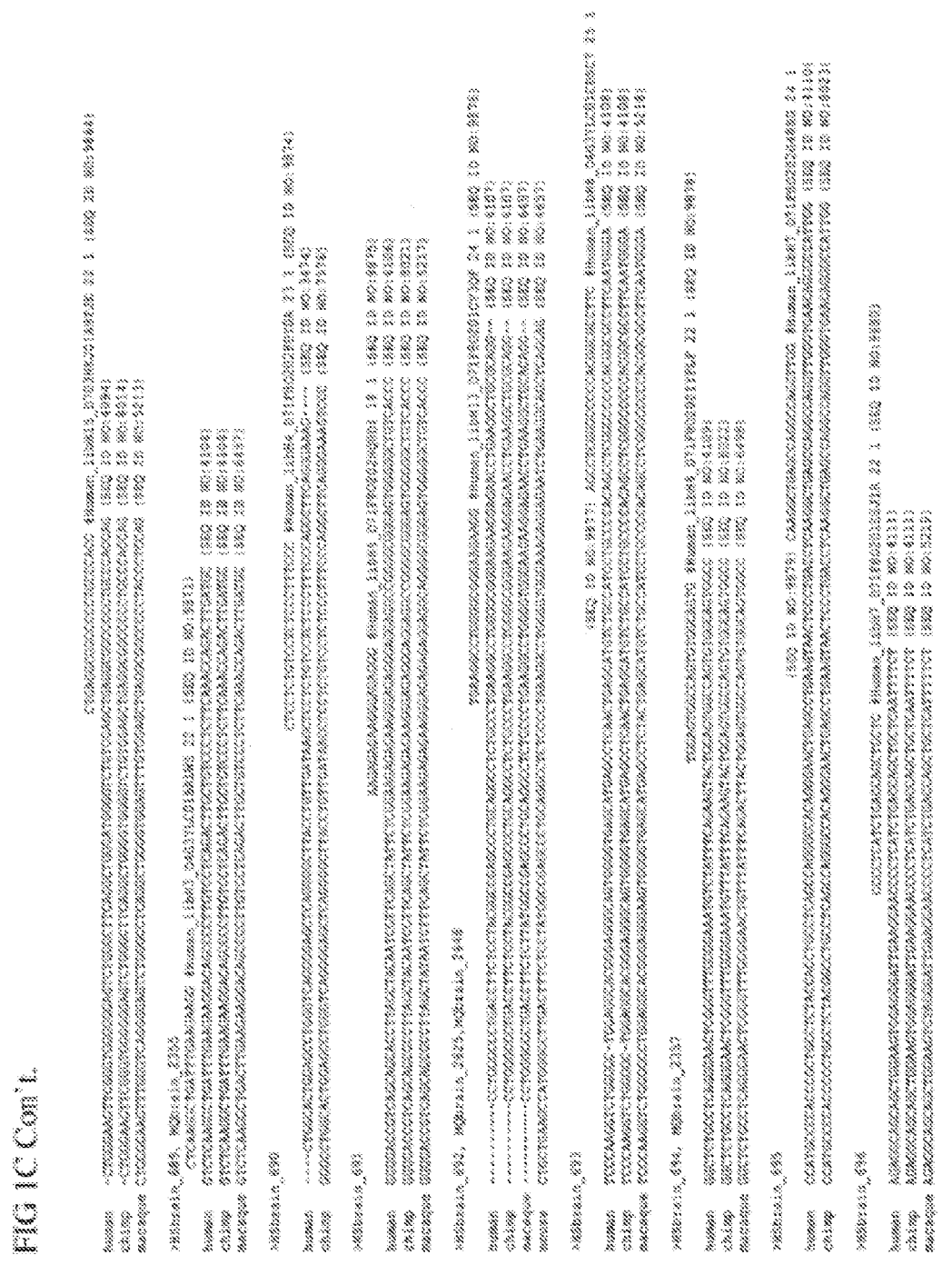
Figure 1C:
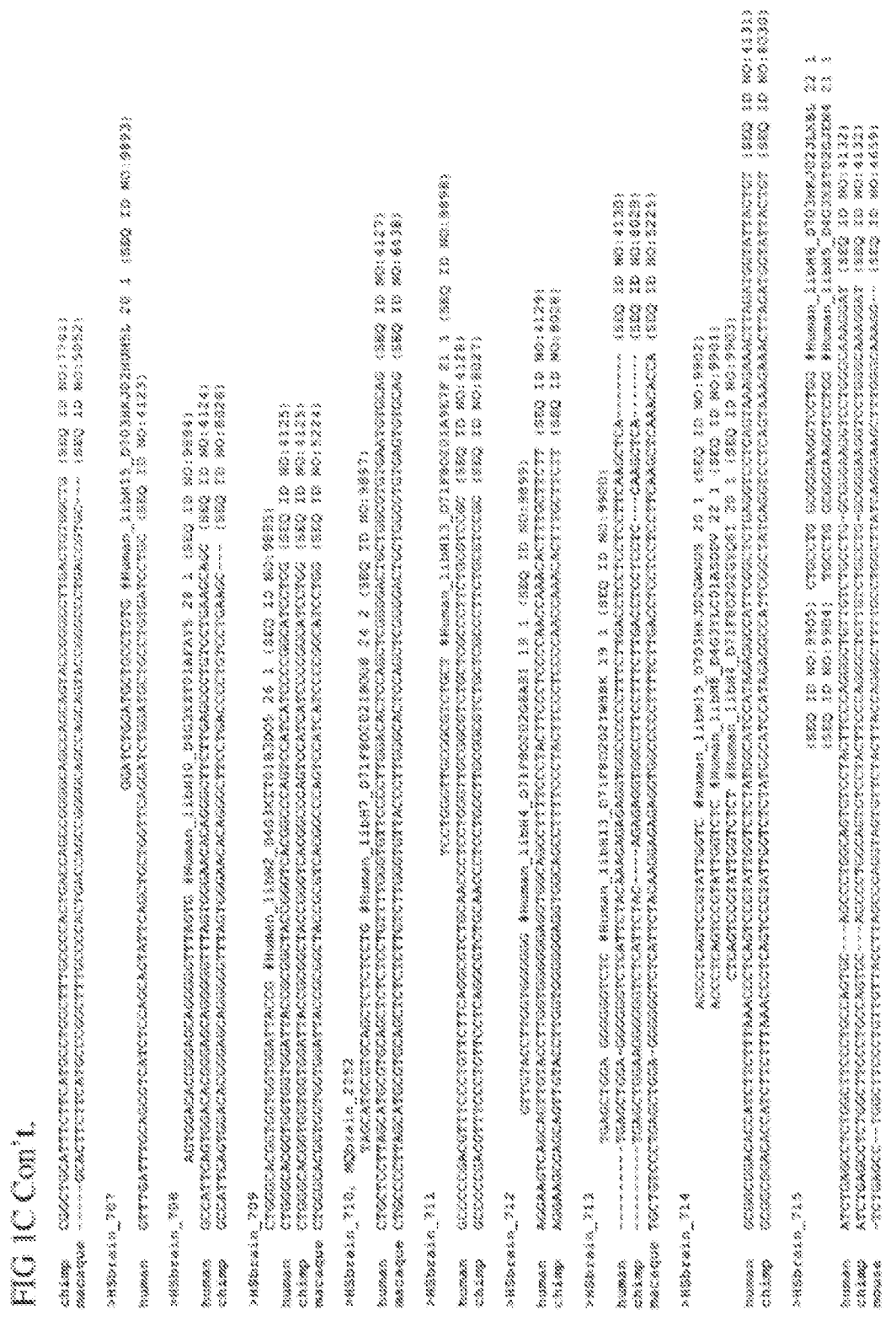
Figure 1C:
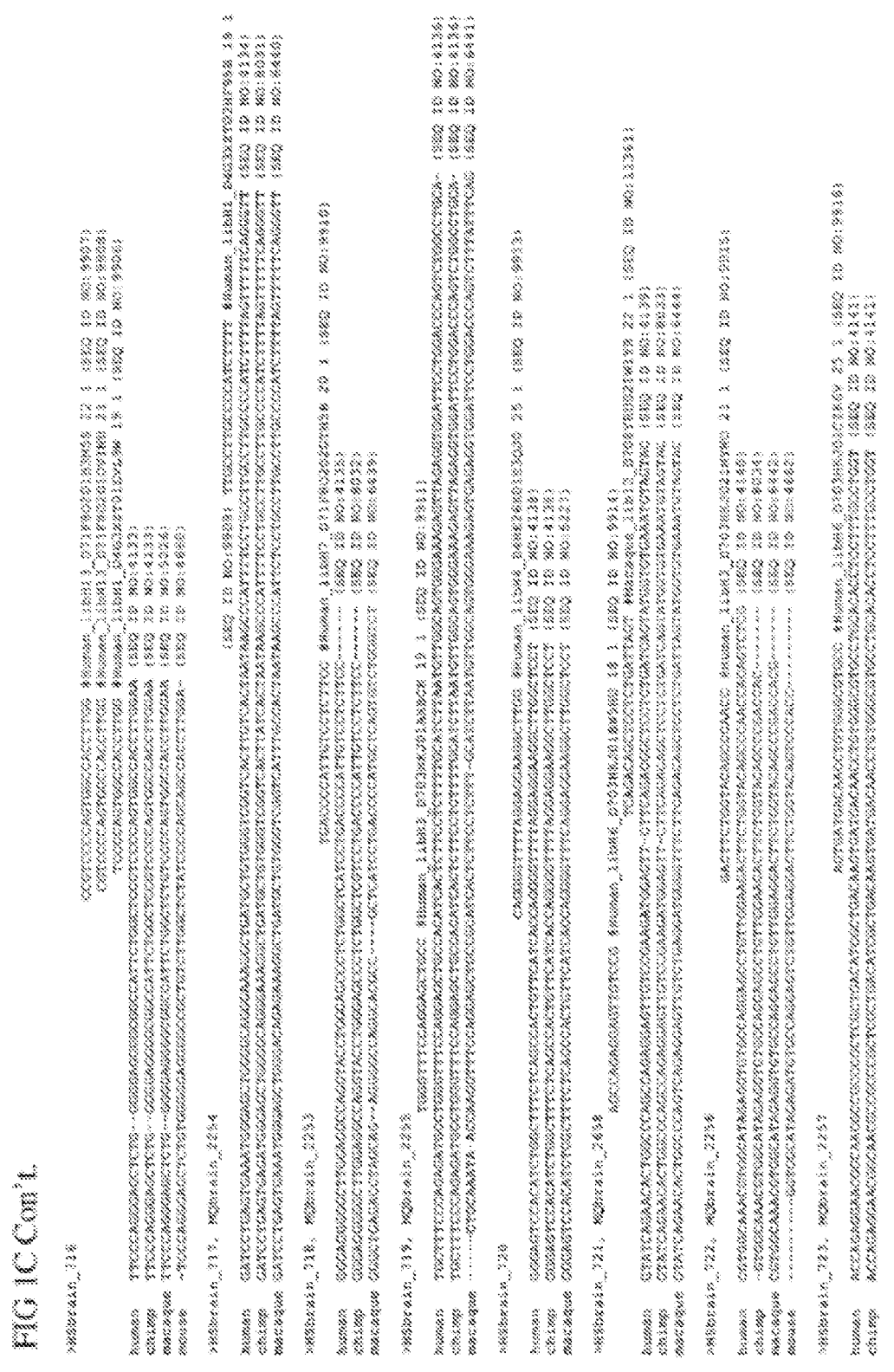
Figure 1C:
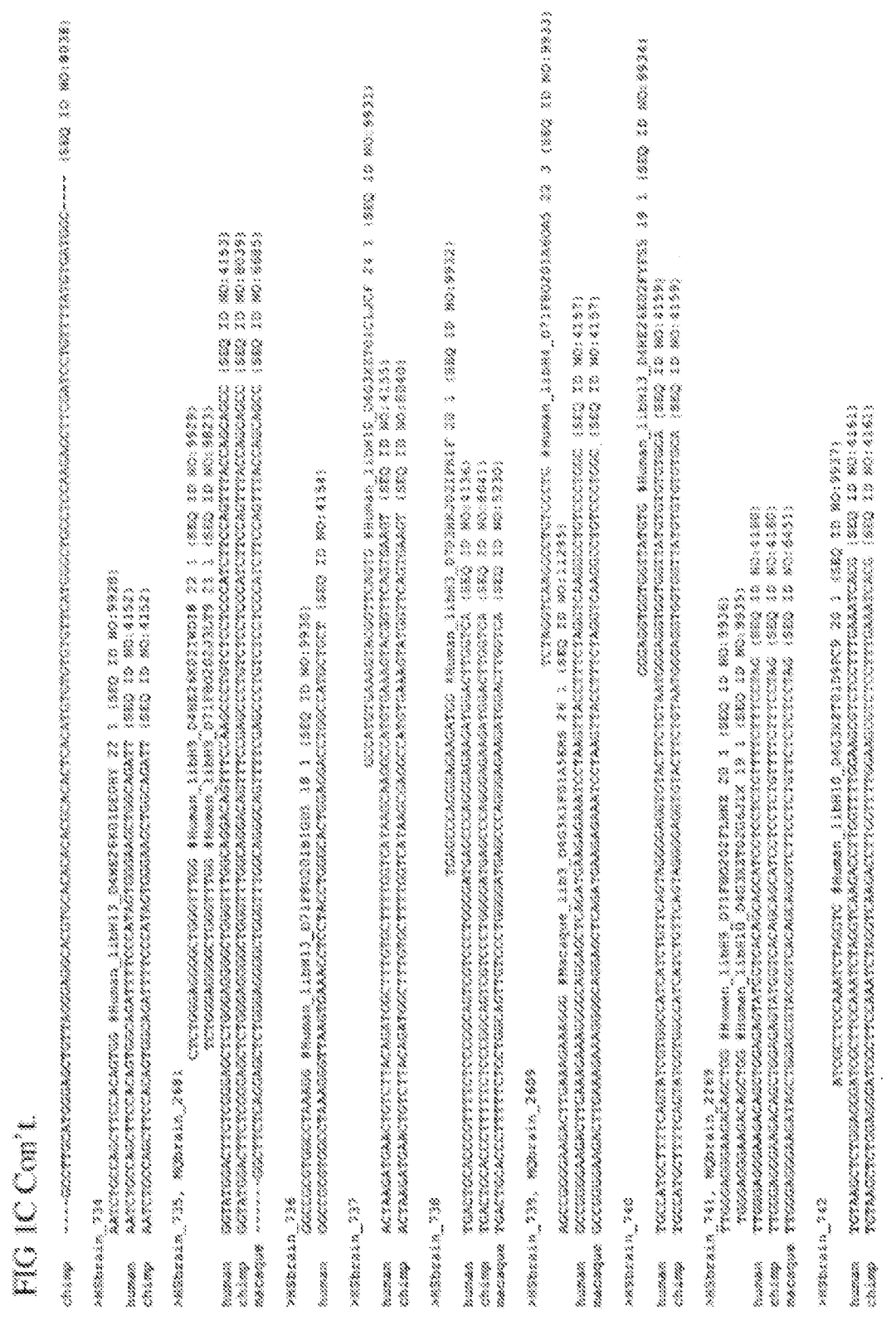
Figure 1C:
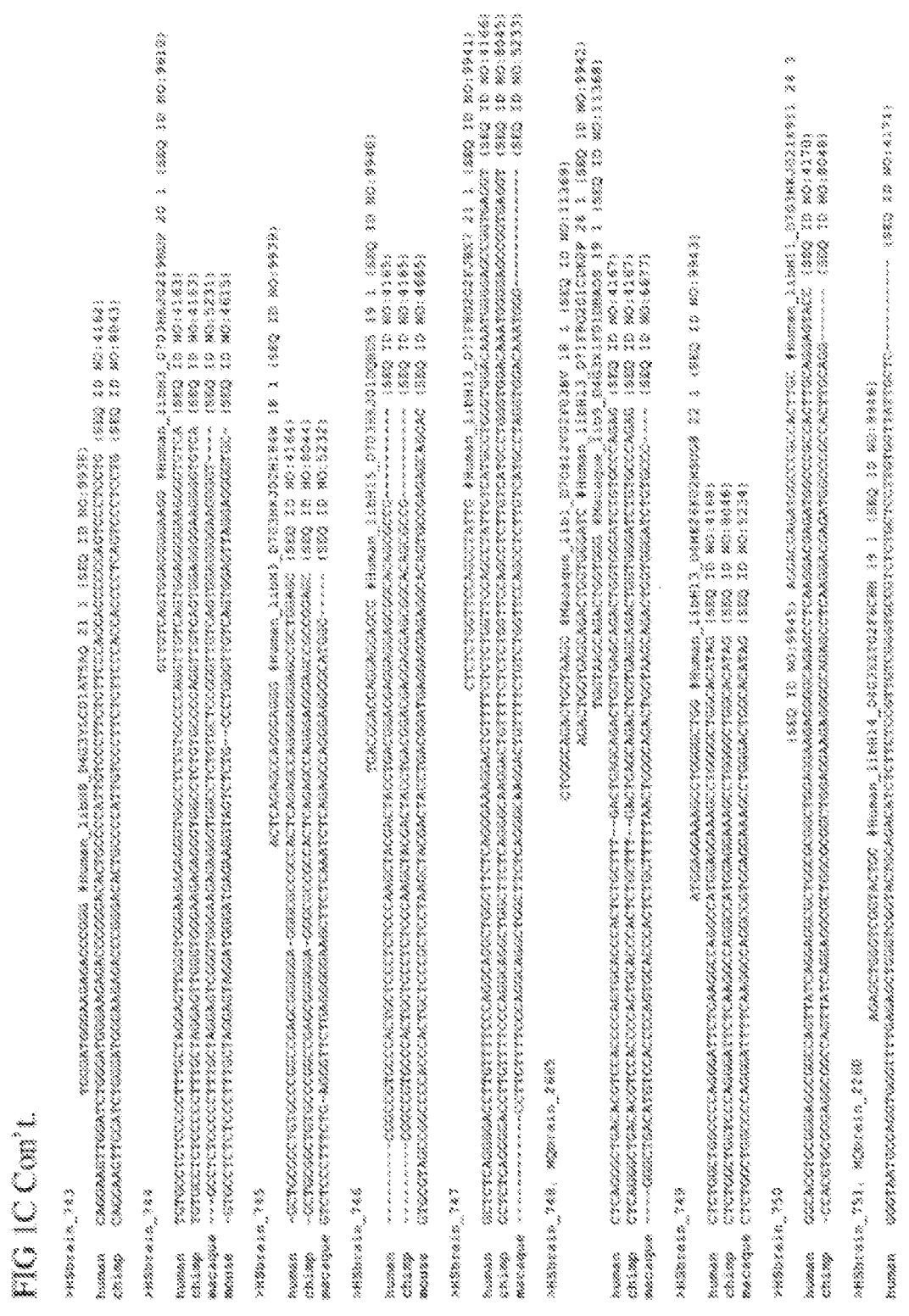
Figure 1C:
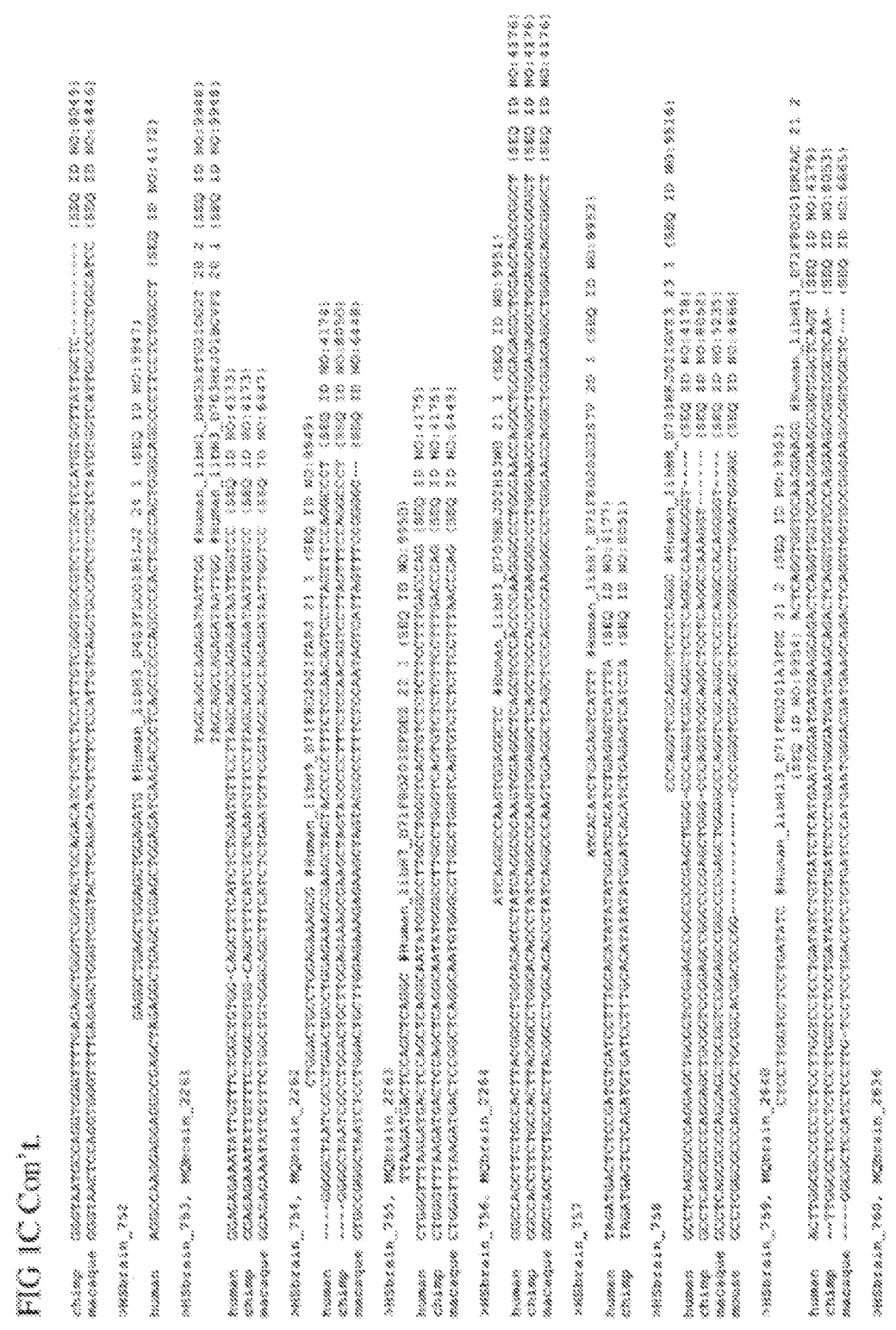
Figure 1C:
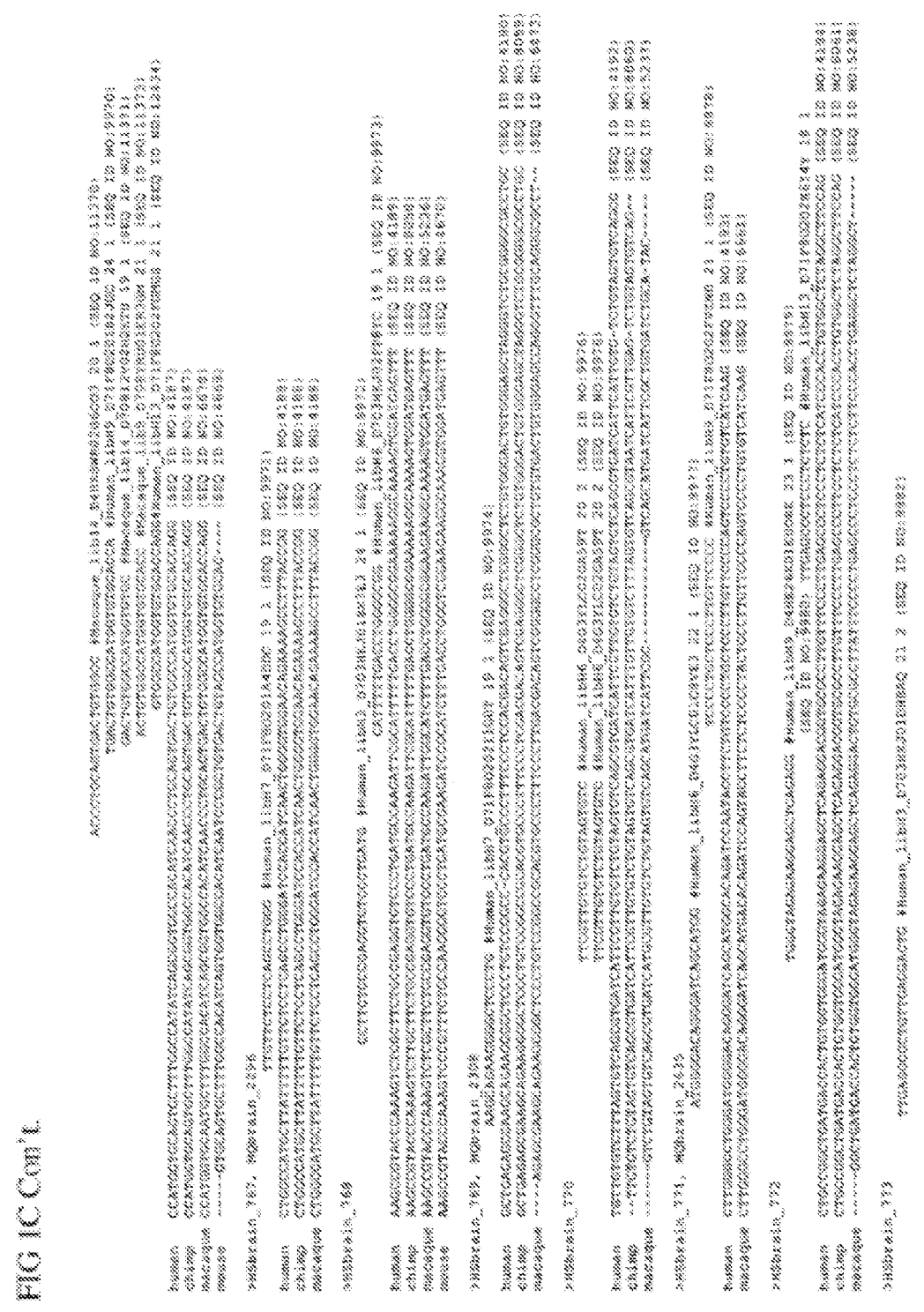
Figure 1C:
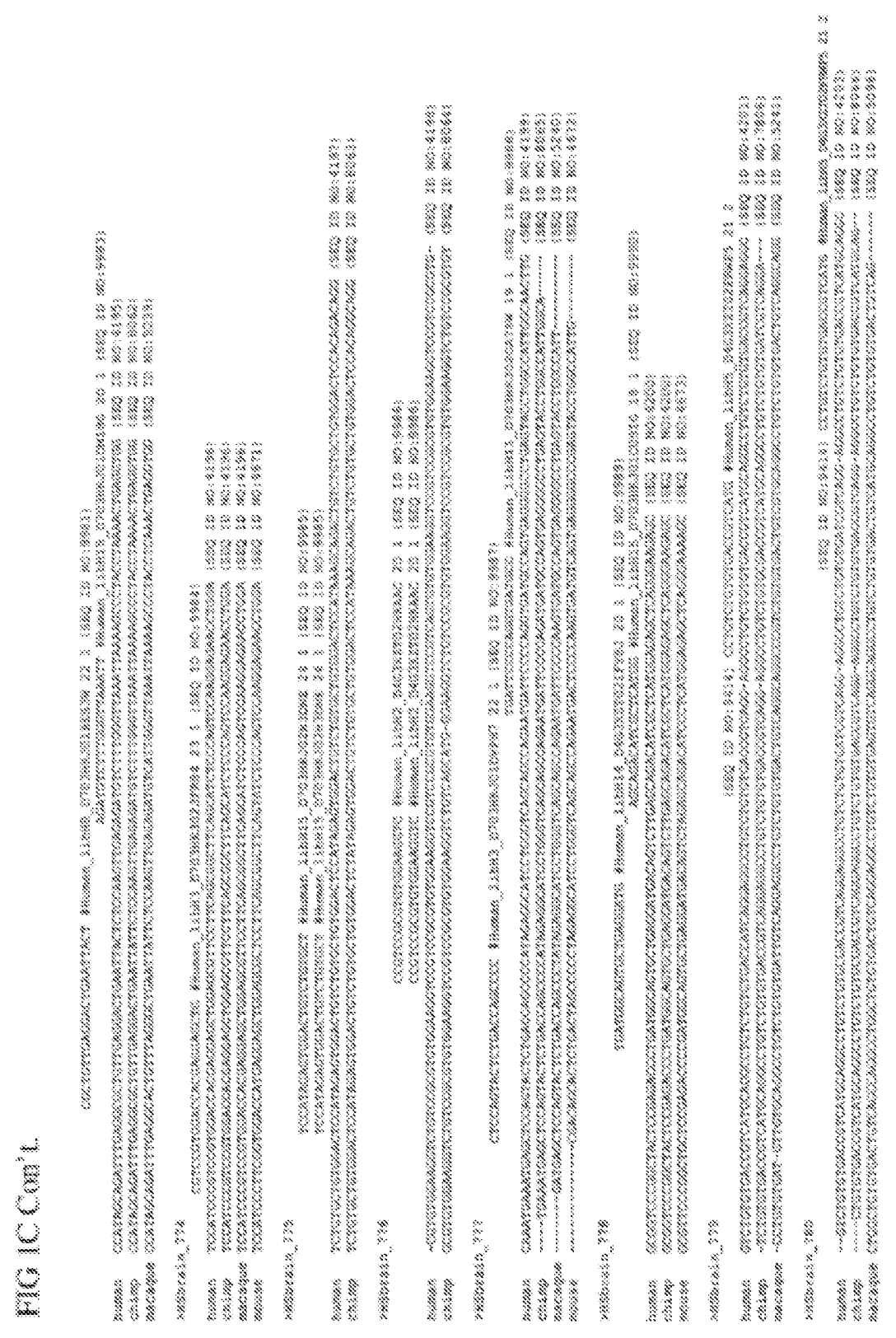
Figure 1C:
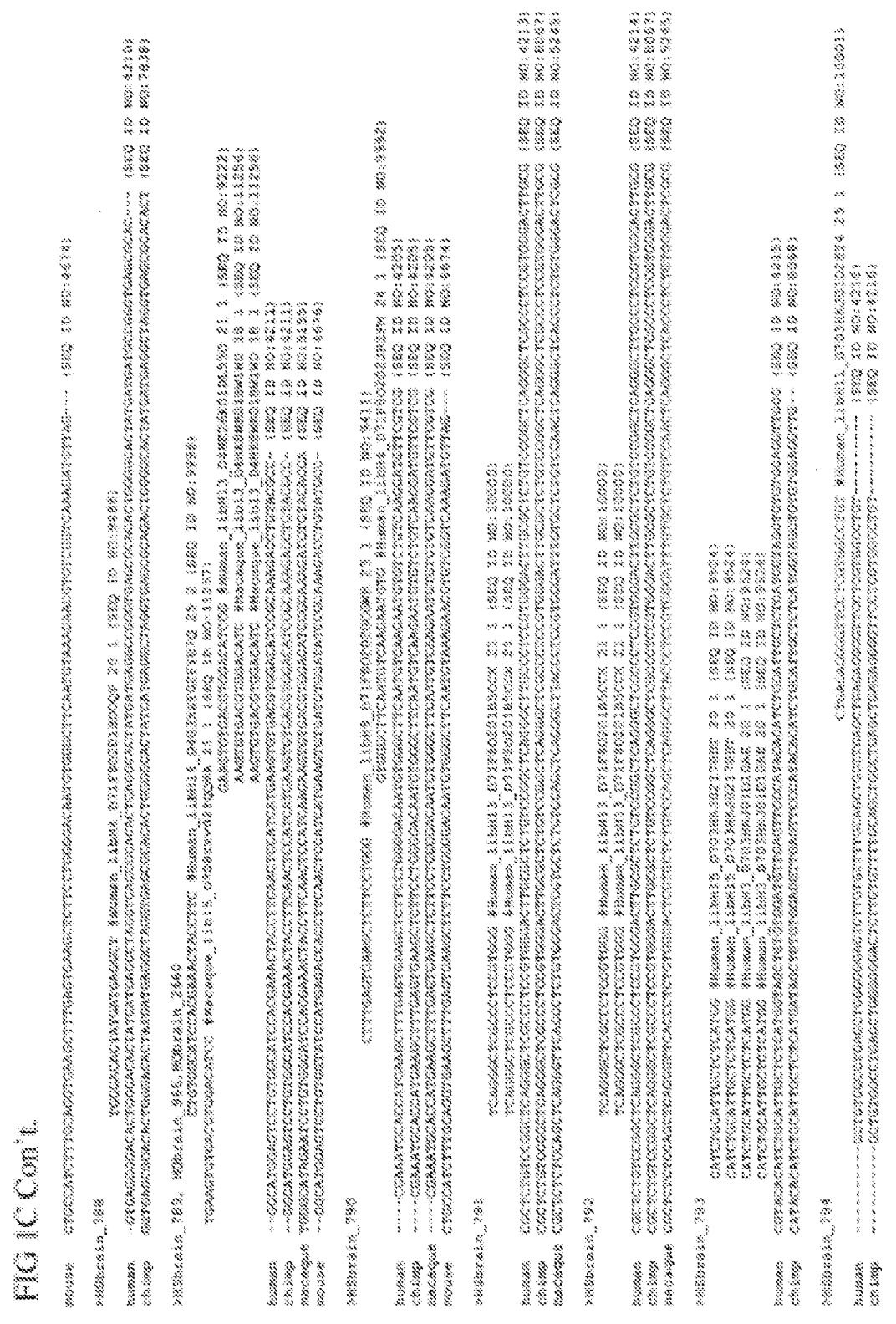
Figure 1C:
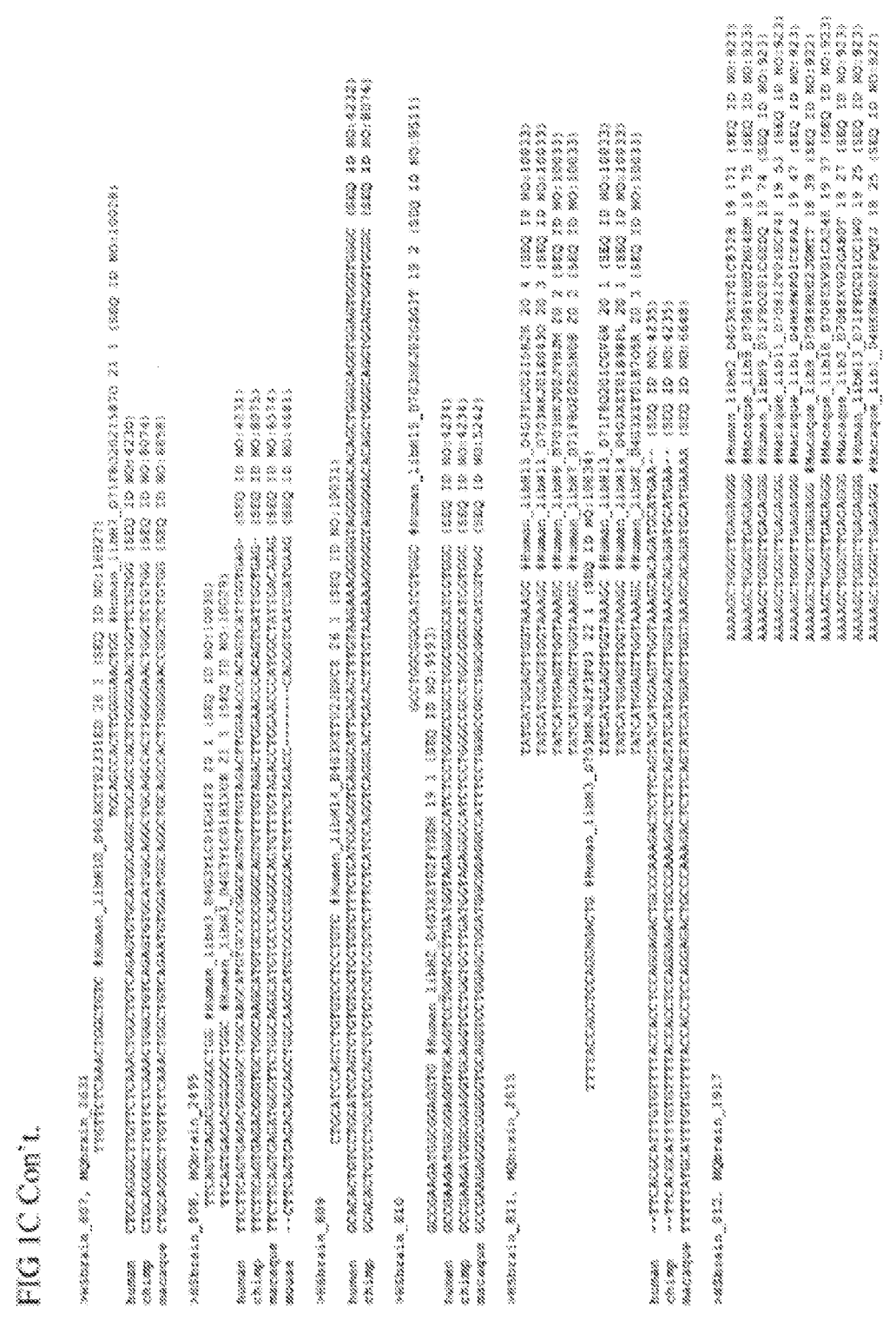
Figure 1C:
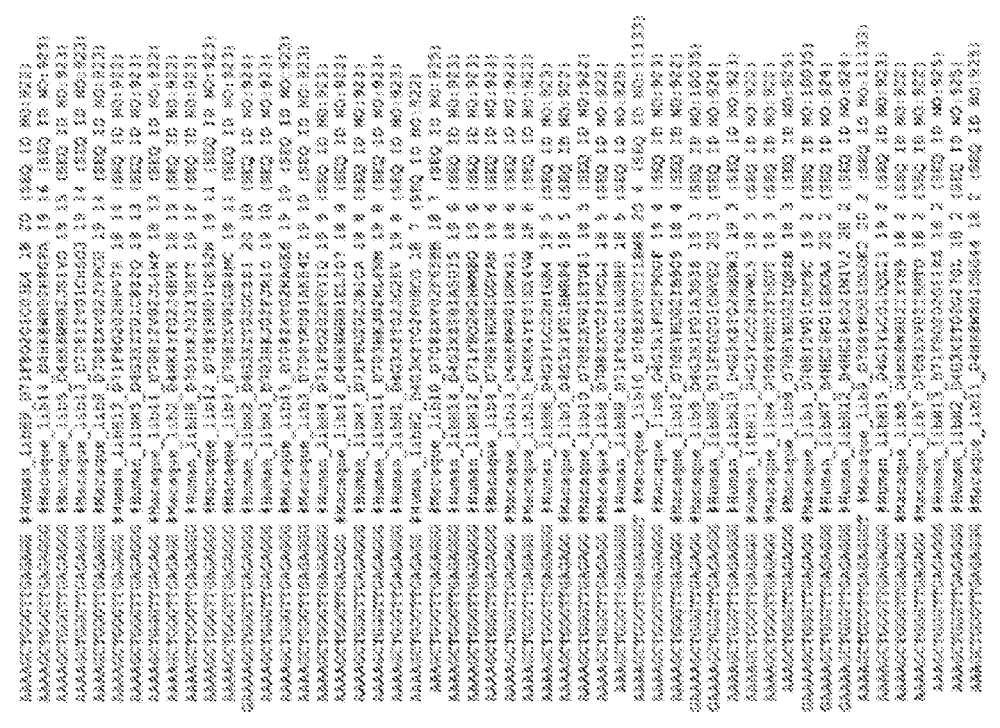
Figure 1C:
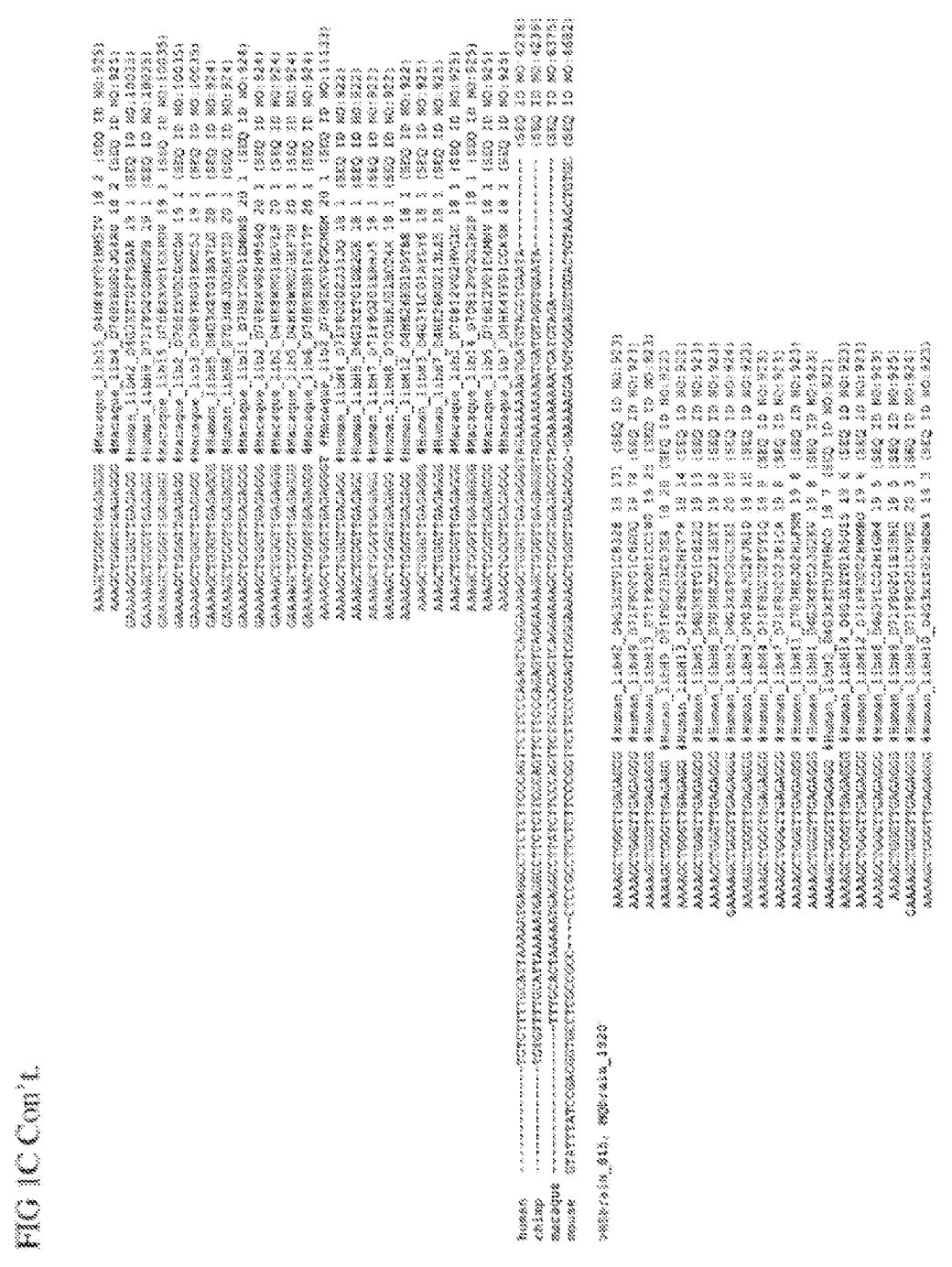
Figure 1C:
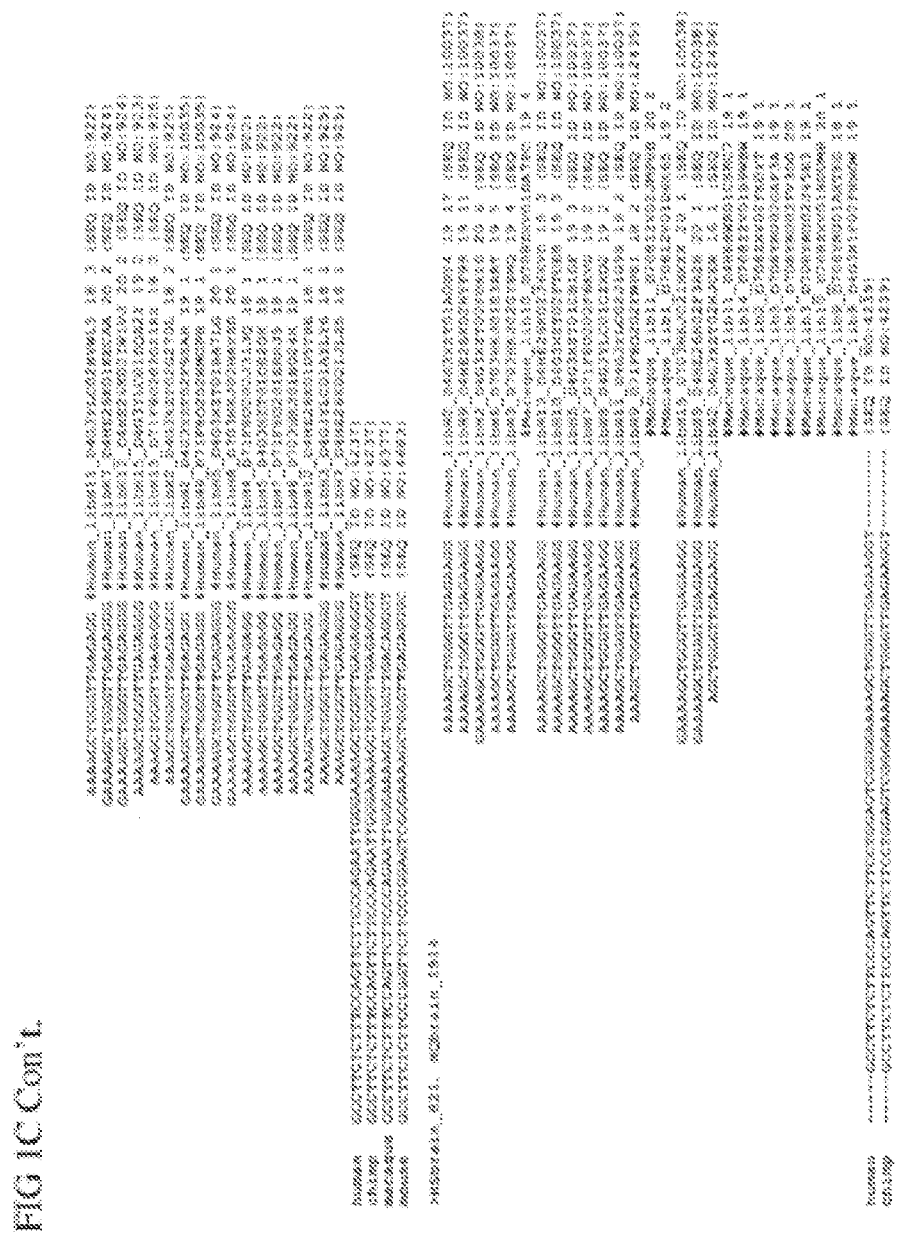
Figure 1C:
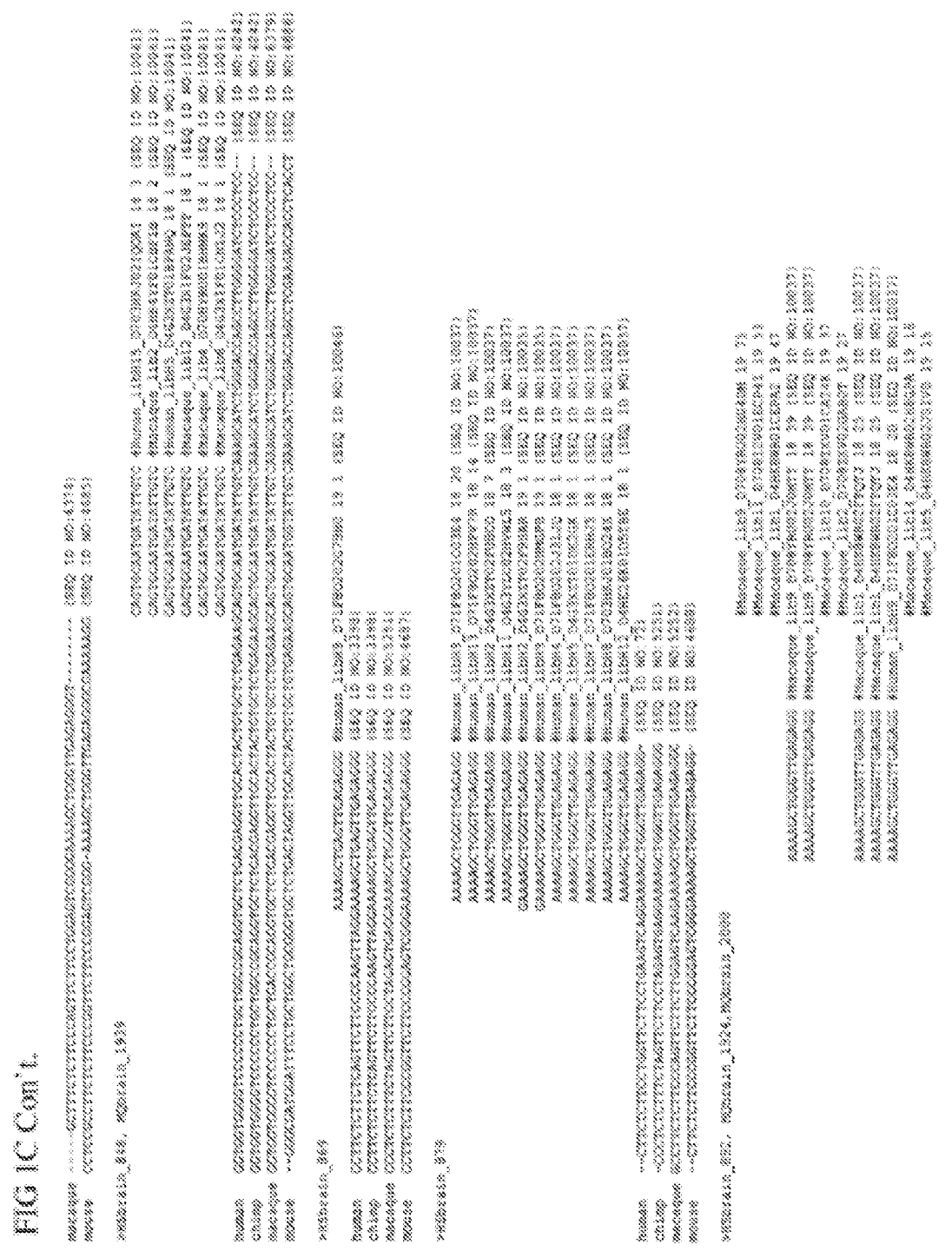
Figure 1C:
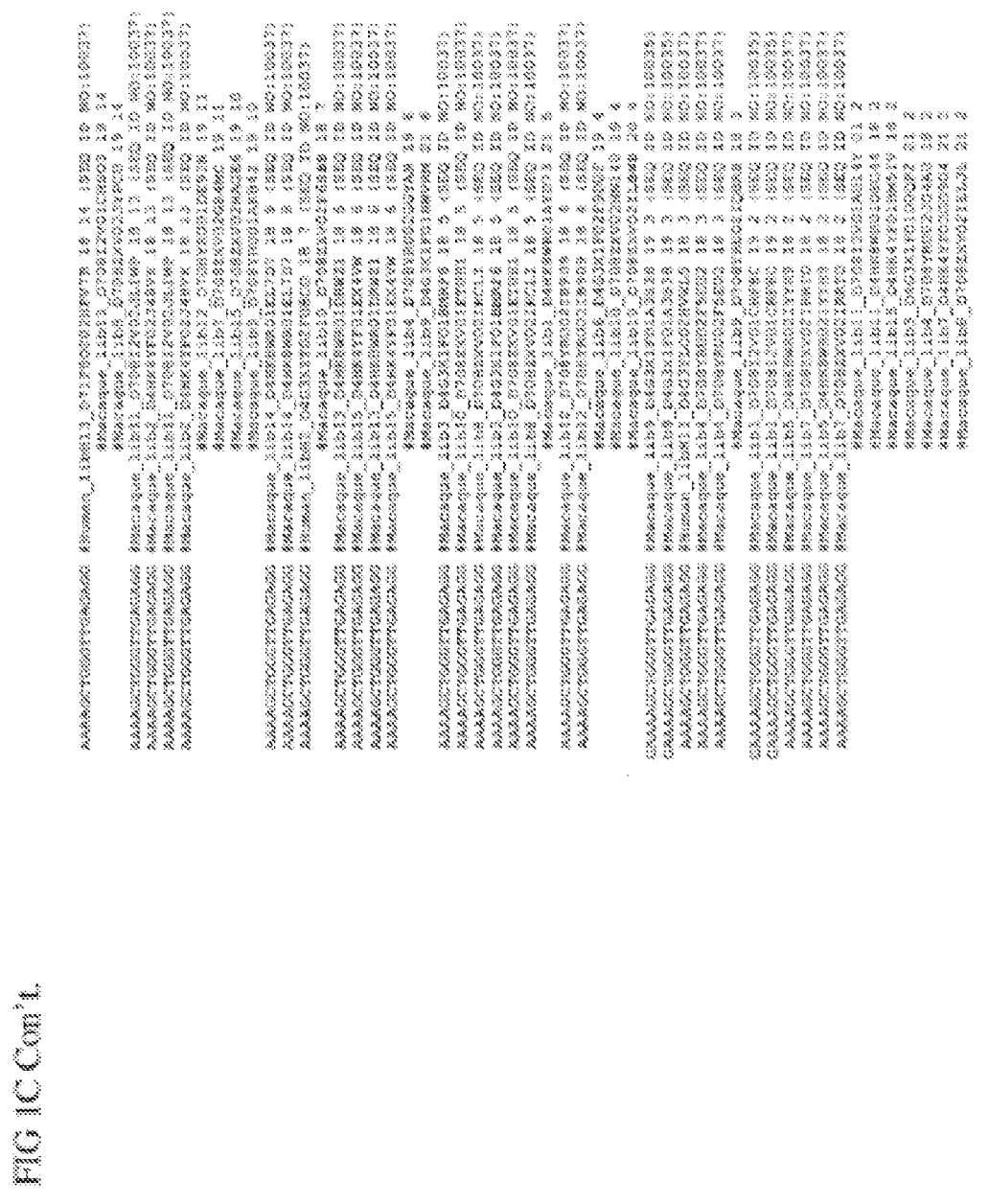
Figure 1C:
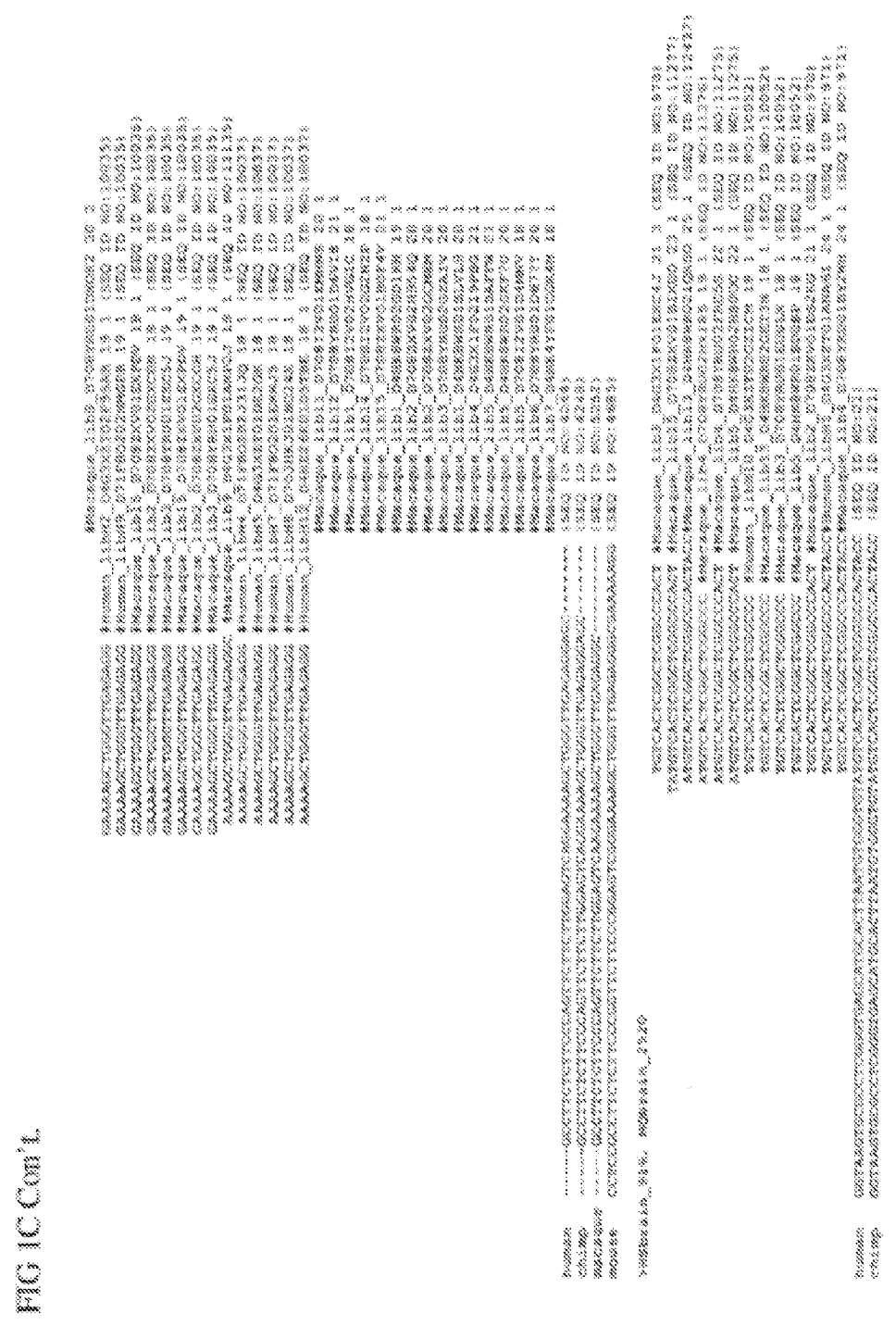
Figure 1C:
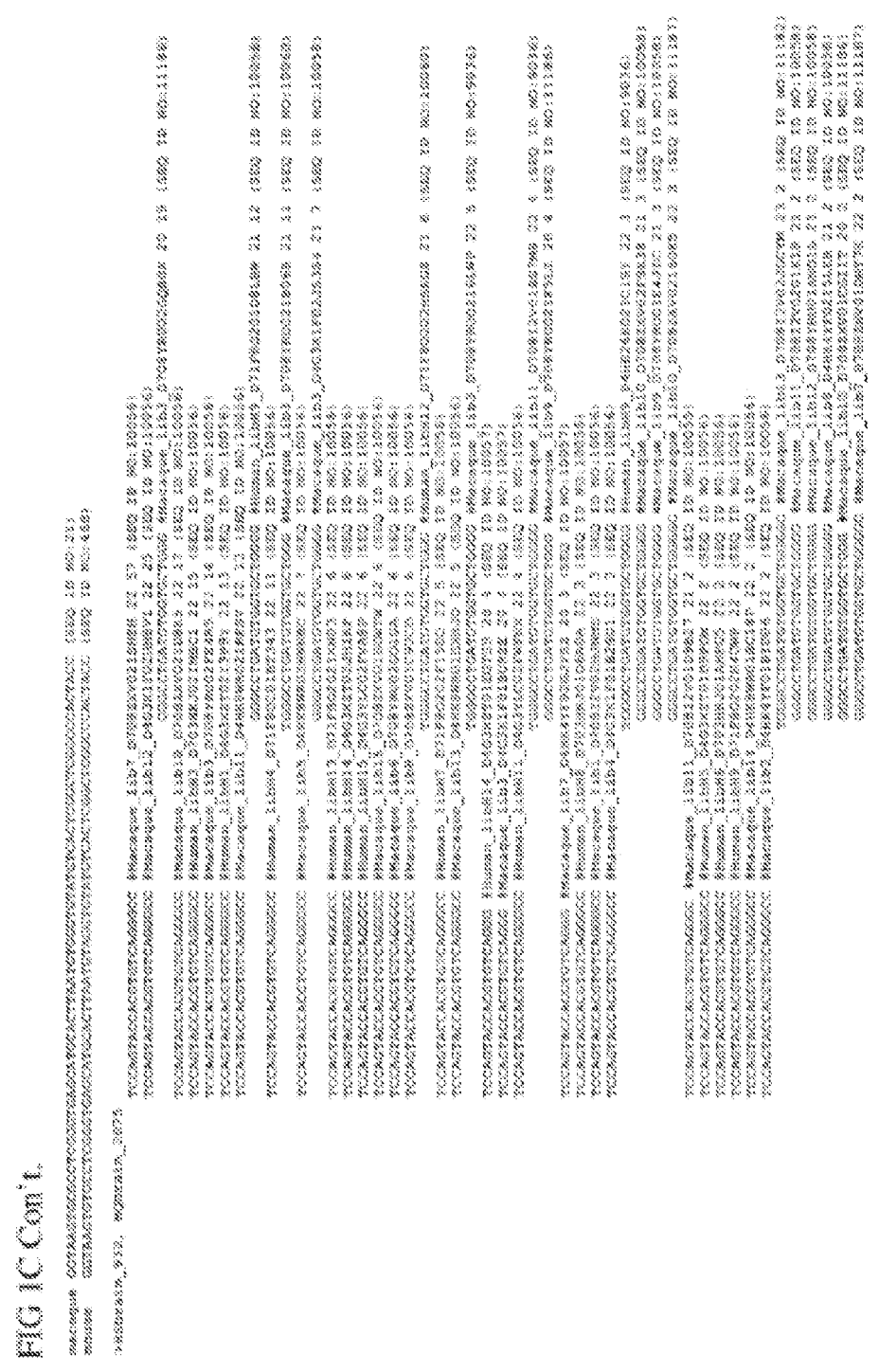
Figure 1C:
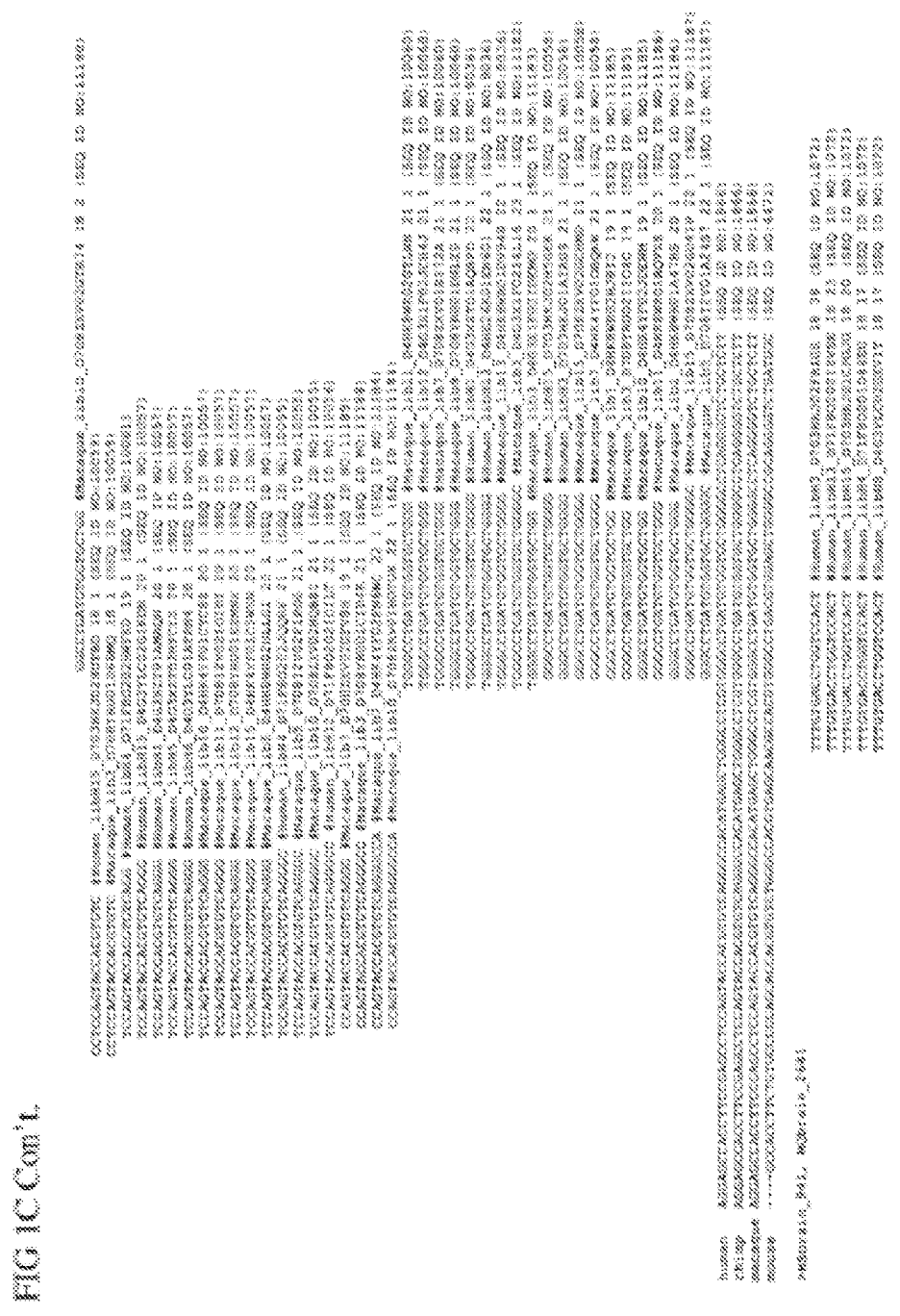
Figure 1C:
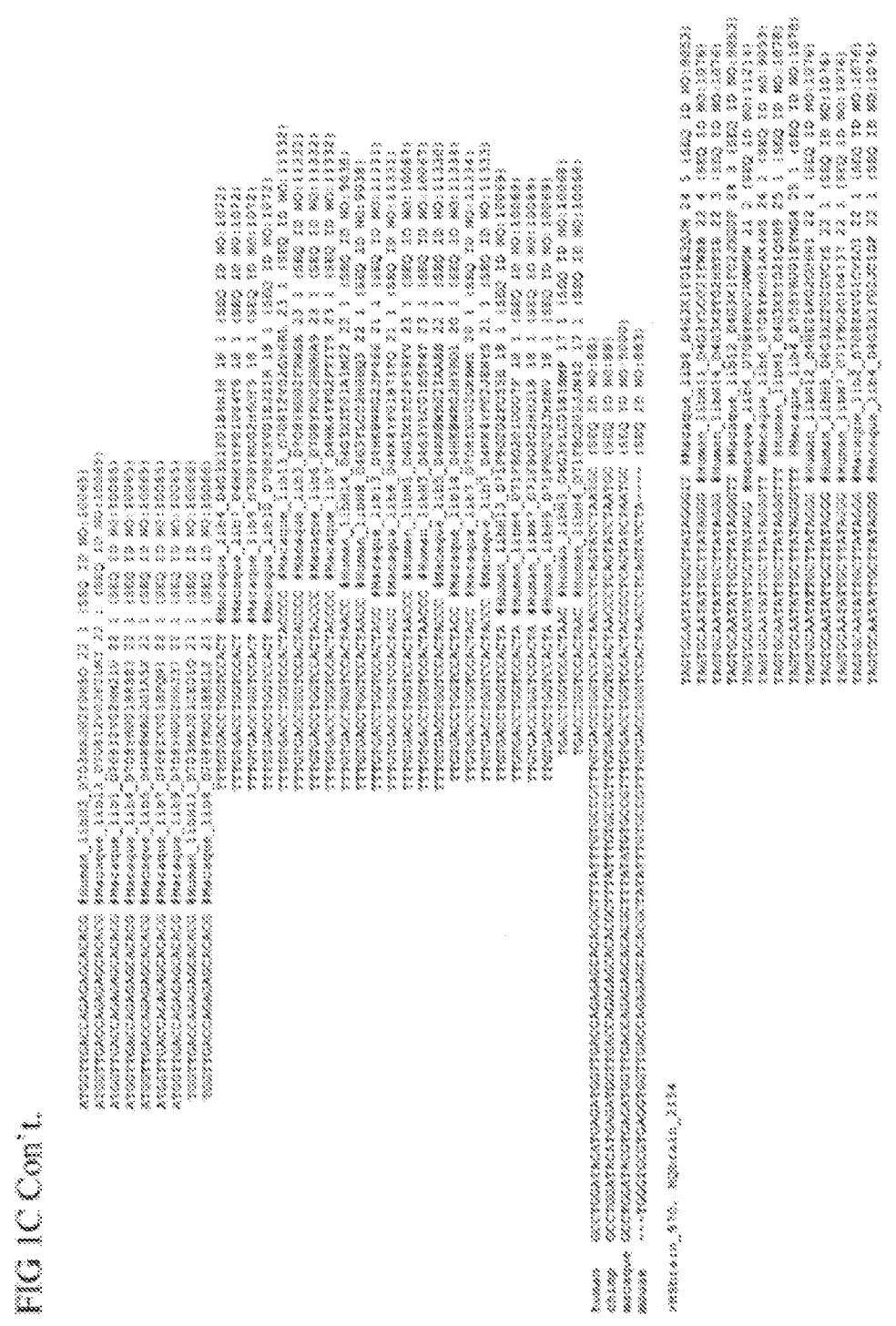
Figure 1C:
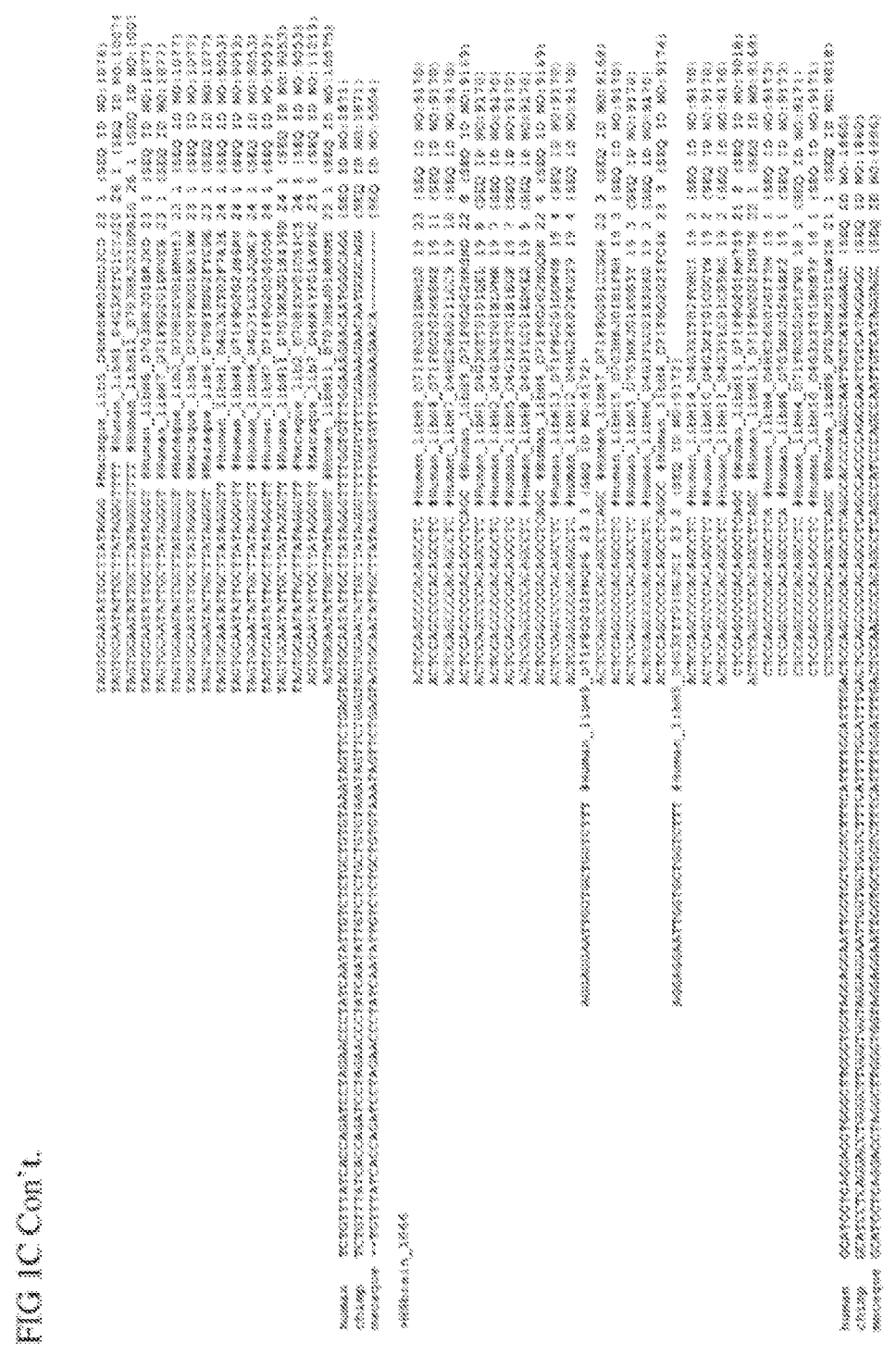
Figure 1C:
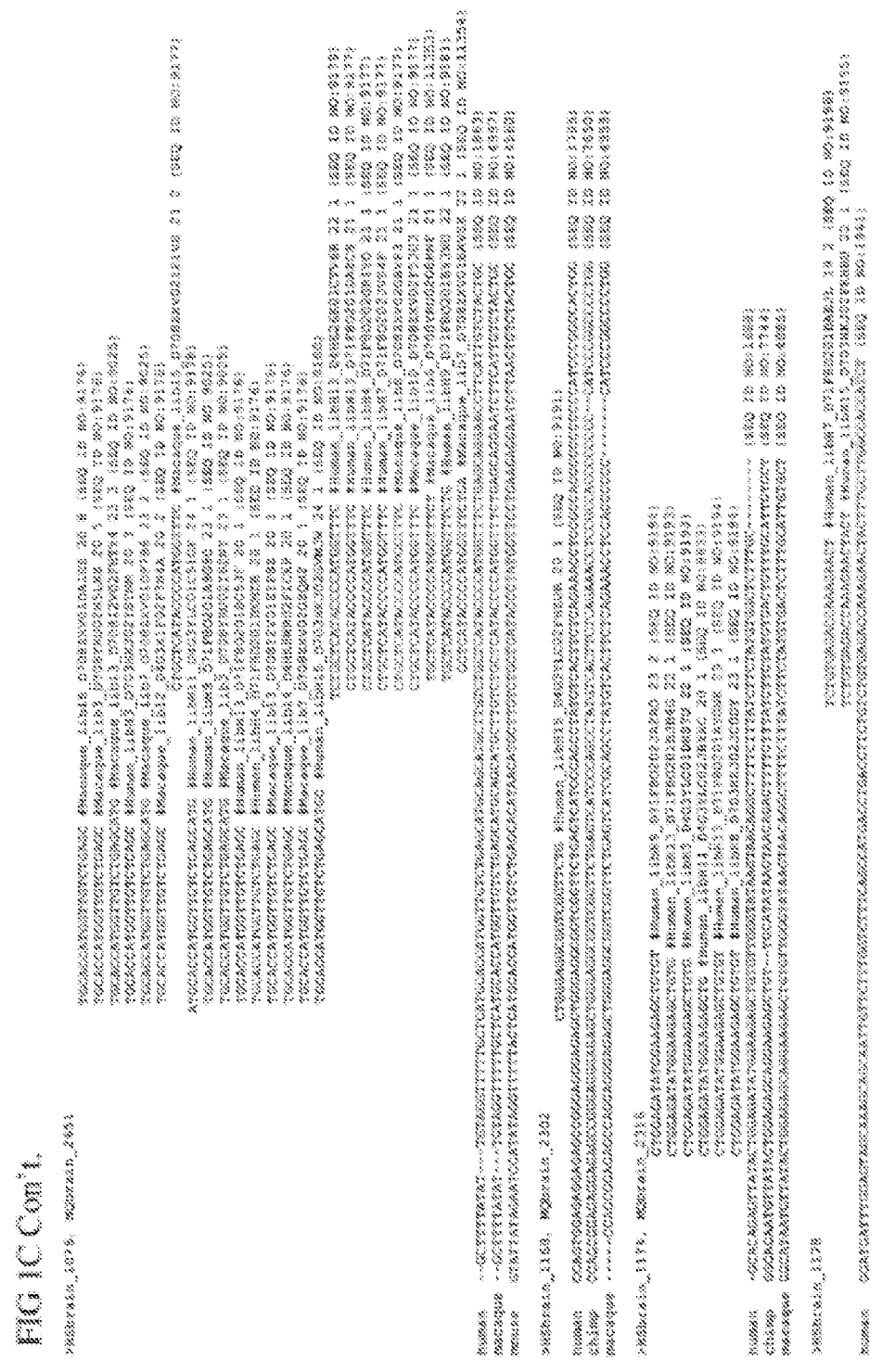
Figure 1C:
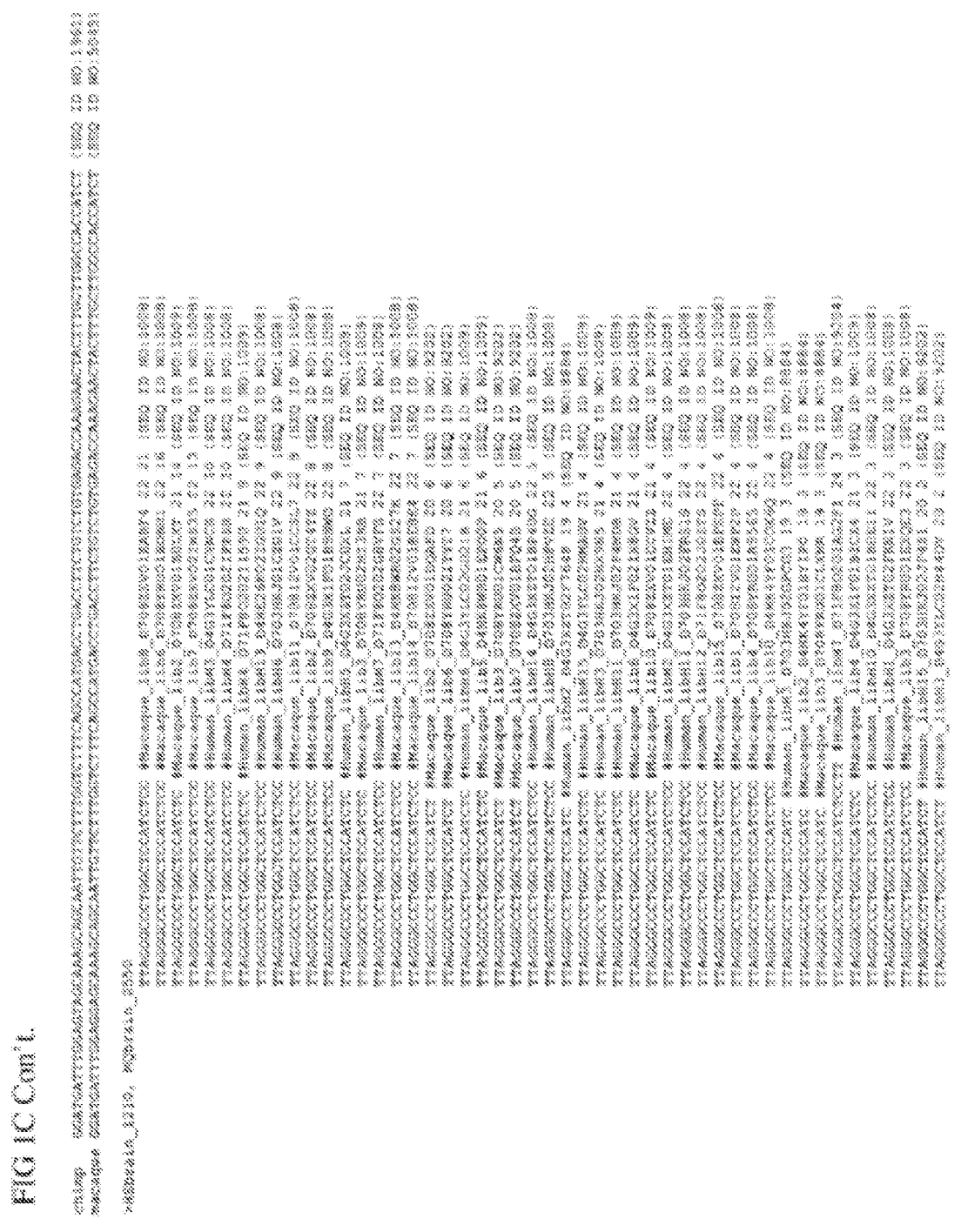
Figure 1C:
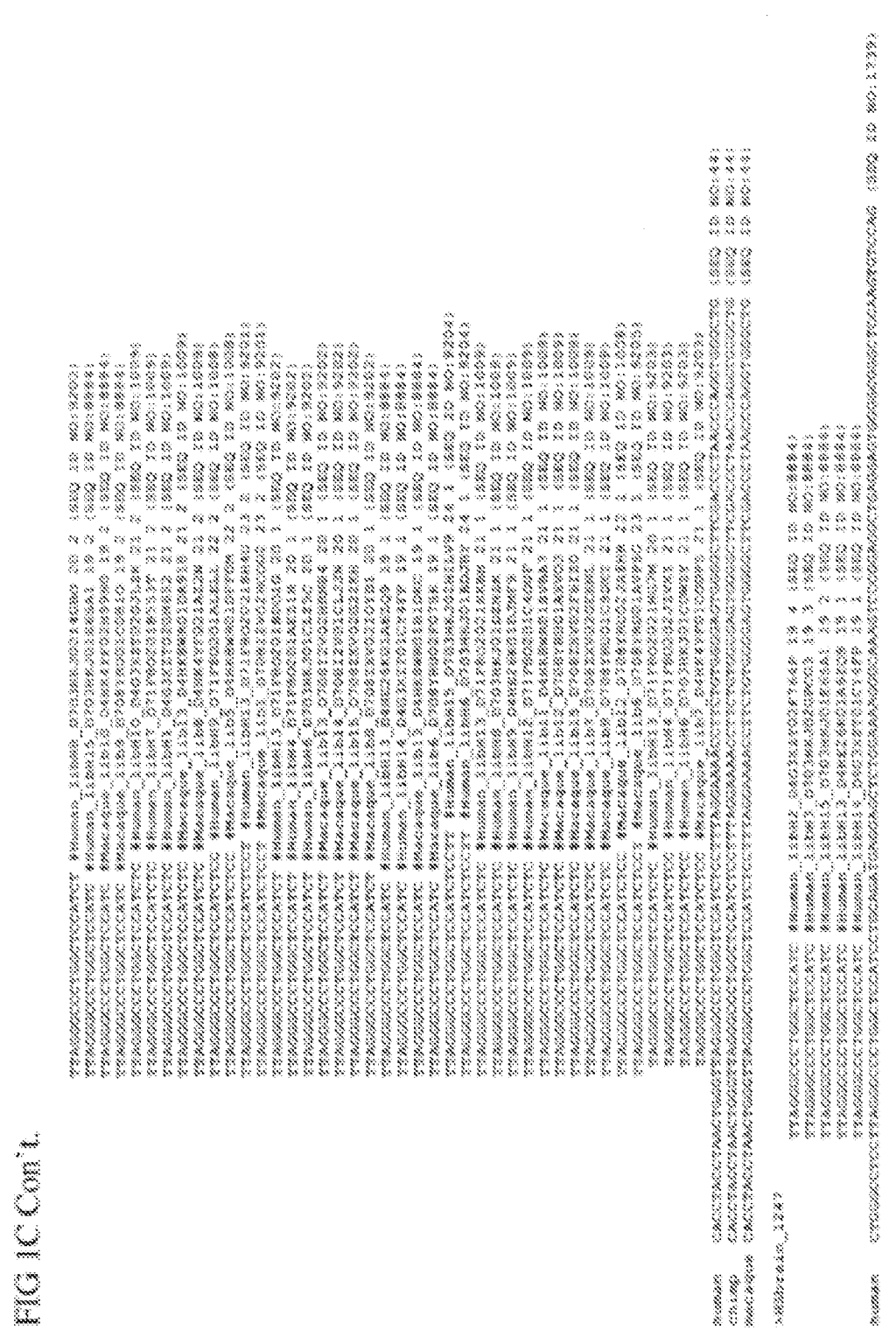
Figure 1C:
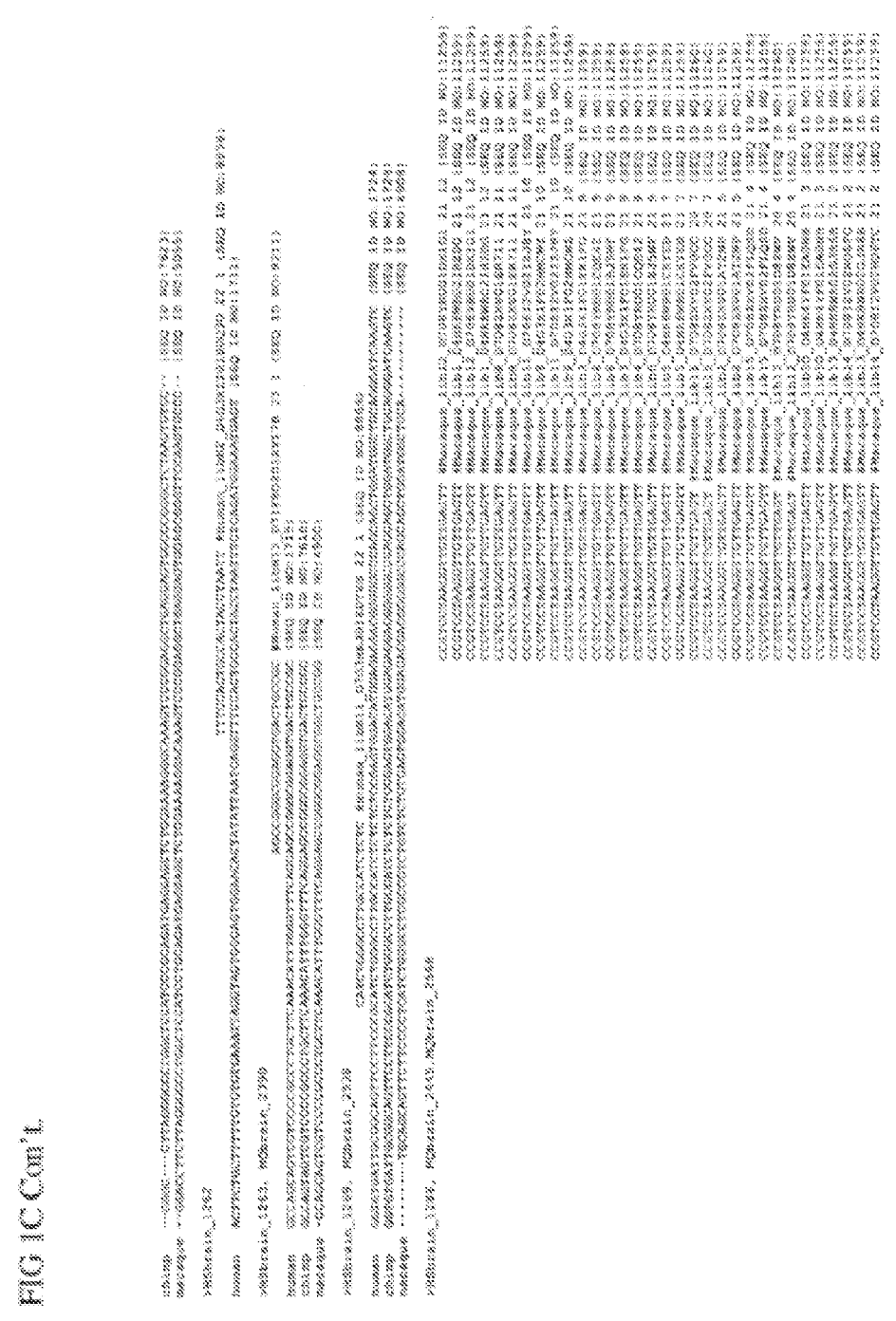
Figure 1C:
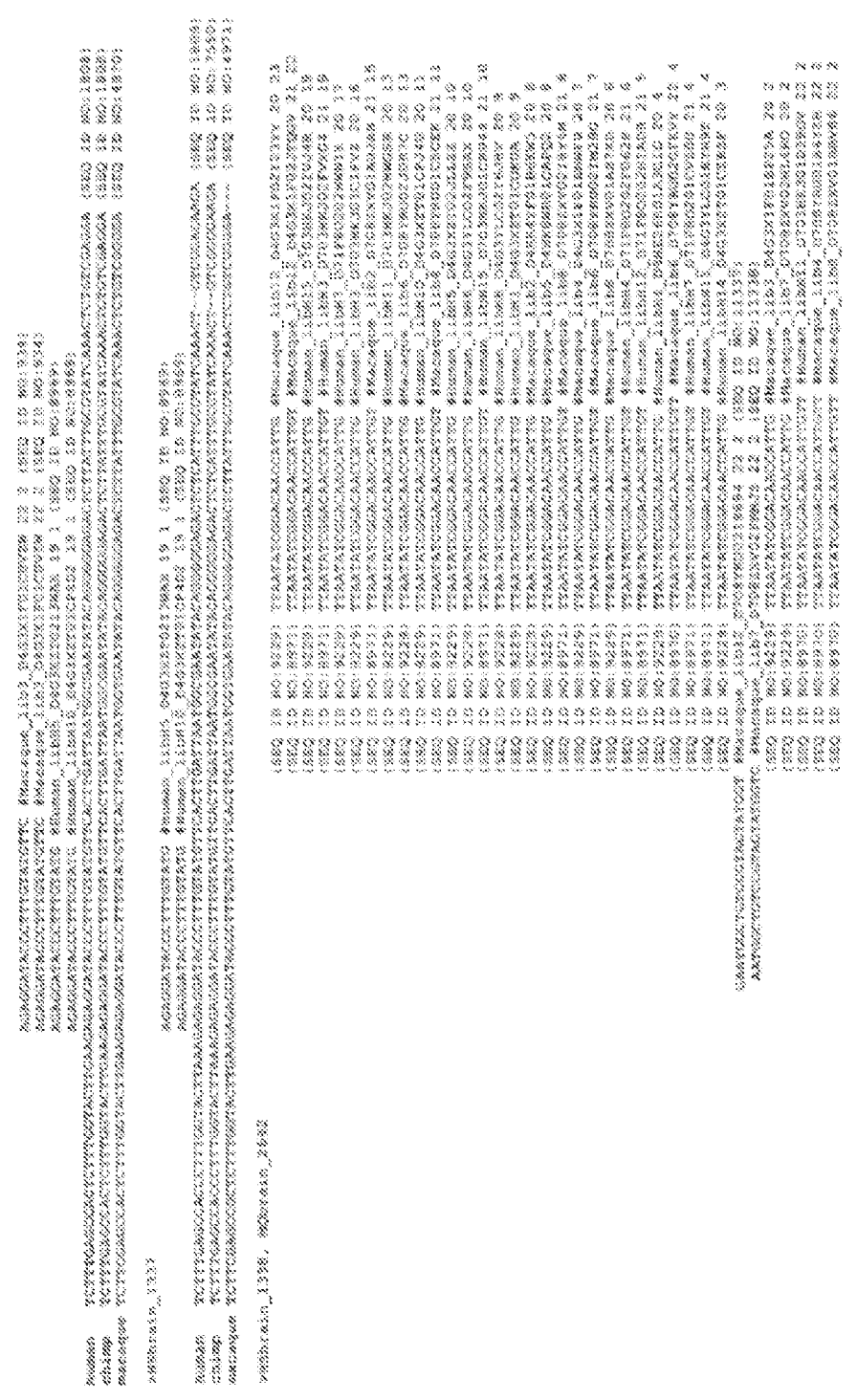
Figure 1C:
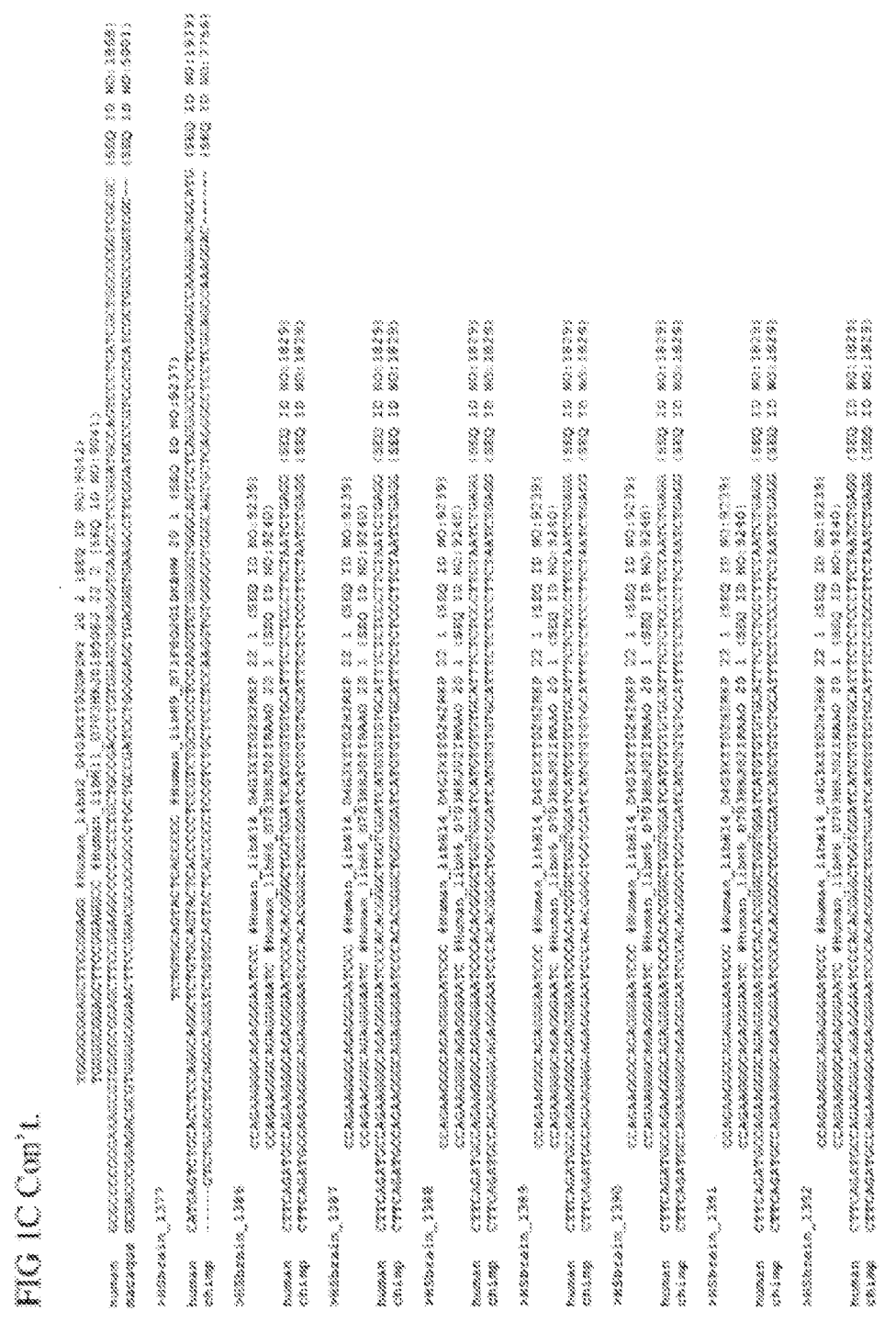
Figure 1C:
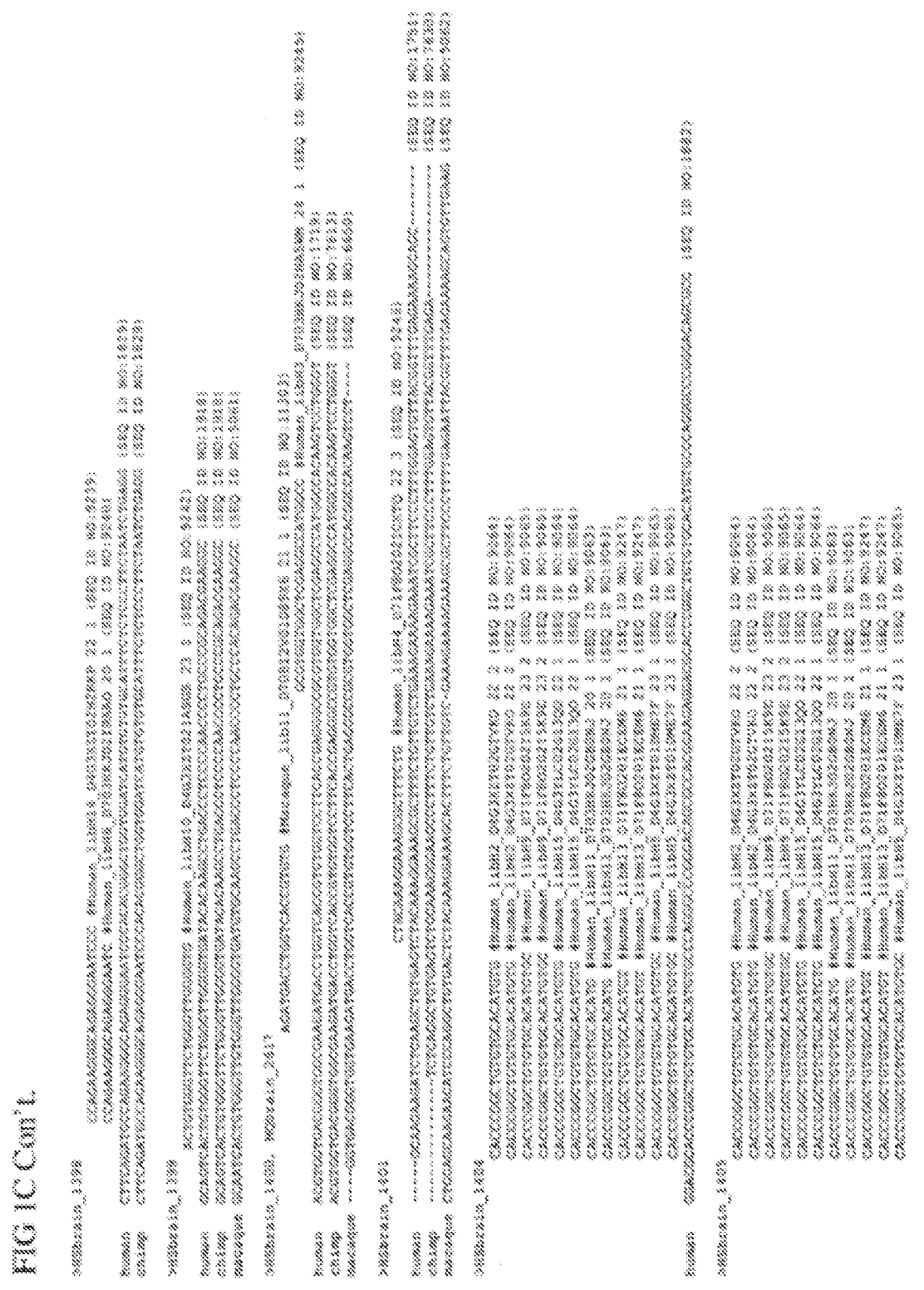
Figure 1C:
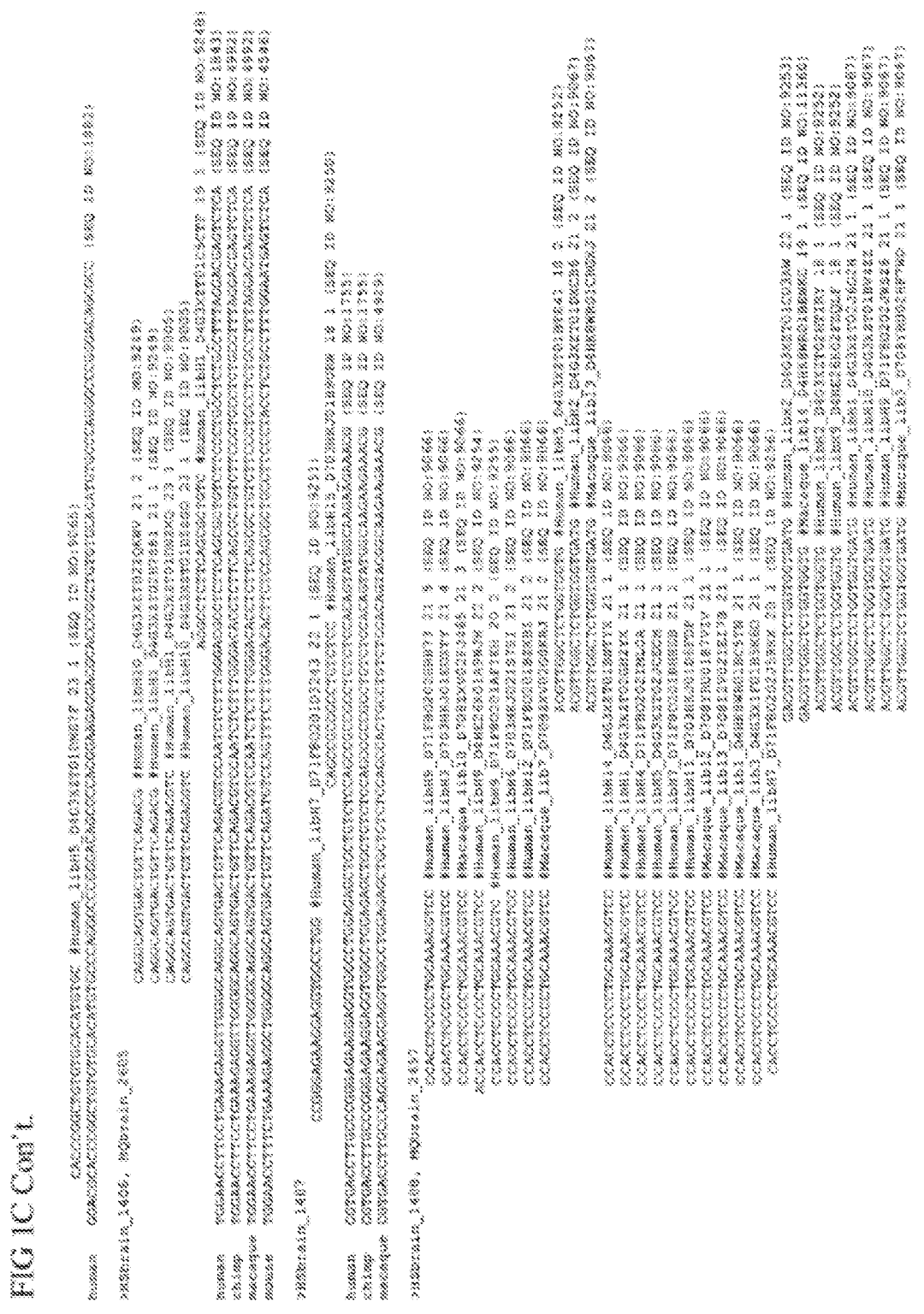
Figure 1C:
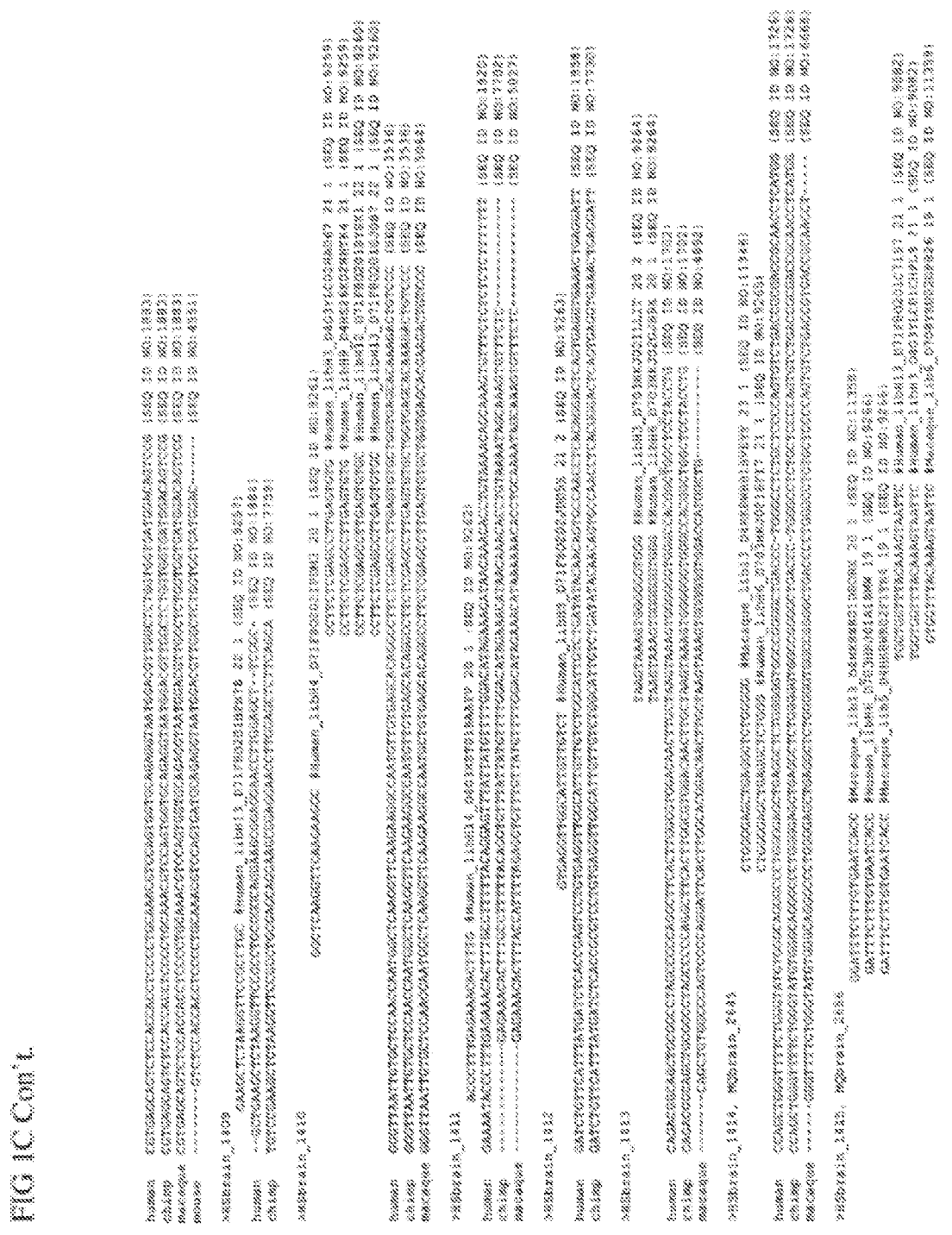
Figure 1C:
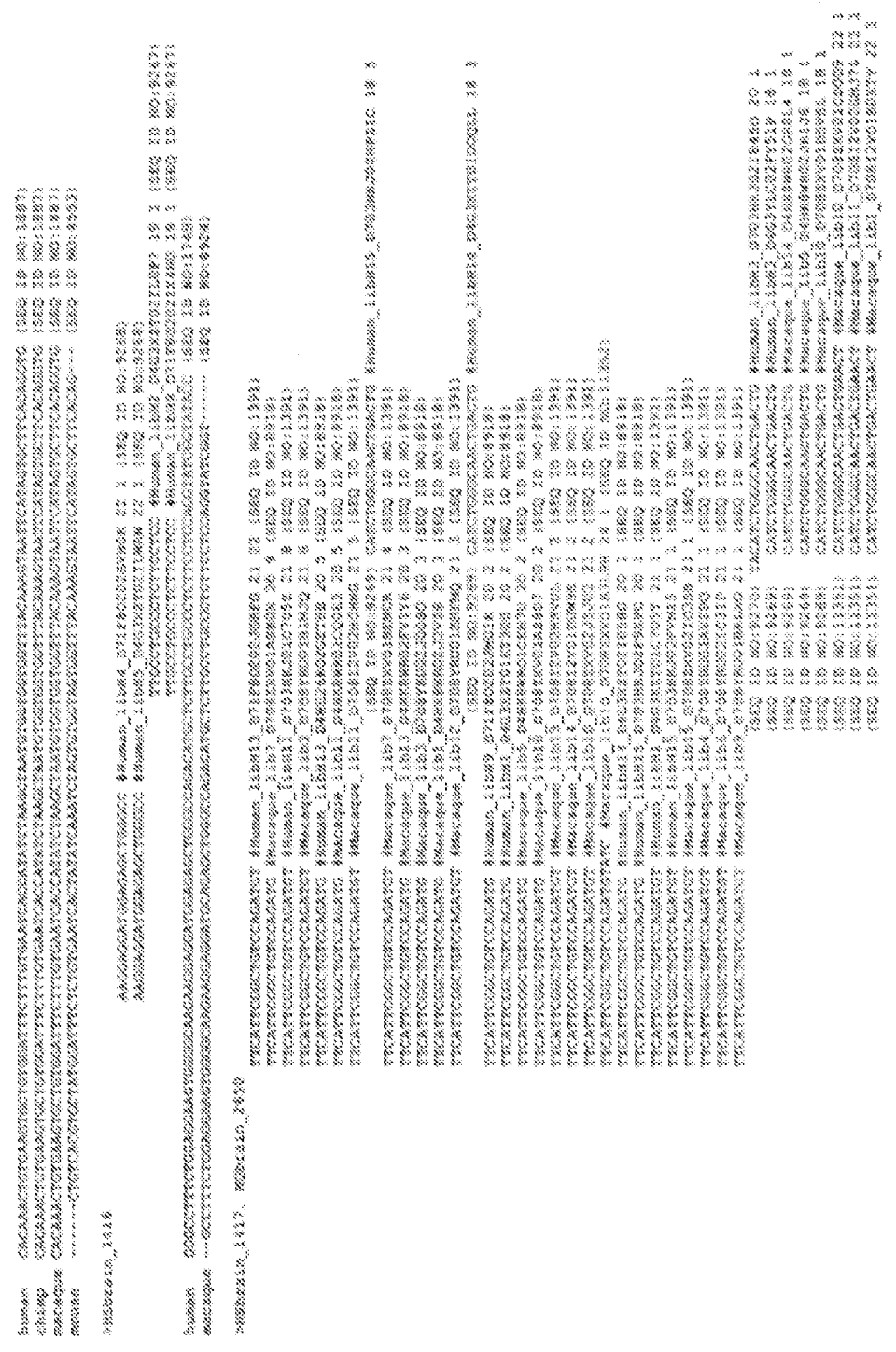
Figure 1C:
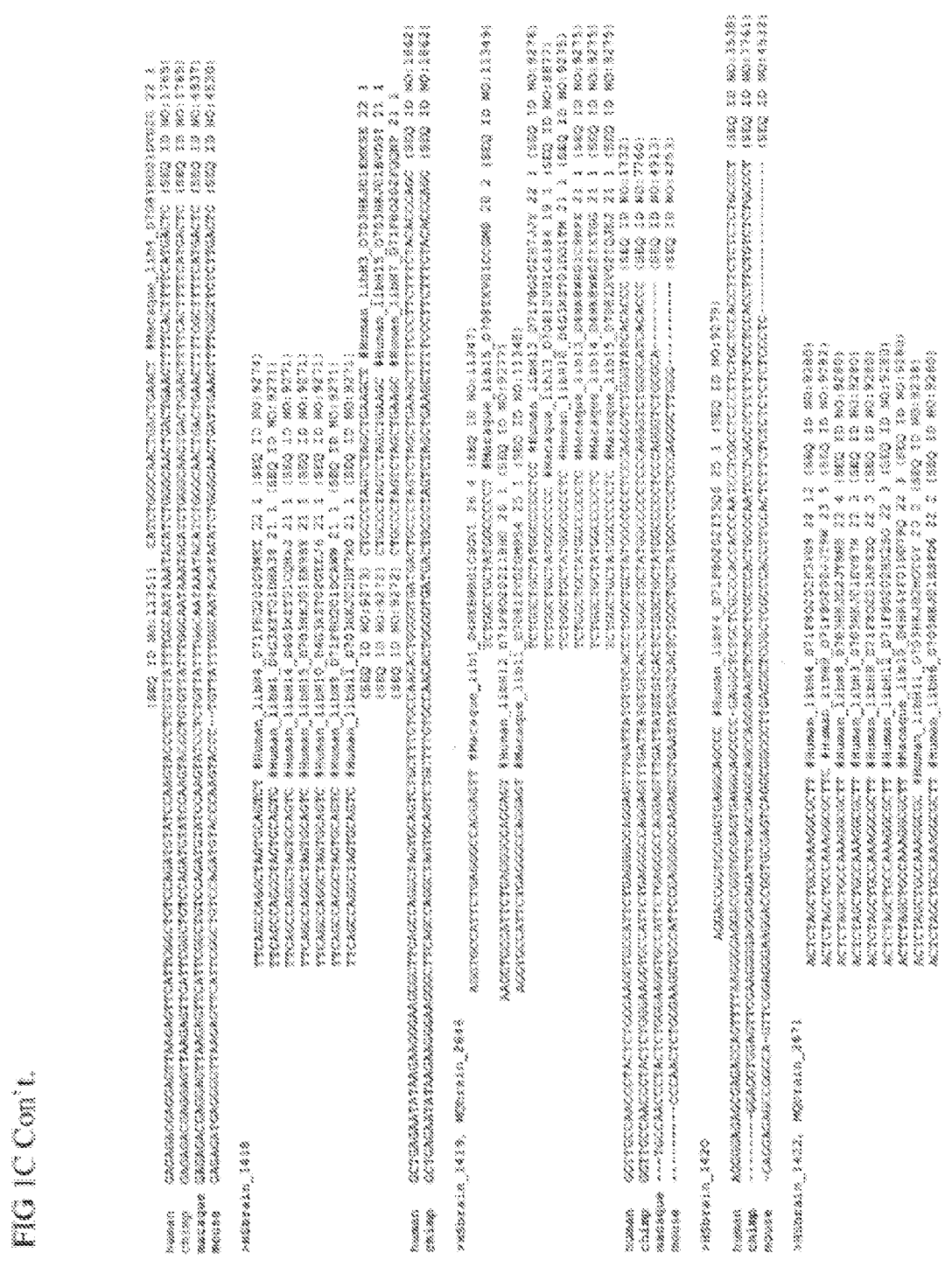
Figure 1C:
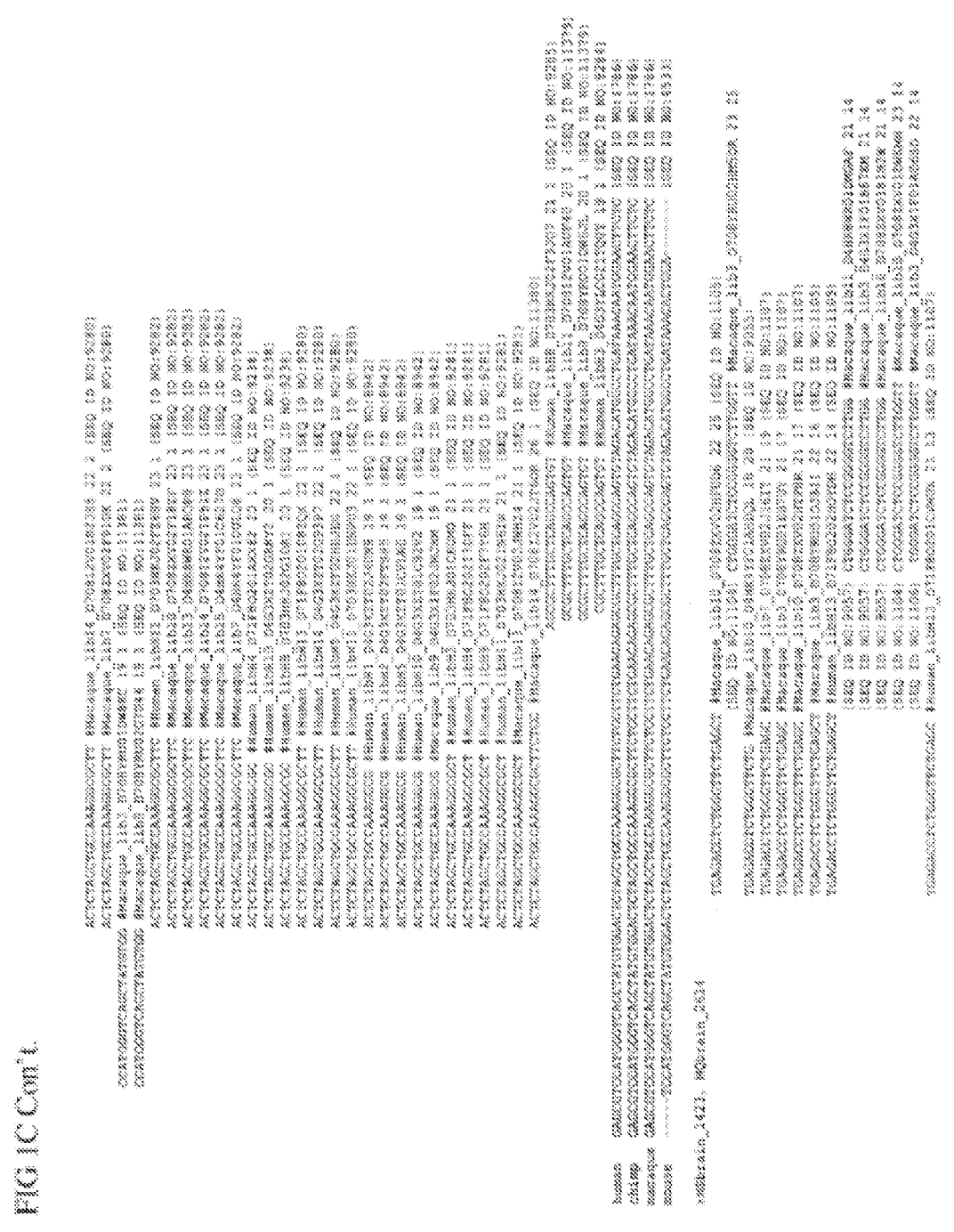
Figure 1C:
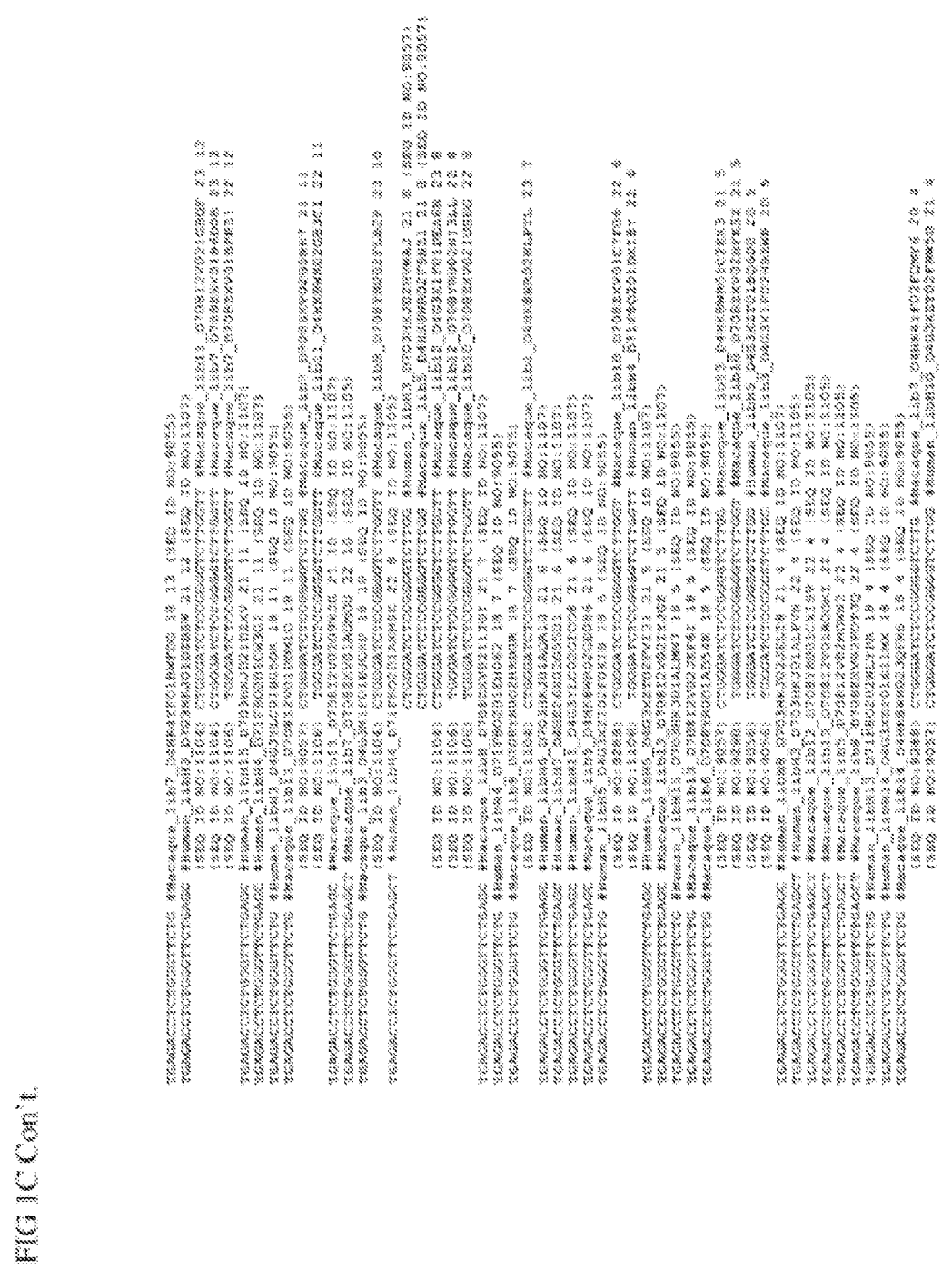
Figure 1C:
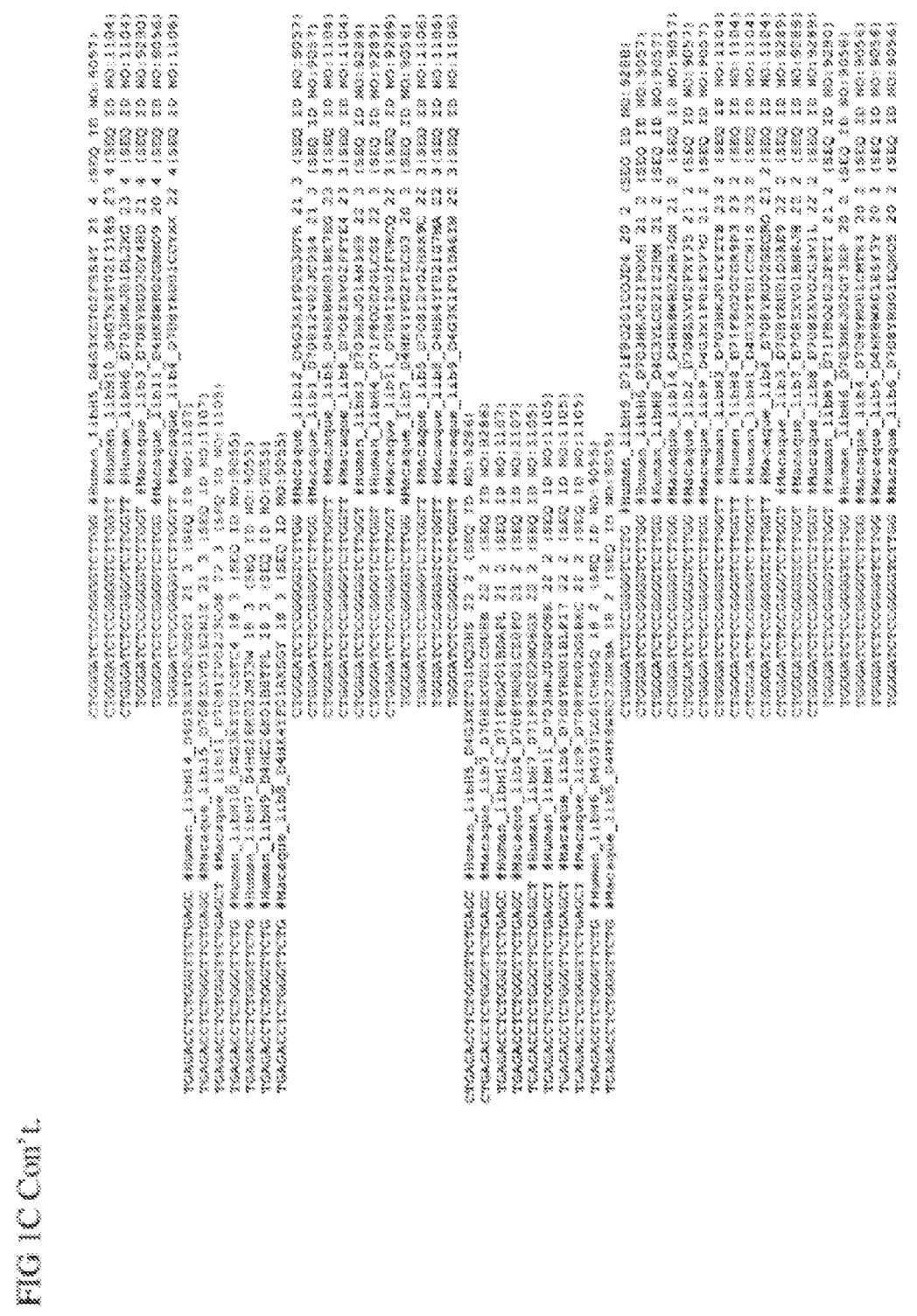
Figure 1C:
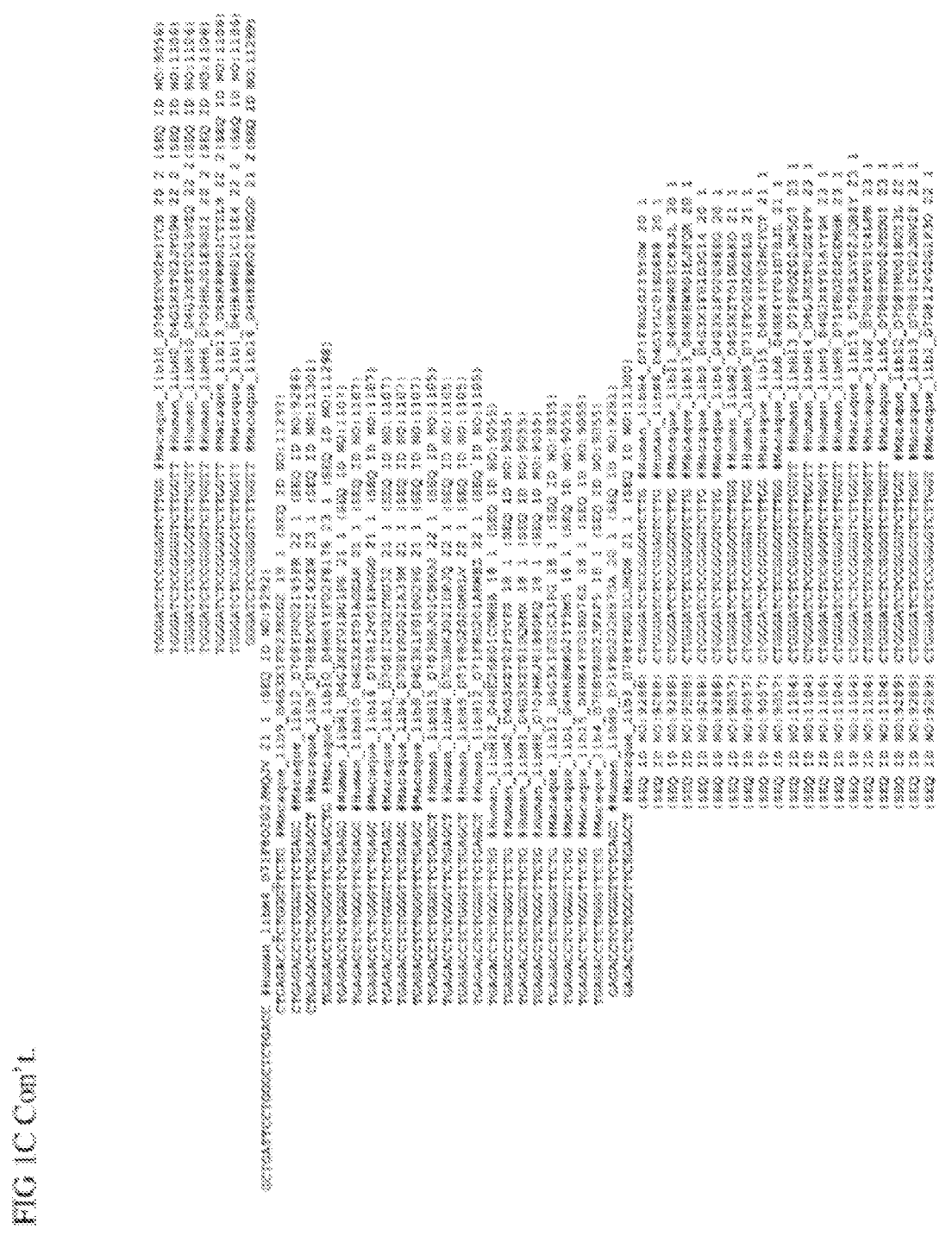
Figure 1C:
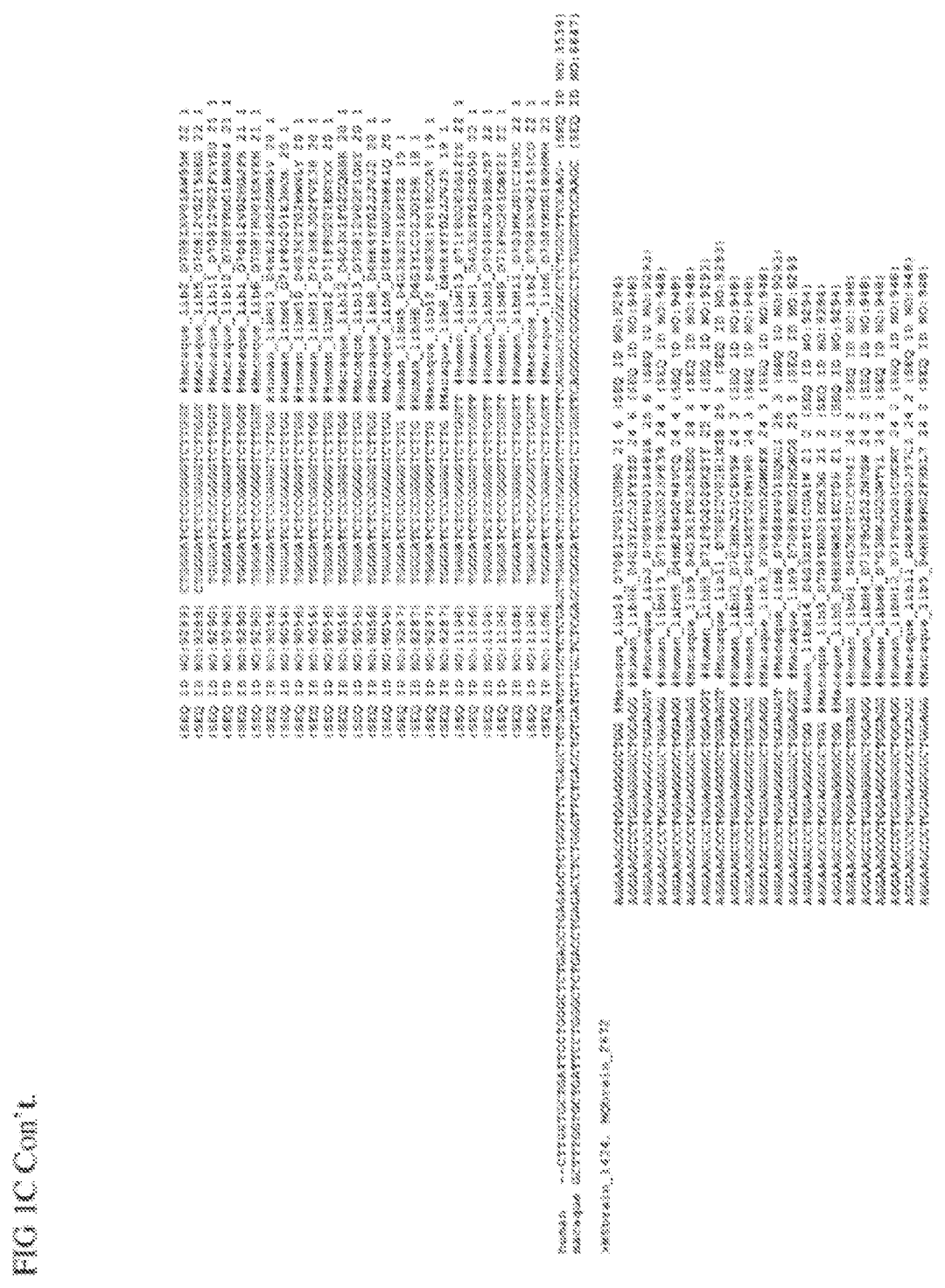
Figure 1C:
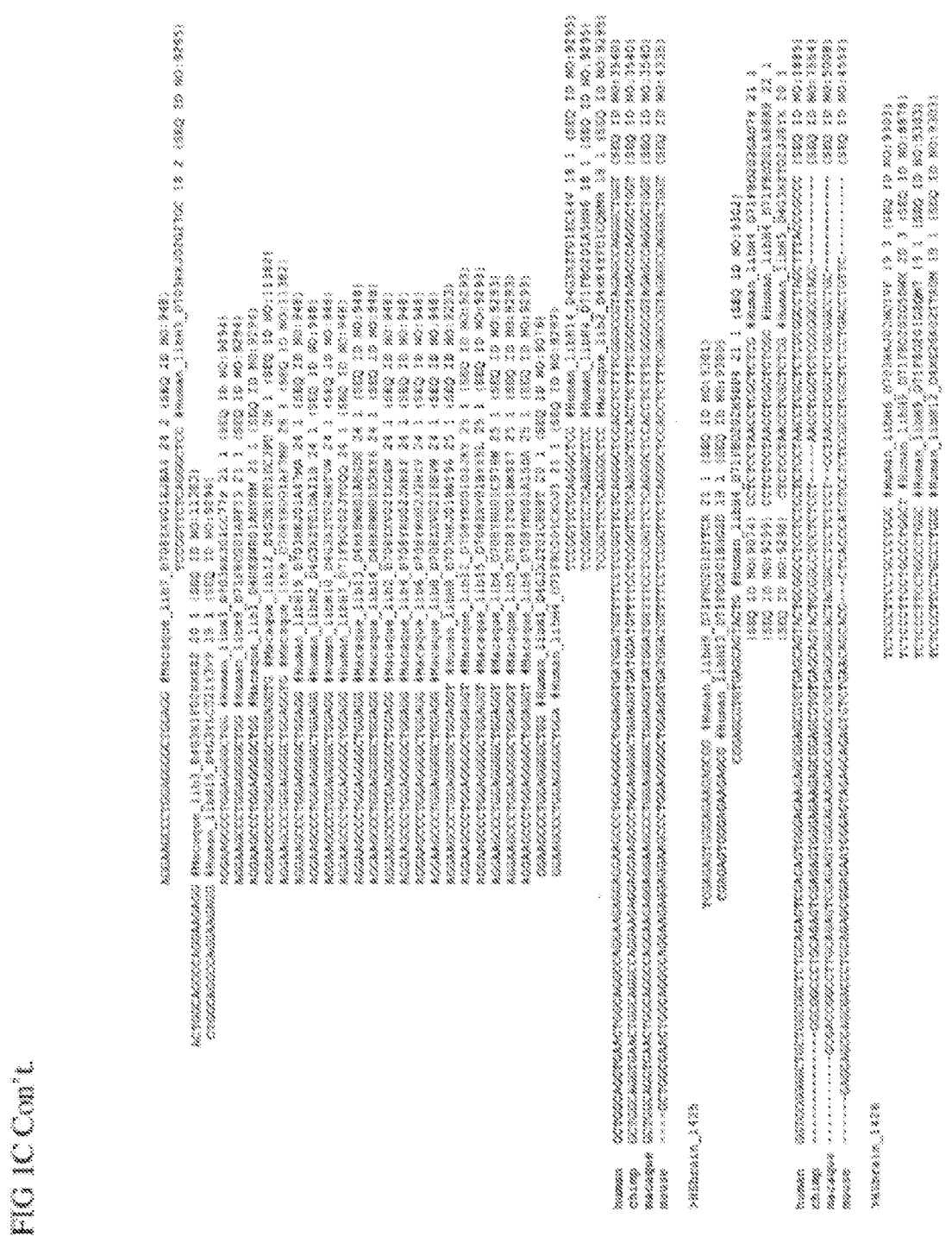
Figure 1C:
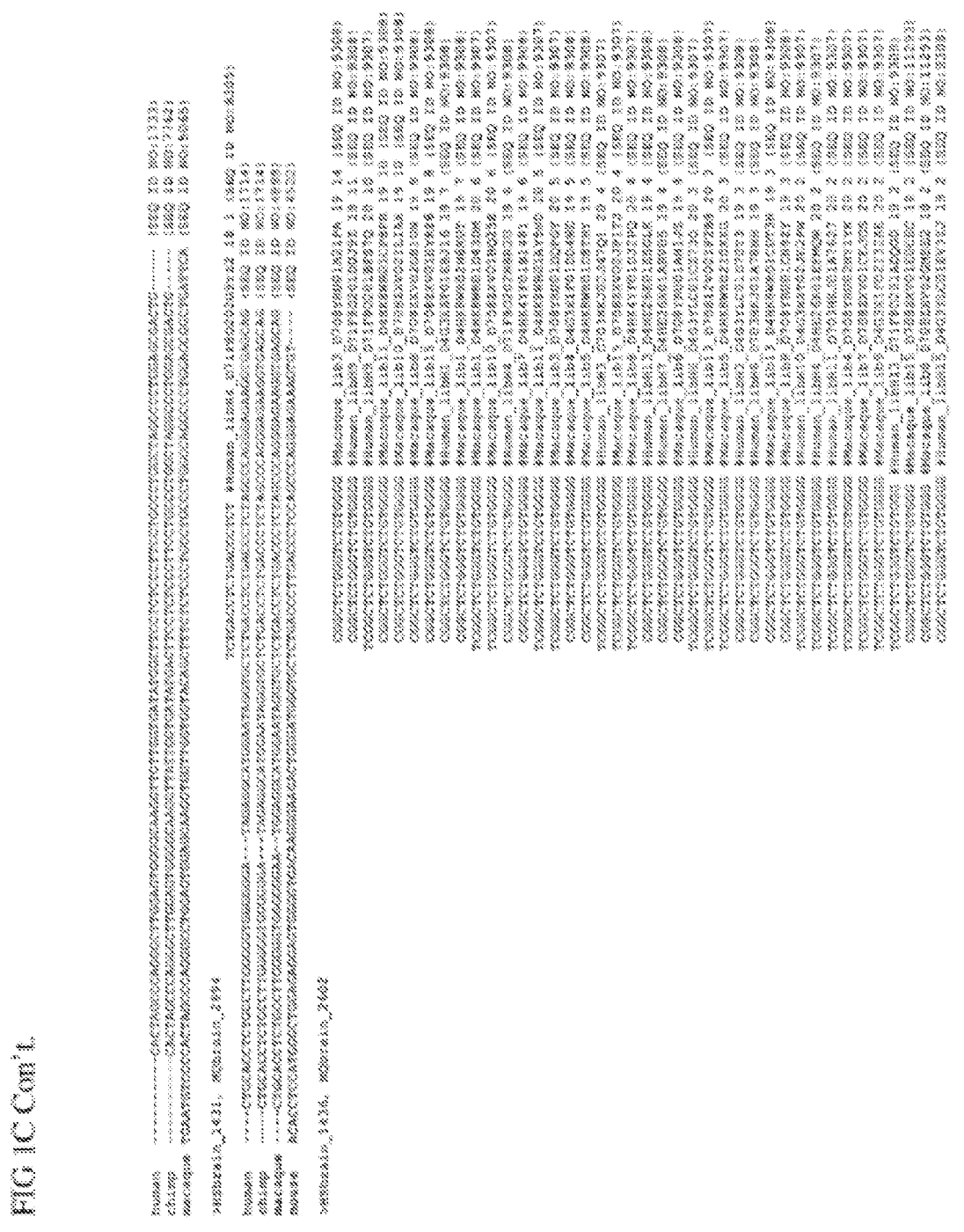
Figure 1C:
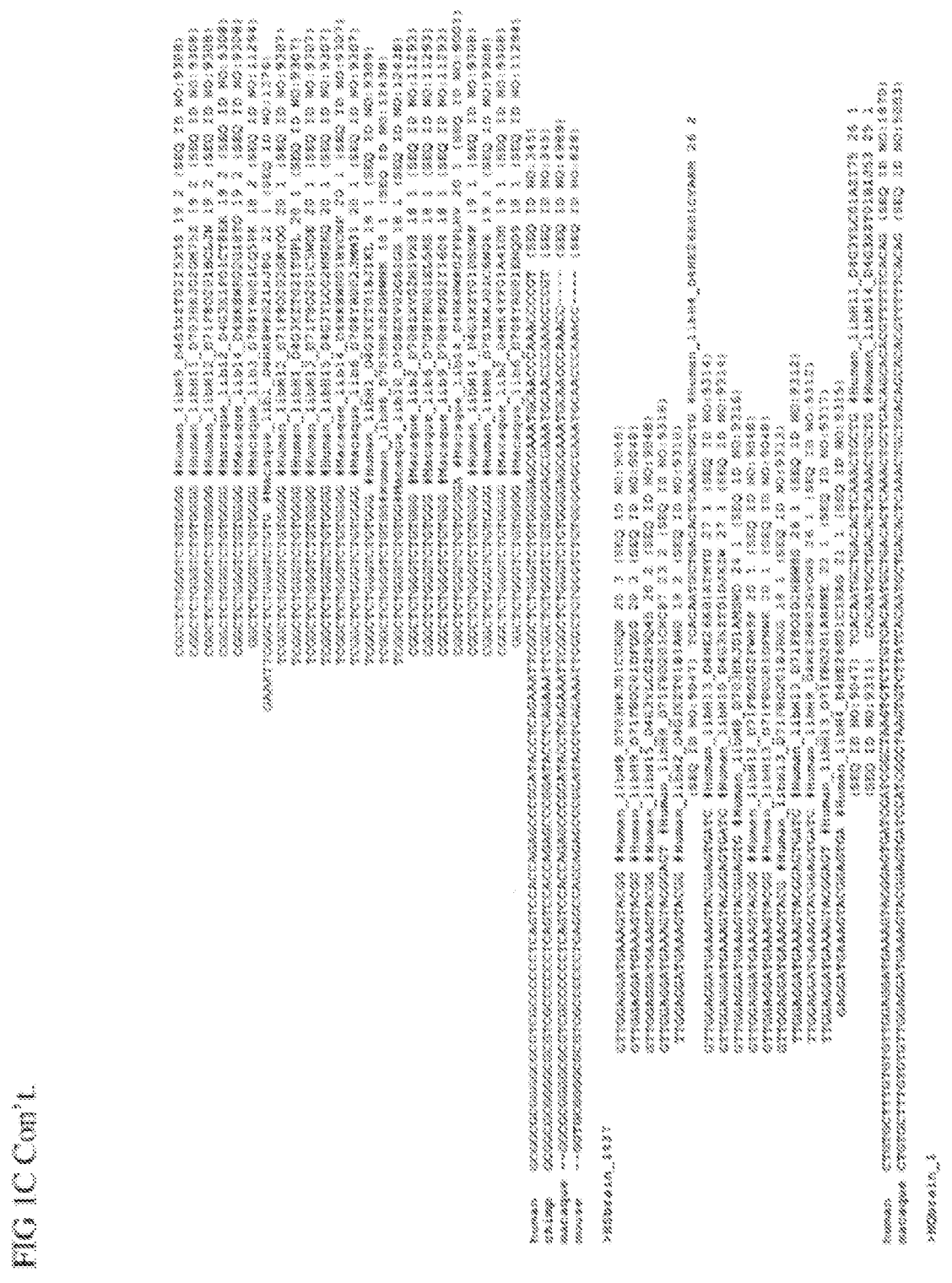
Figure 1C:
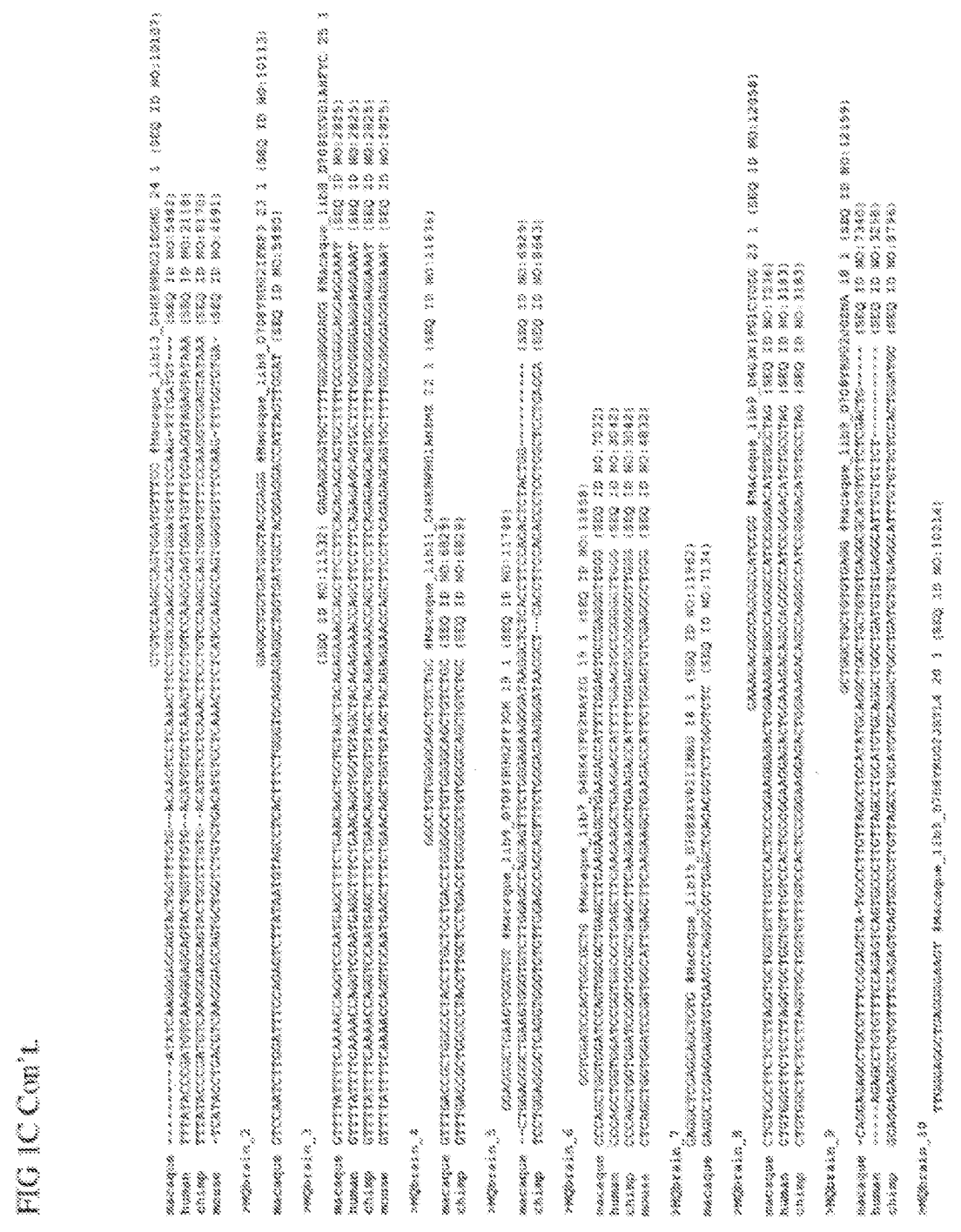
Figure 1C:
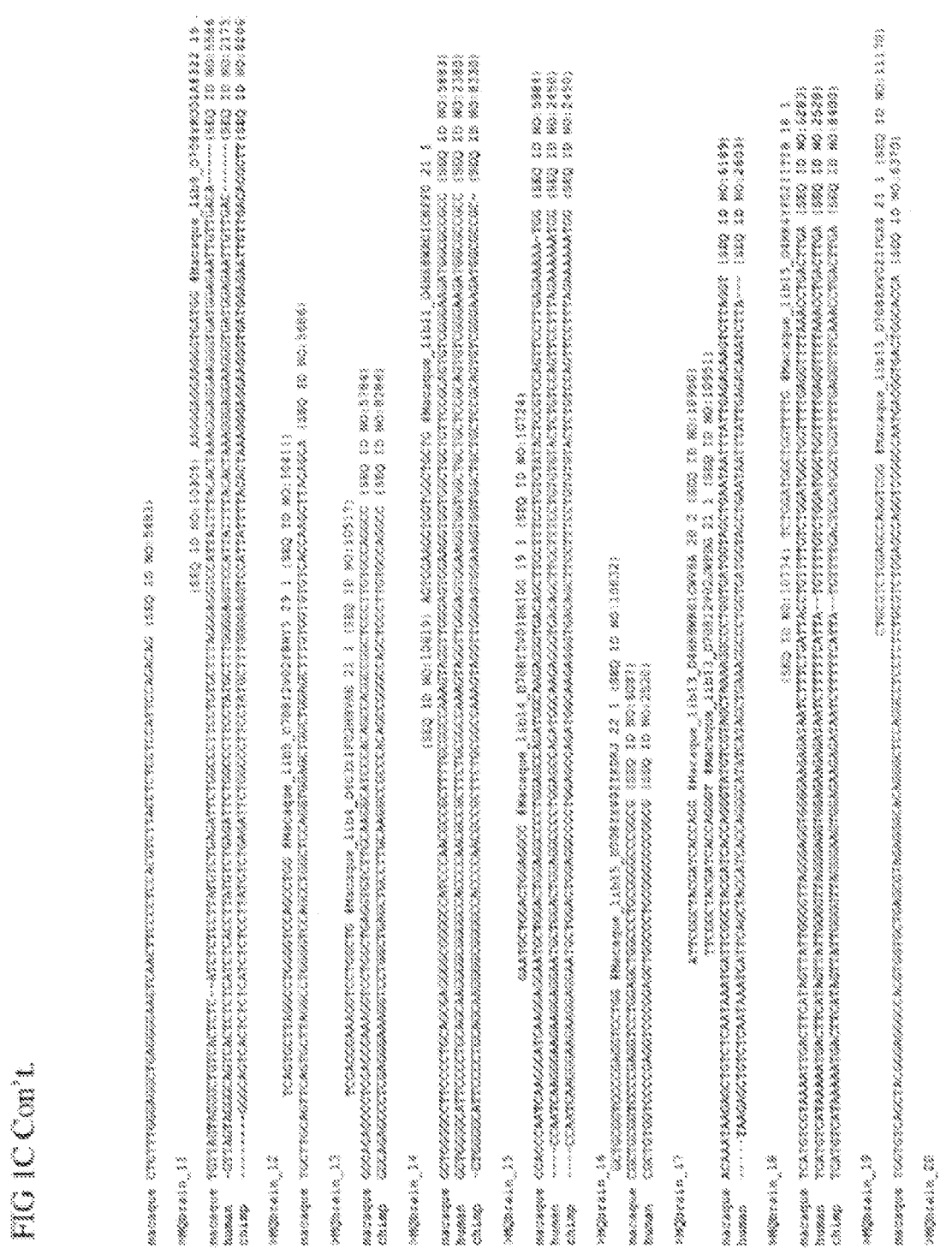
Figure 1C:
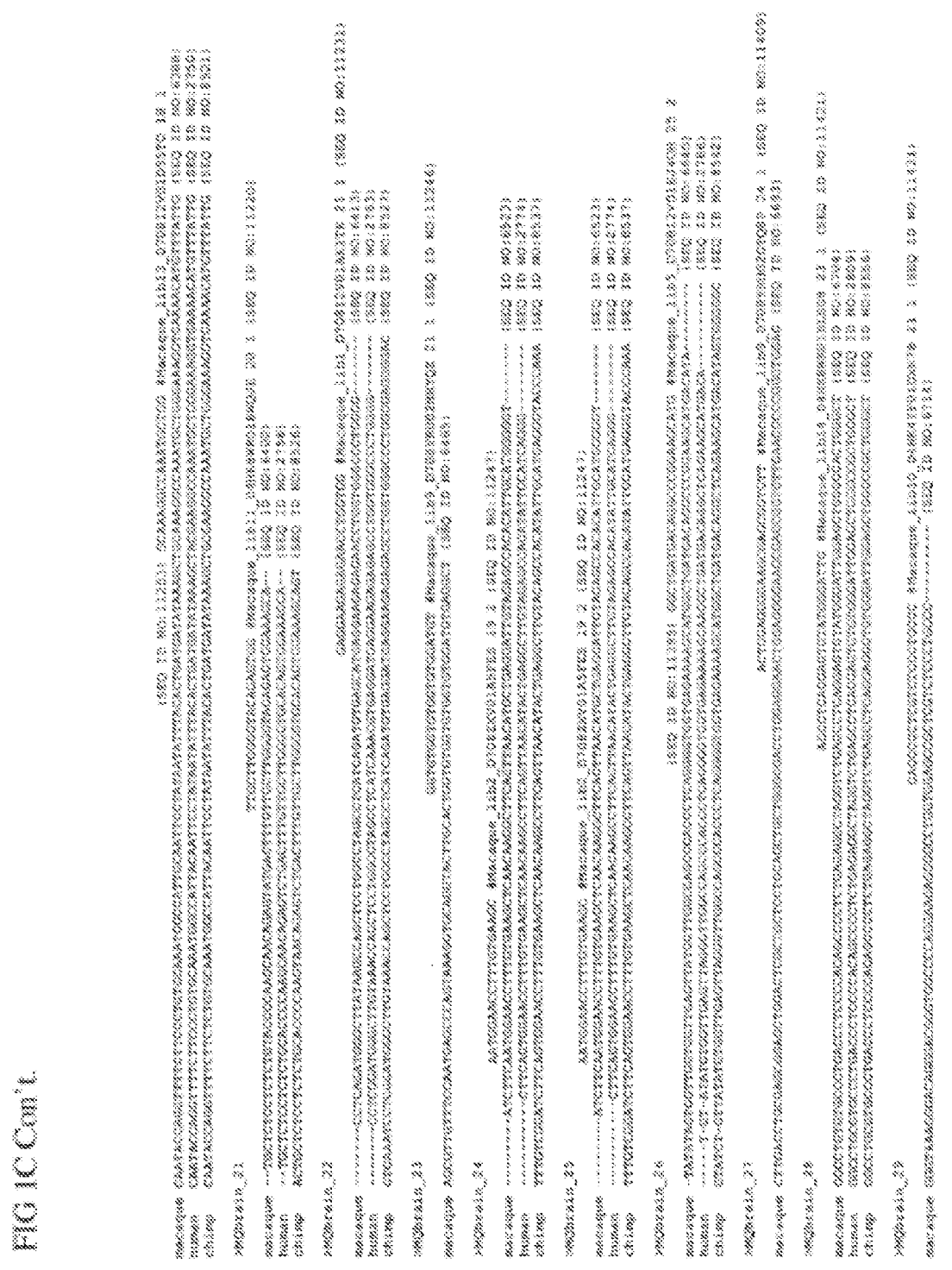
Figure 1C:
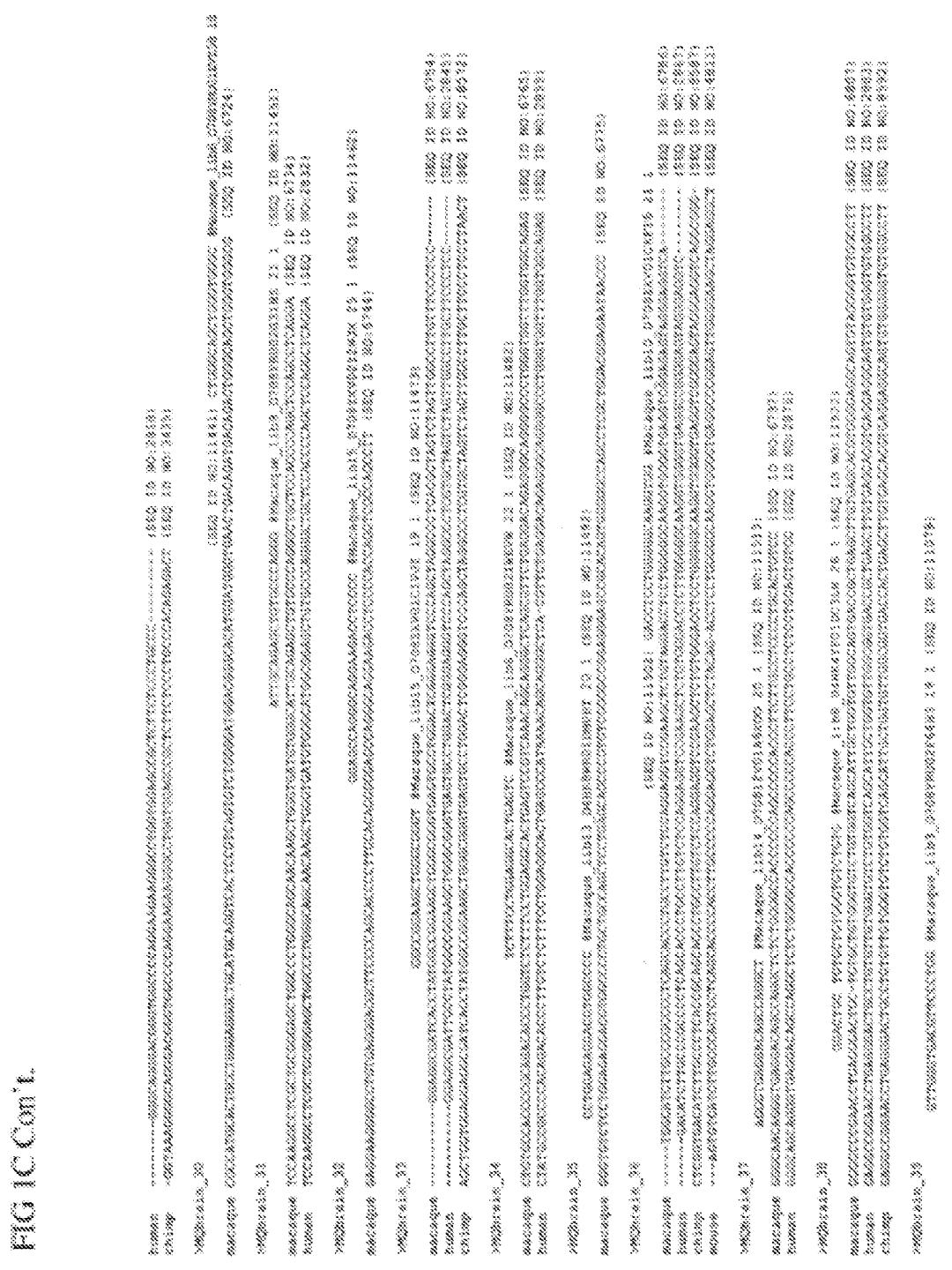
Figure 1C:
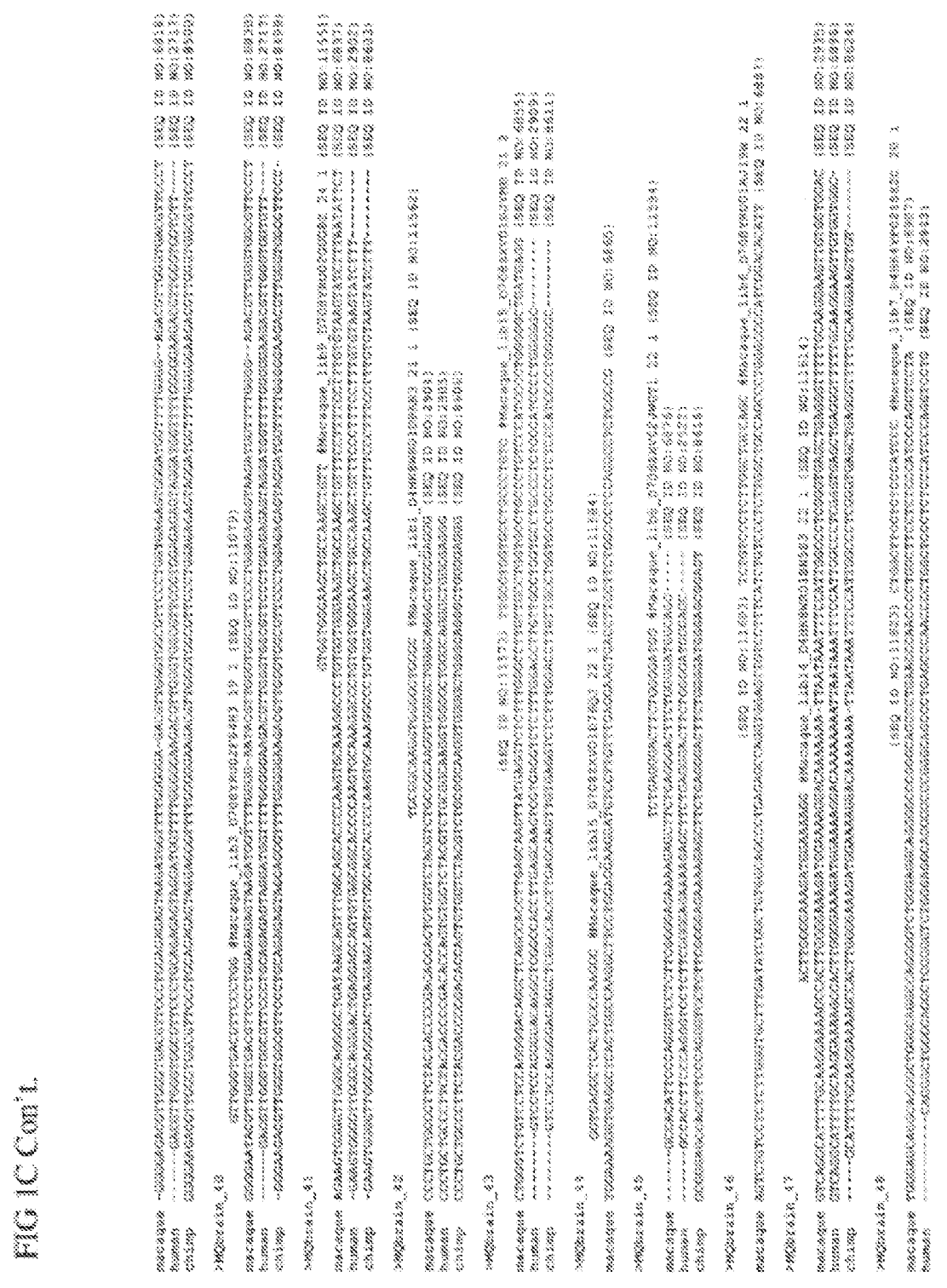
Figure 1C:
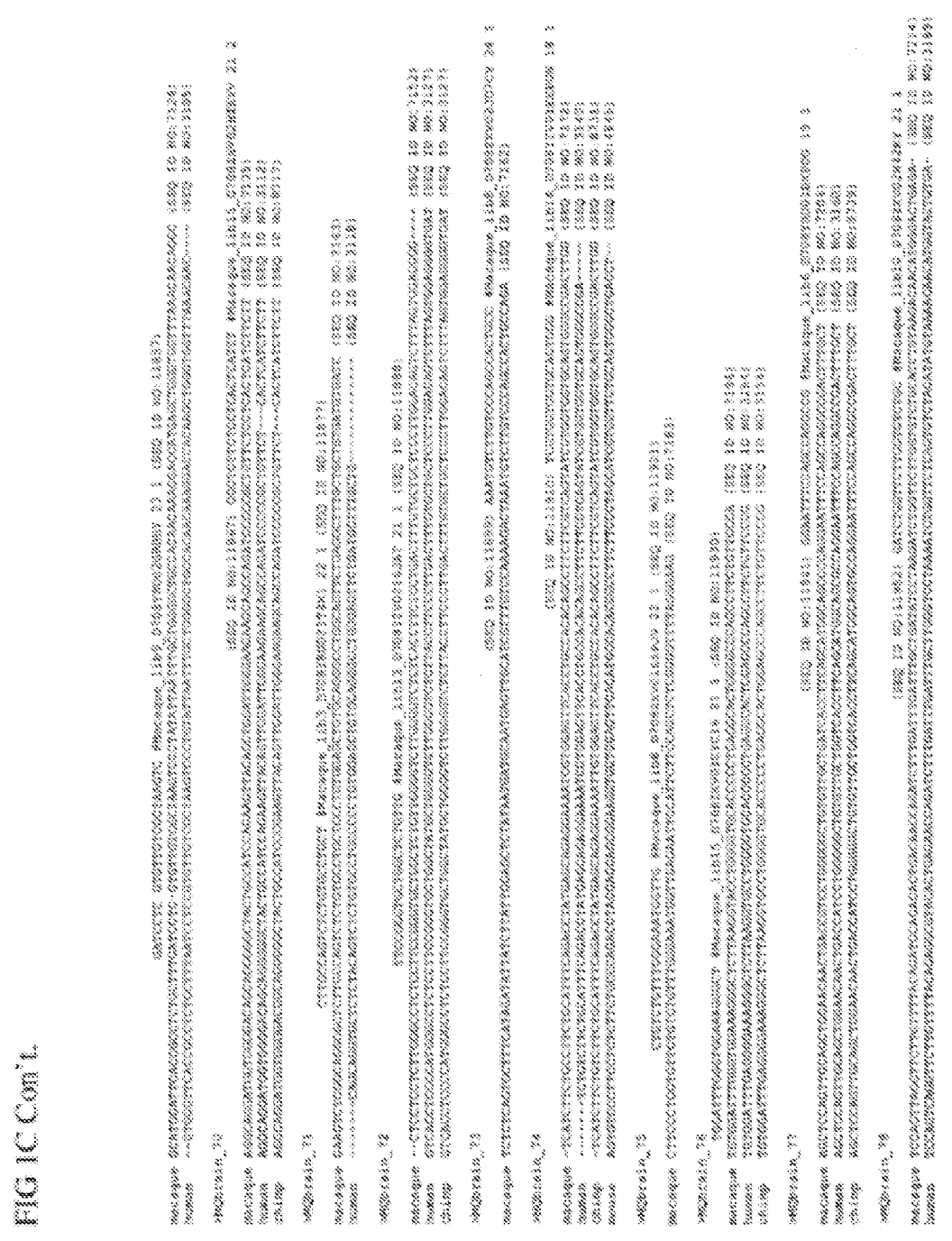
Figure 1C:
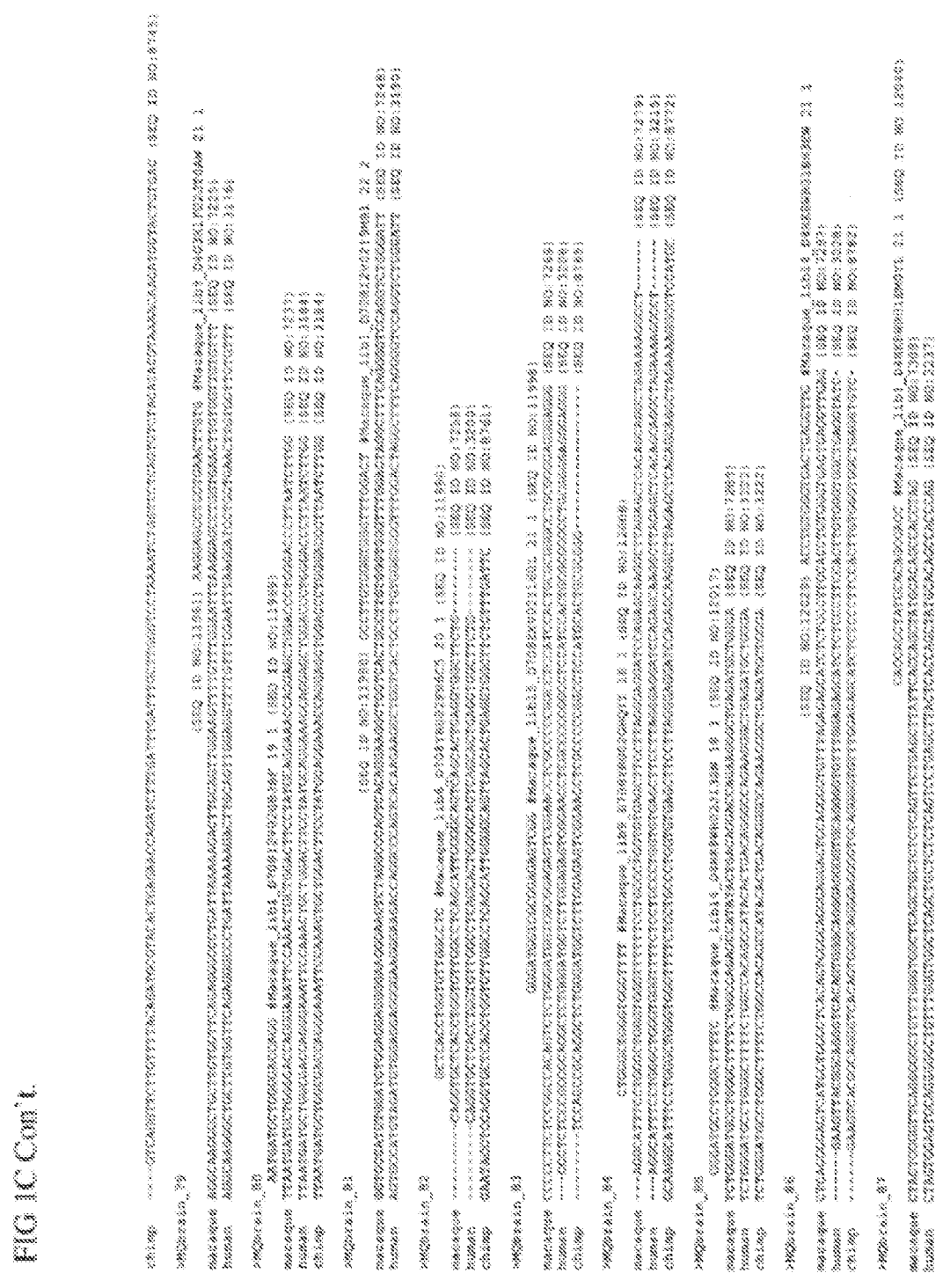
Figure 1C:
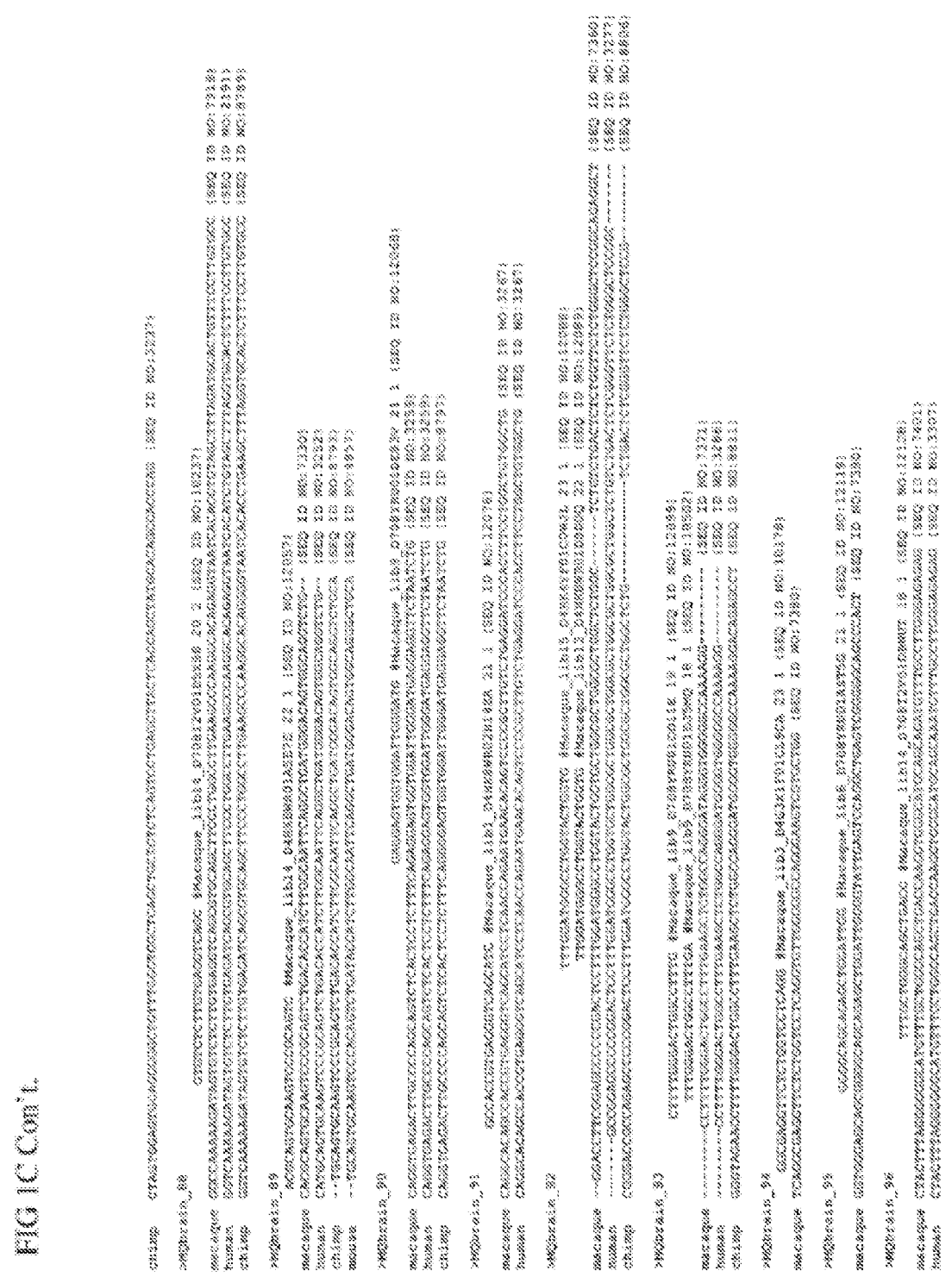
Figure 1C:
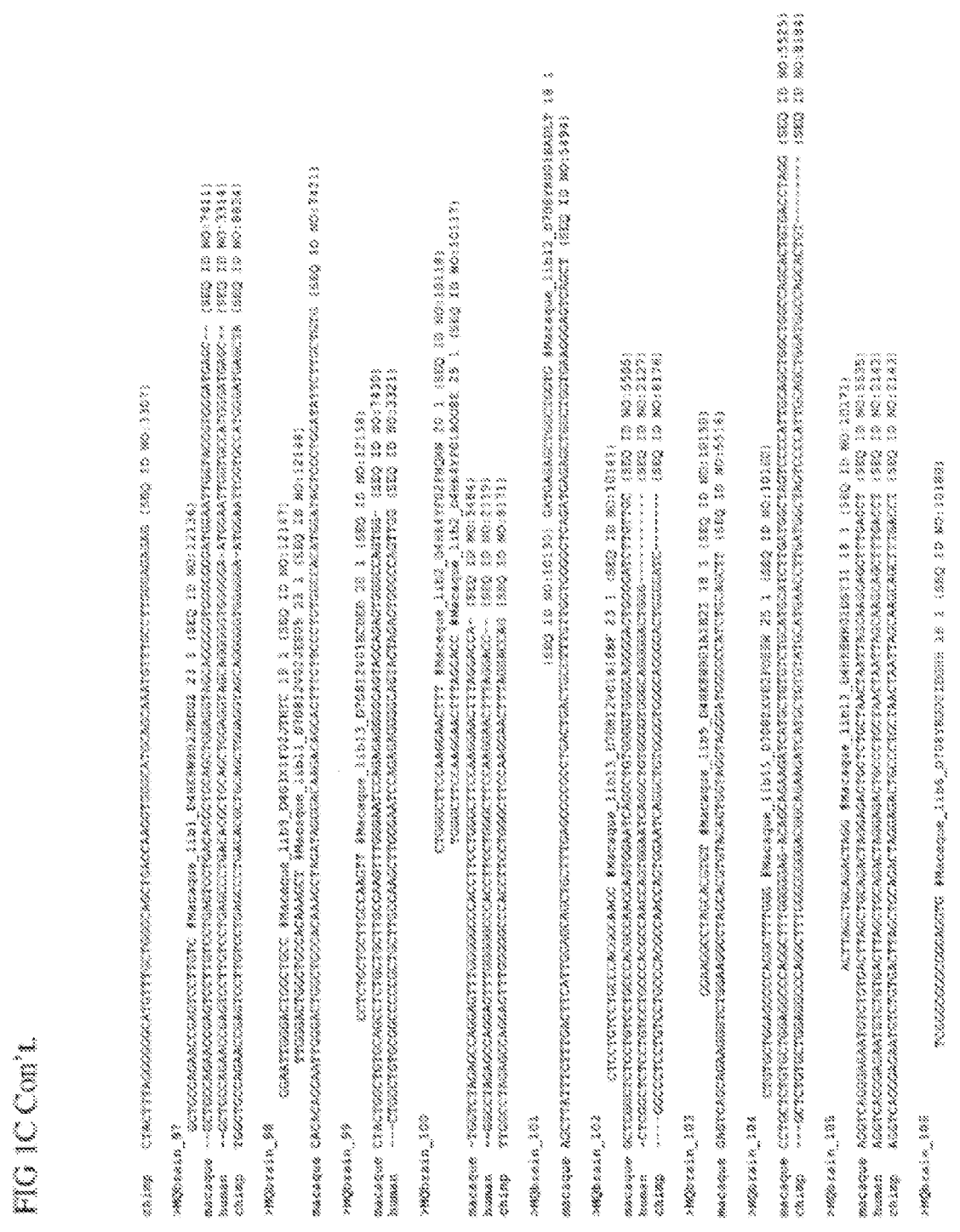
Figure 1C:
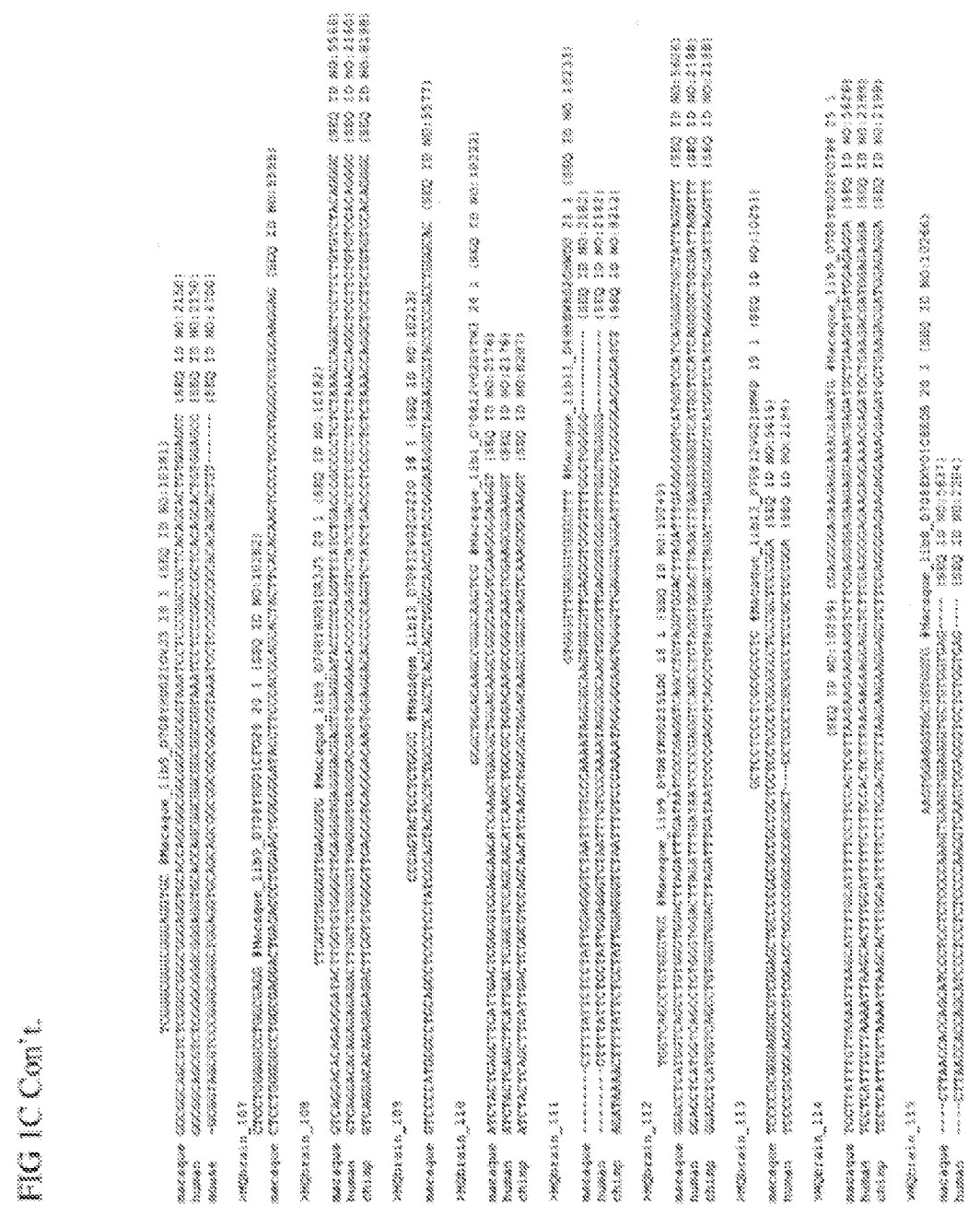
Figure 1C:
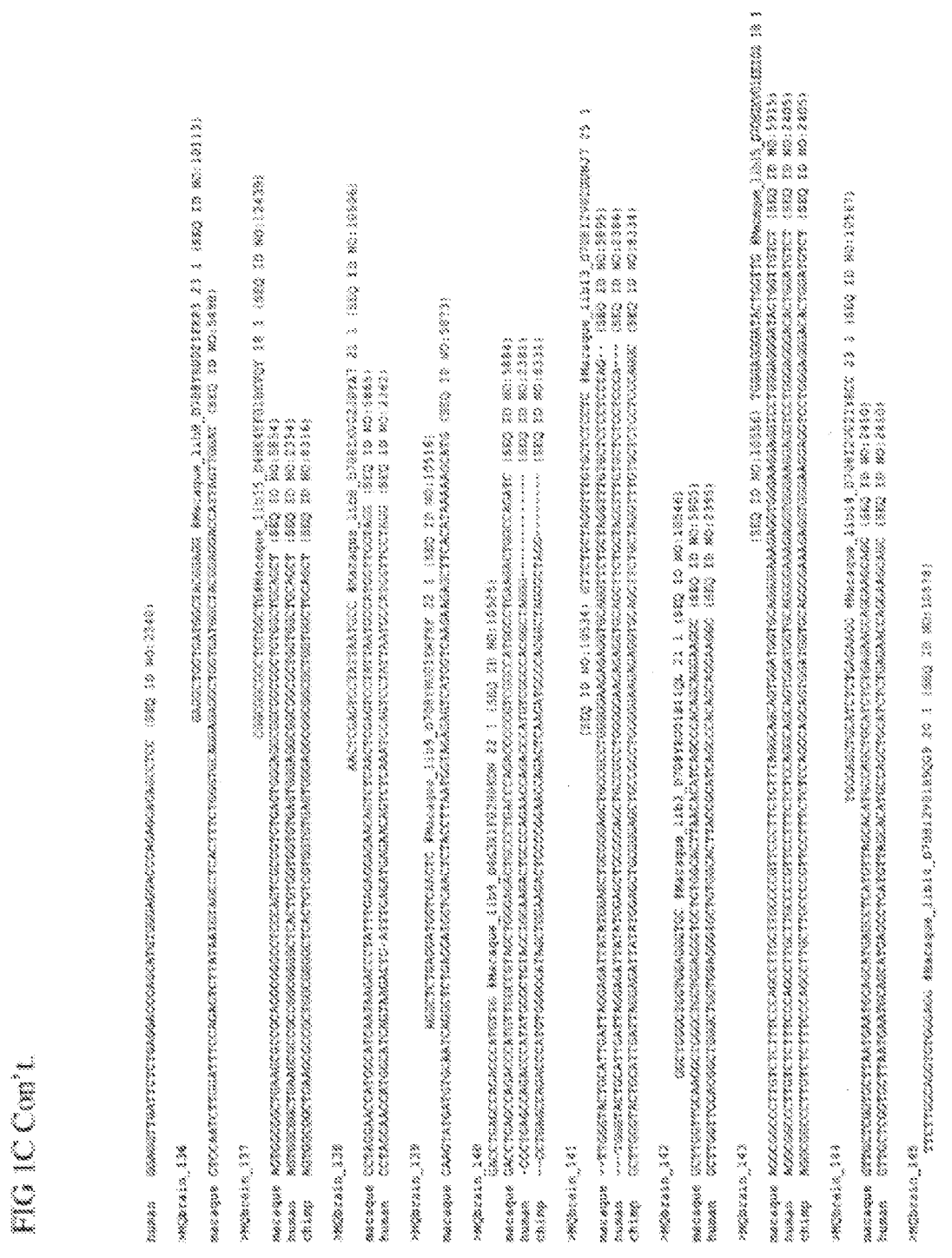
Figure 1C:
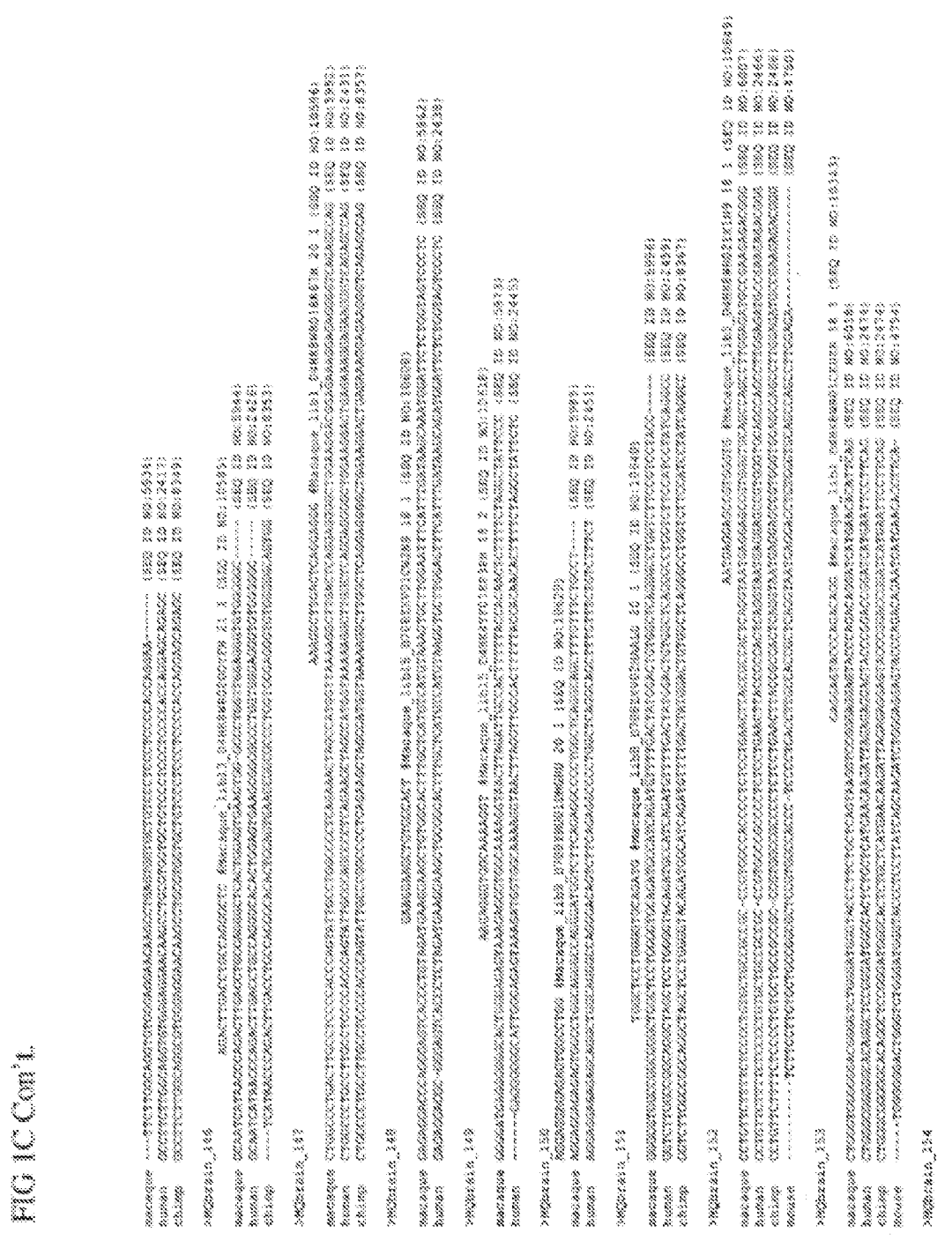
Figure 1C:
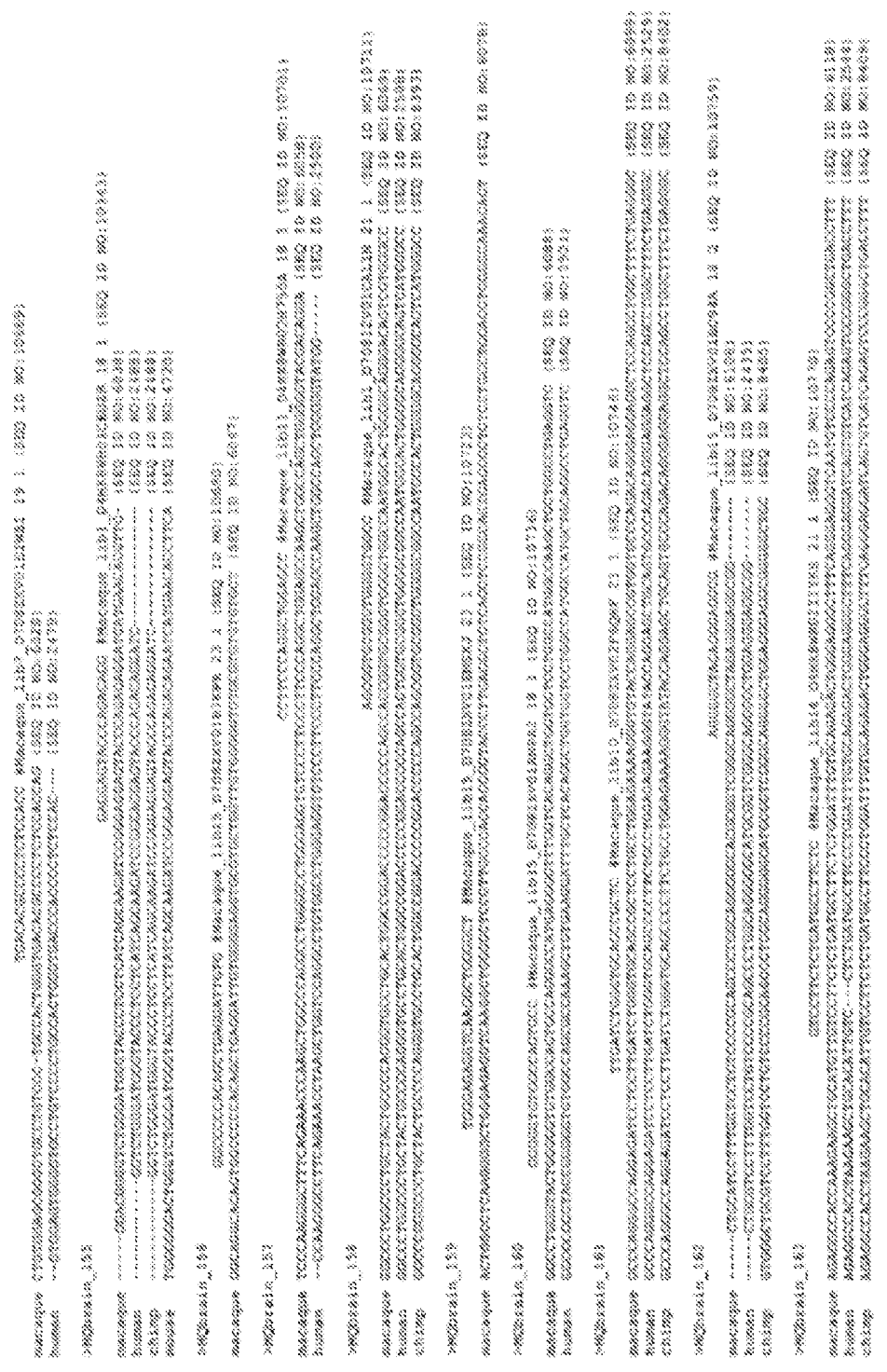
Figure 1C:
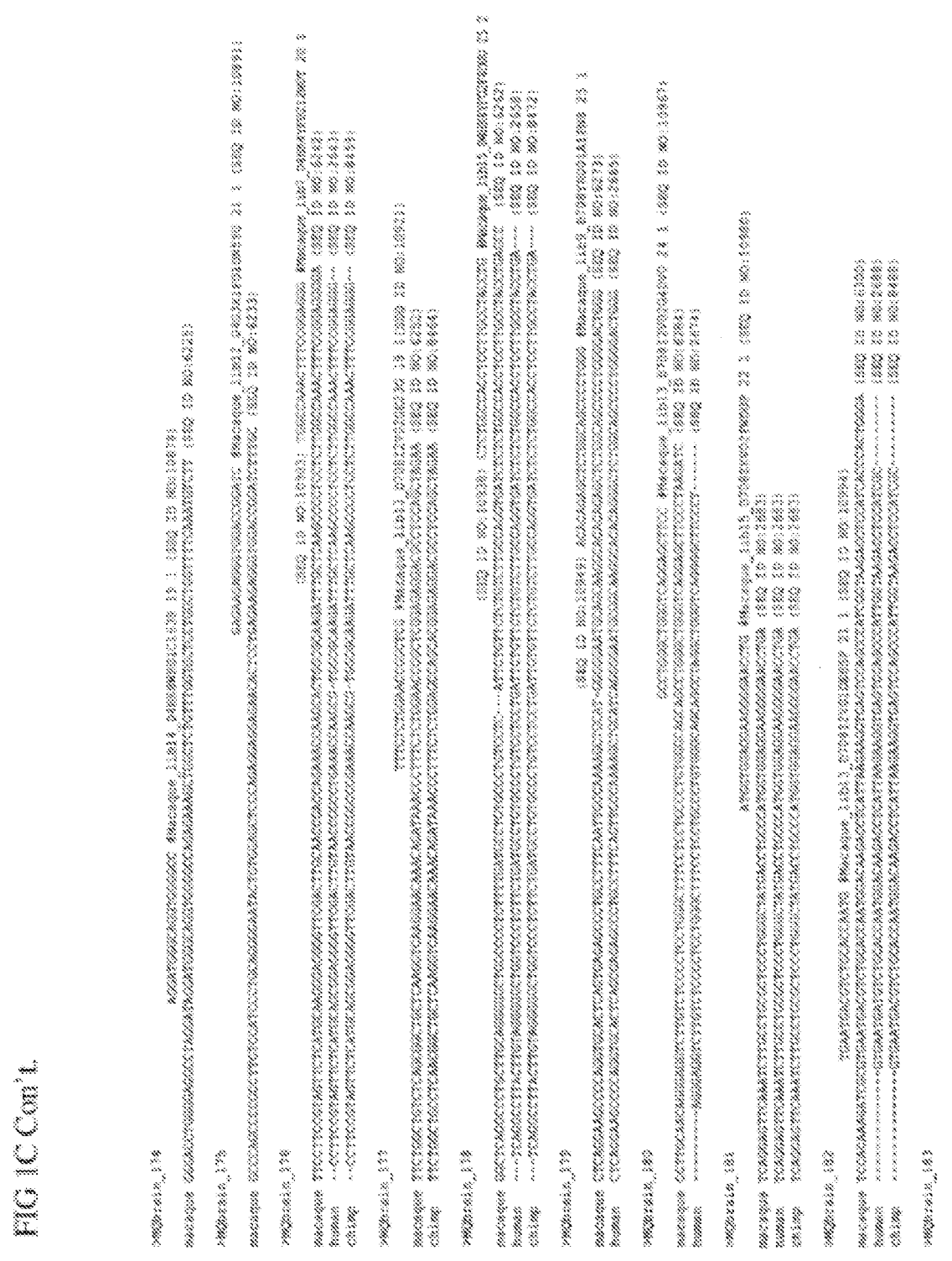
Figure 1C:
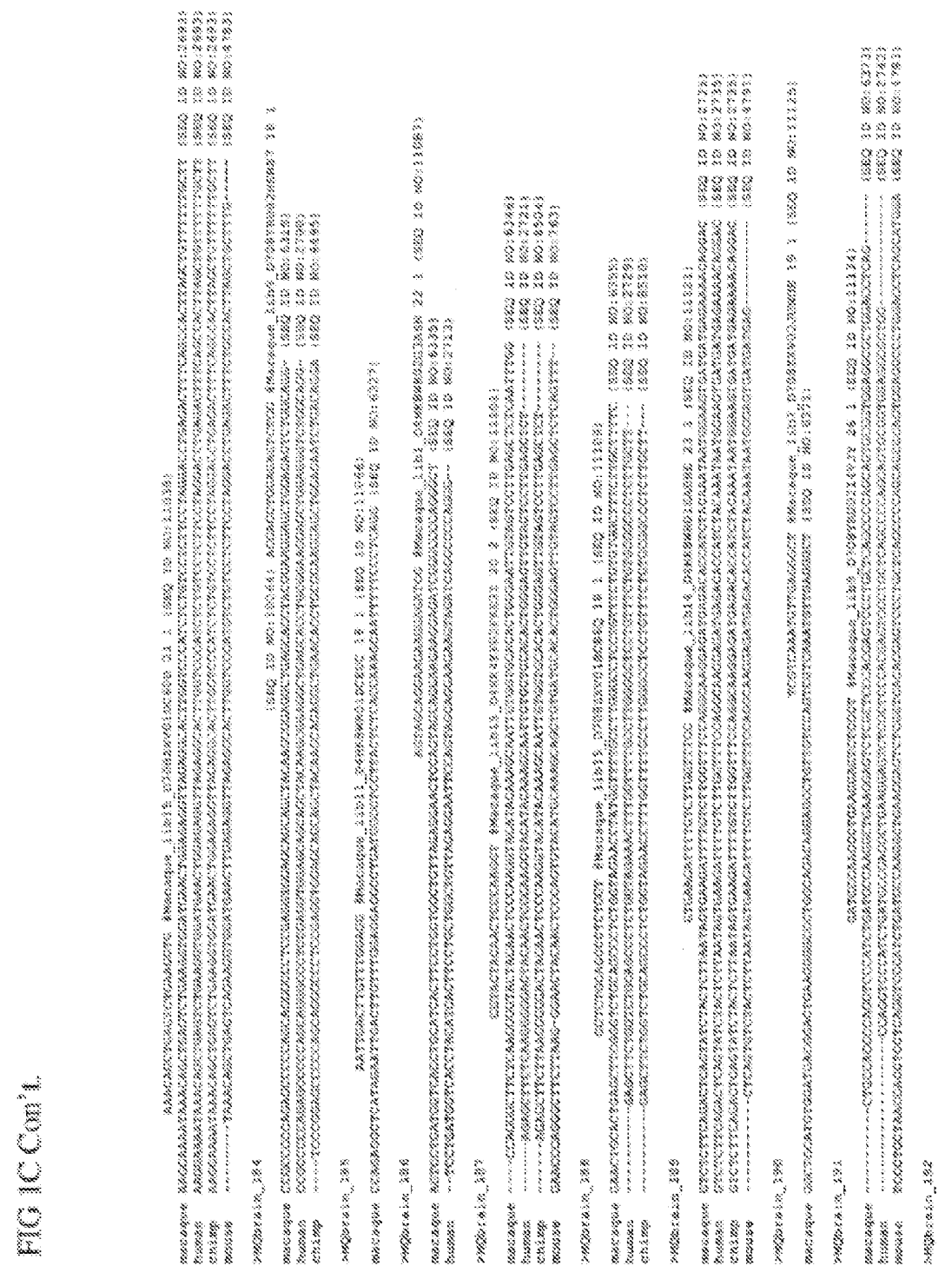
Figure 1C:
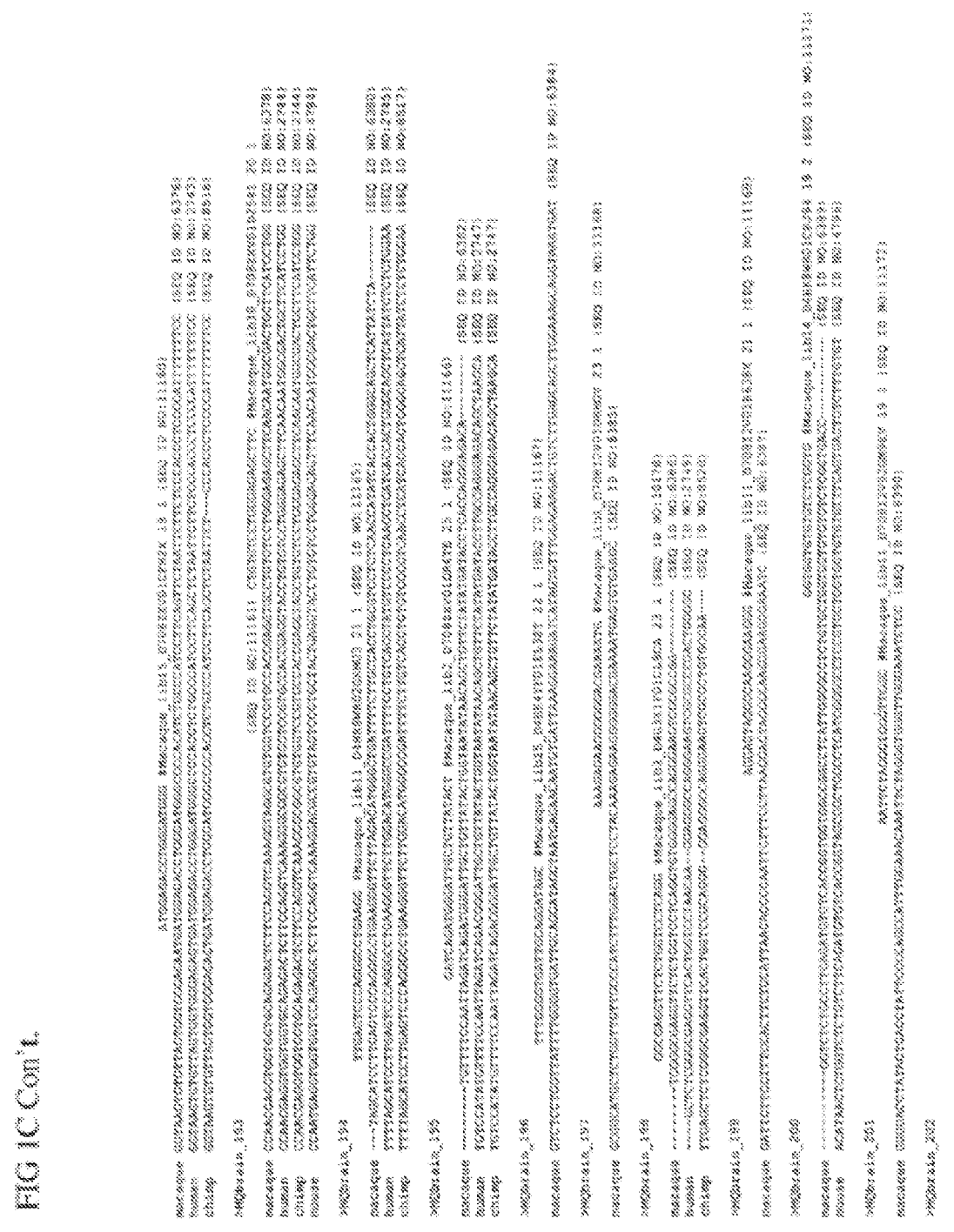
Figure 1C:
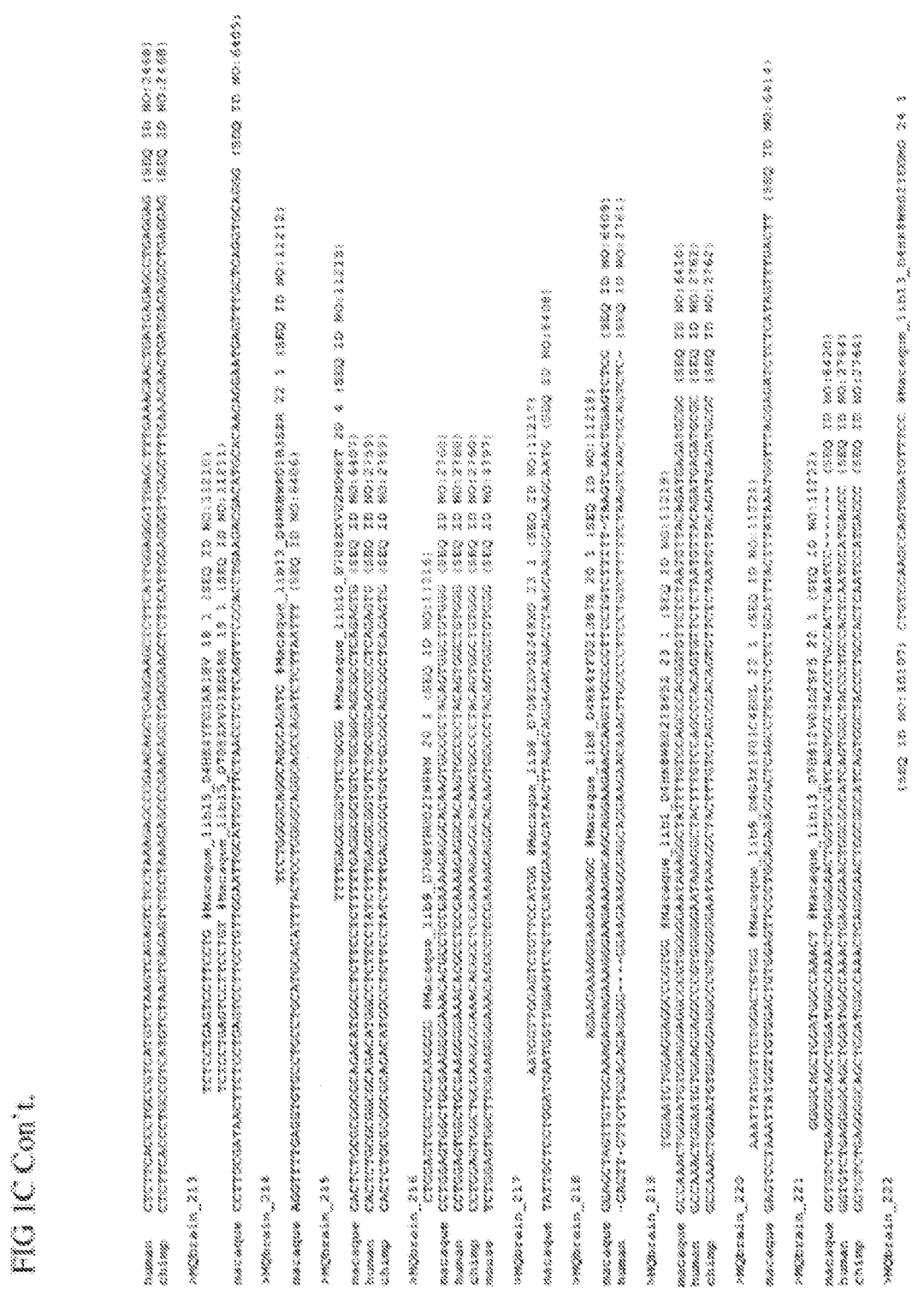
Figure 1C:
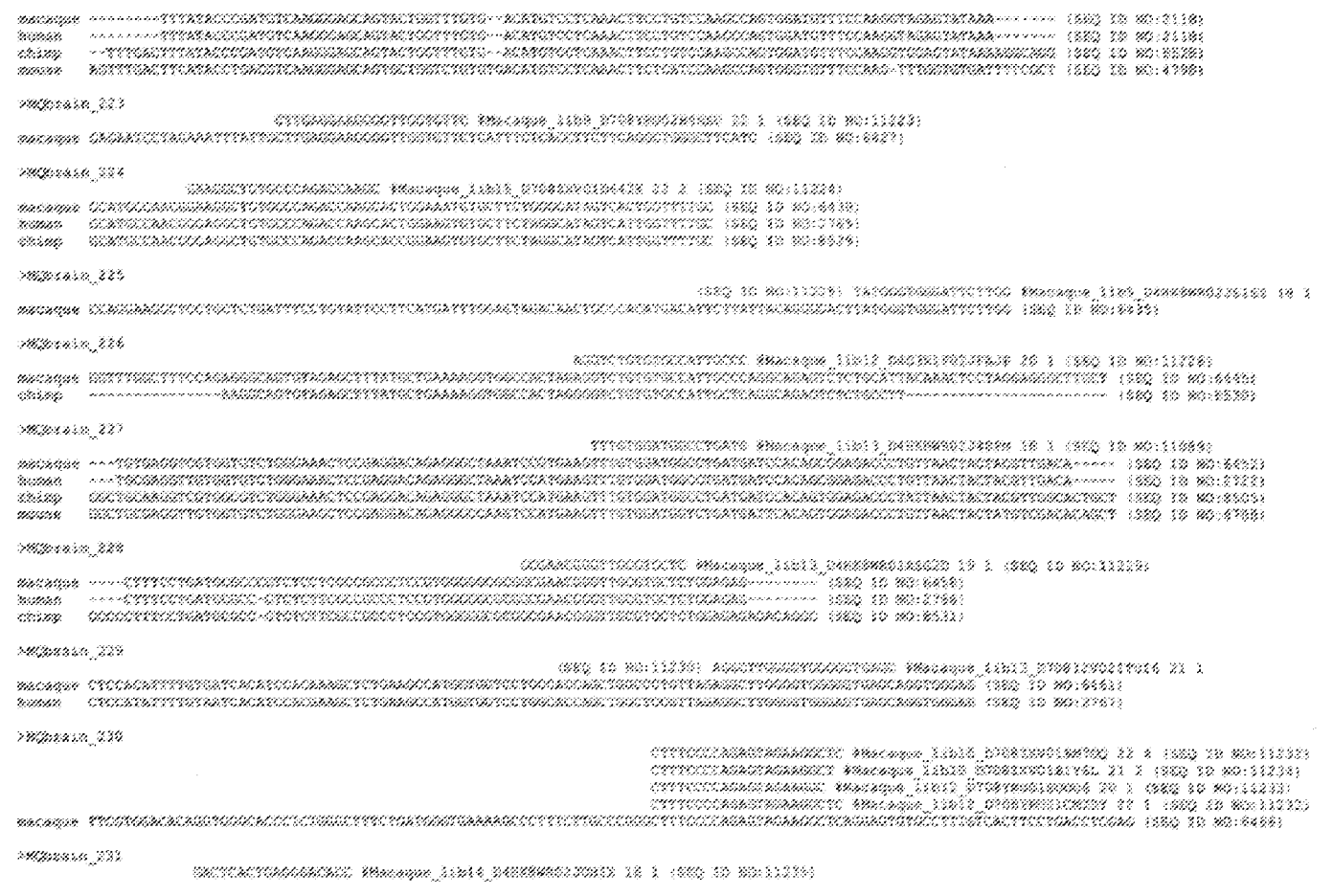
Figure 1C:
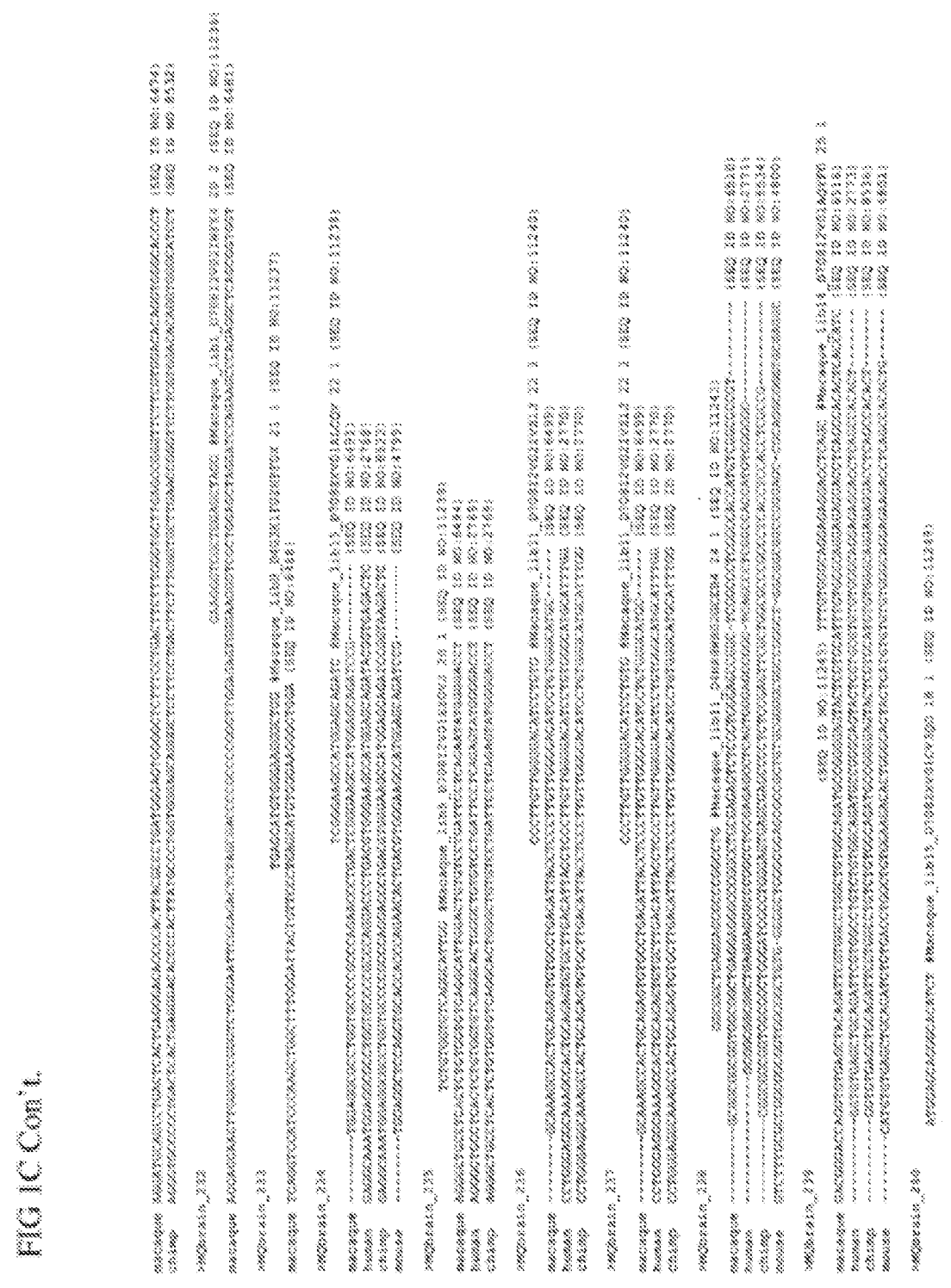
Figure 1C:
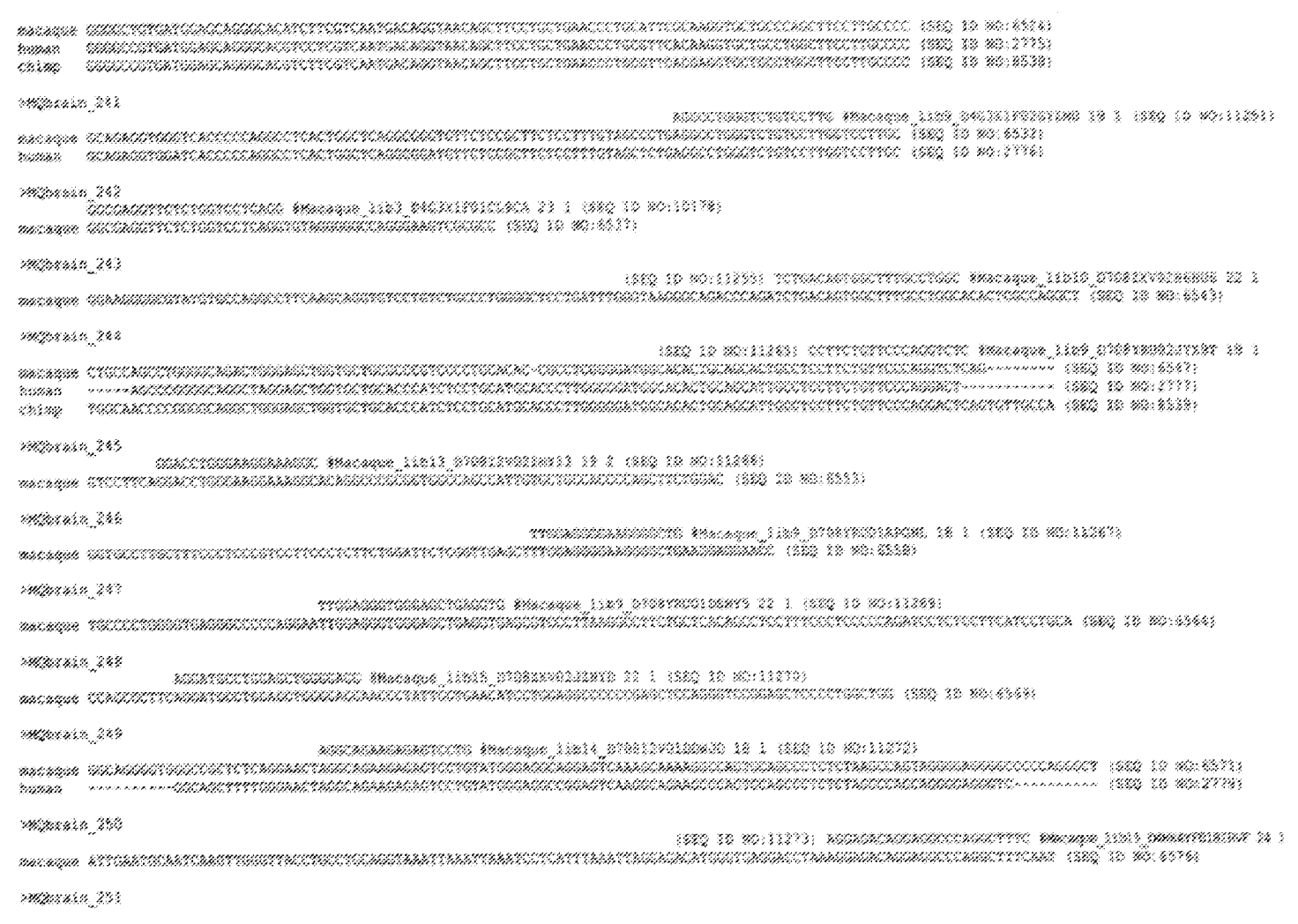
Figure 1C:
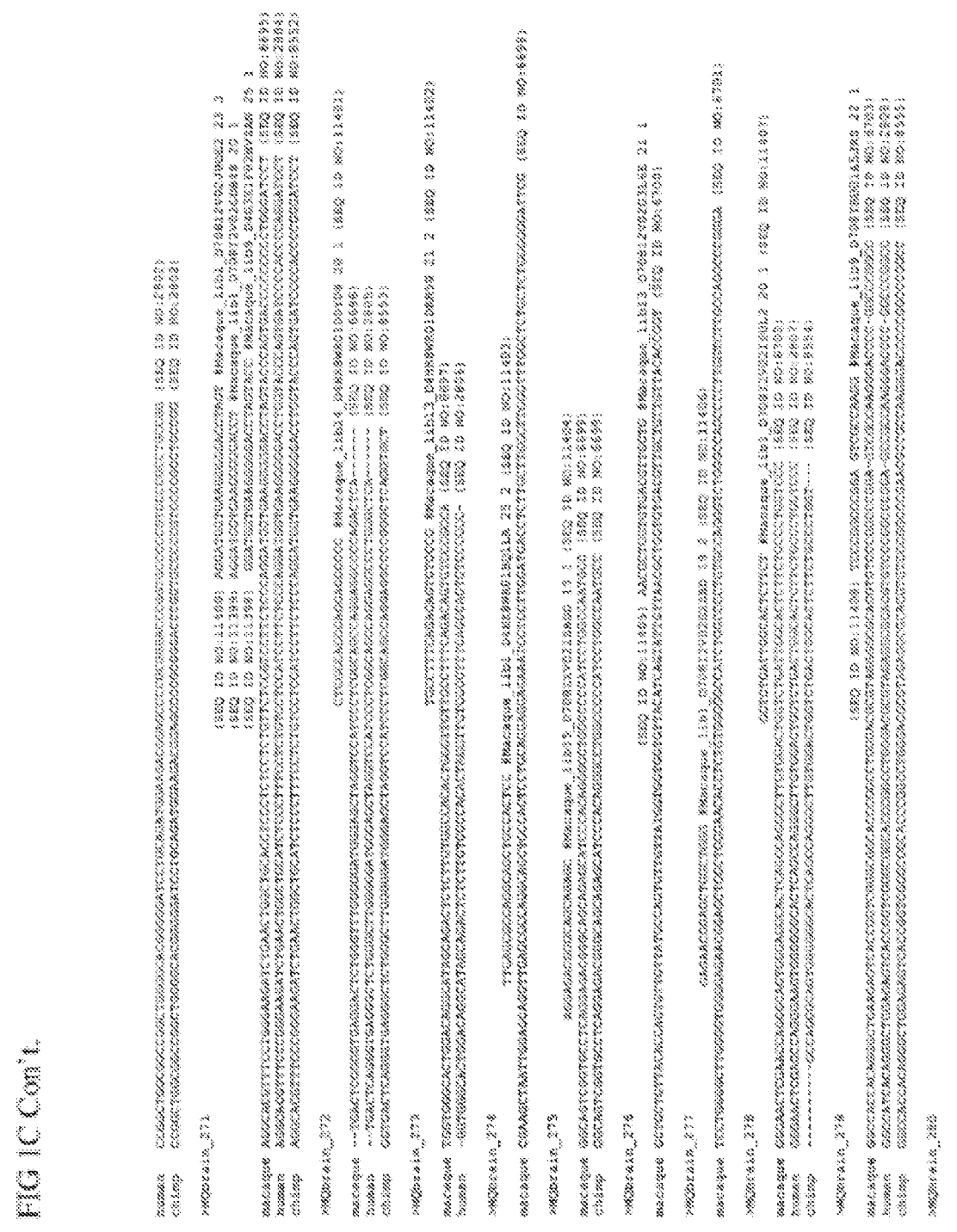
Figure 1C:
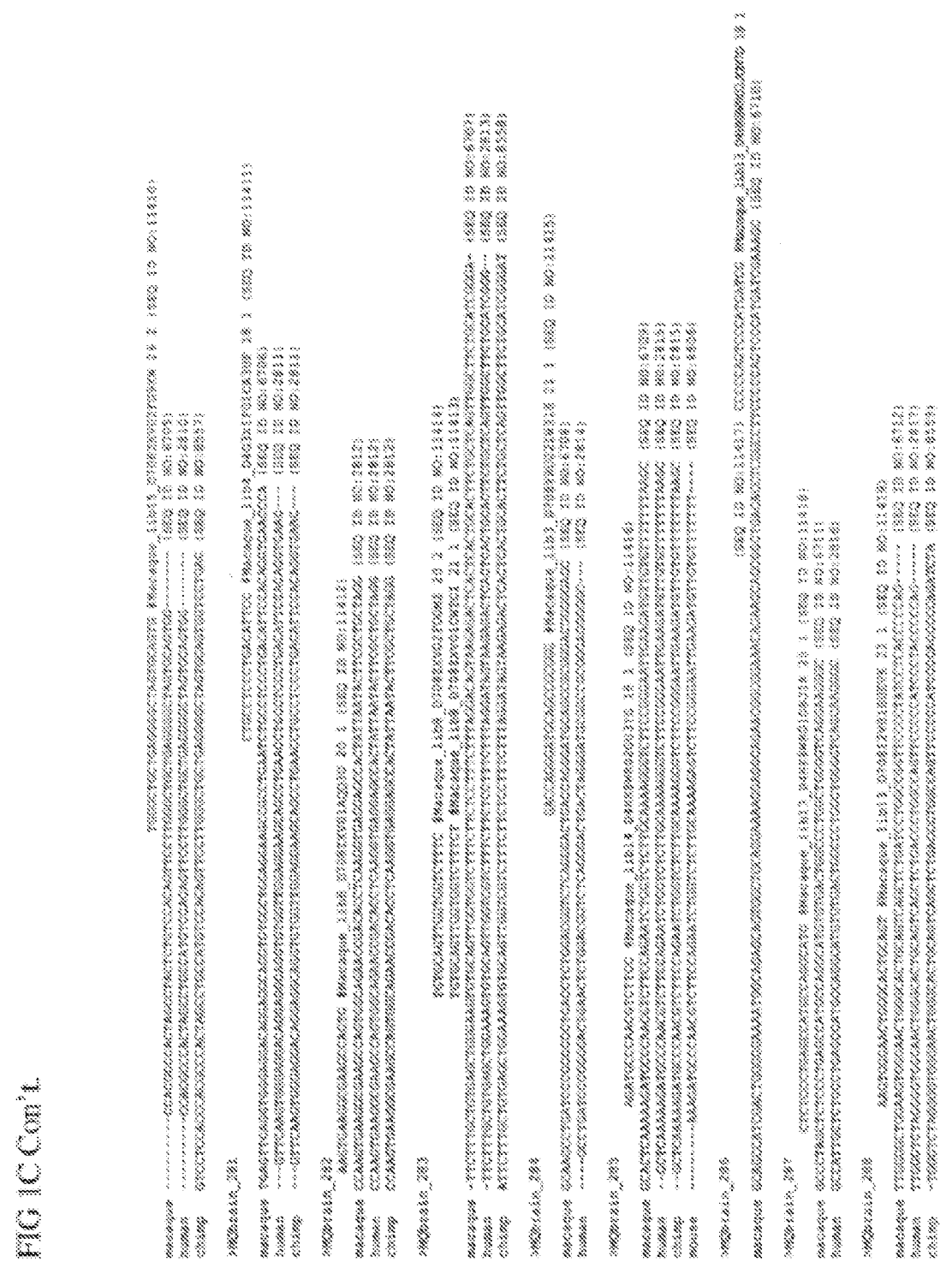
Figure 1C:
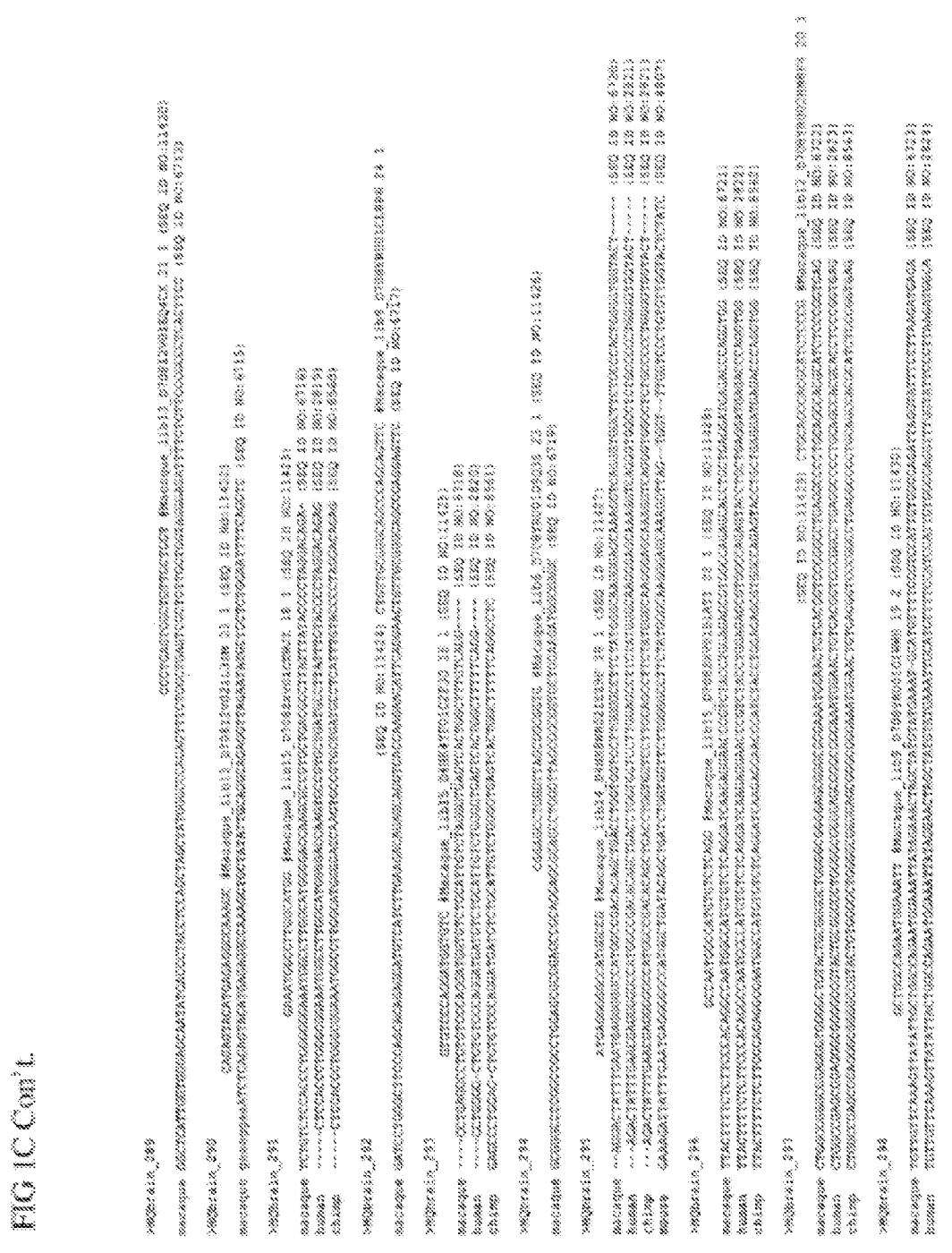
Figure 1C:
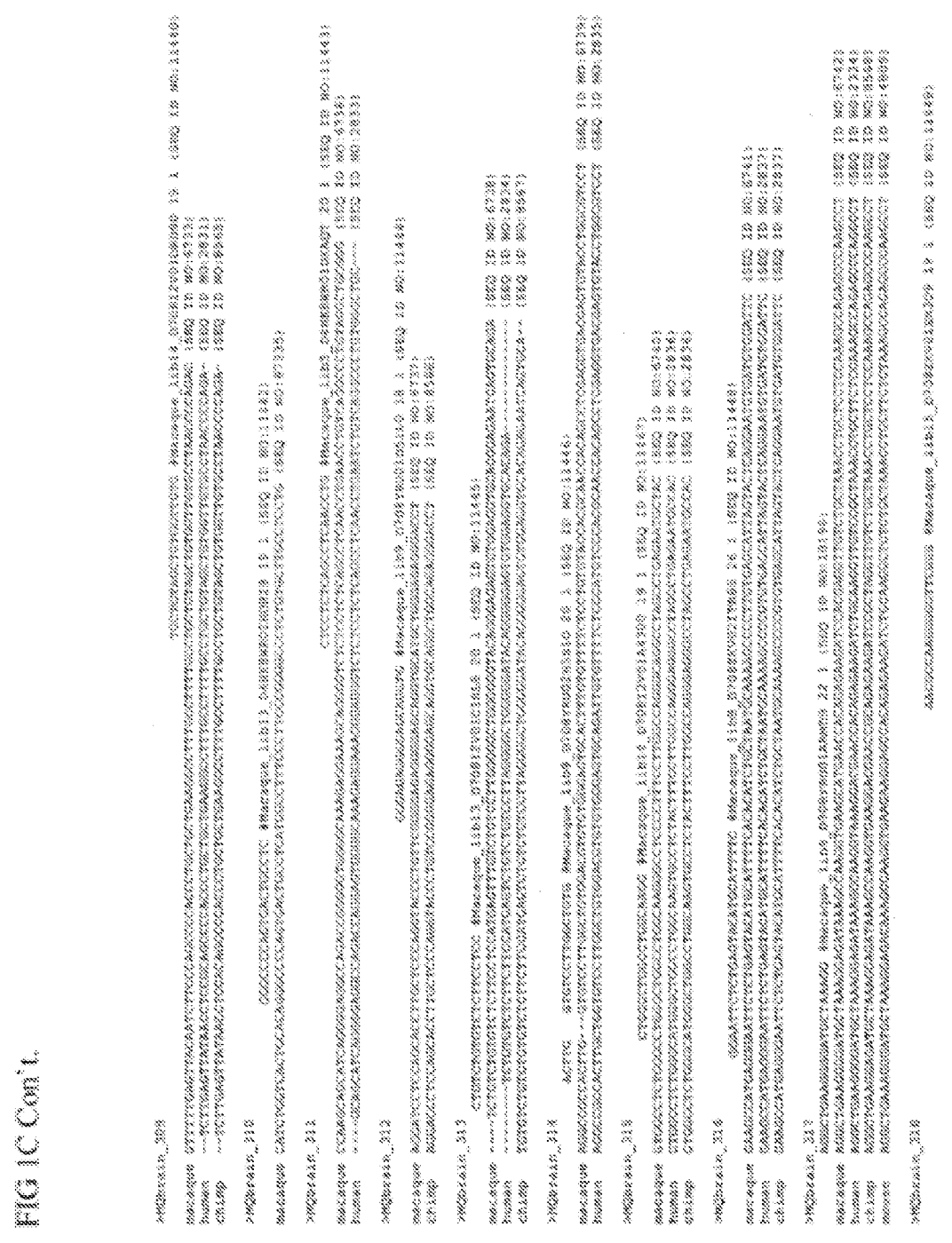
Figure 1C:
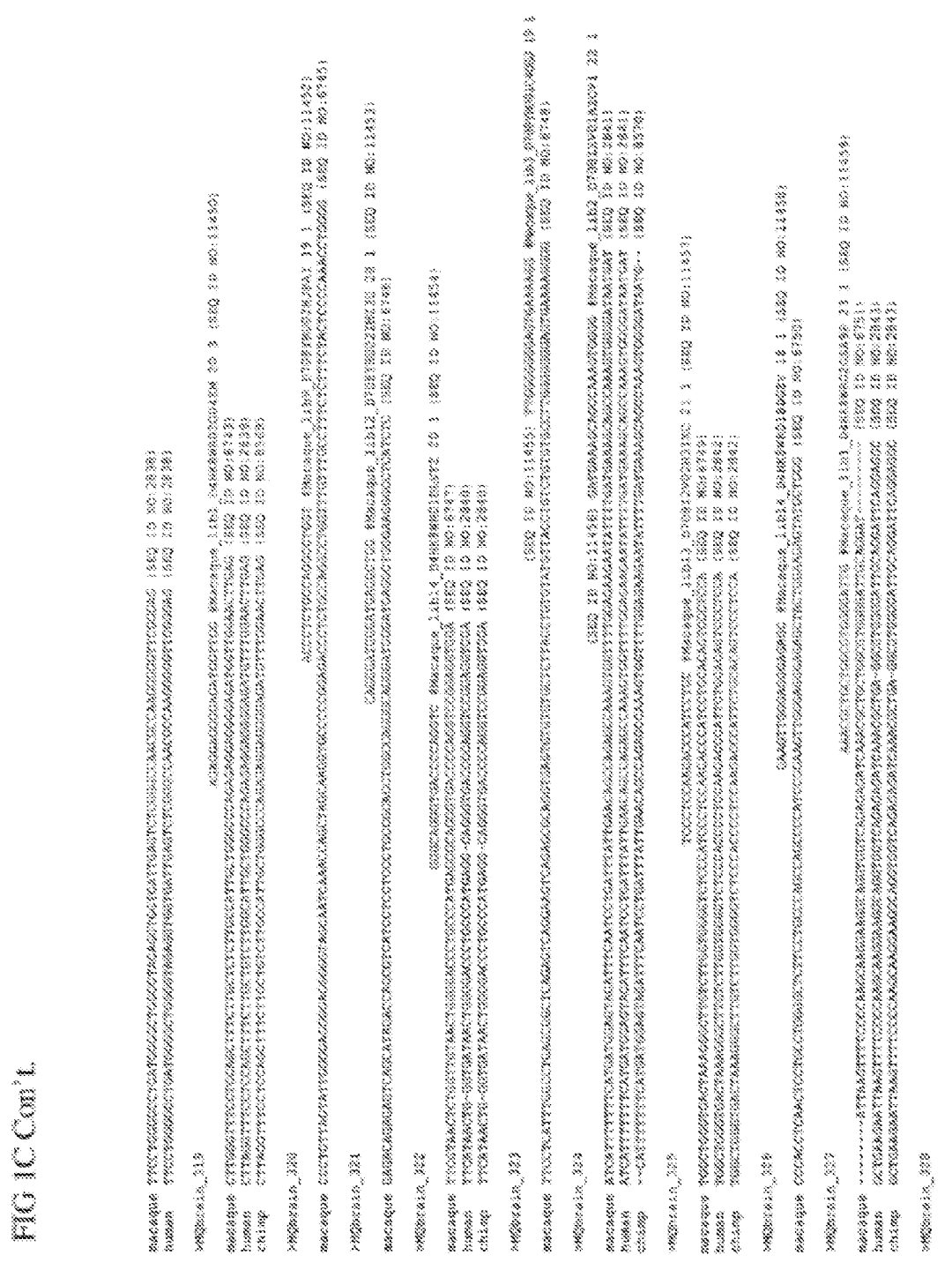
Figure 1C:
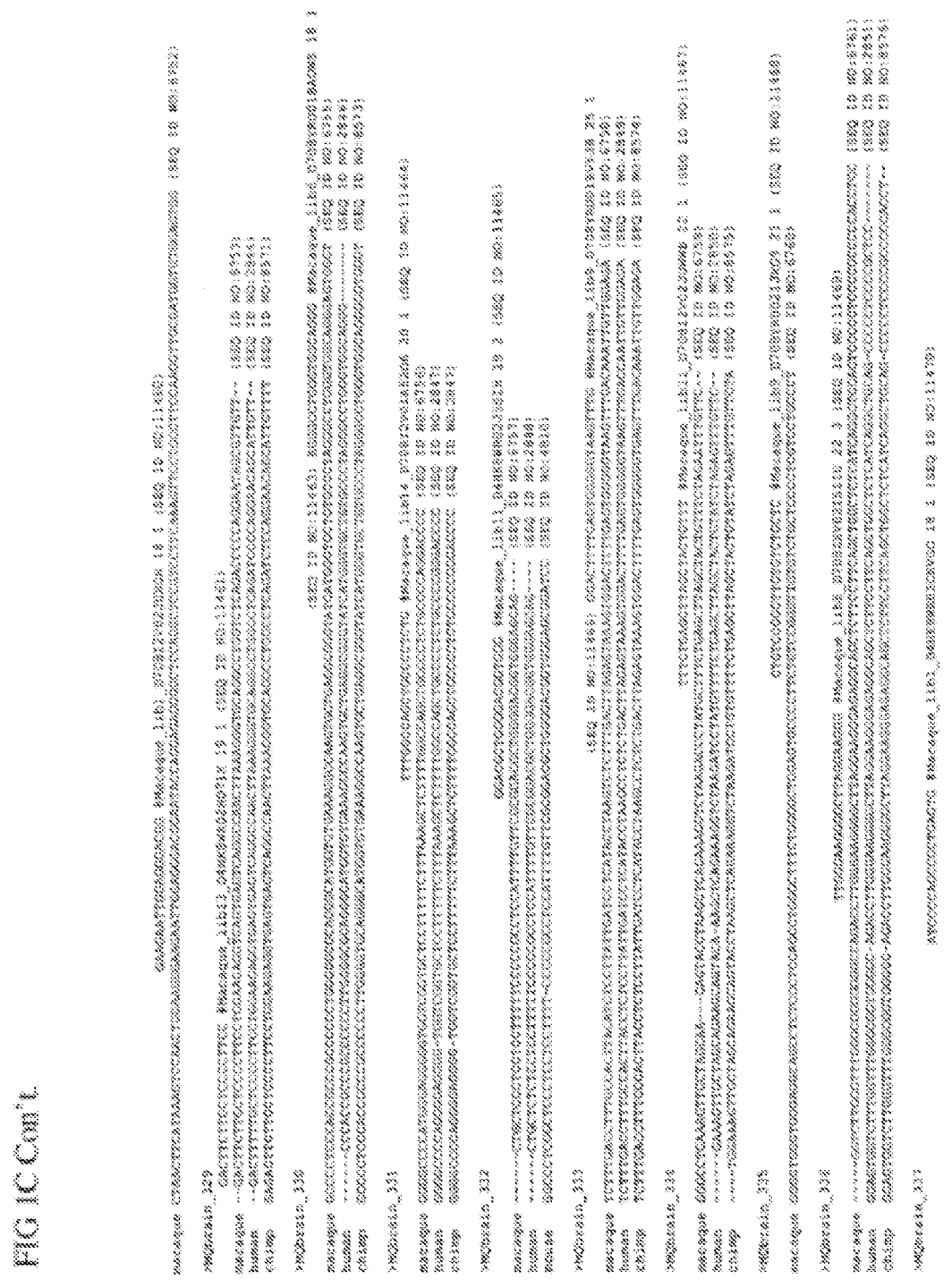
Figure 1C:
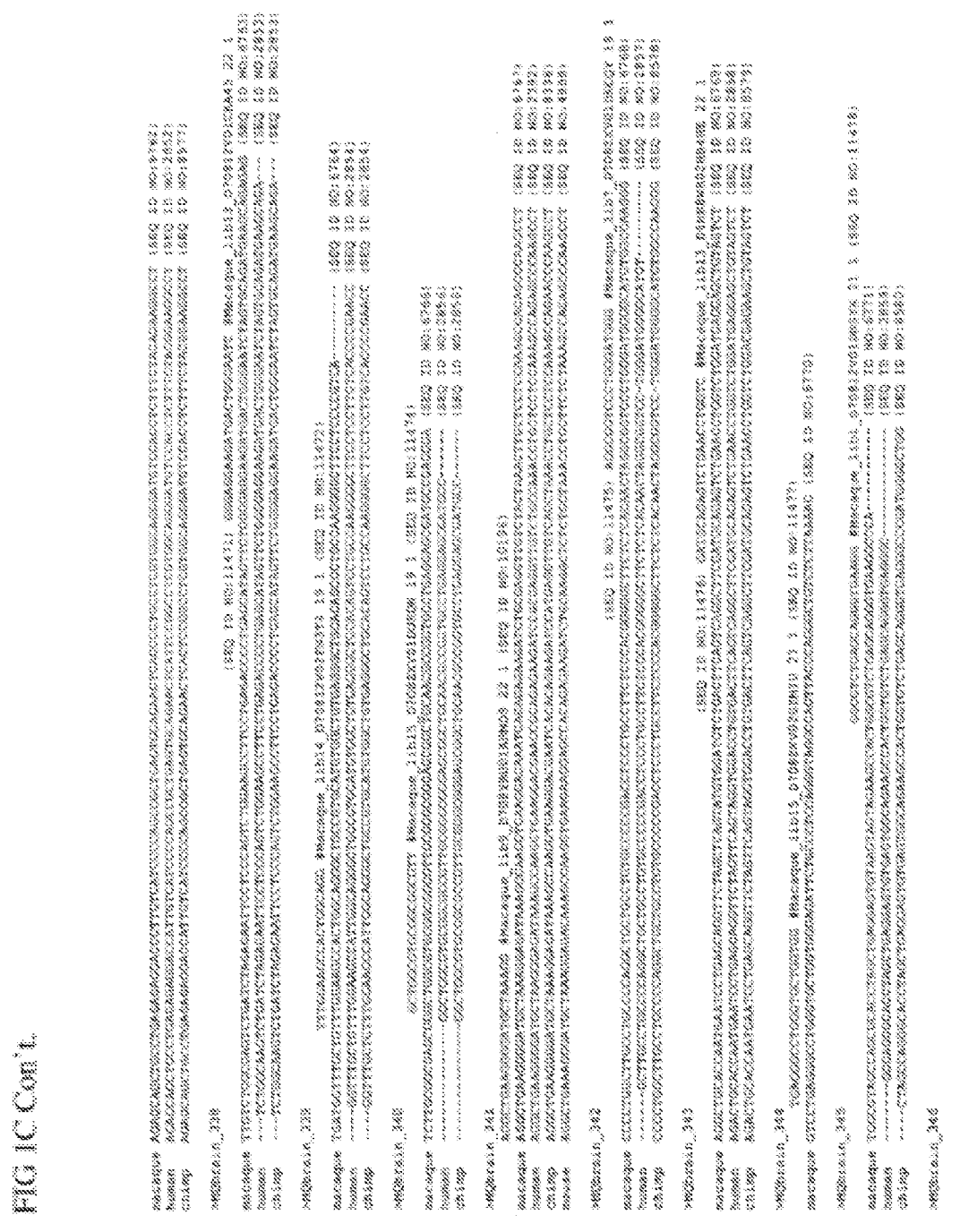
Figure 1C:
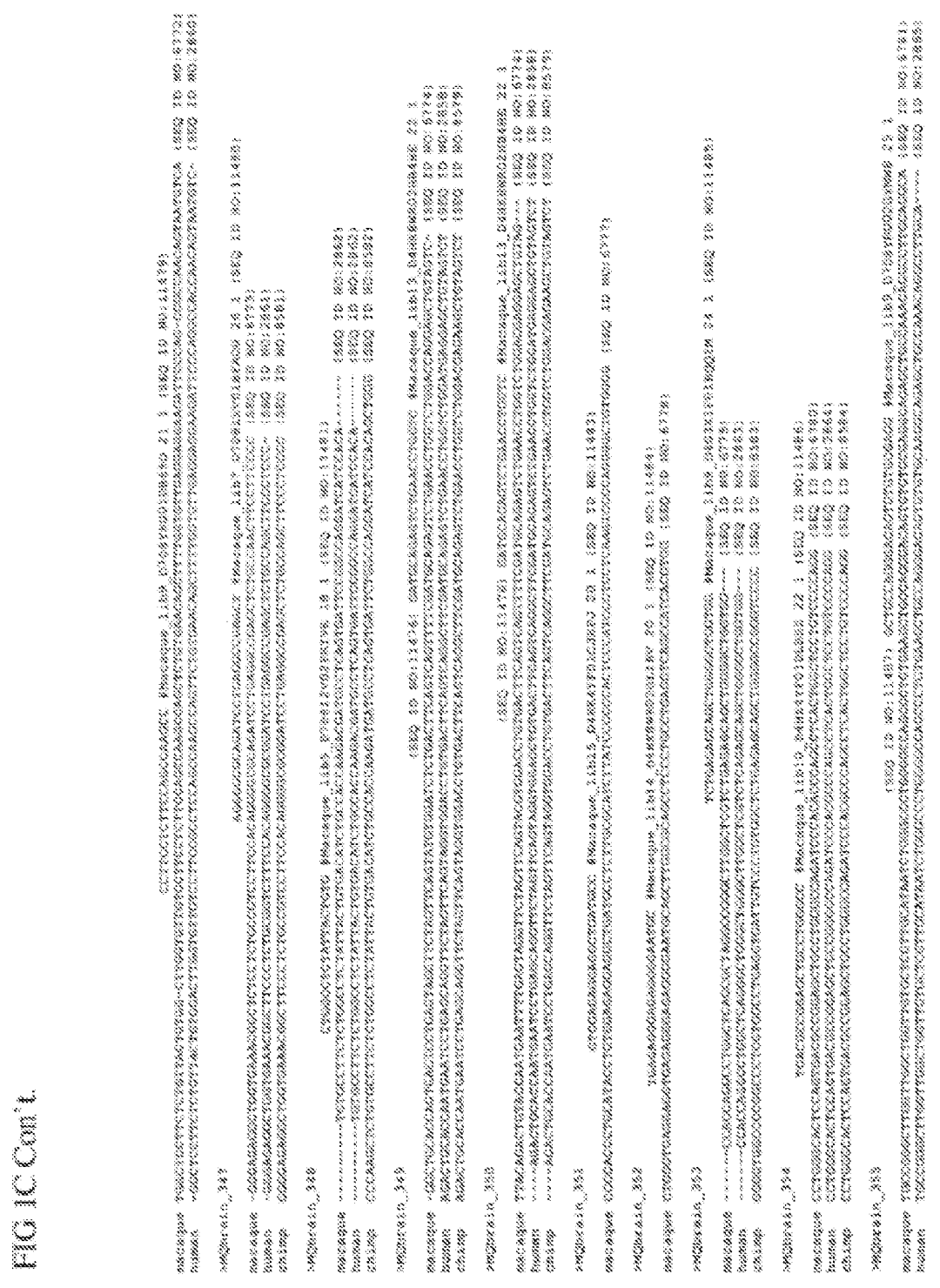
Figure 1C:
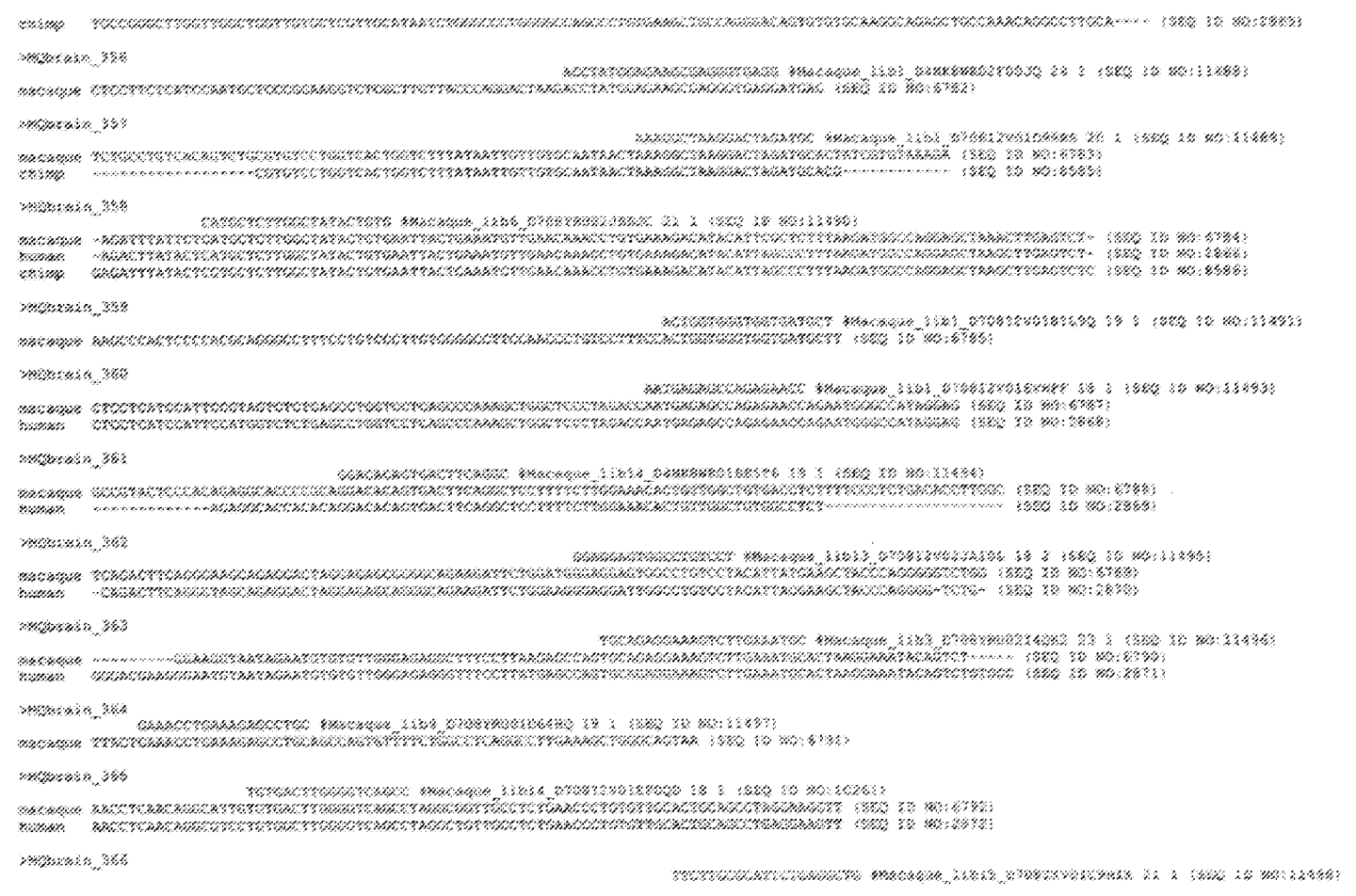
Figure 1C:
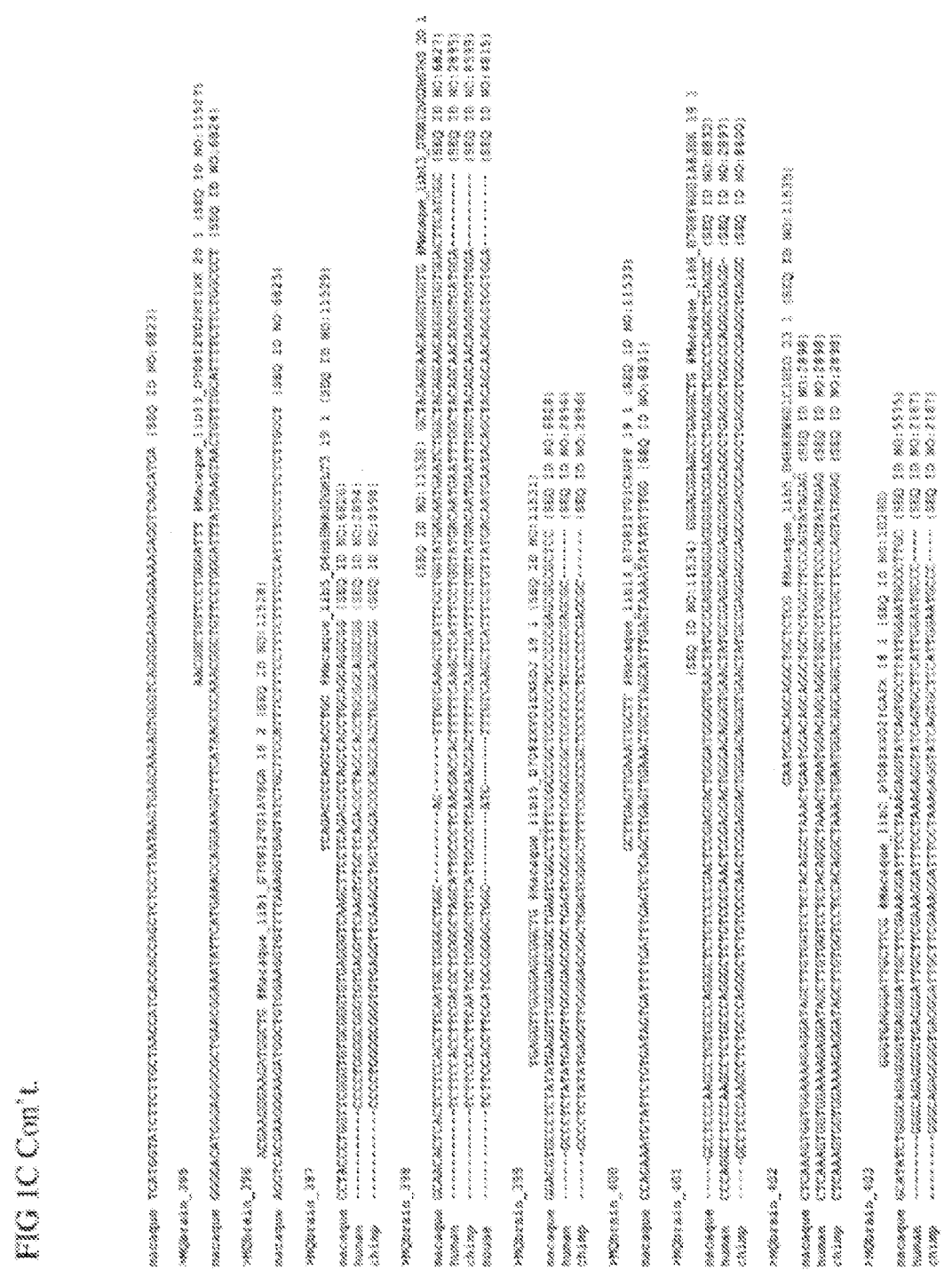
Figure 1C:
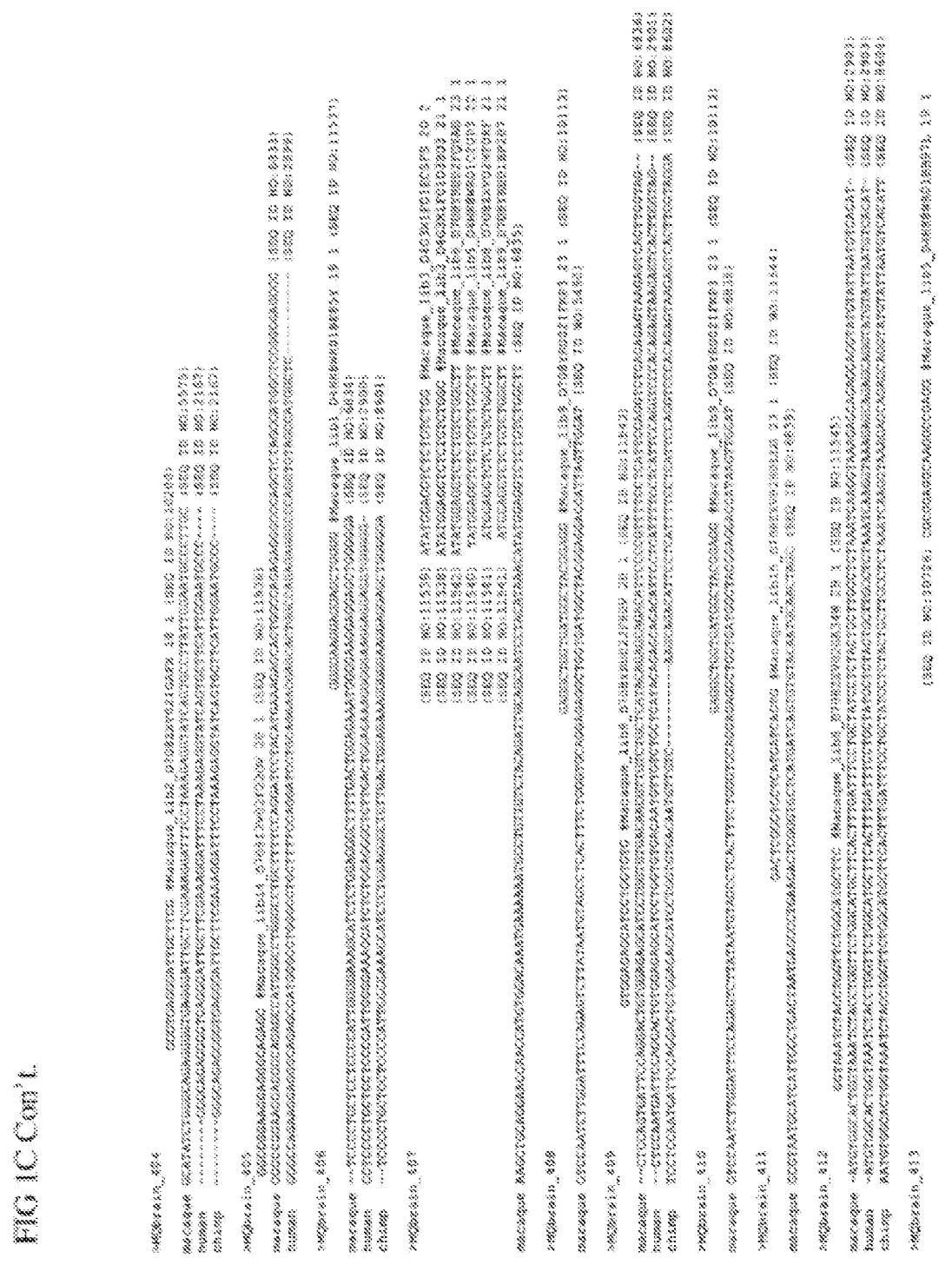
Figure 1C:
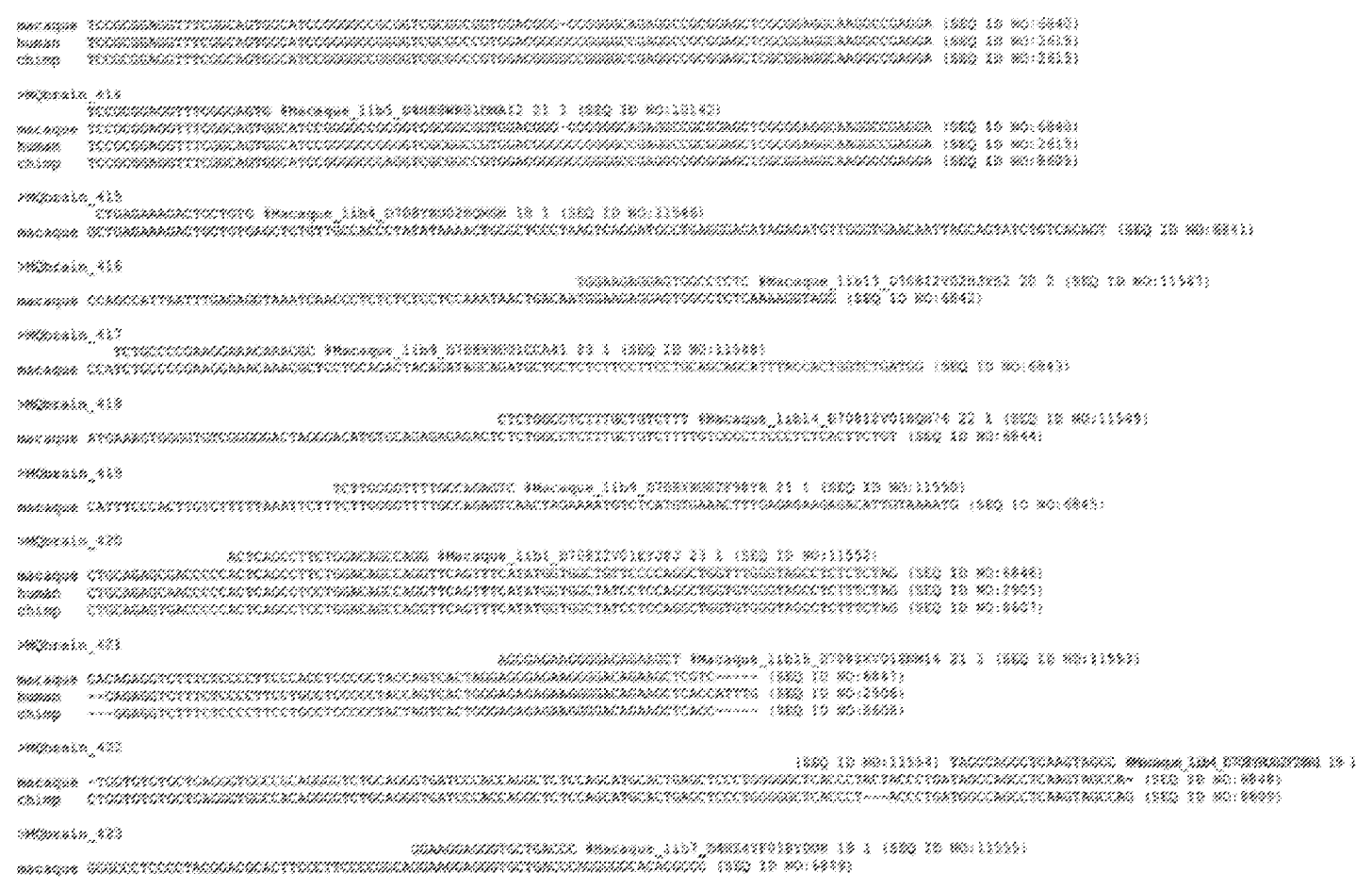
Figure 1C:
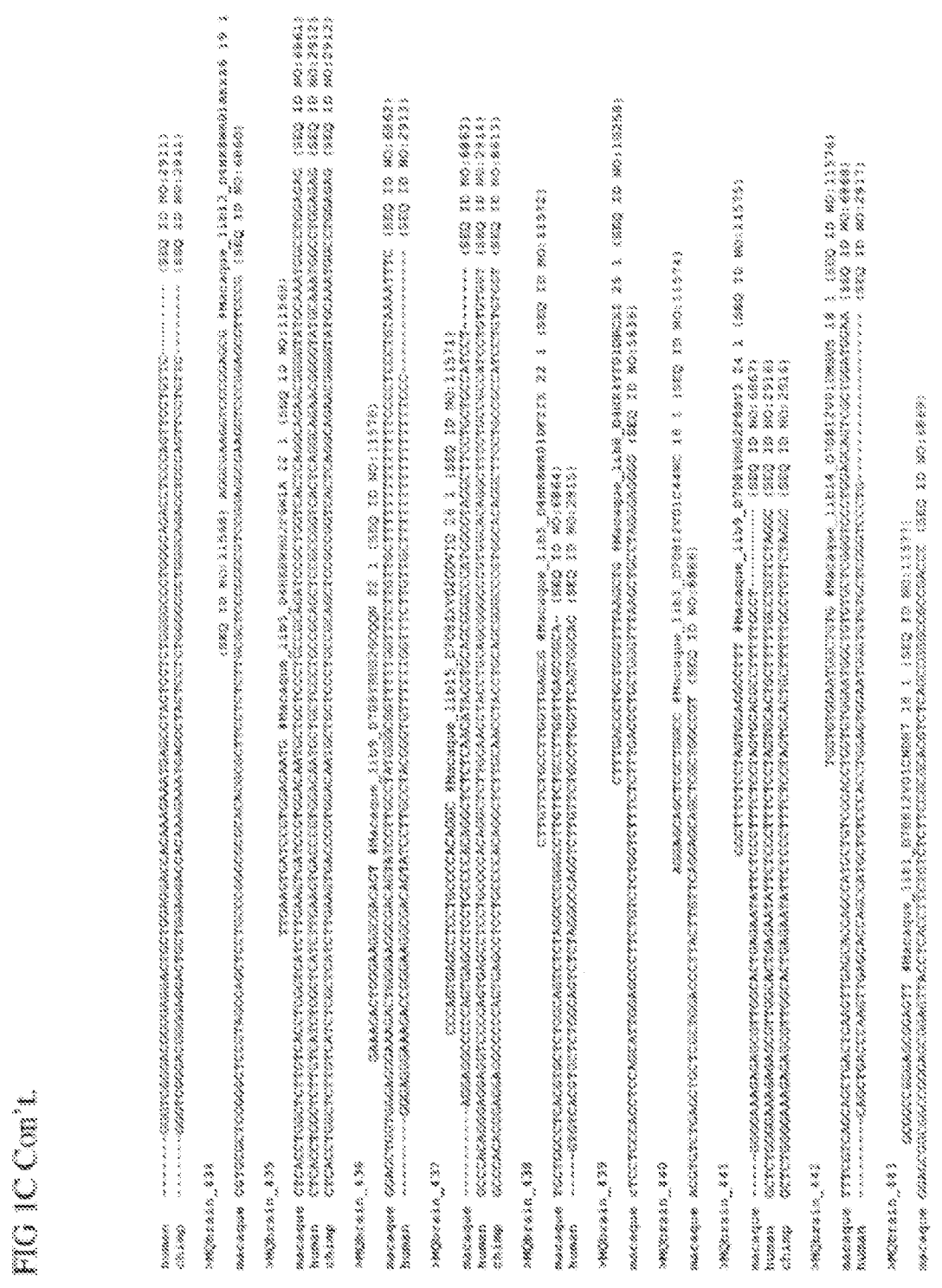
Figure 1C:
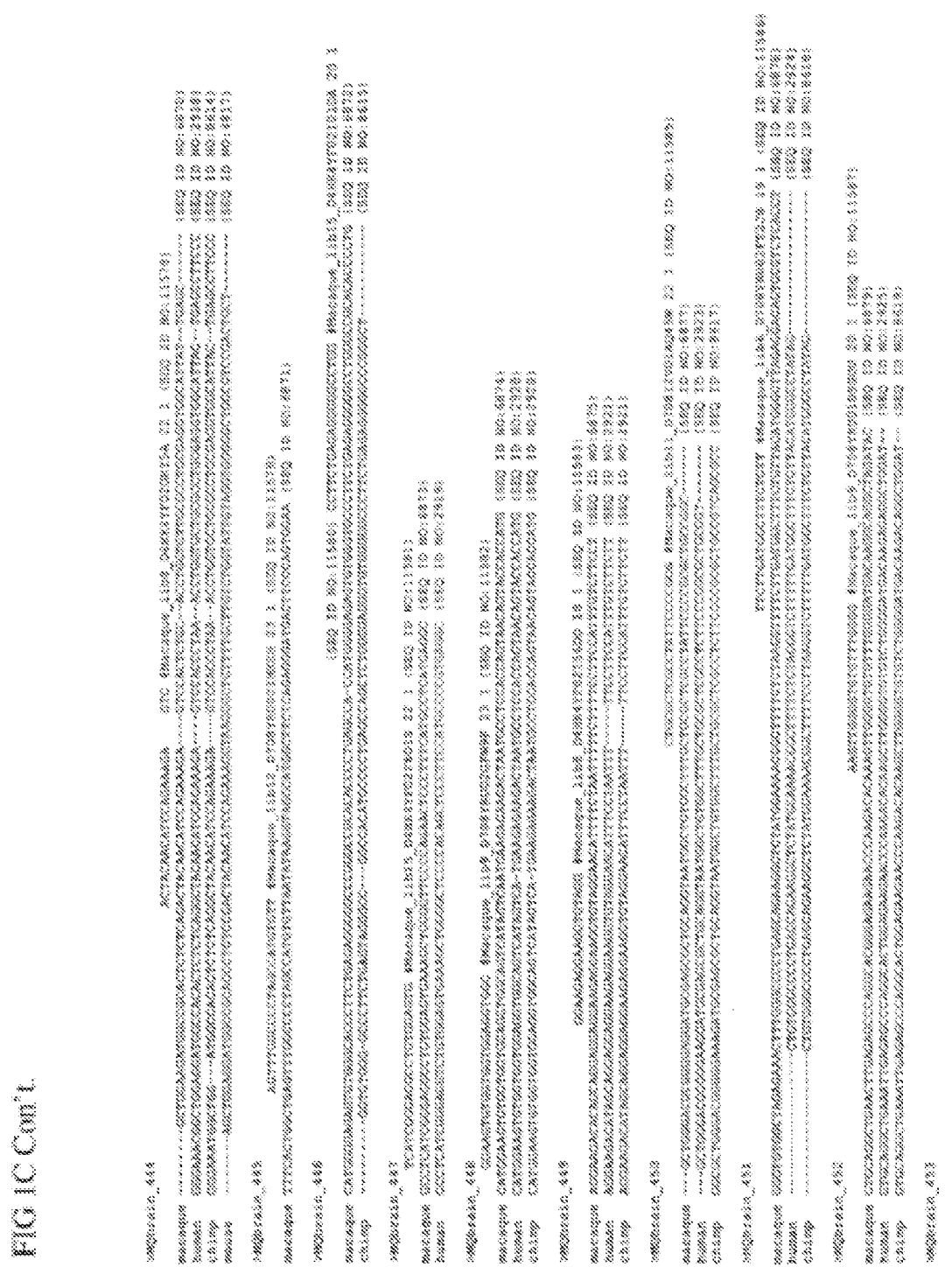
Figure 1C:
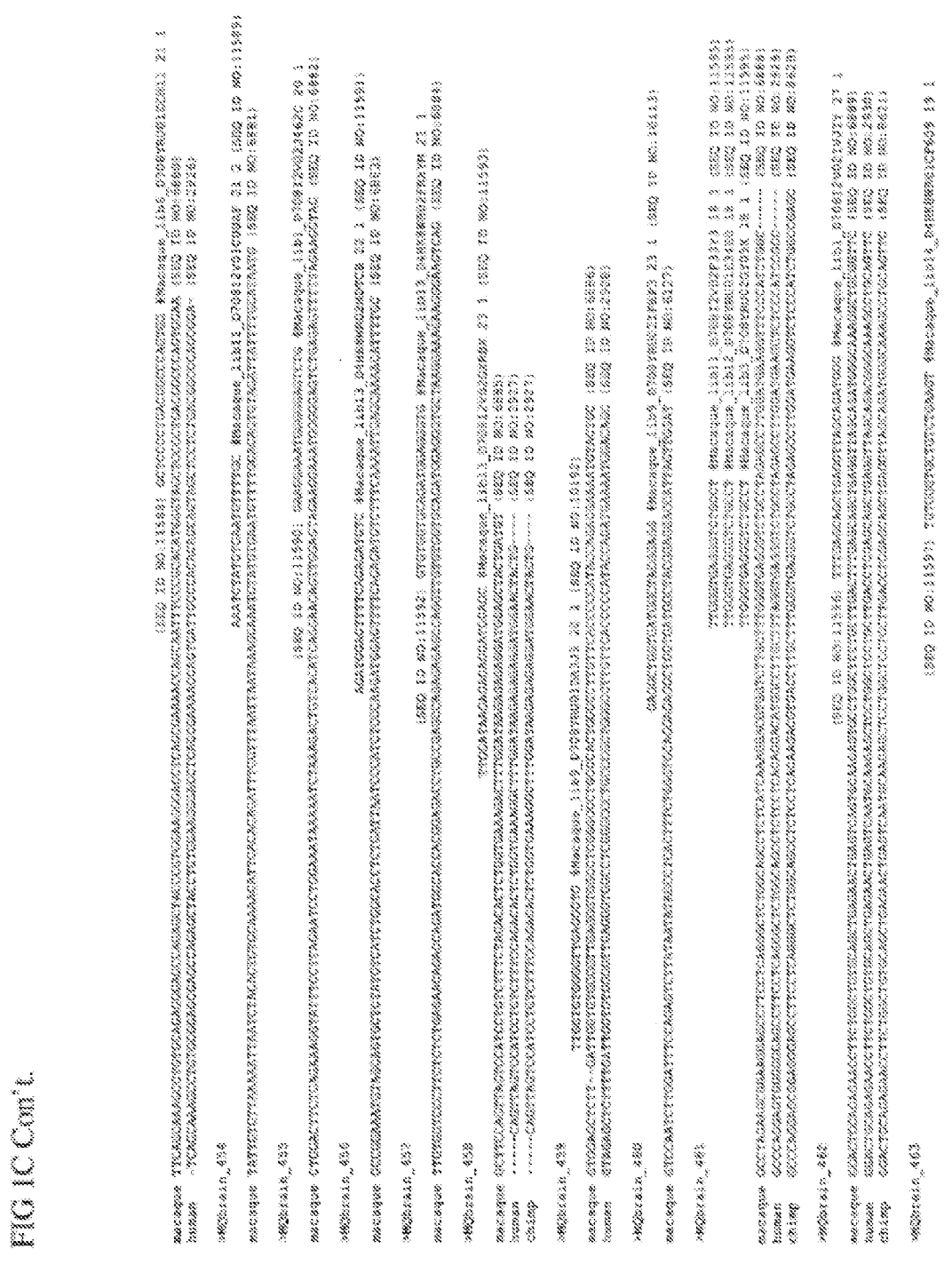
Figure 1C:
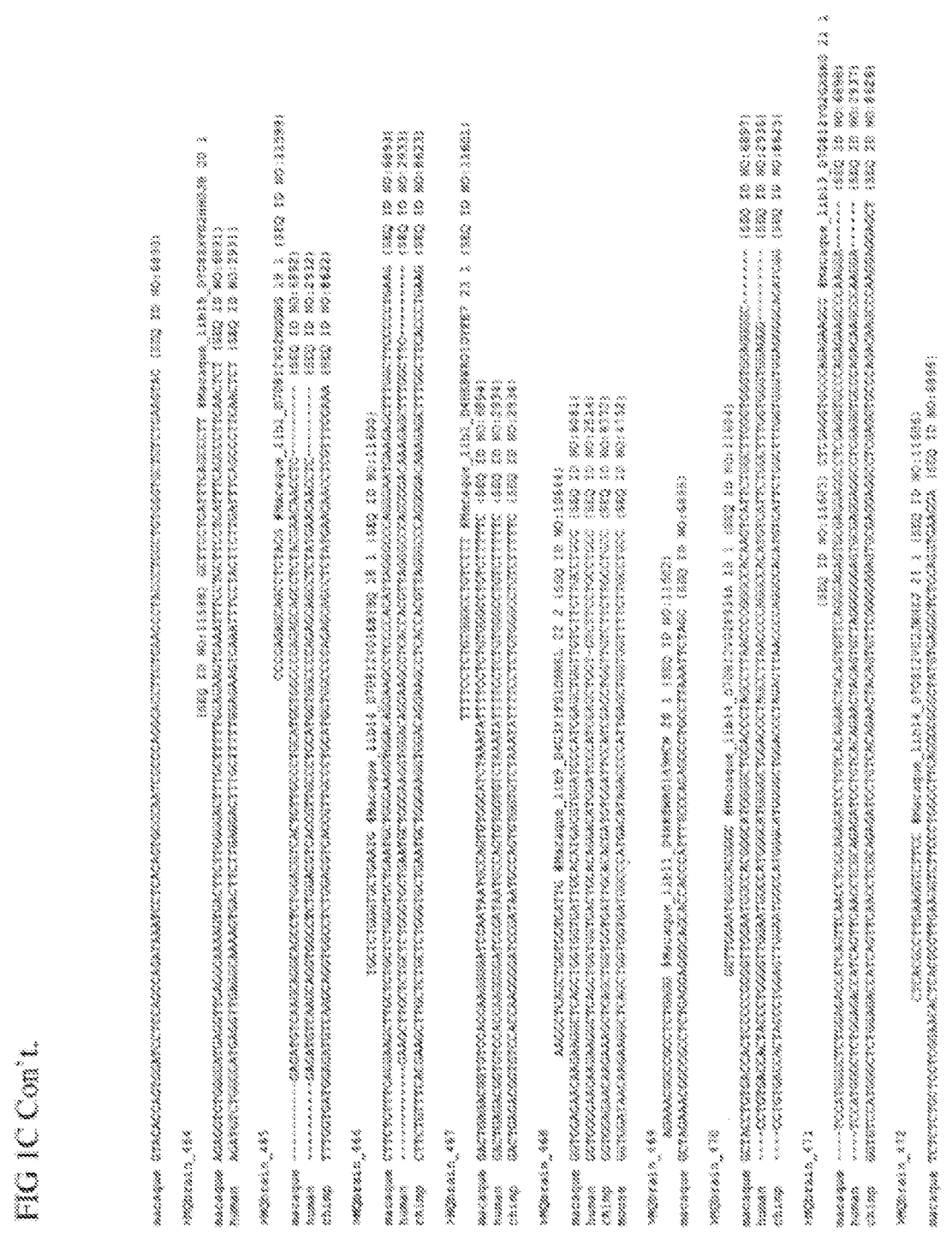
Figure 1C:
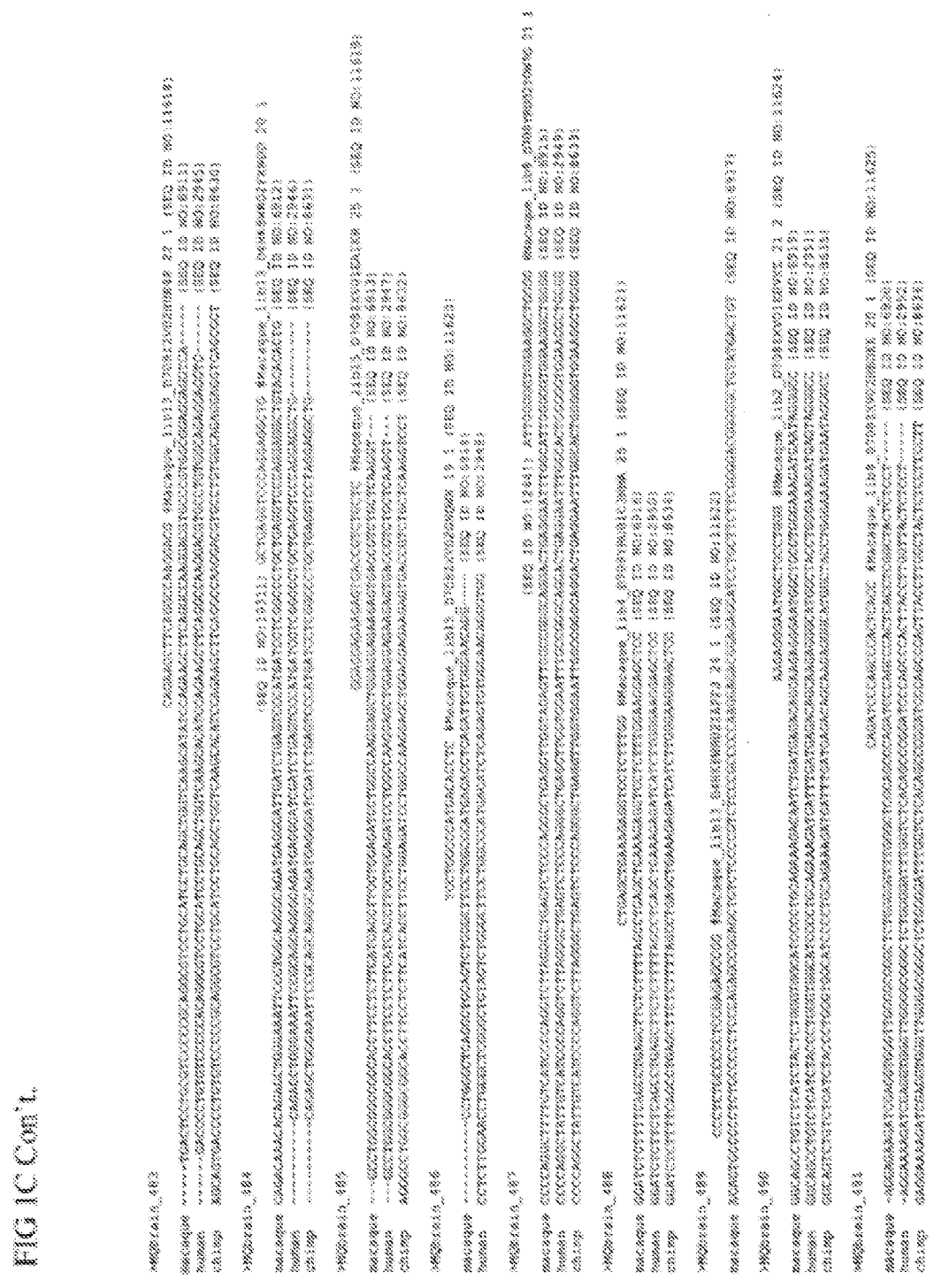
Figure 1C:
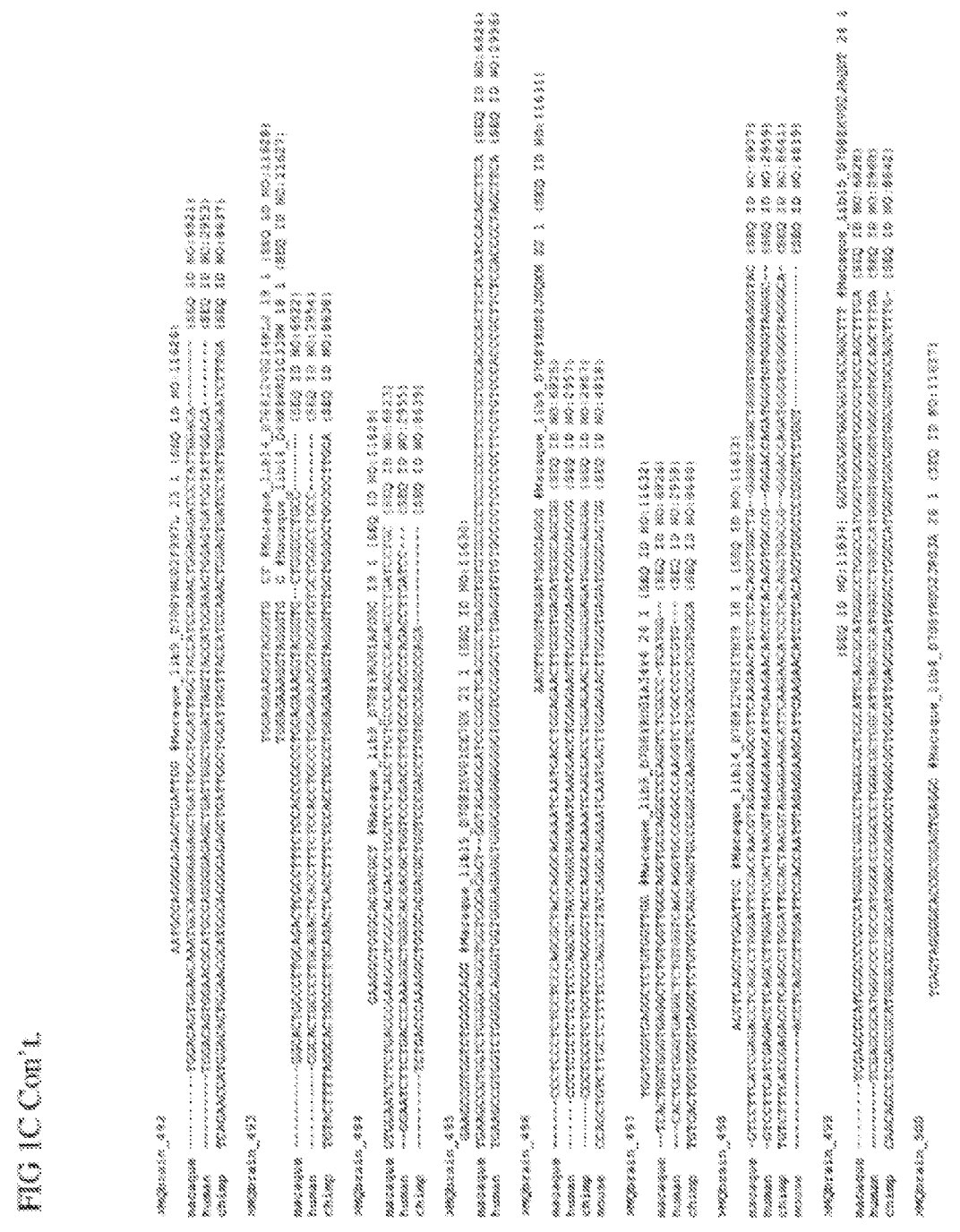
Figure 1C:
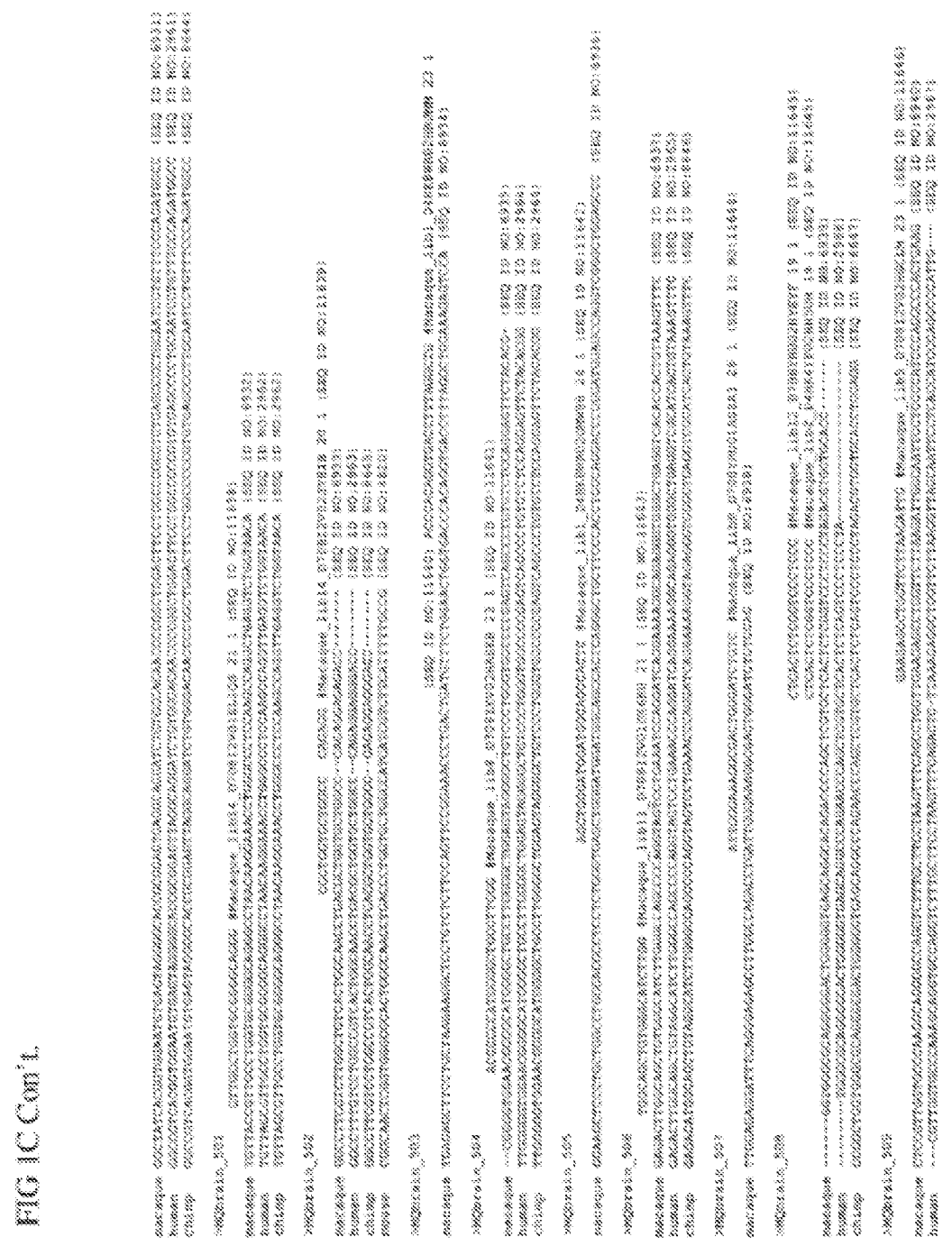
Figure 1C:
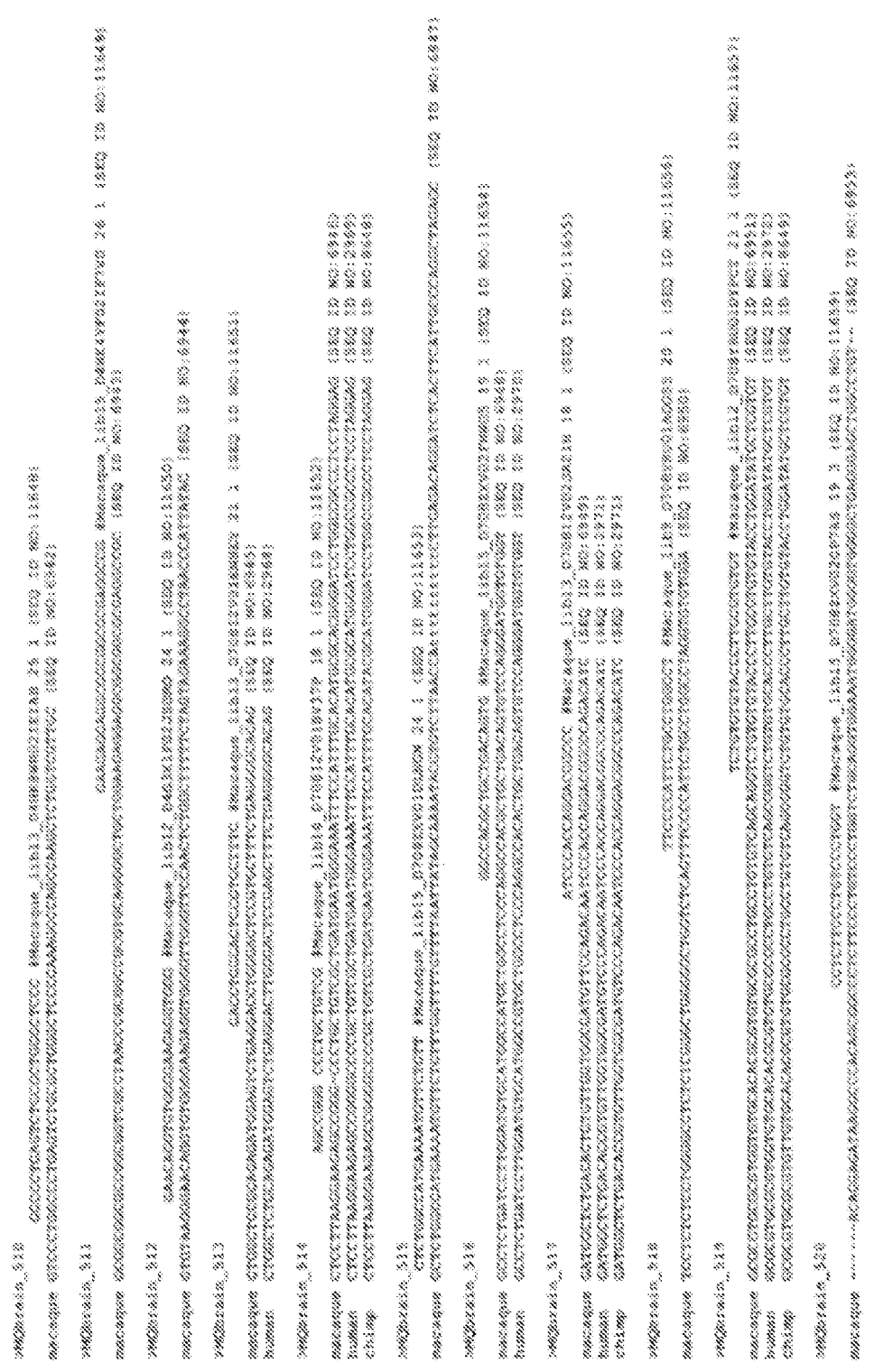
Figure 1C:
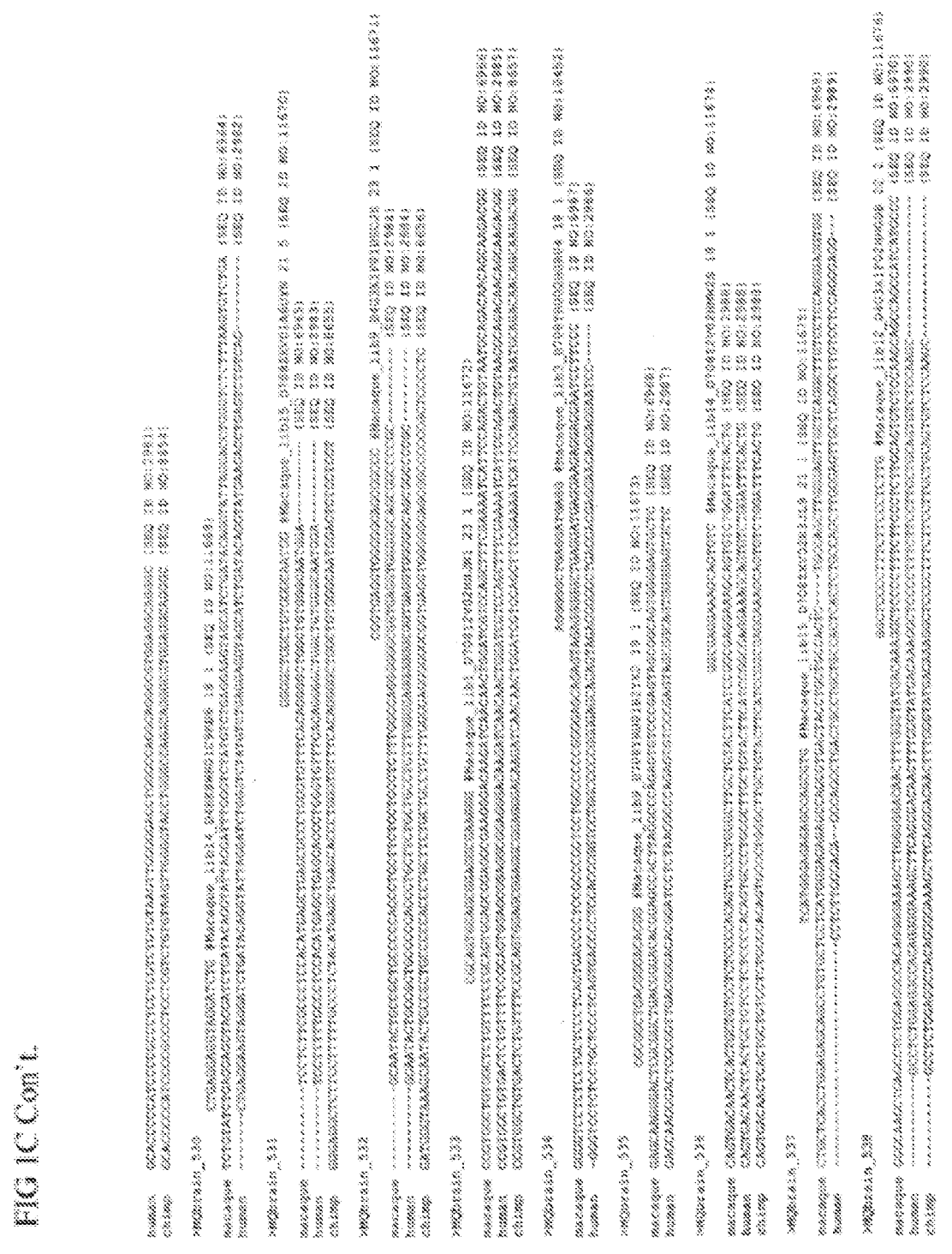
Figure 1C:
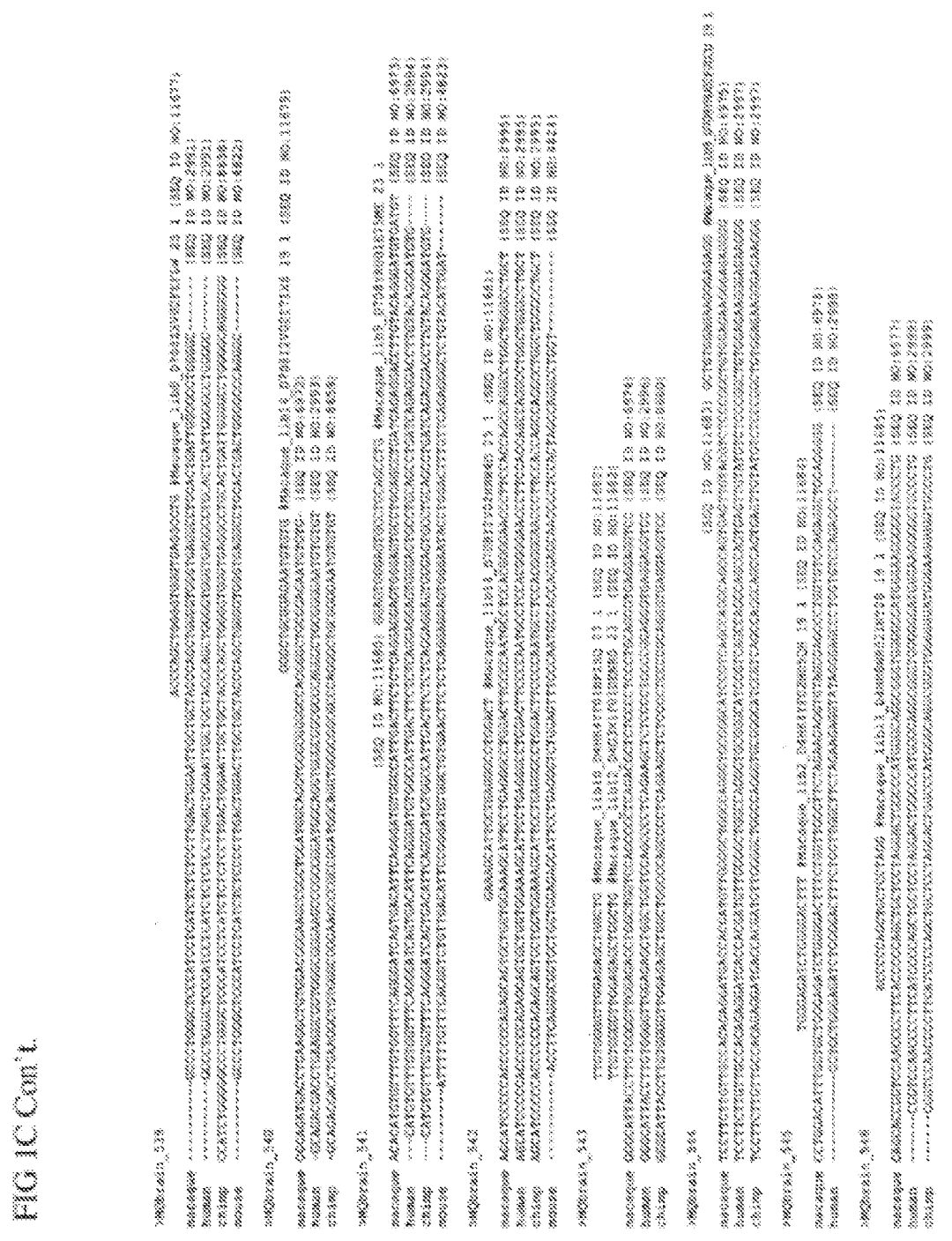
Figure 1C:
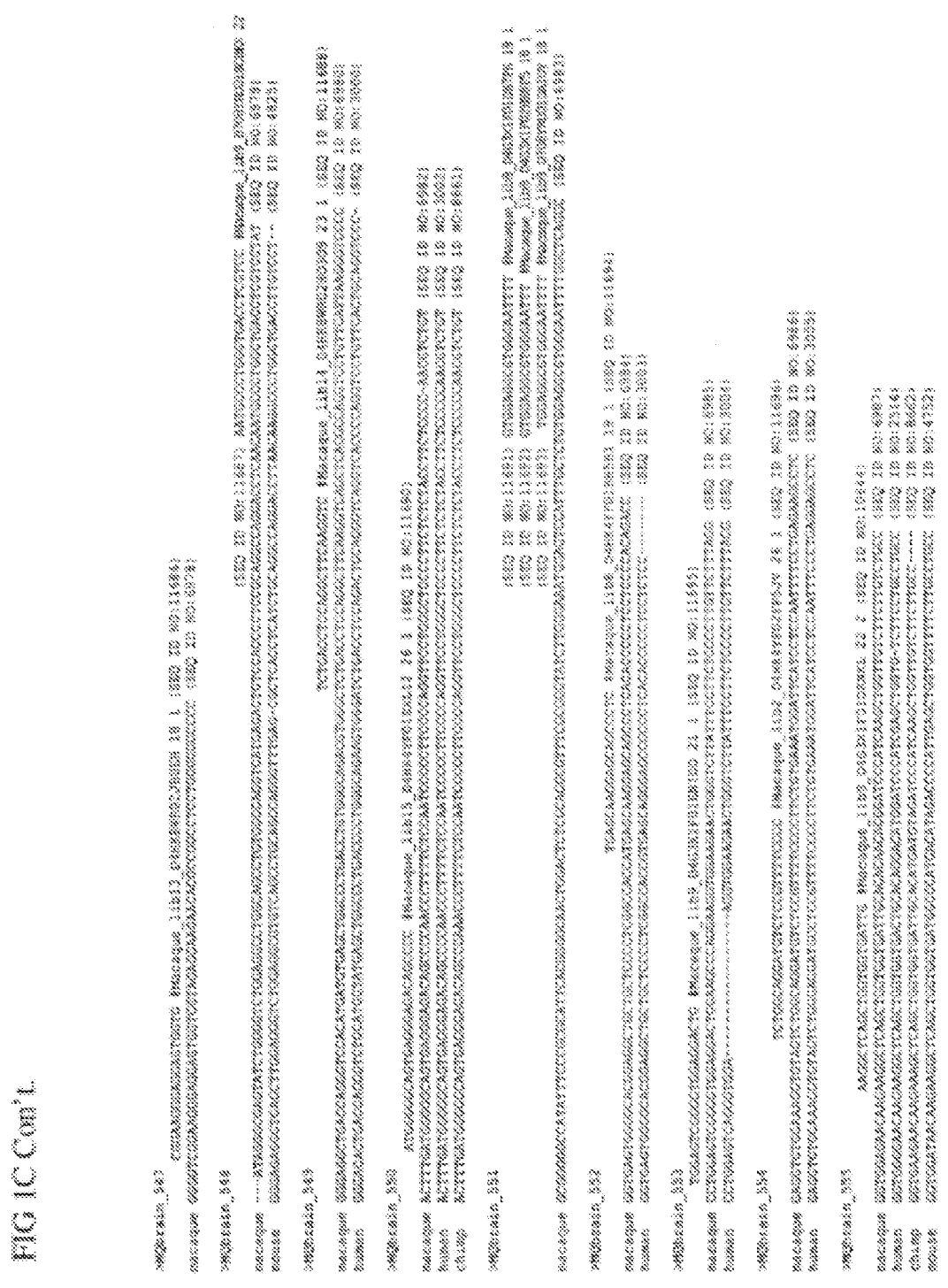
Figure 1C:
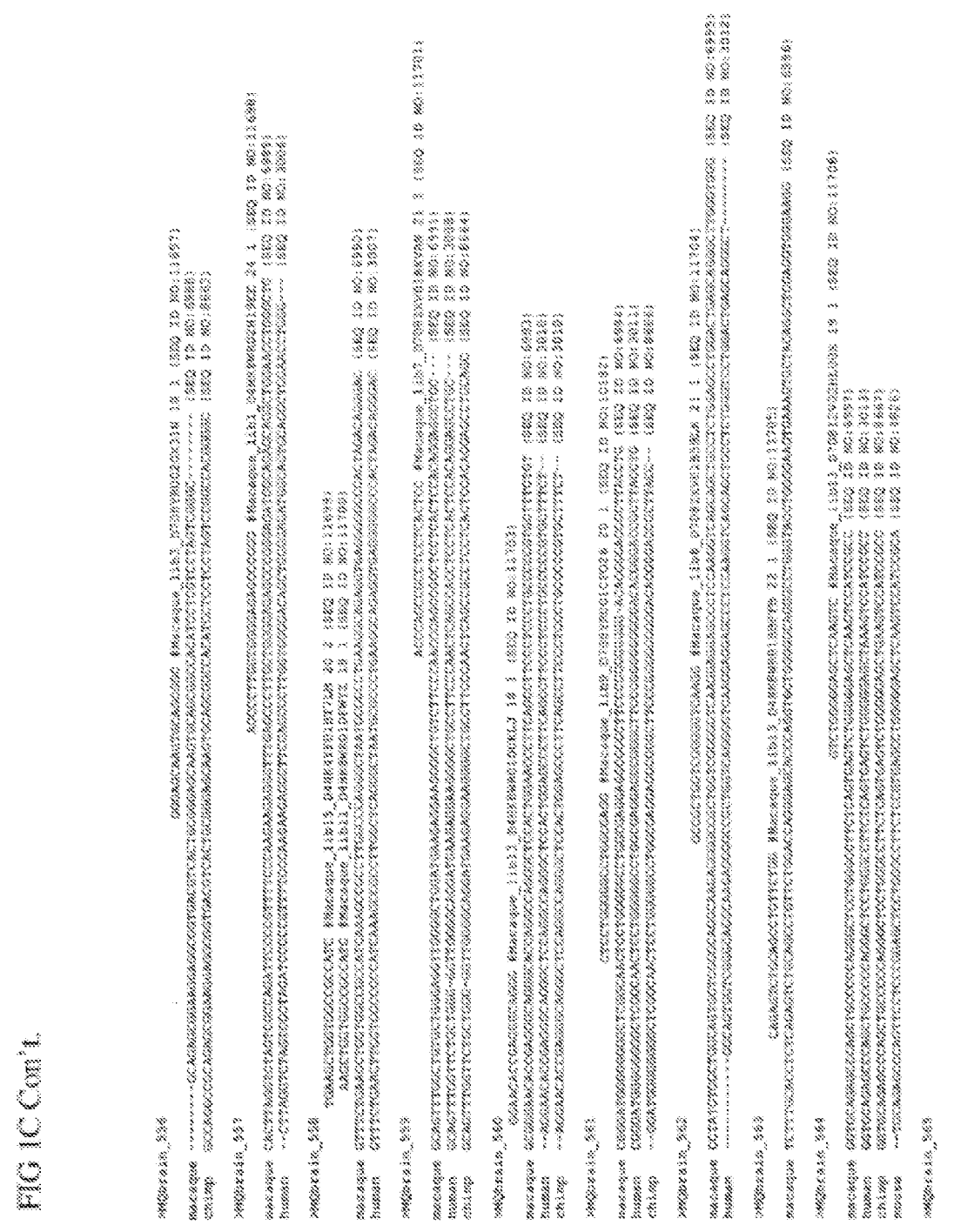
Figure 1C:
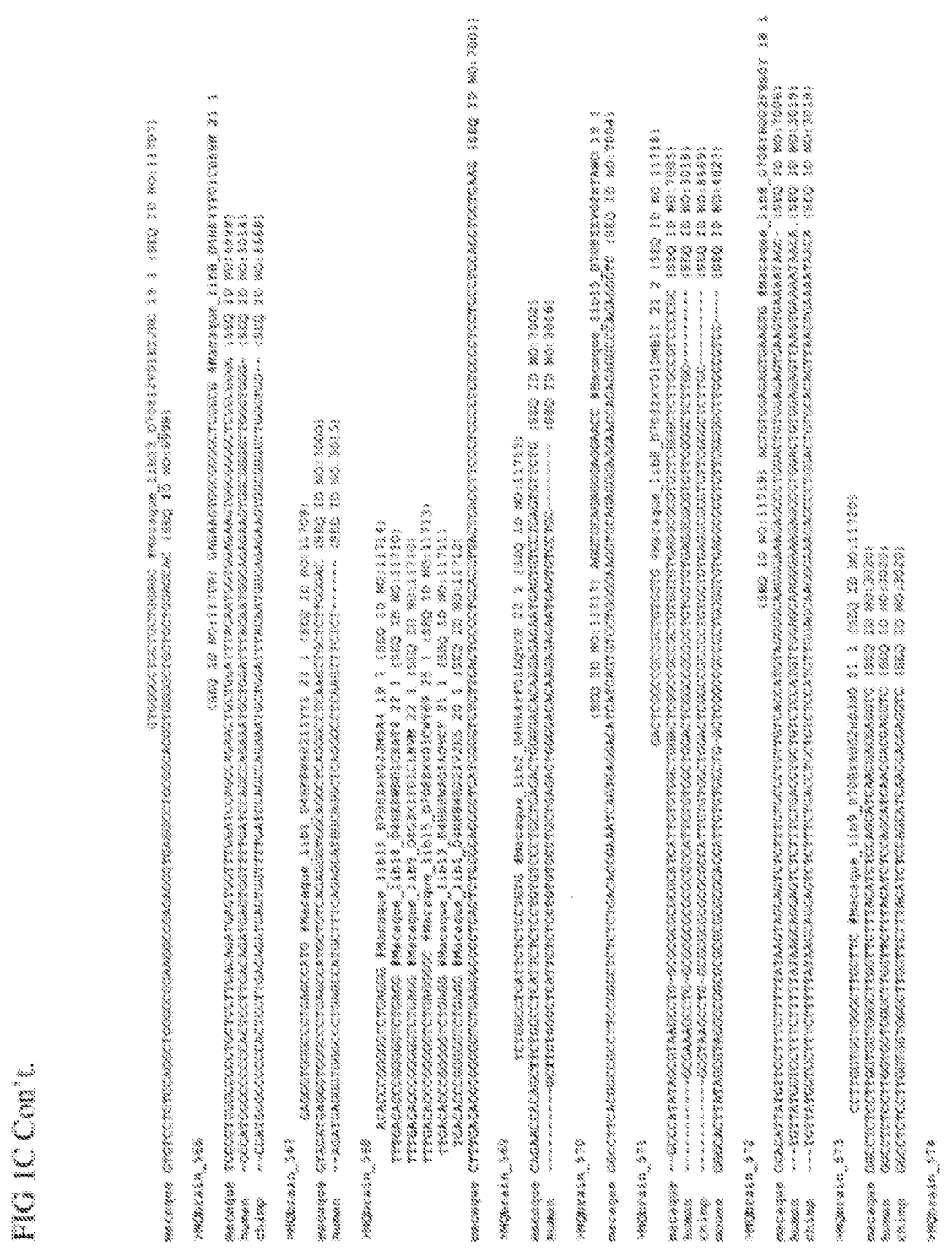
Figure 1C:
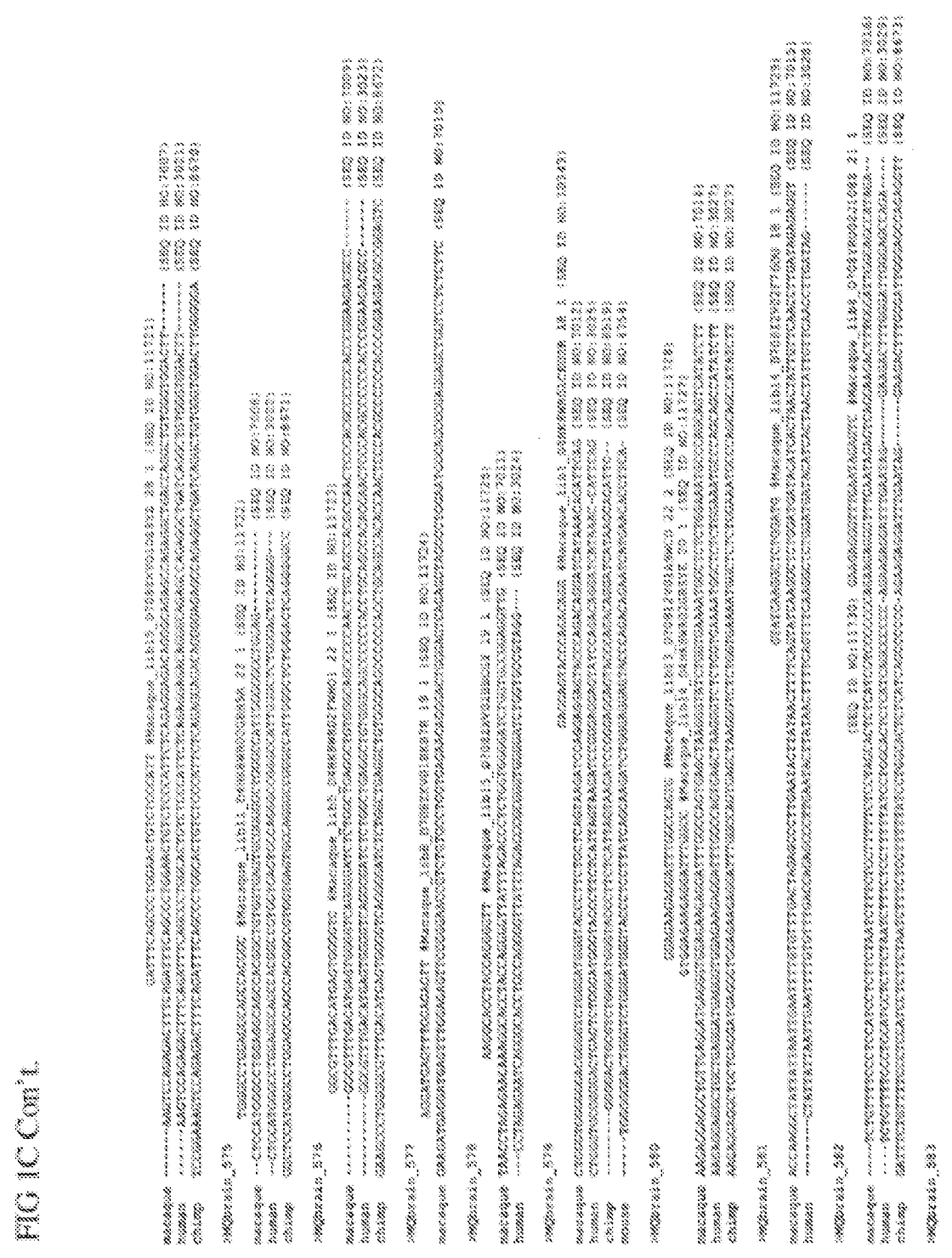
Figure 1C:
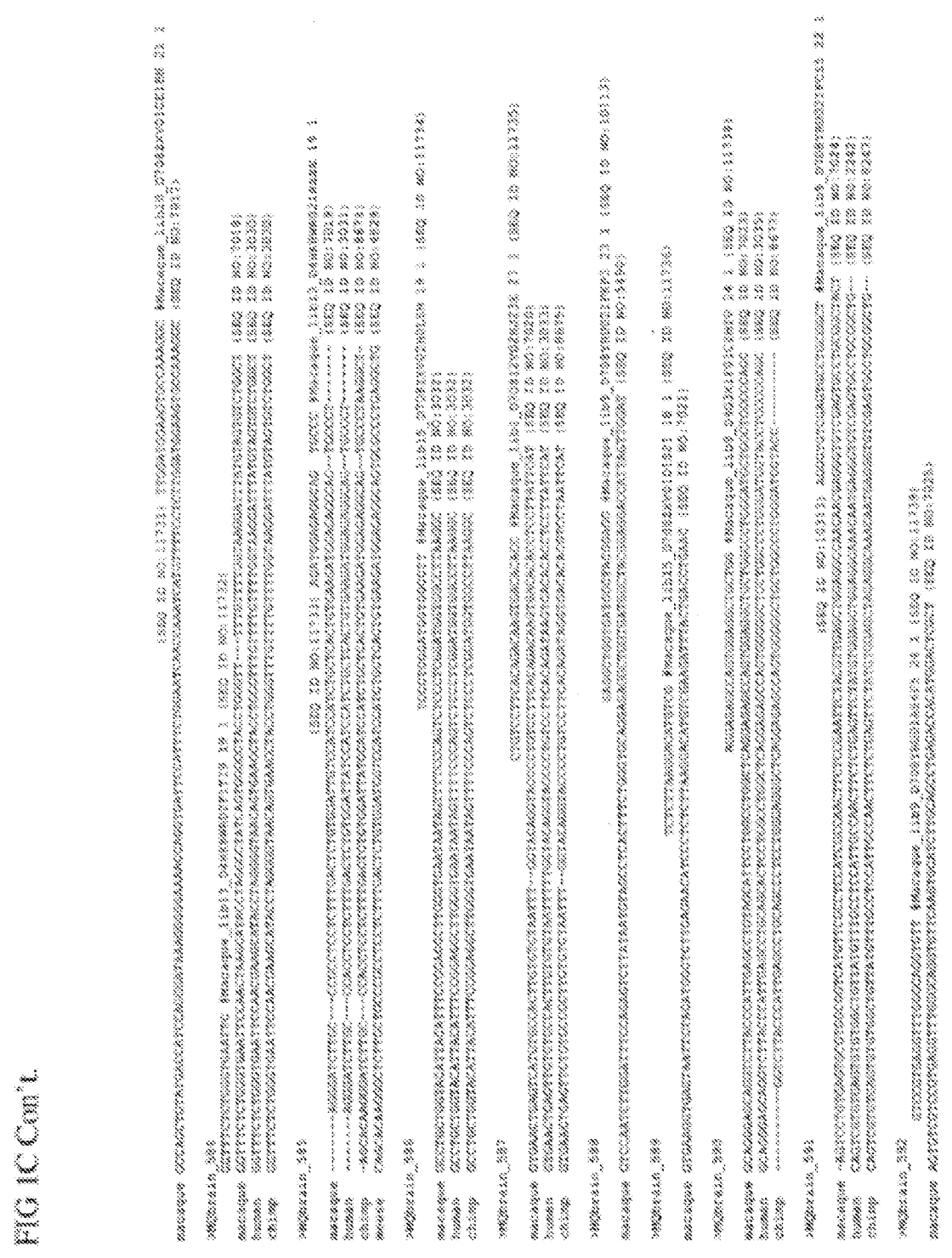
Figure 1C:
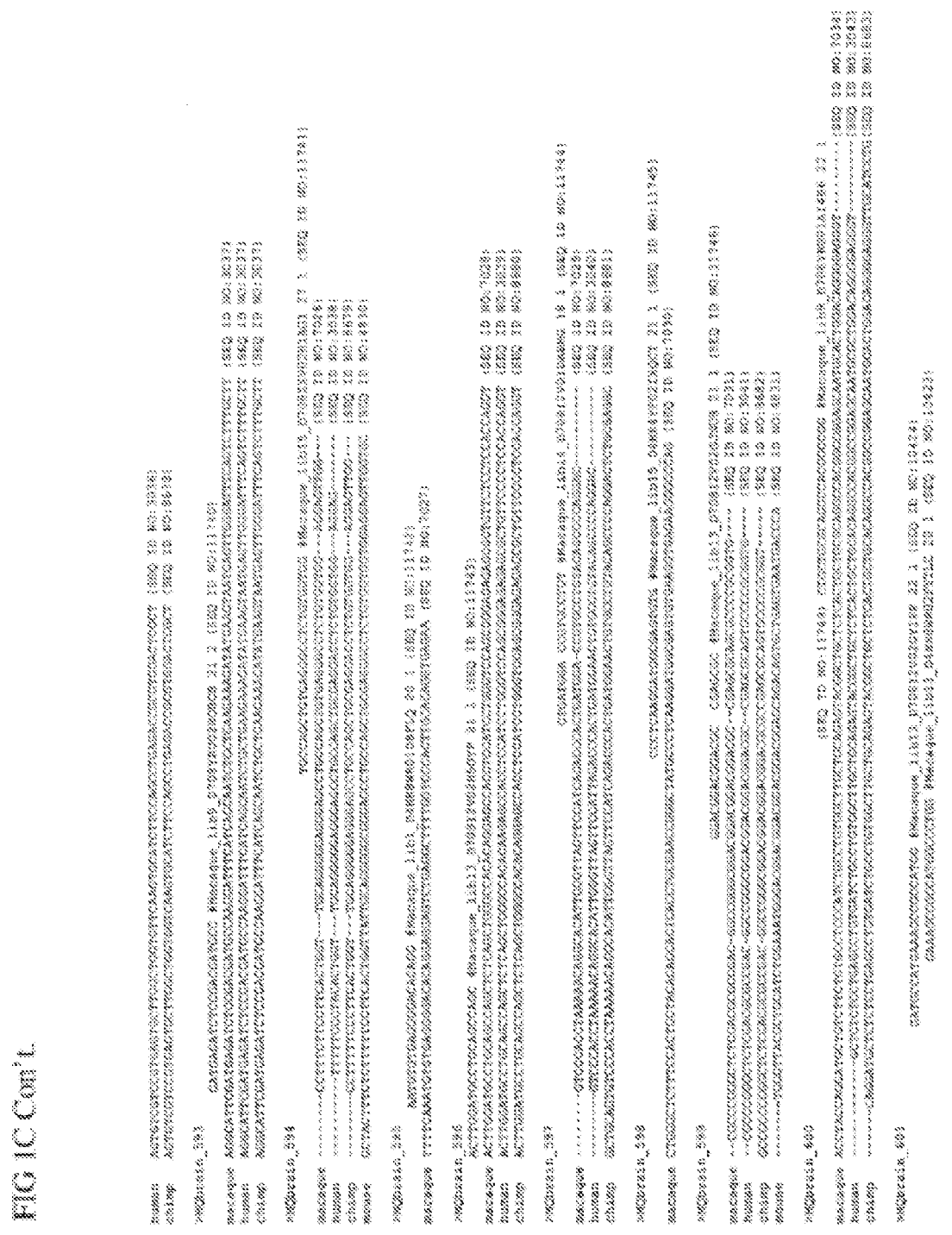
Figure 1C:
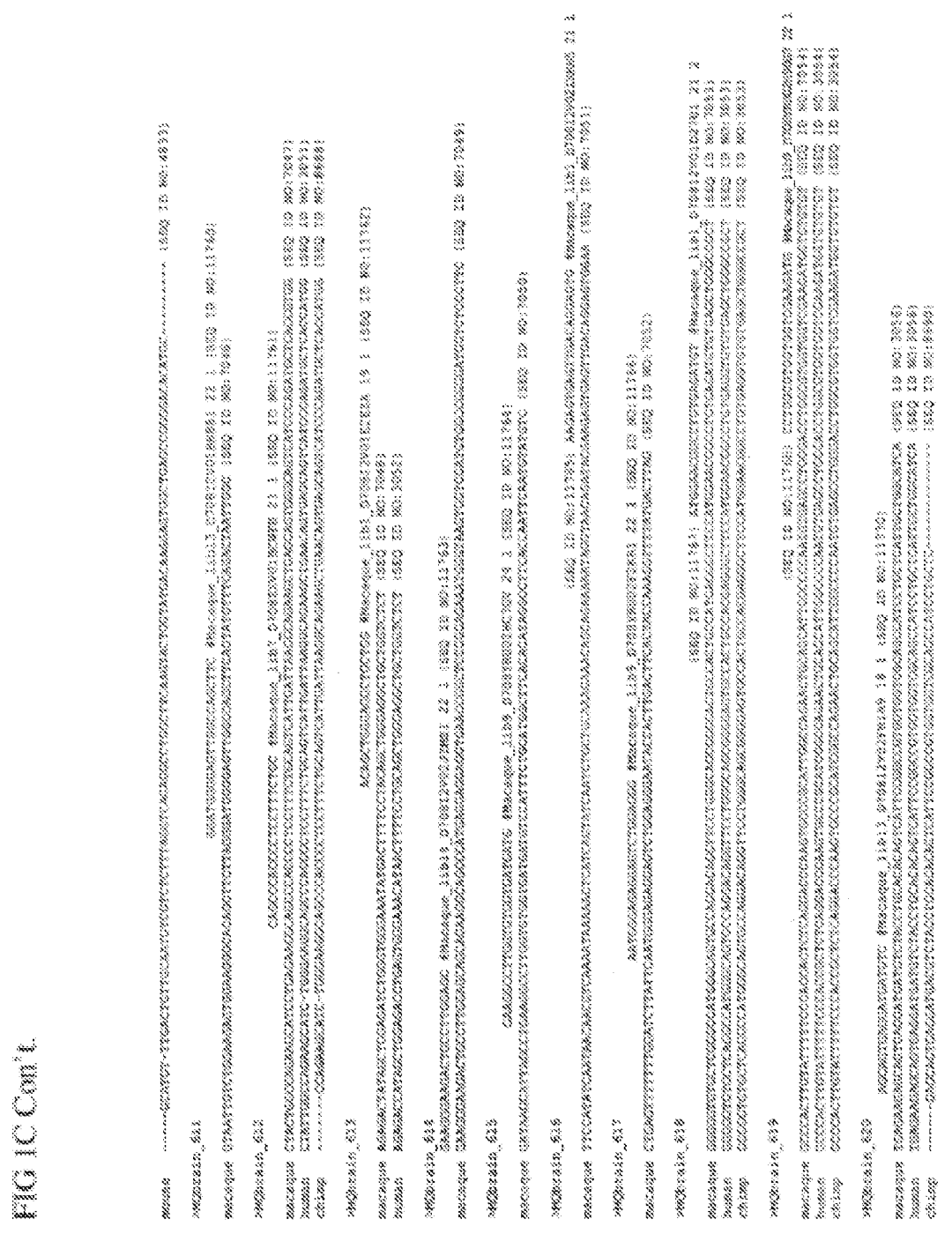
Figure 1C:
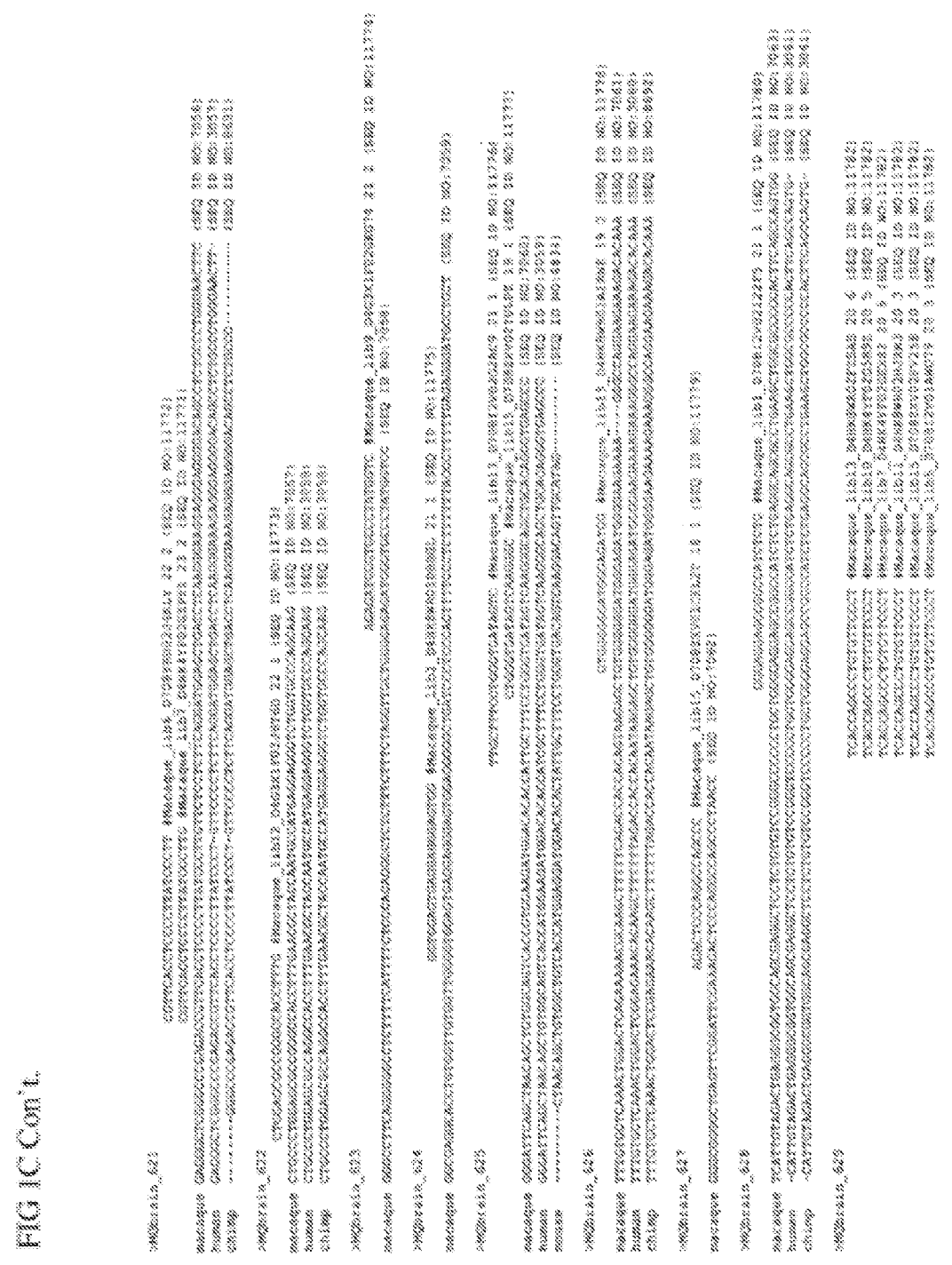
Figure 1C:
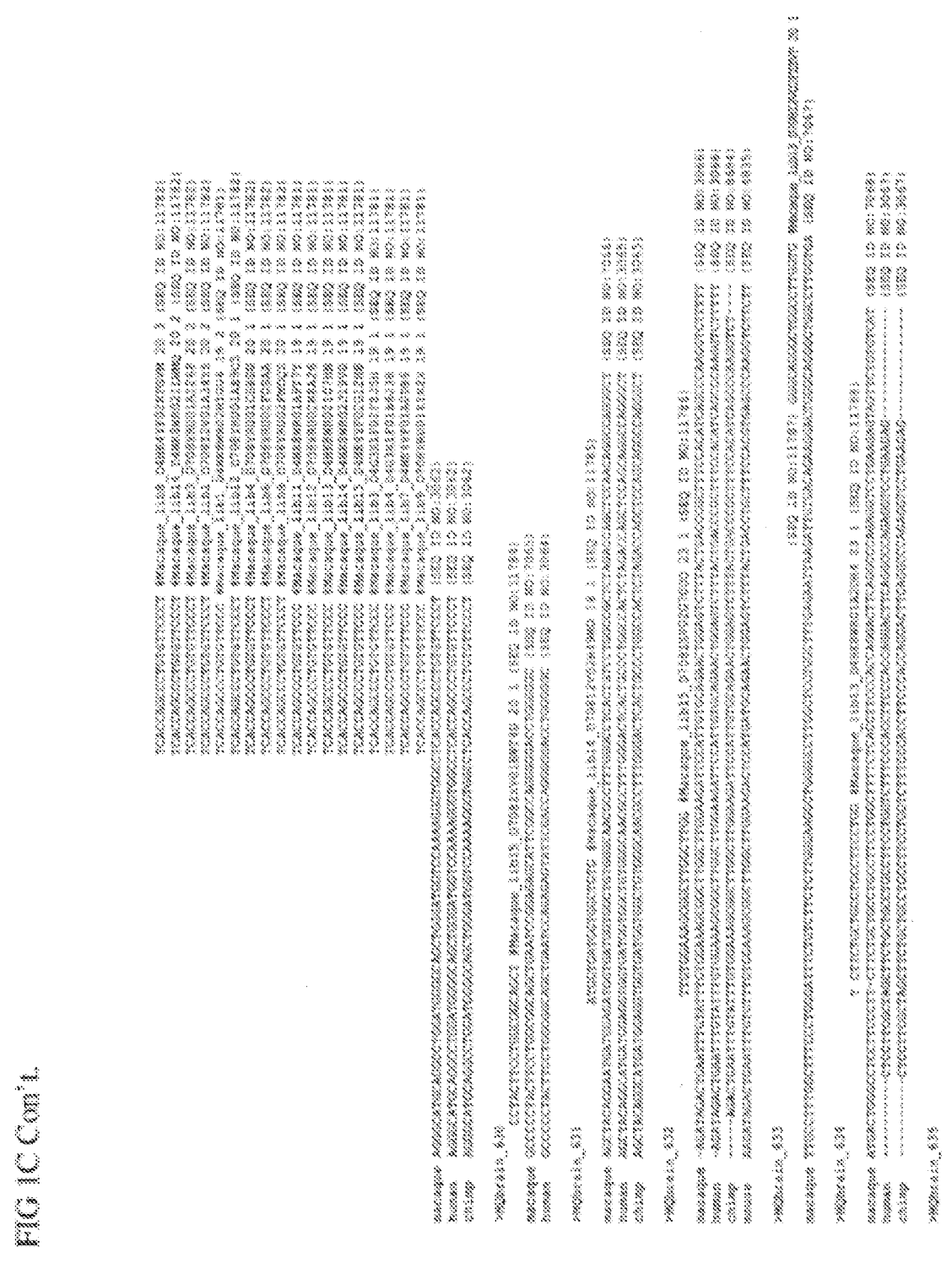
Figure 1C:
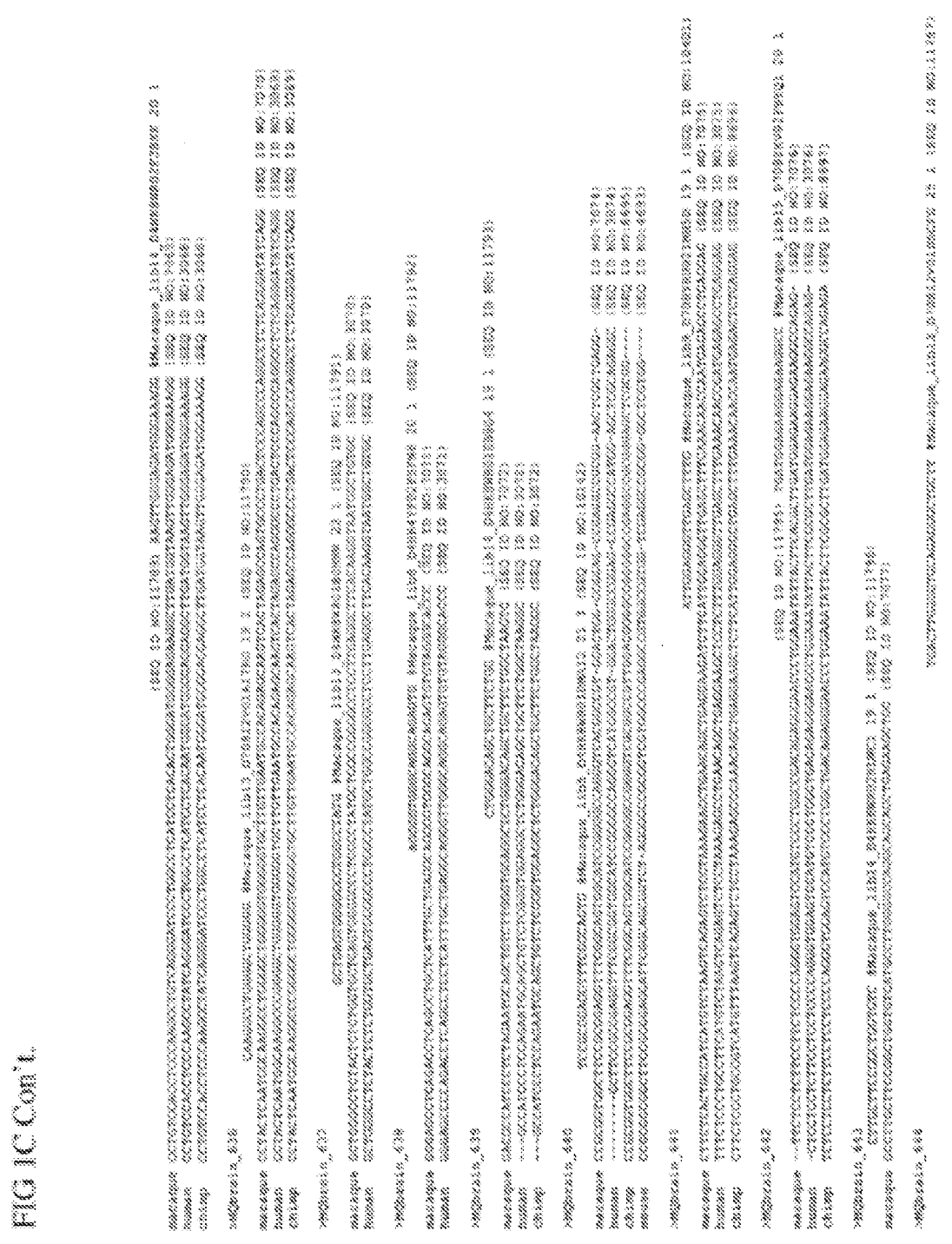
Figure 1C:
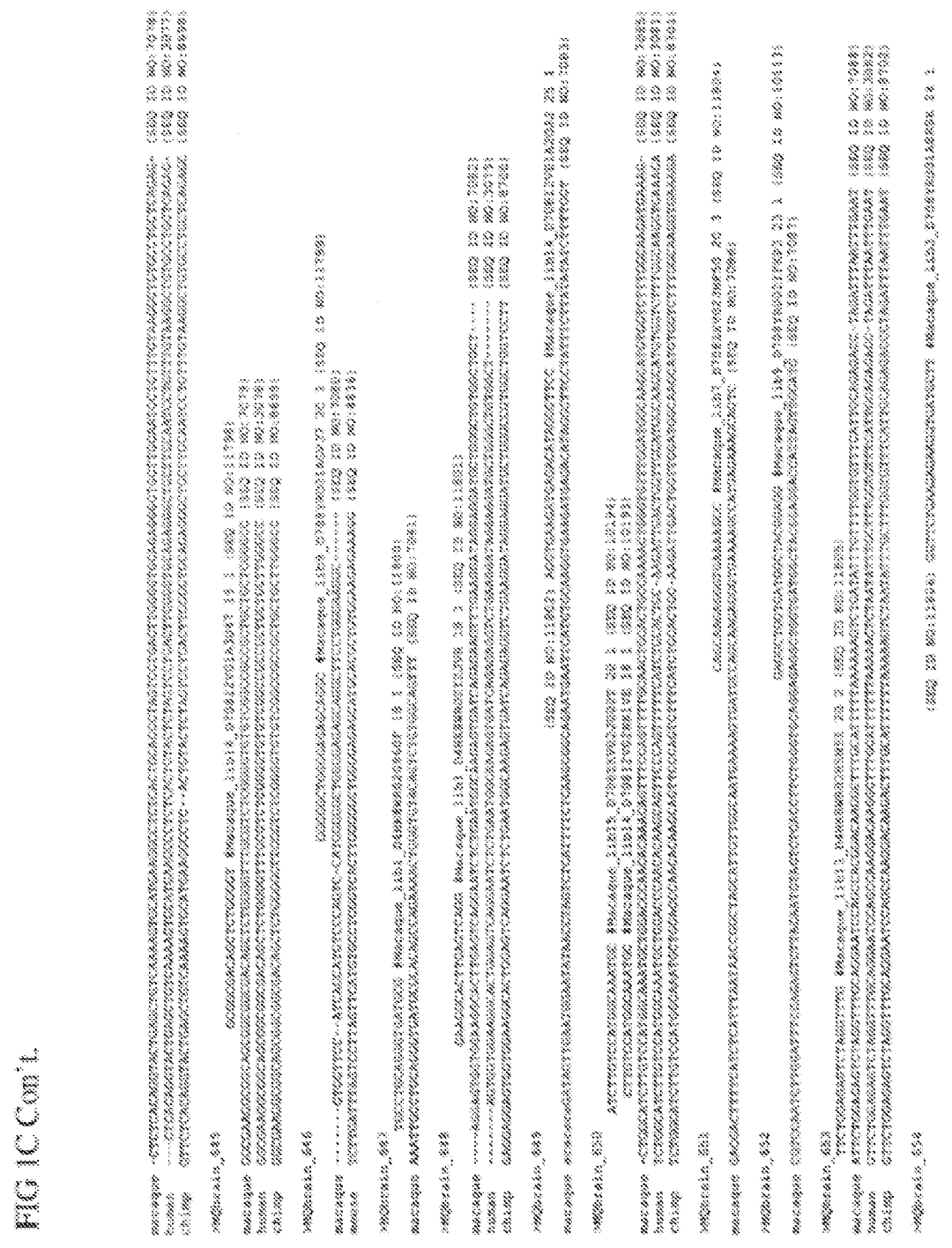
Figure 1C:
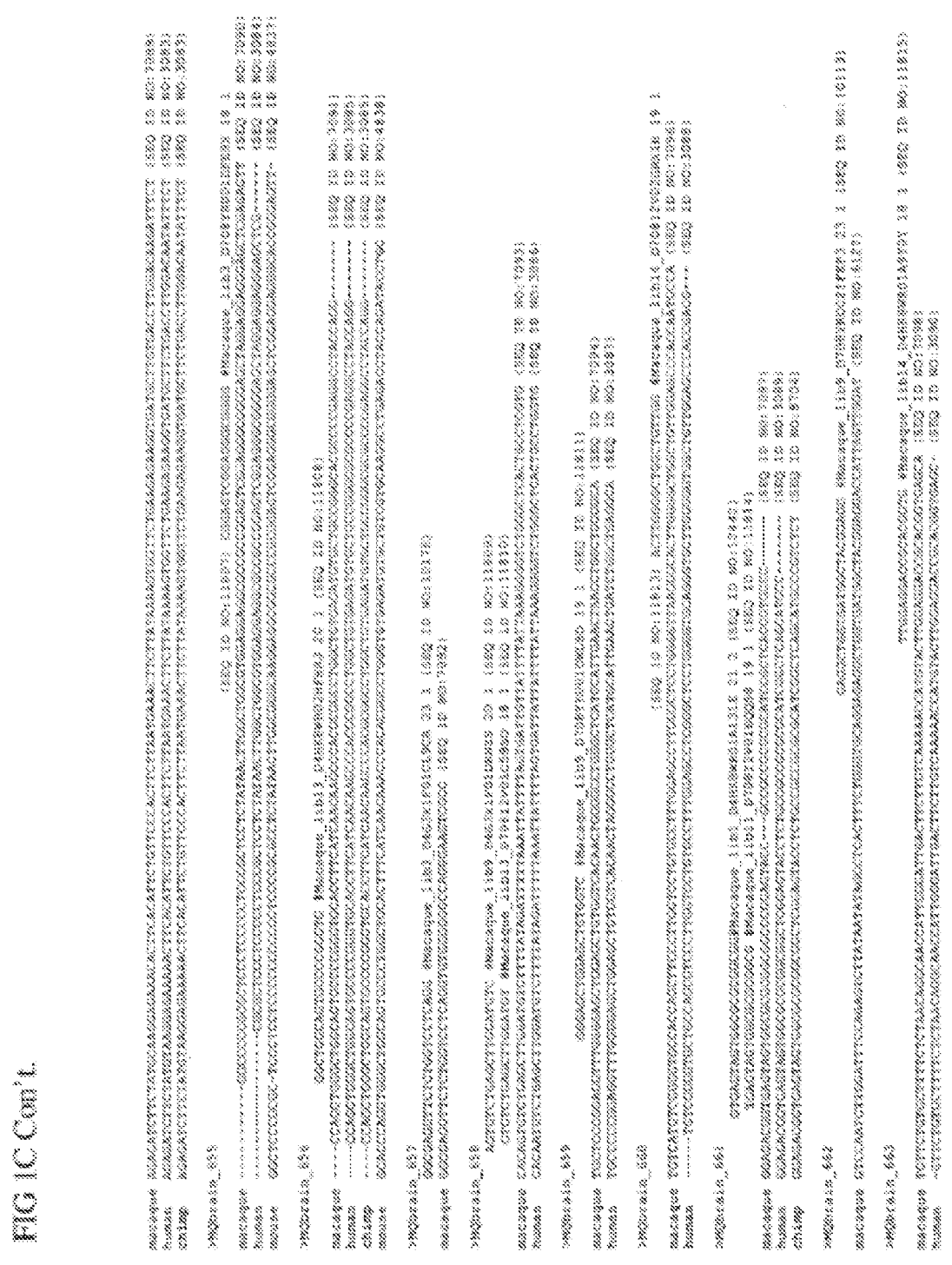
Figure 1C:
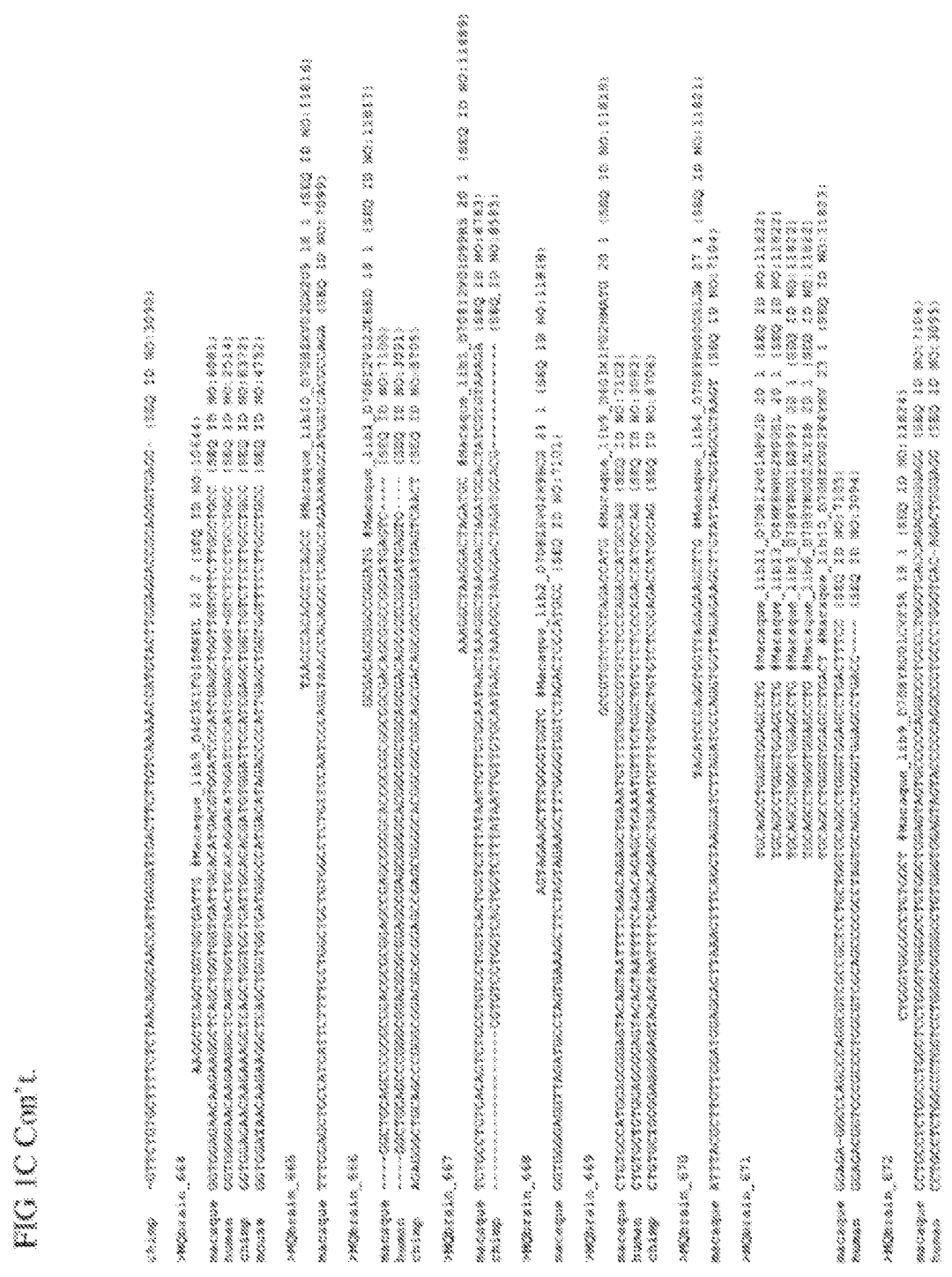
Figure 1C:
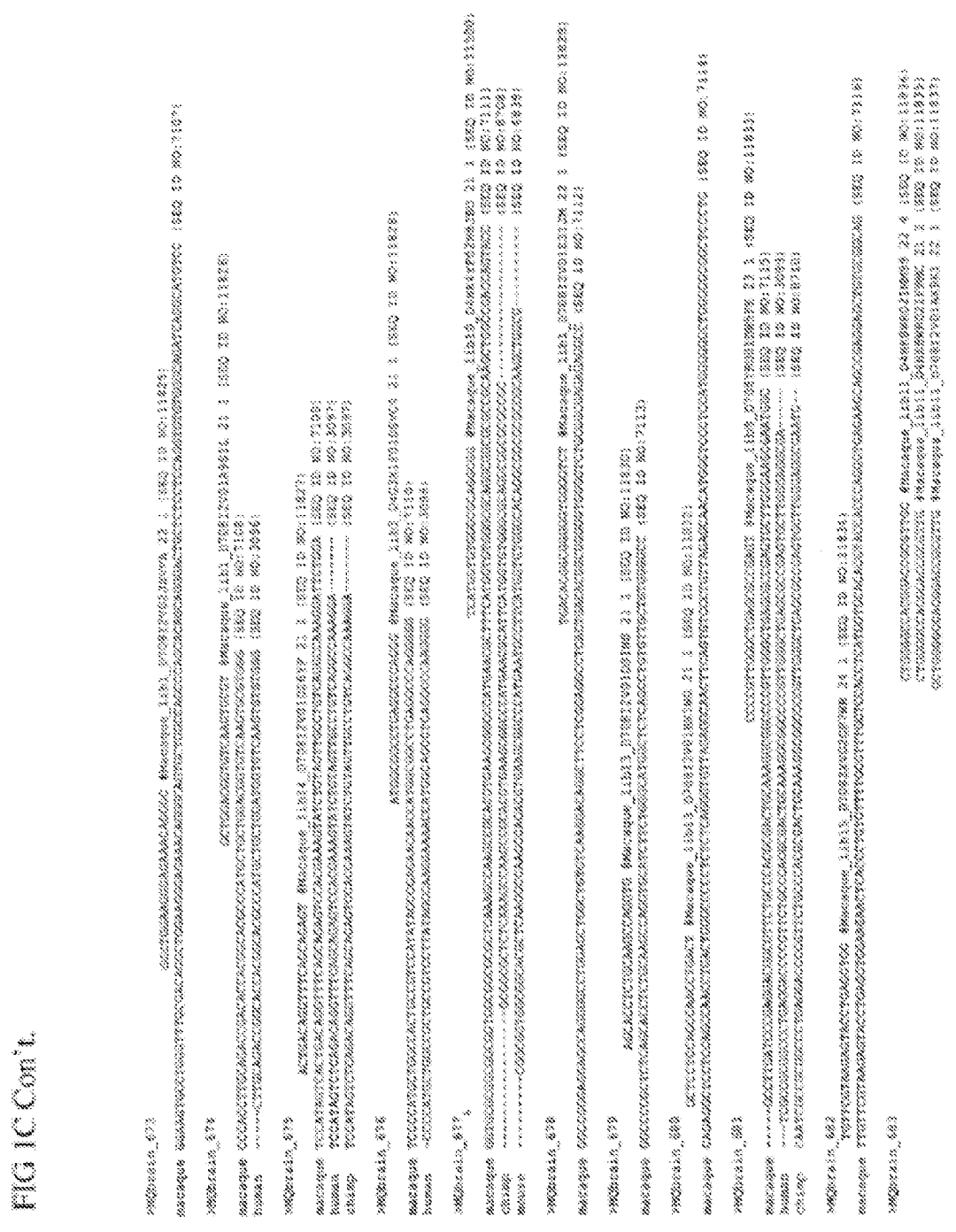
Figure 1C:
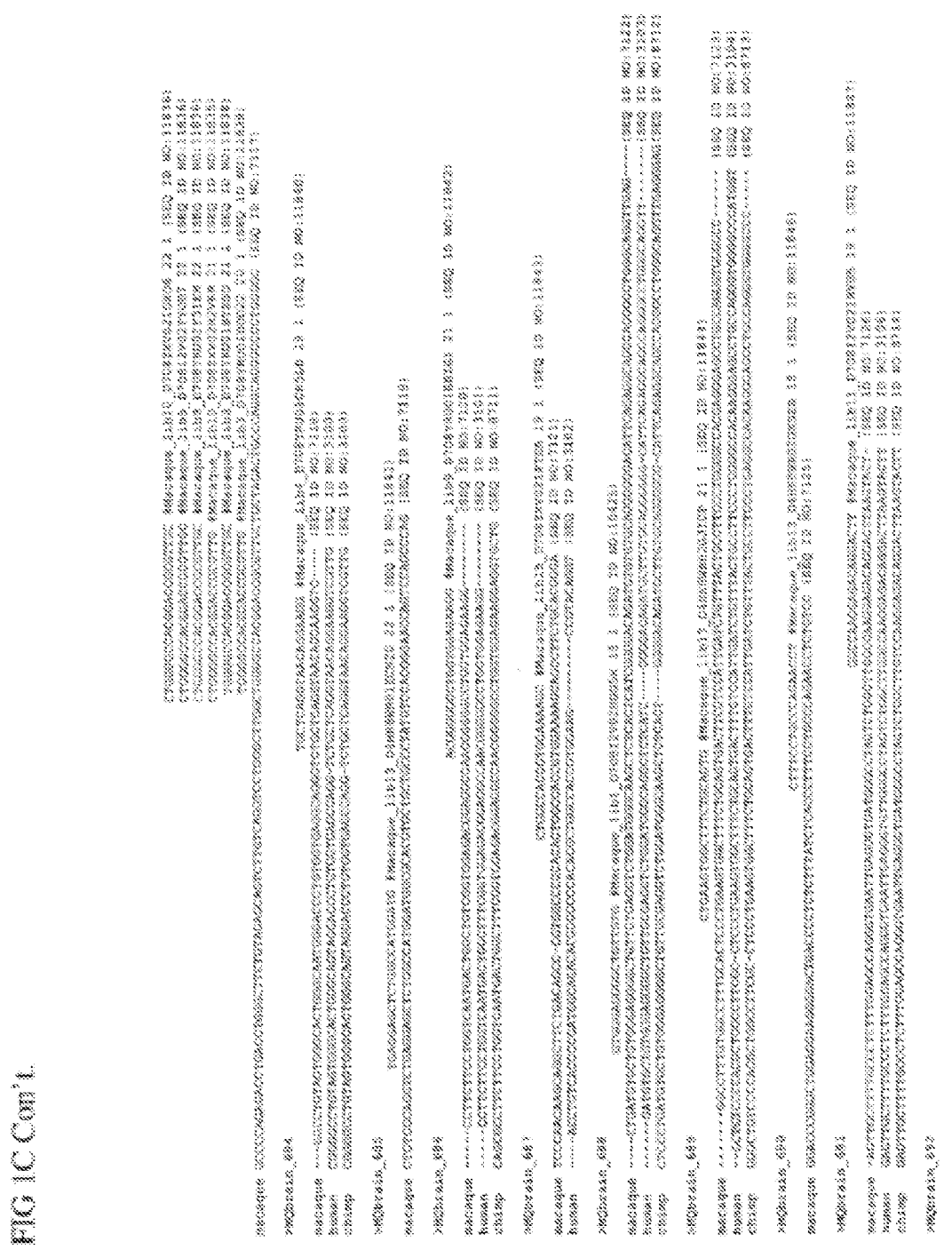
Figure 1C:
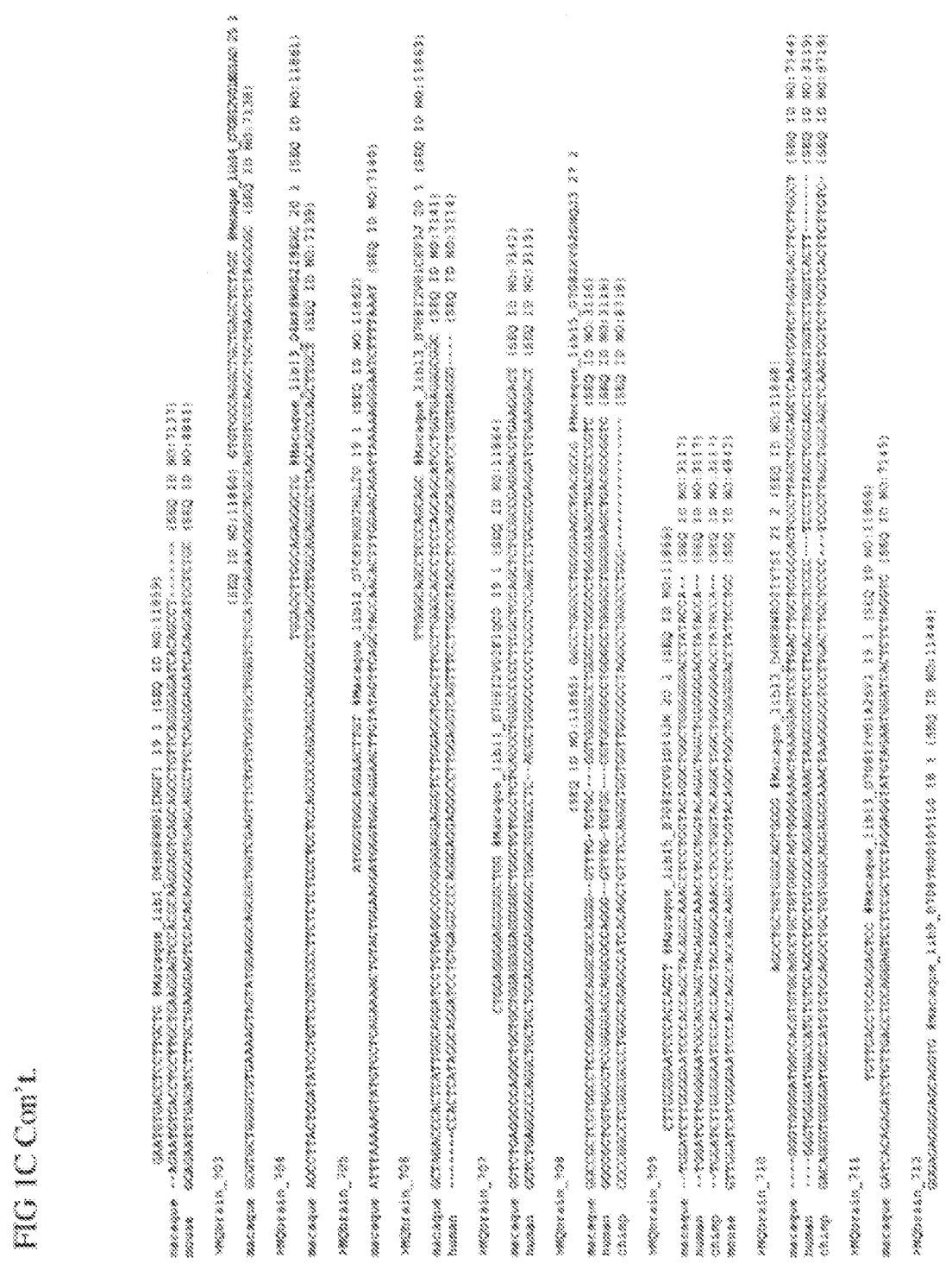
Figure 1C:
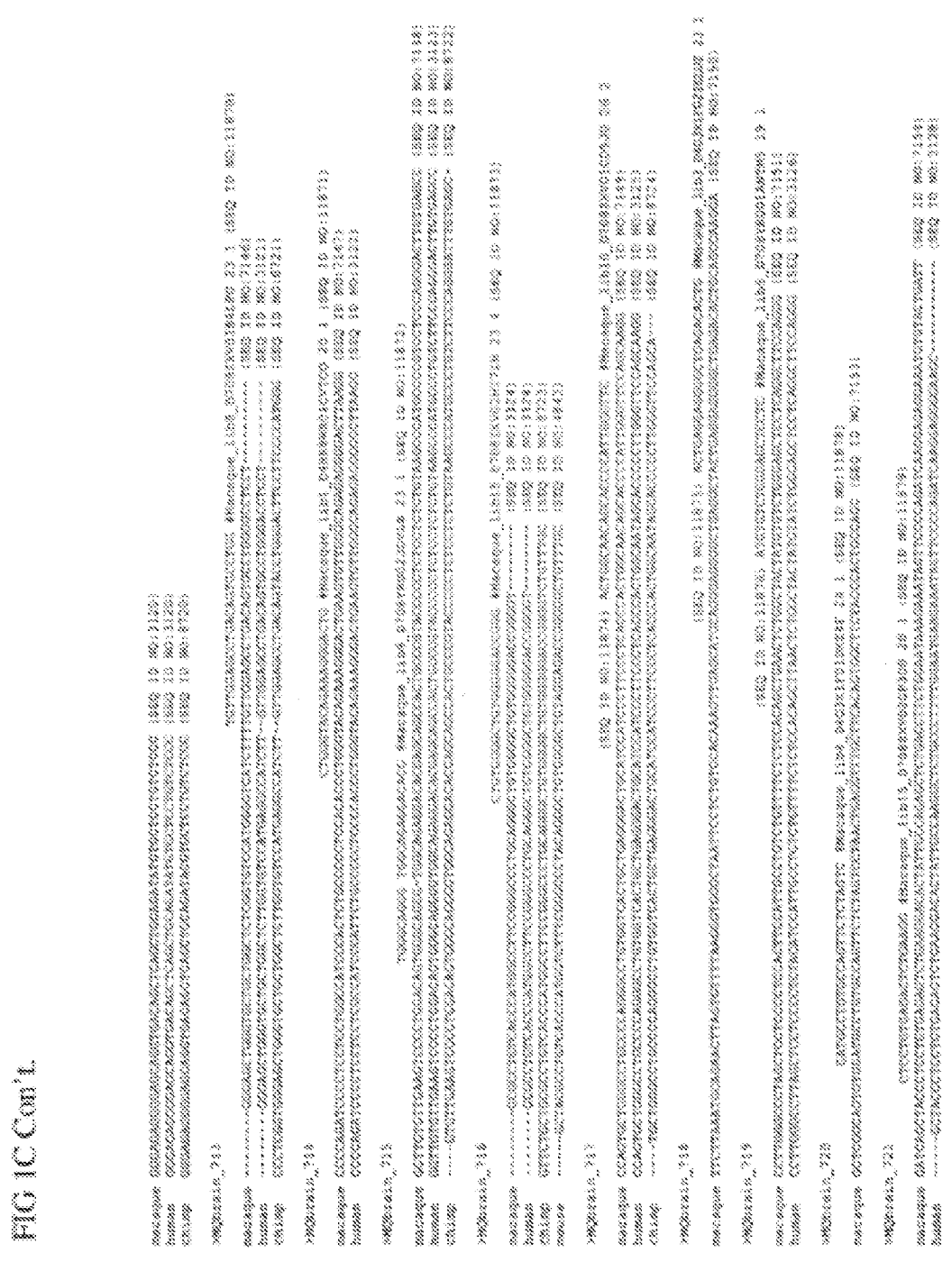
Figure 1C:
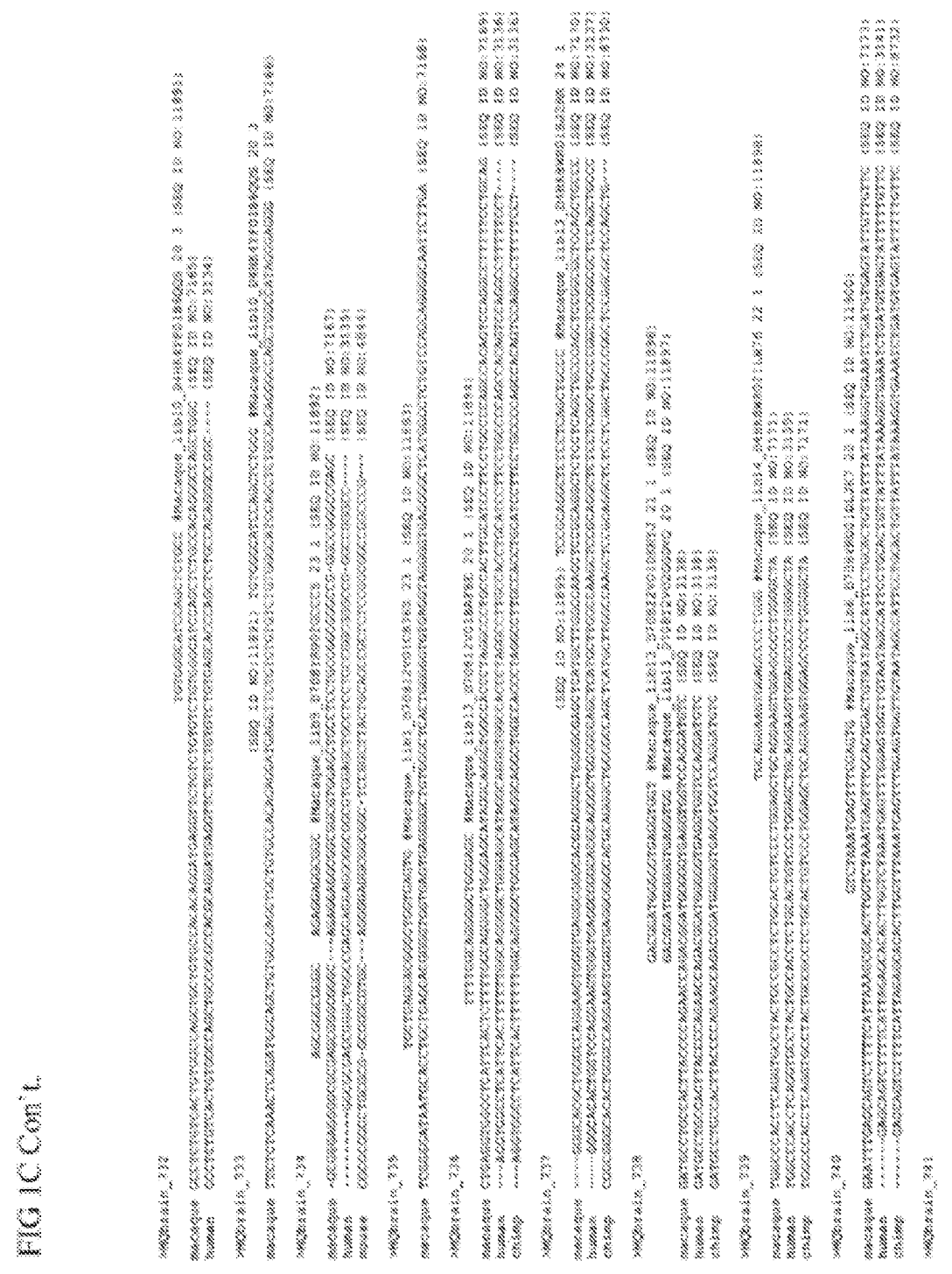
Figure 1C:
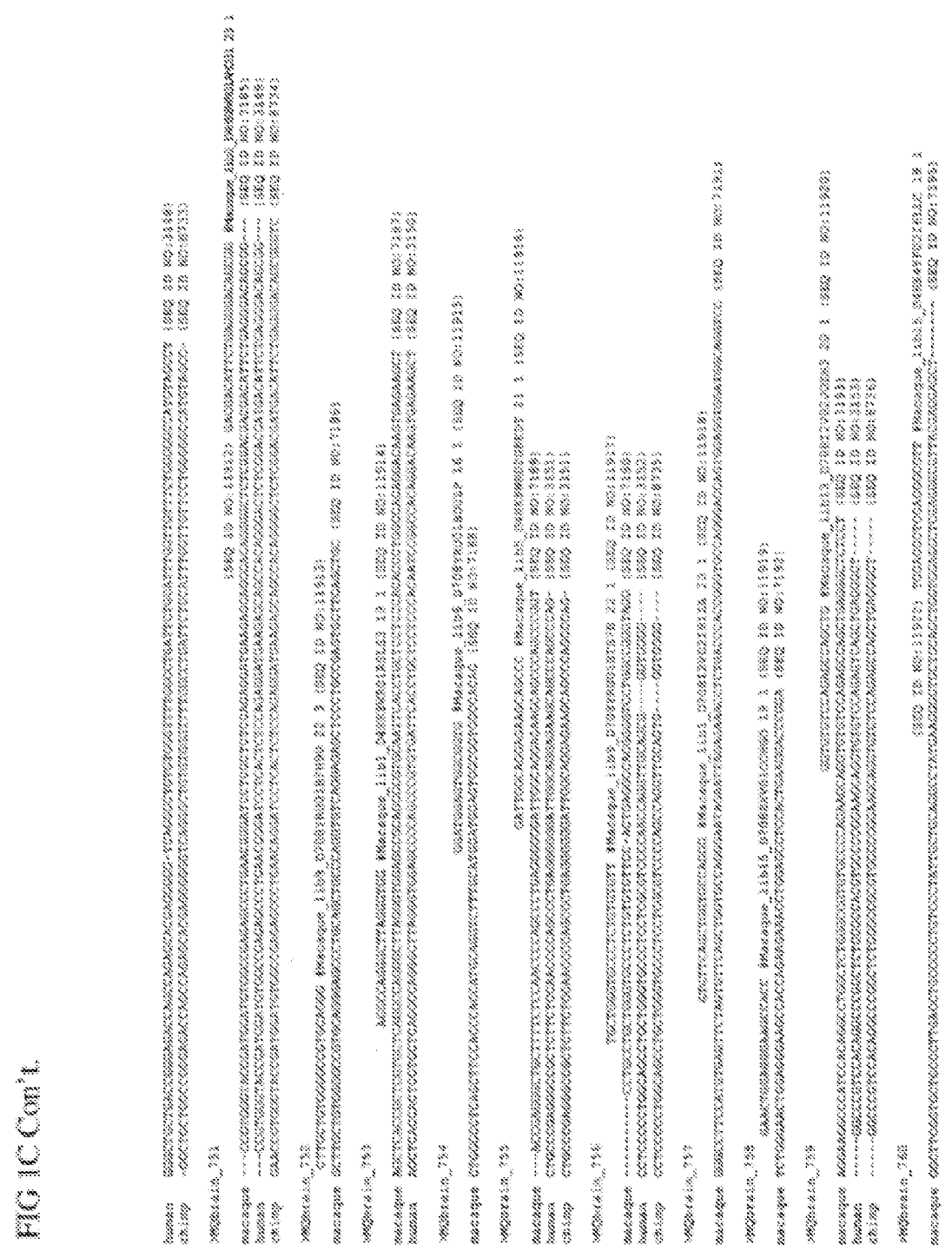
Figure 1C:
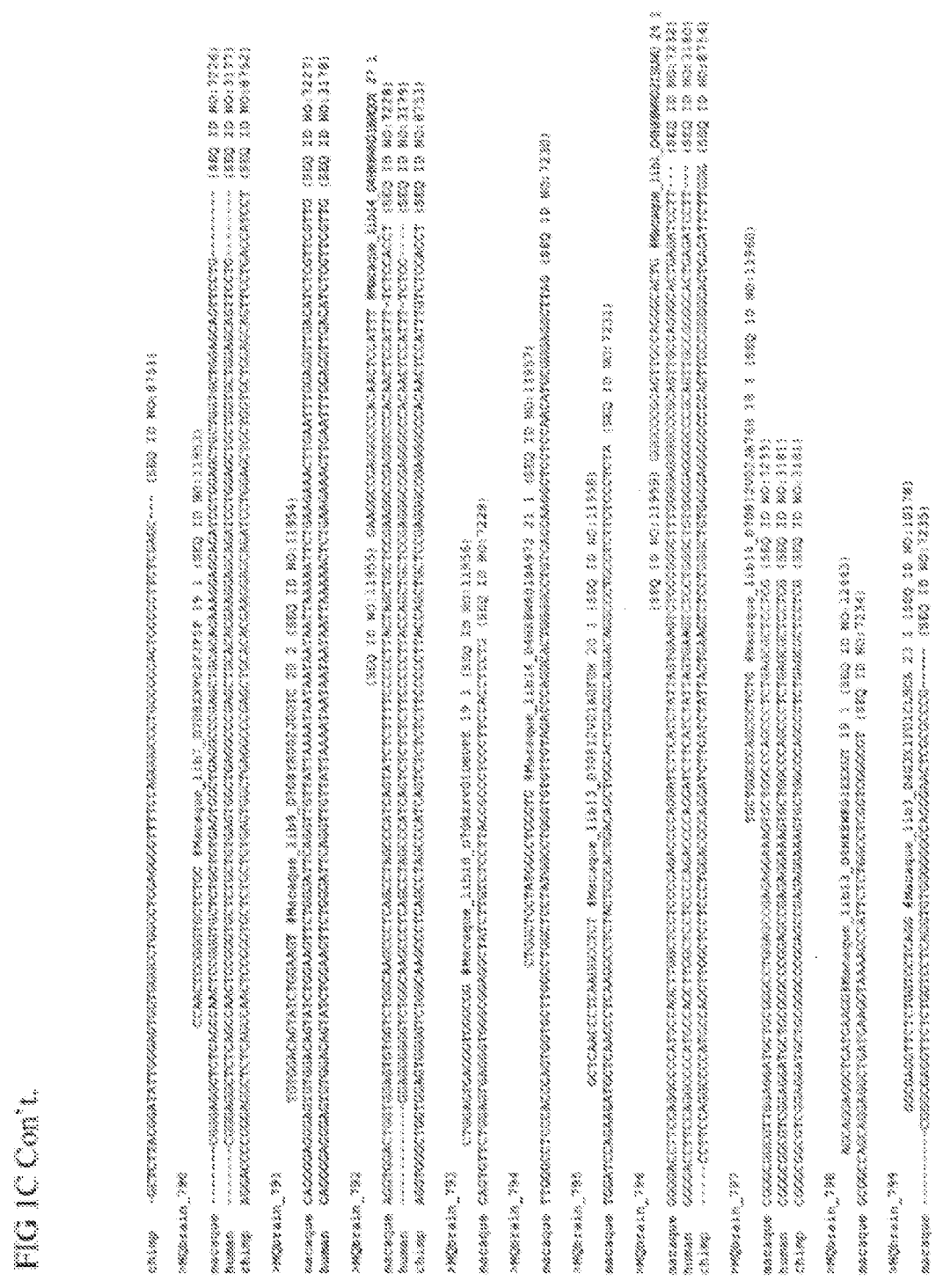
Figure 1C:
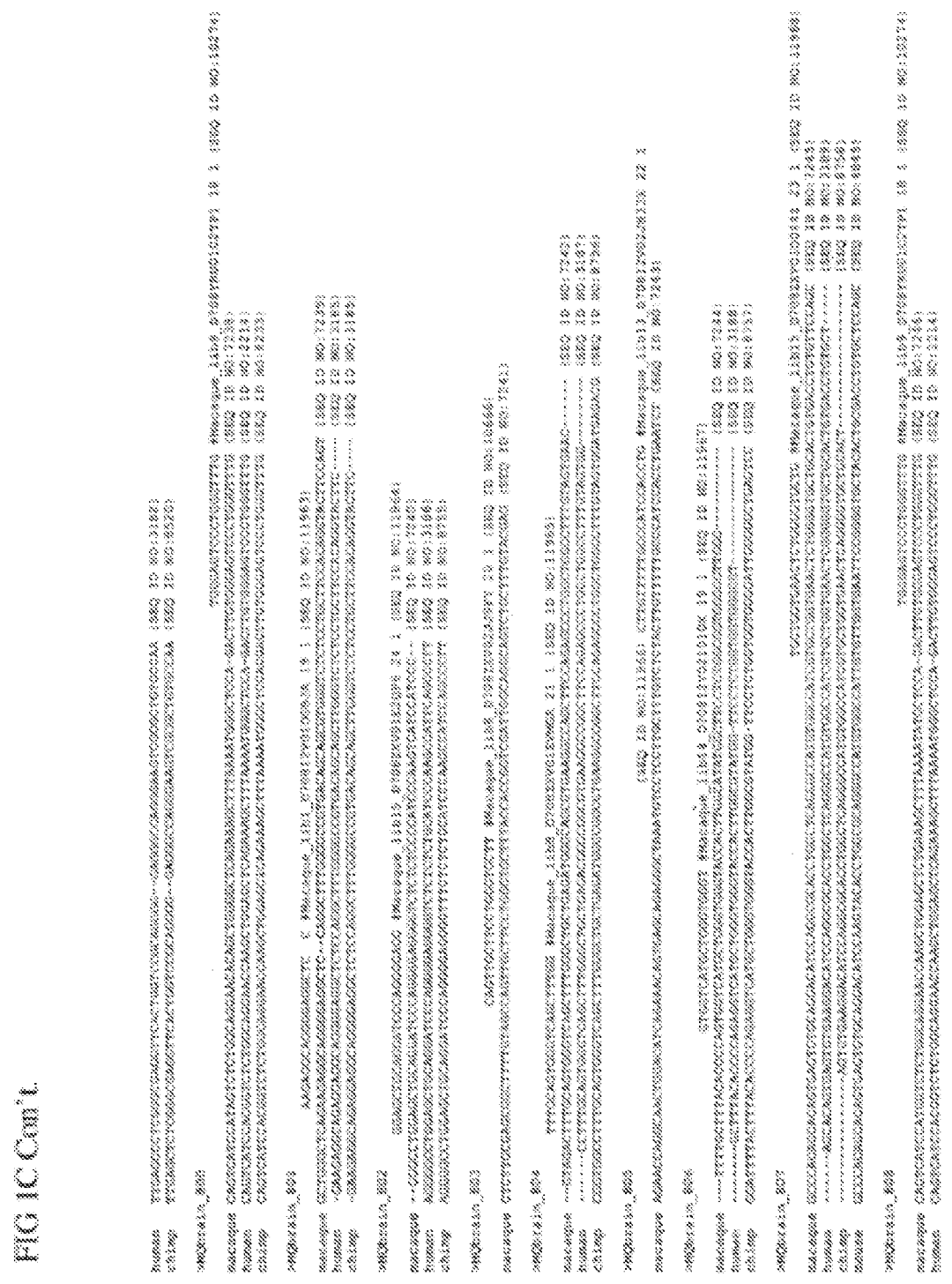
Figure 1C:
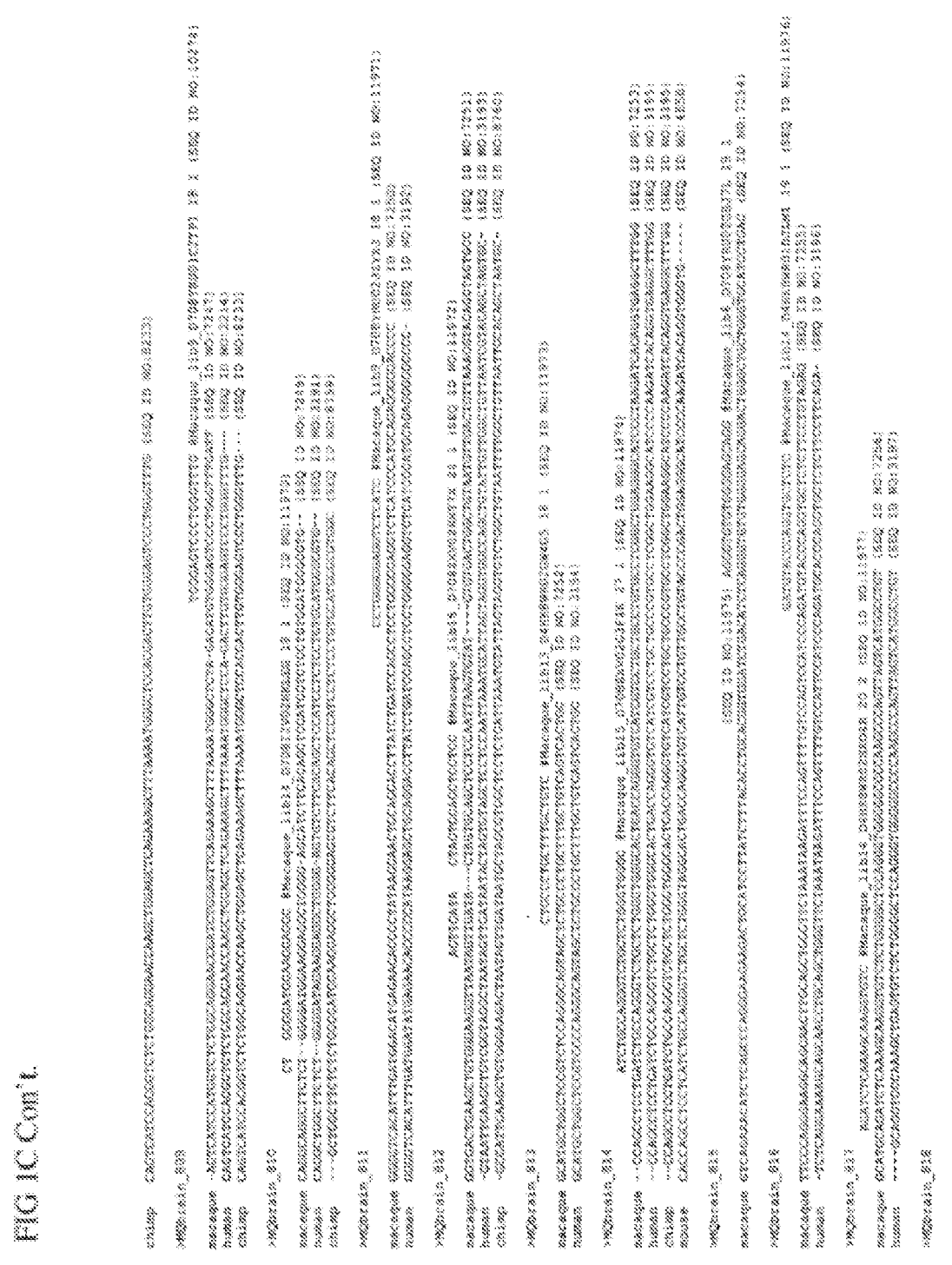
Figure 1C:
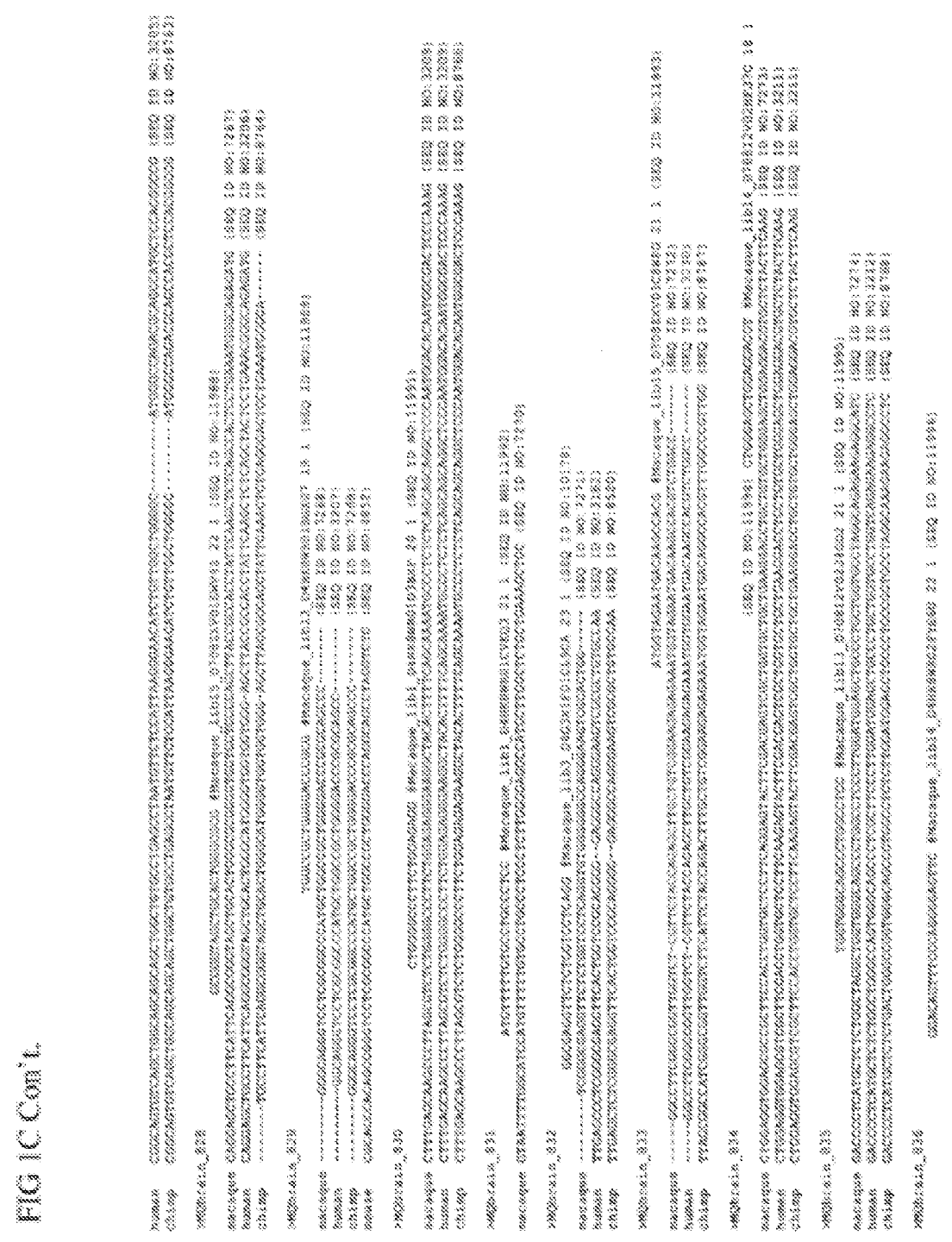
Figure 1C:
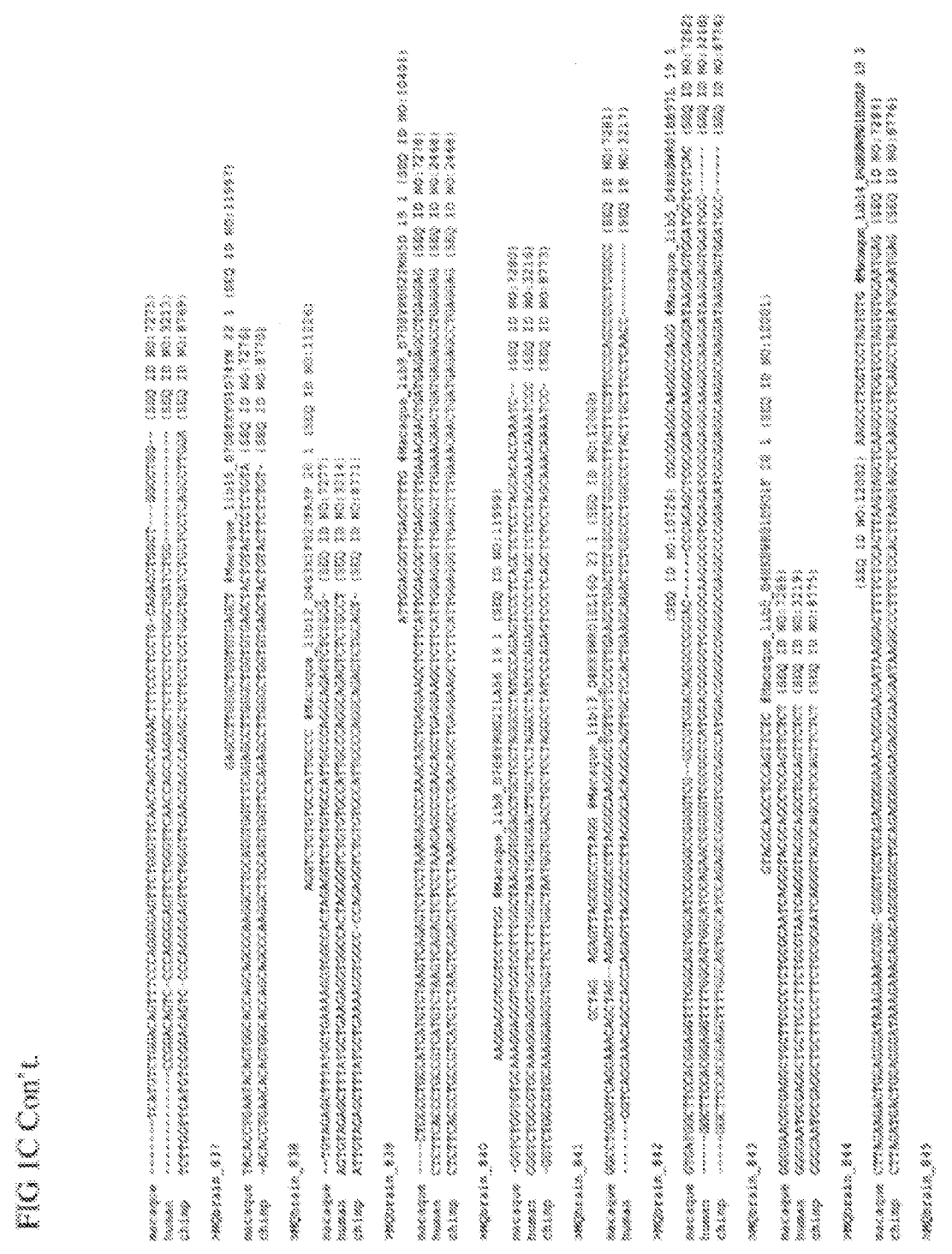
Figure 1C:
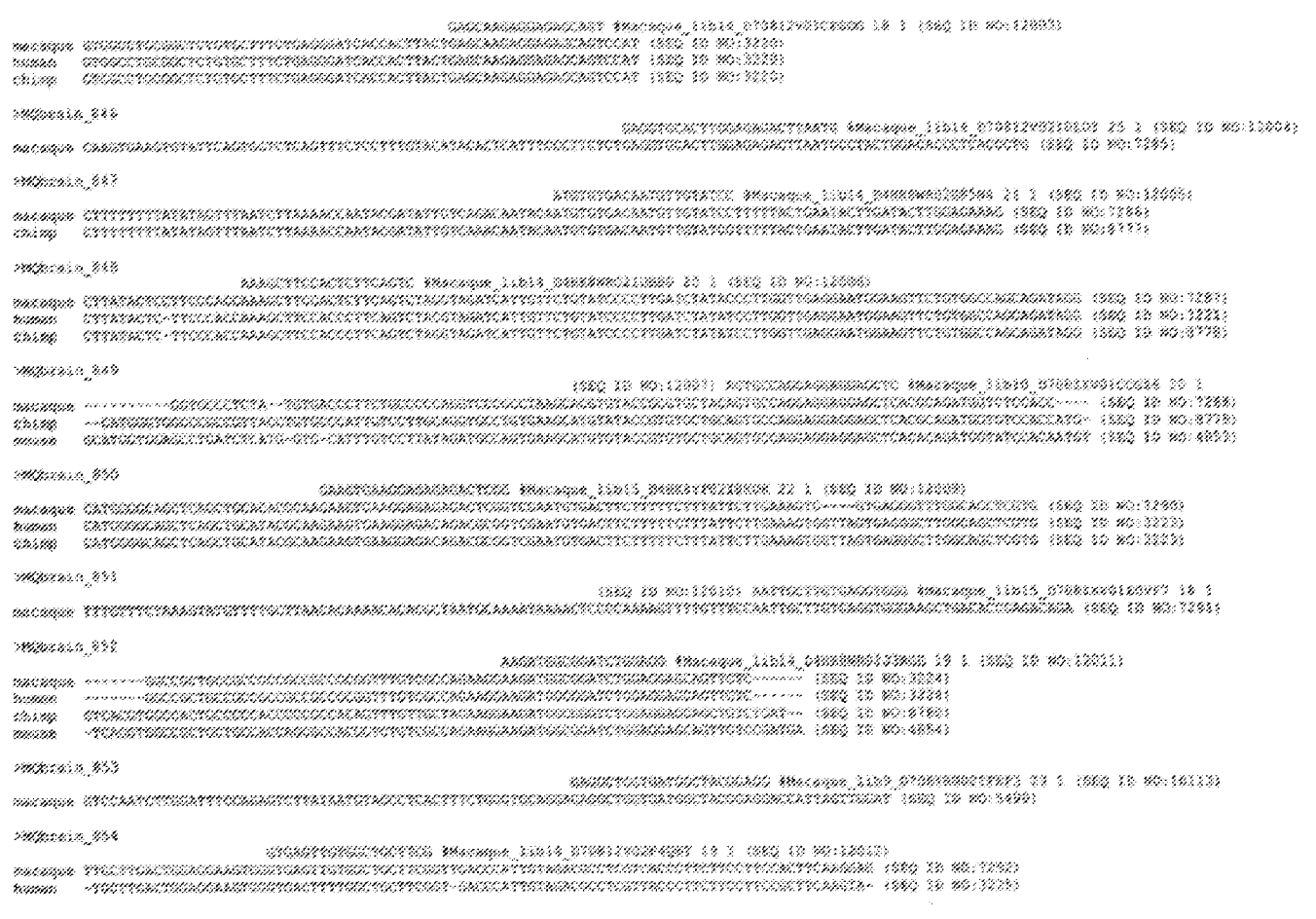
Figure 1C:
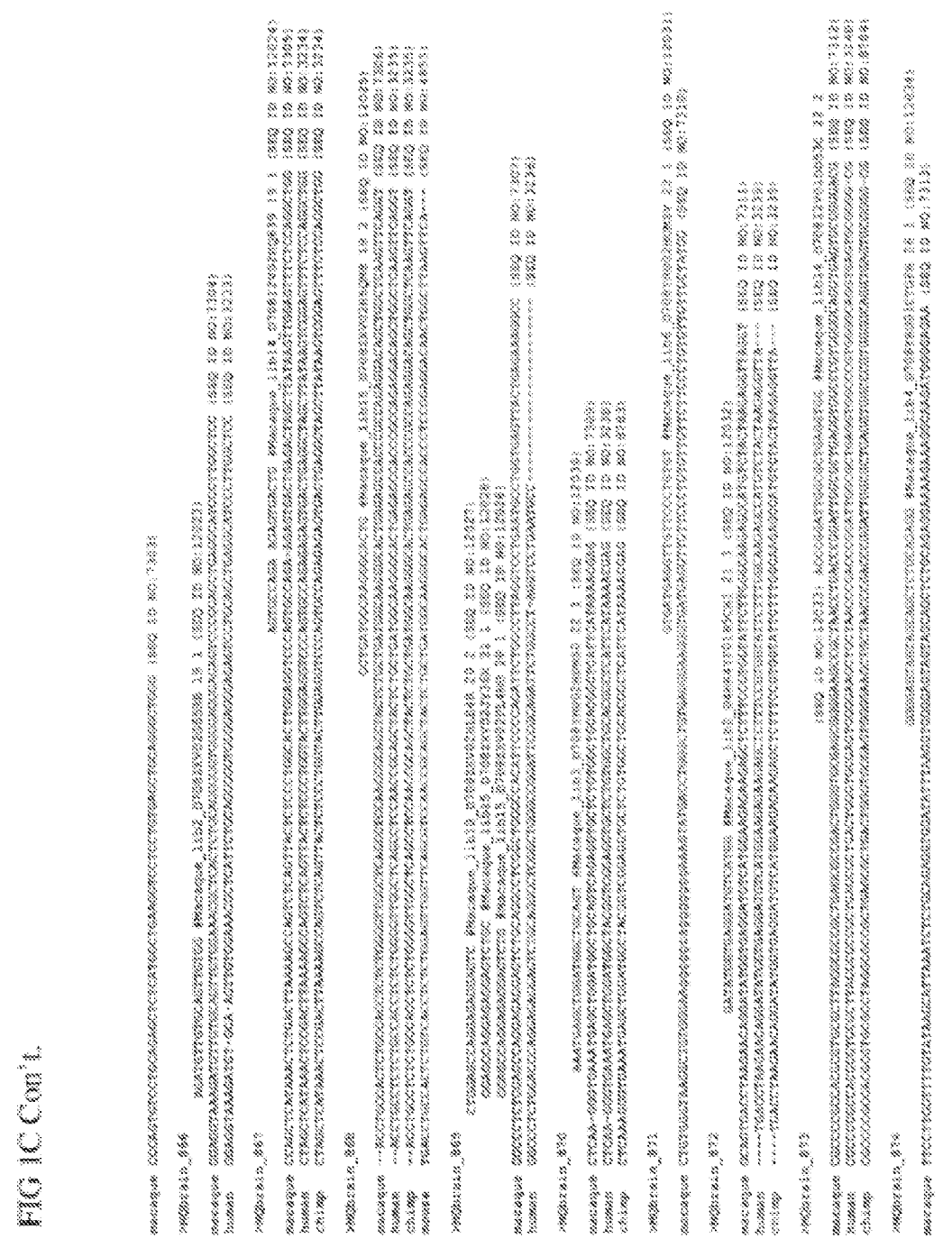
Figure 1C:
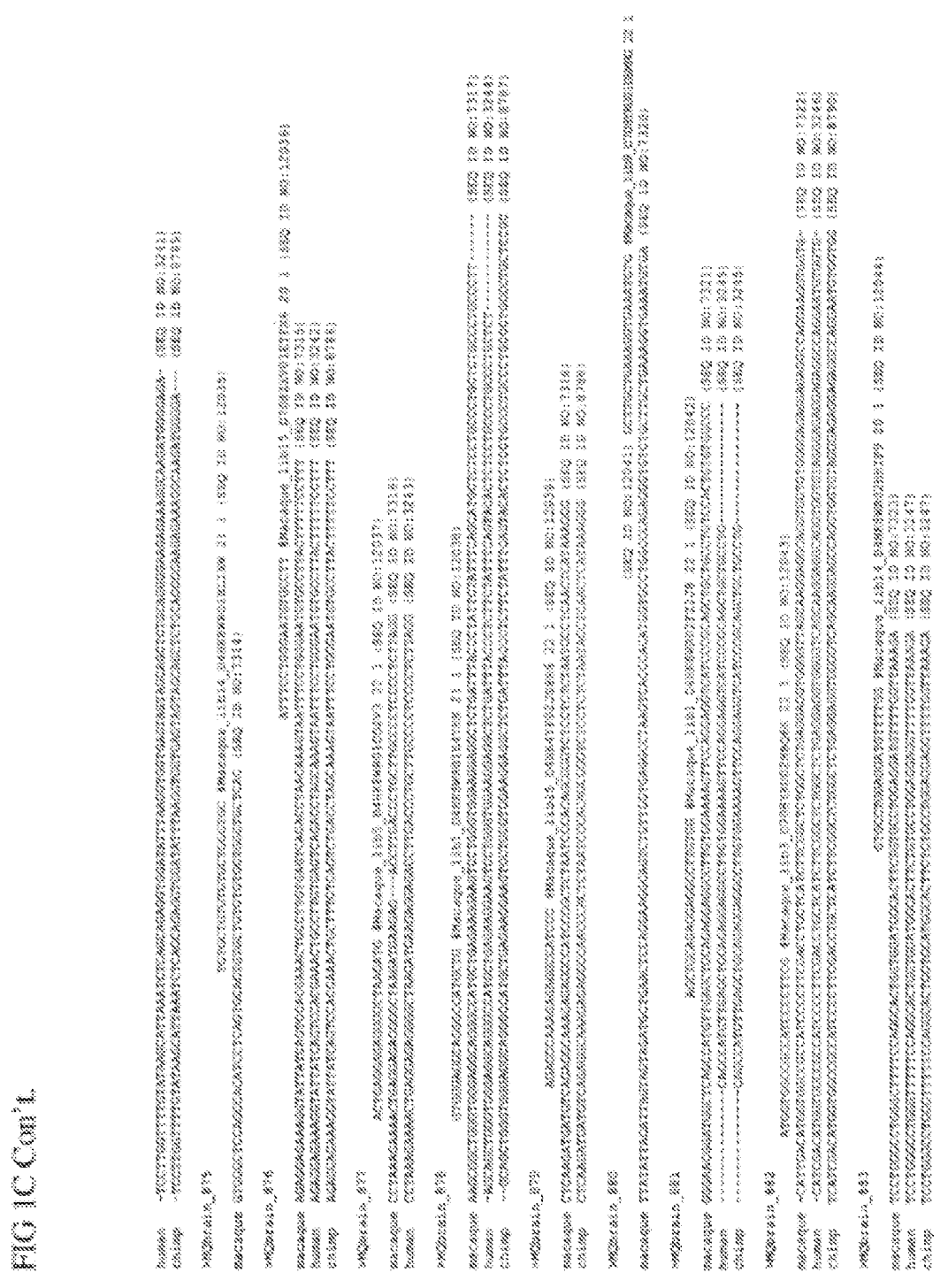
Figure 1C:
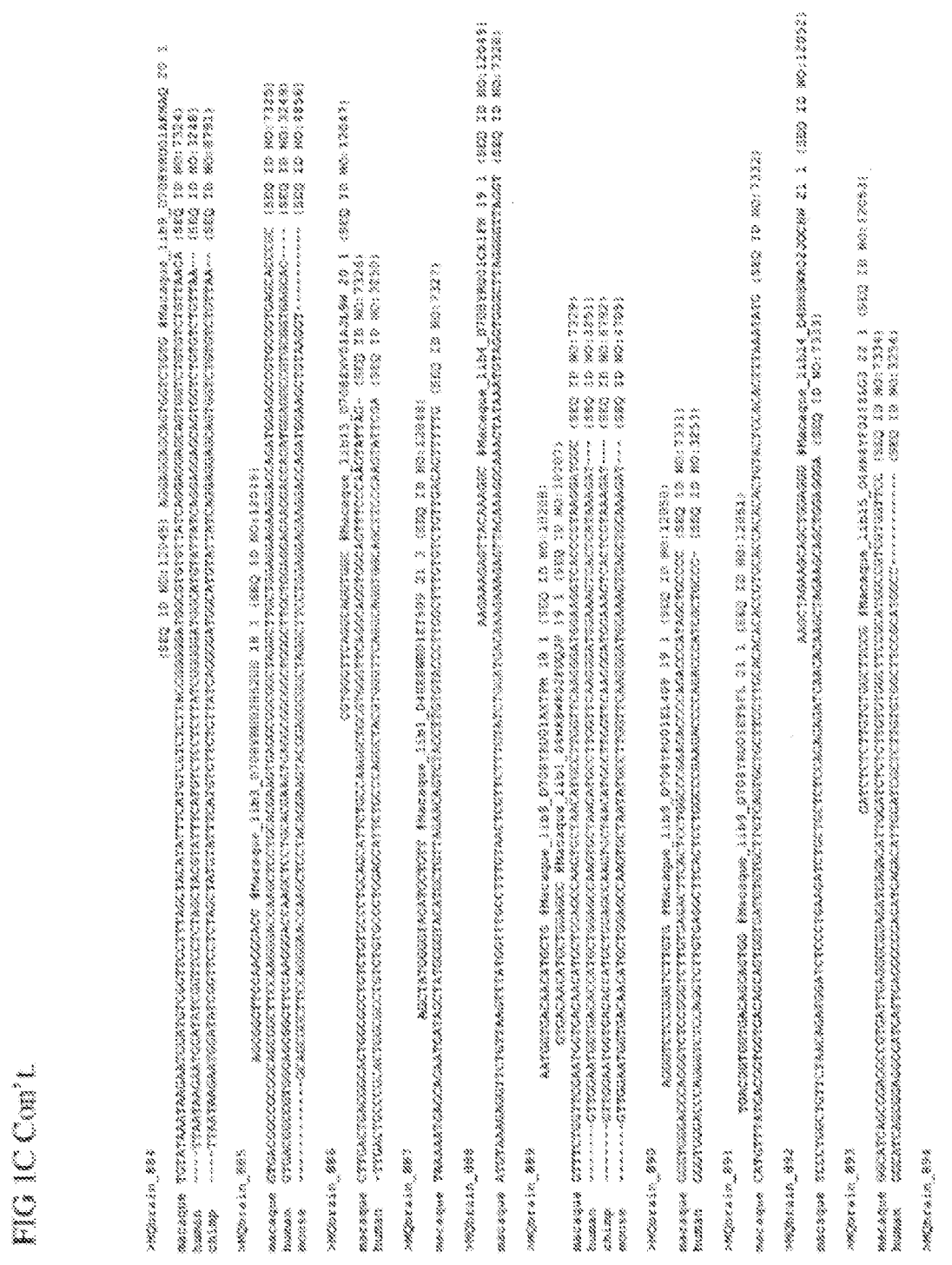
Figure 1C:
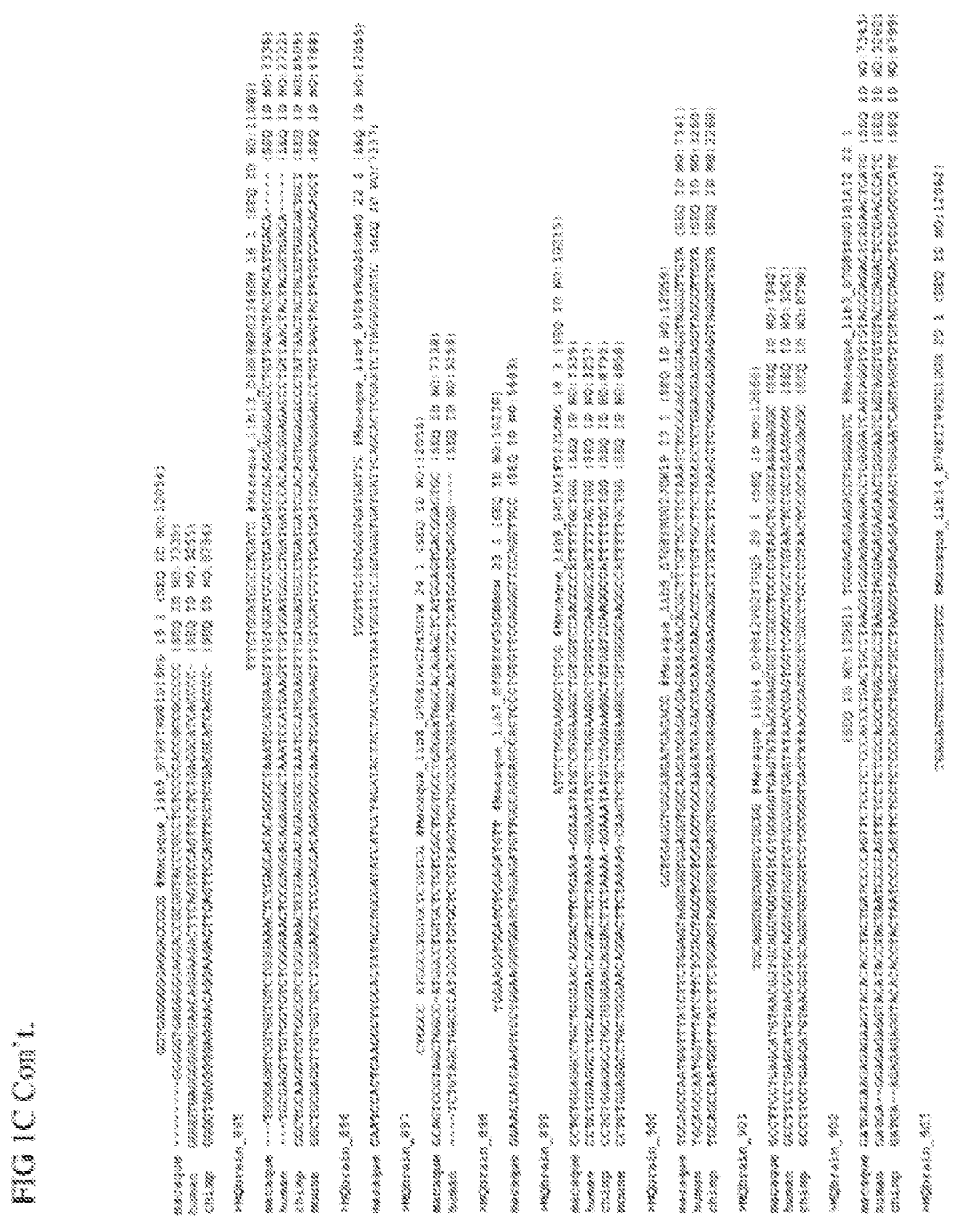
Figure 1C:
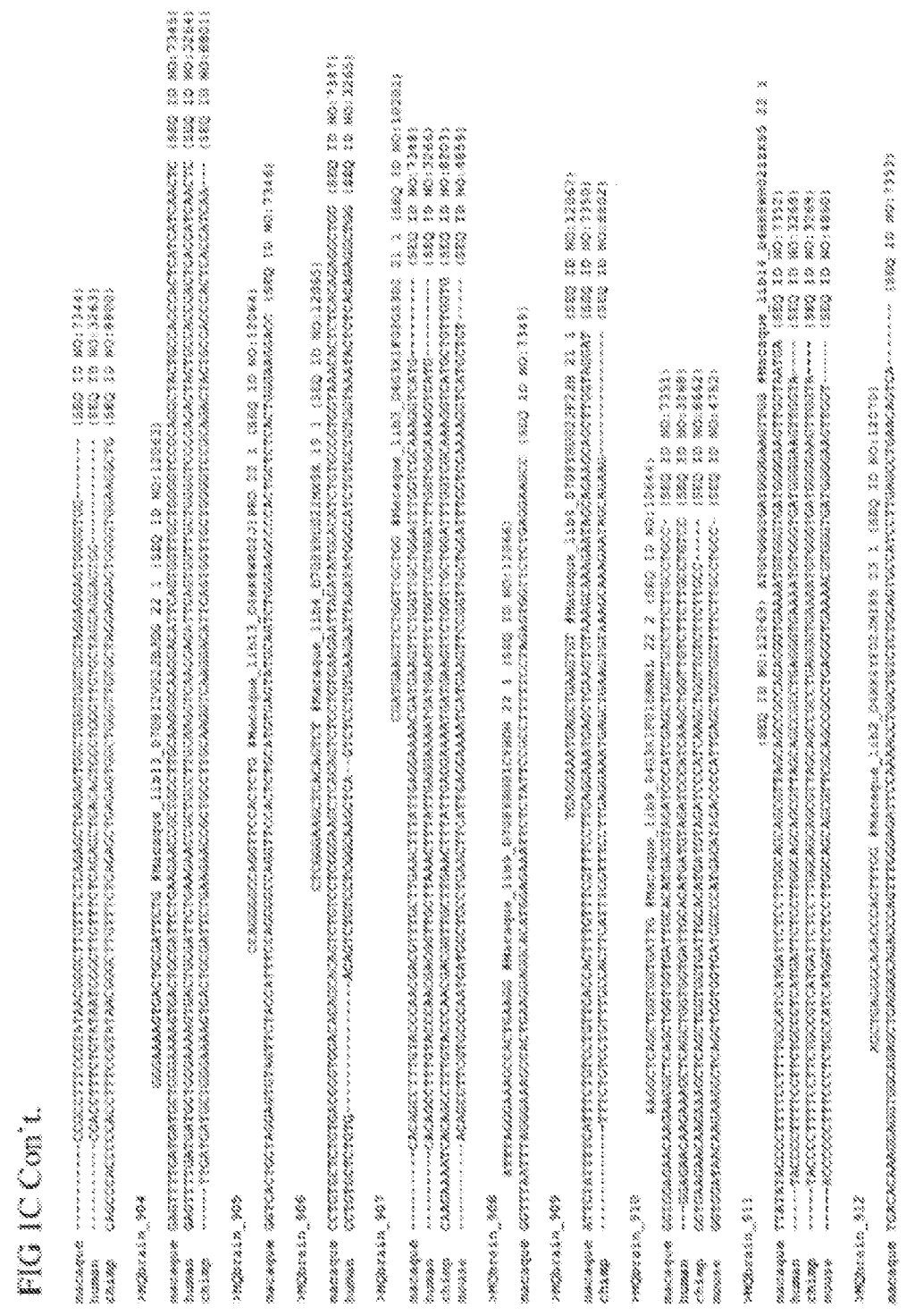
Figure 1C:
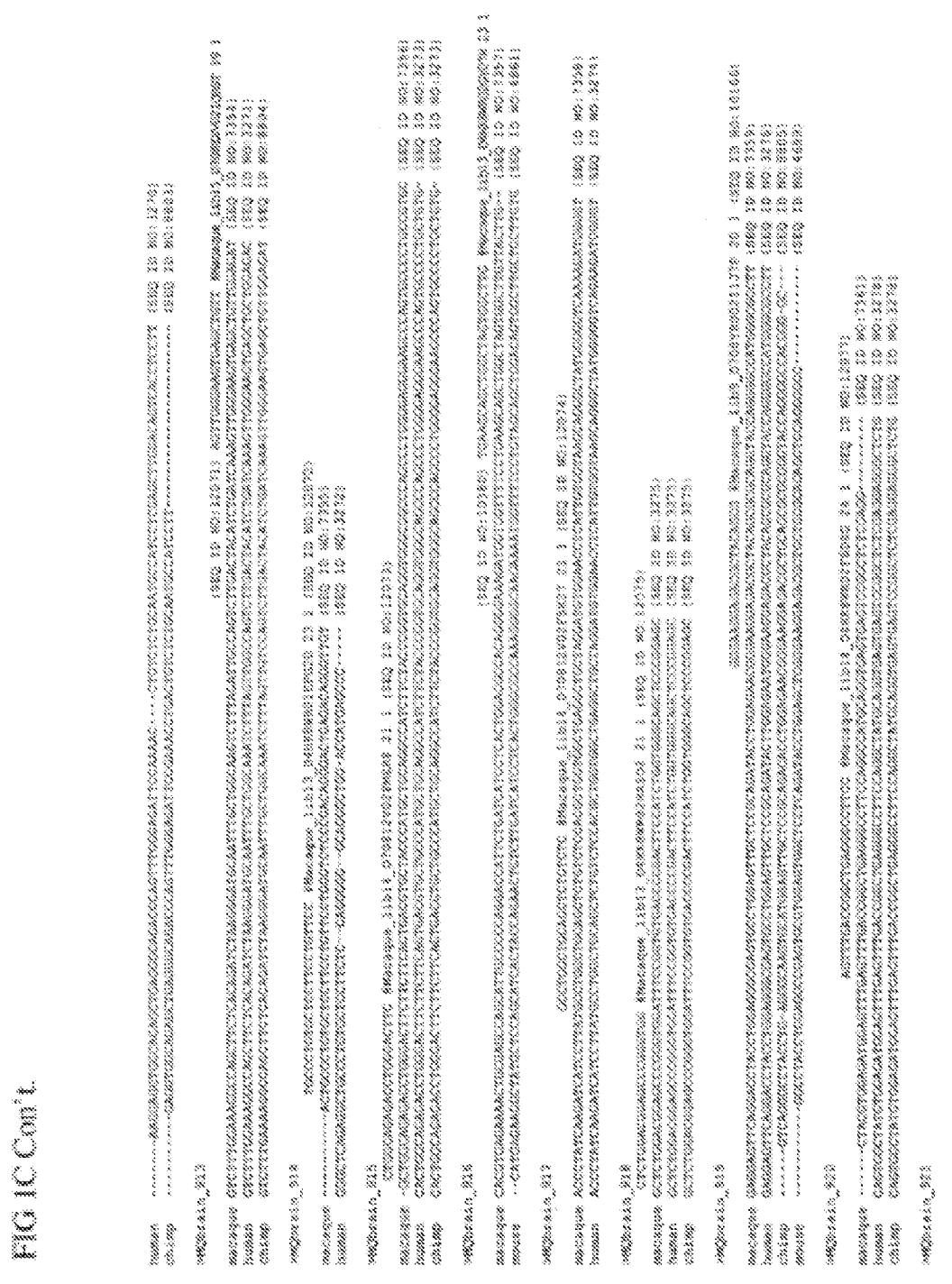
Figure 1C:
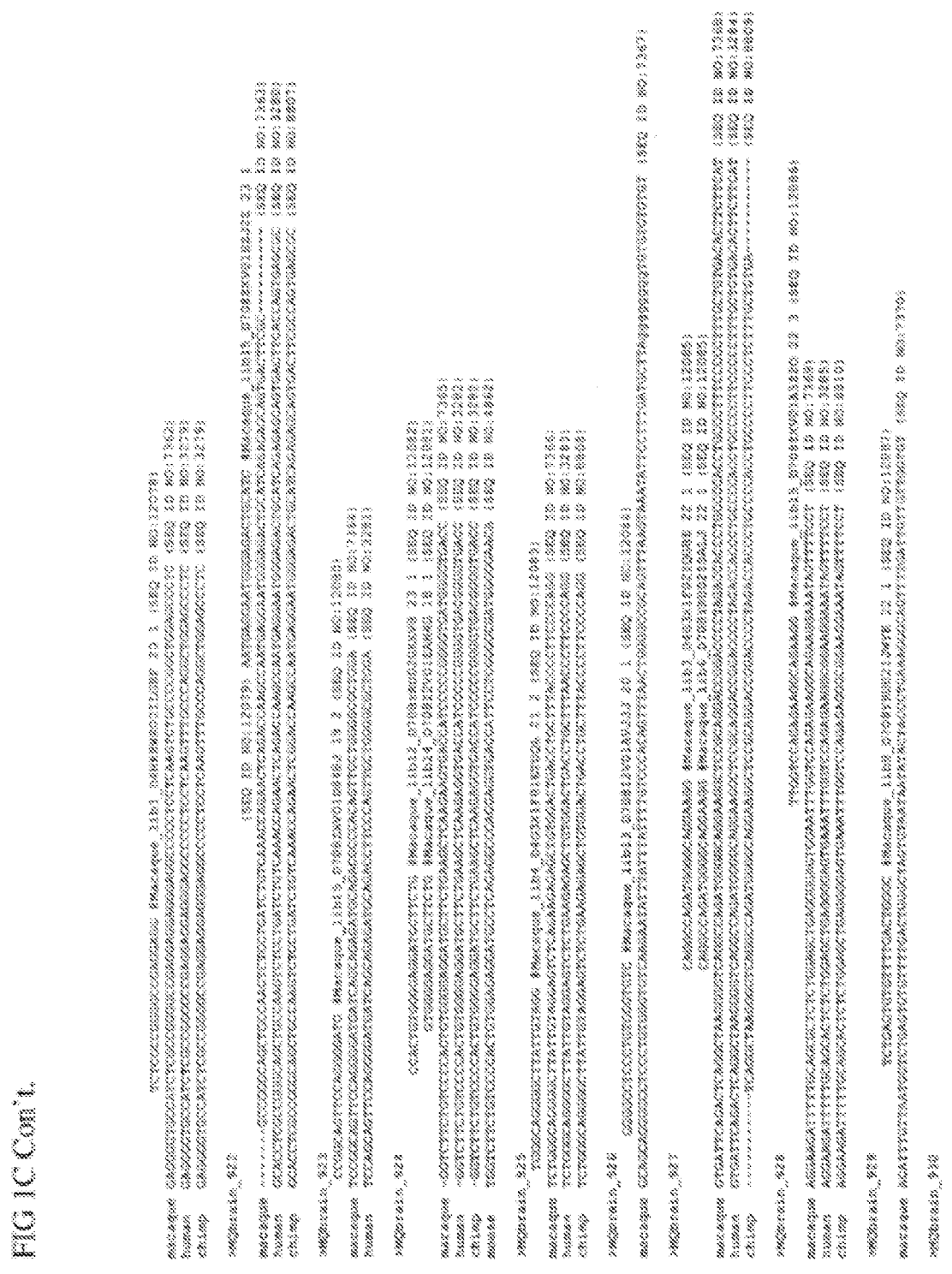
Figure 1C:
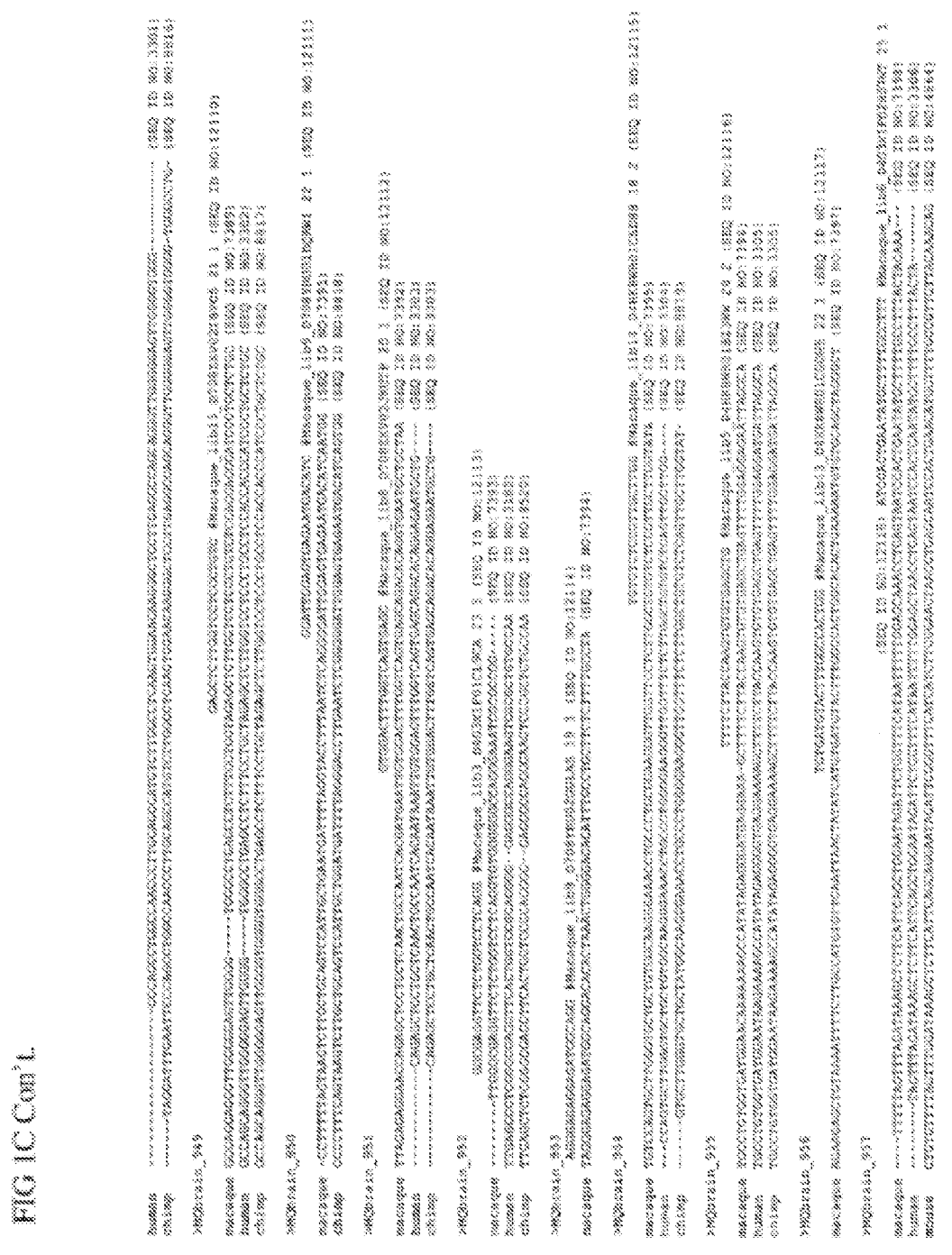
Figure 1C:
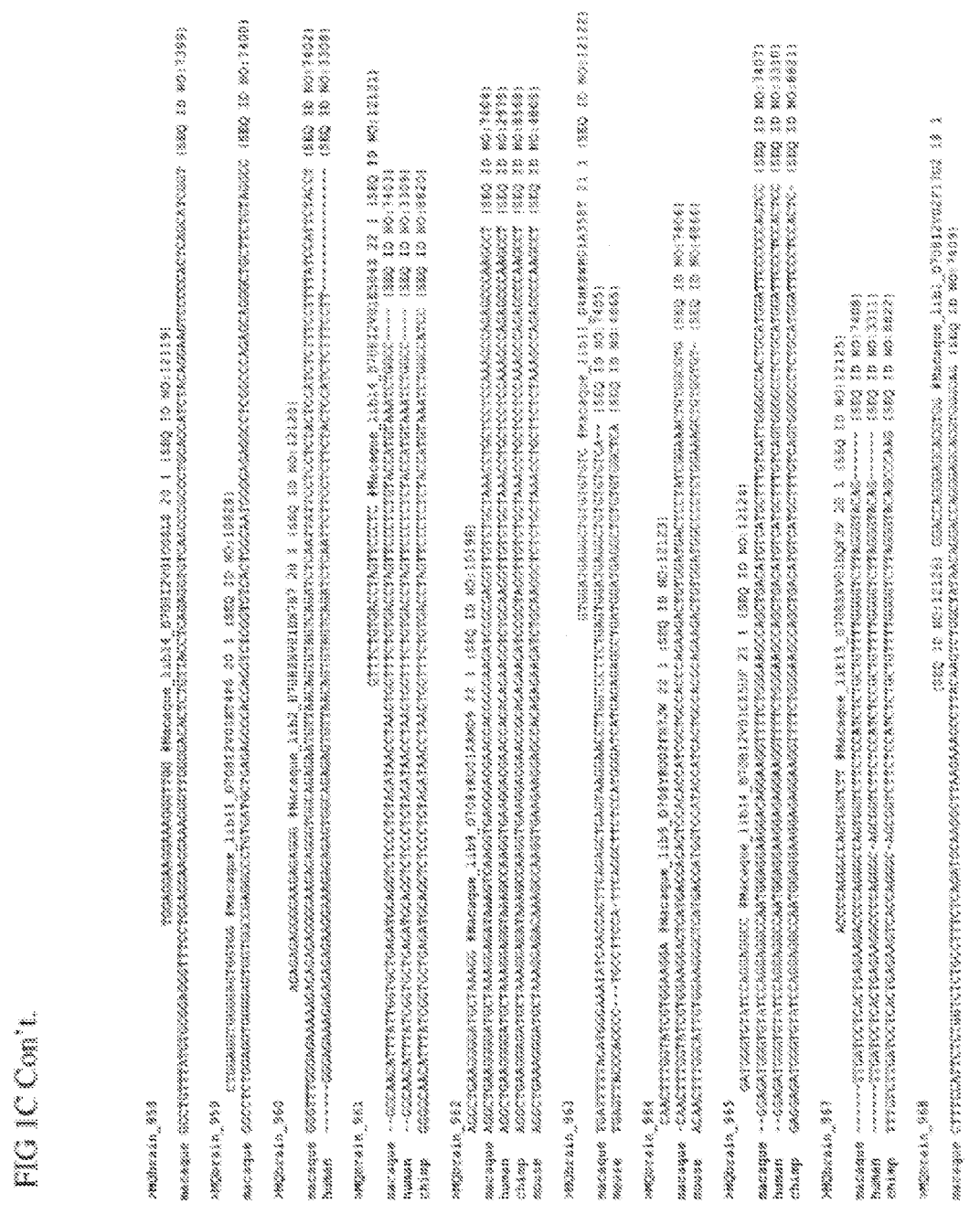
Figure 1C:
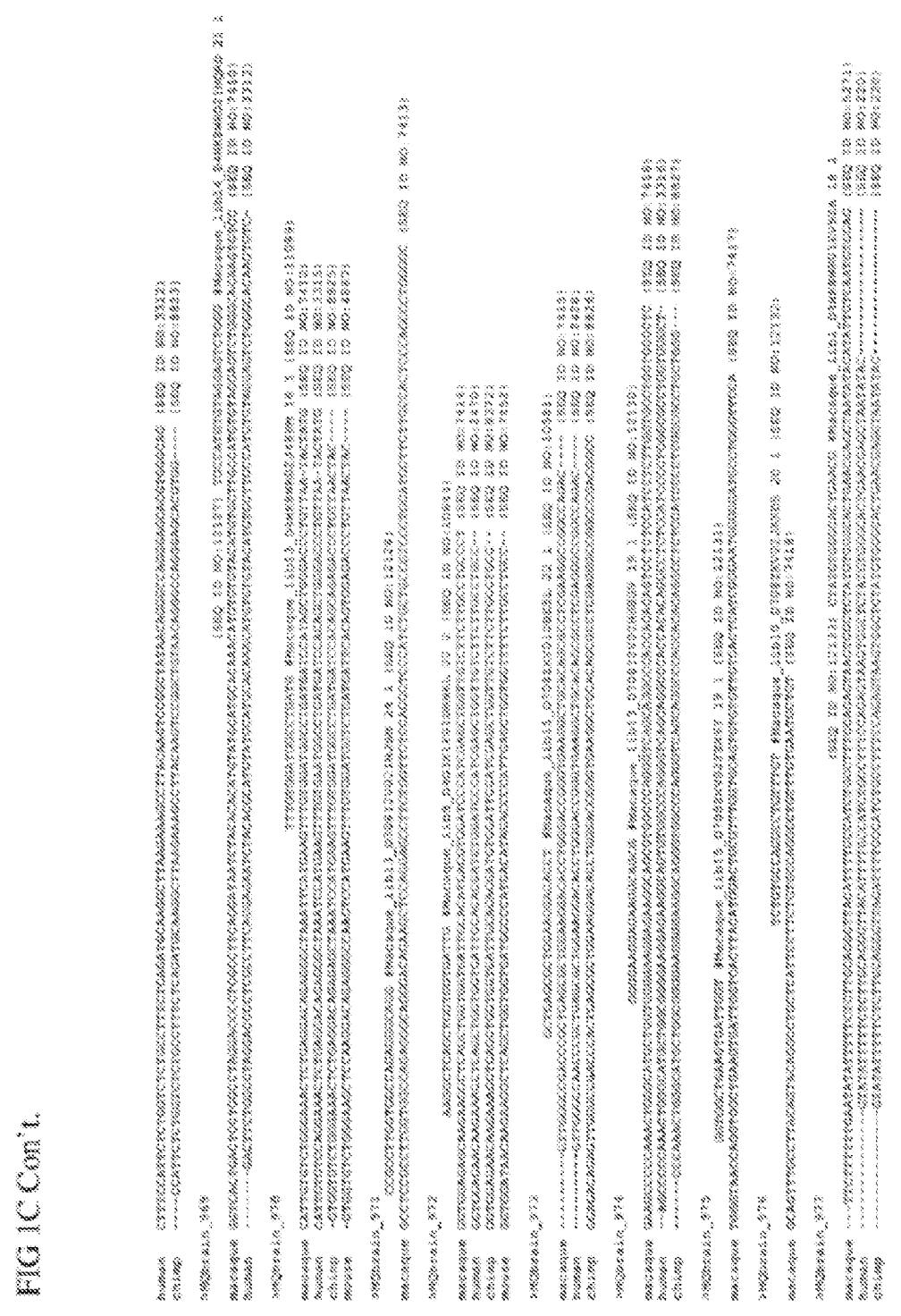
Figure 1C:
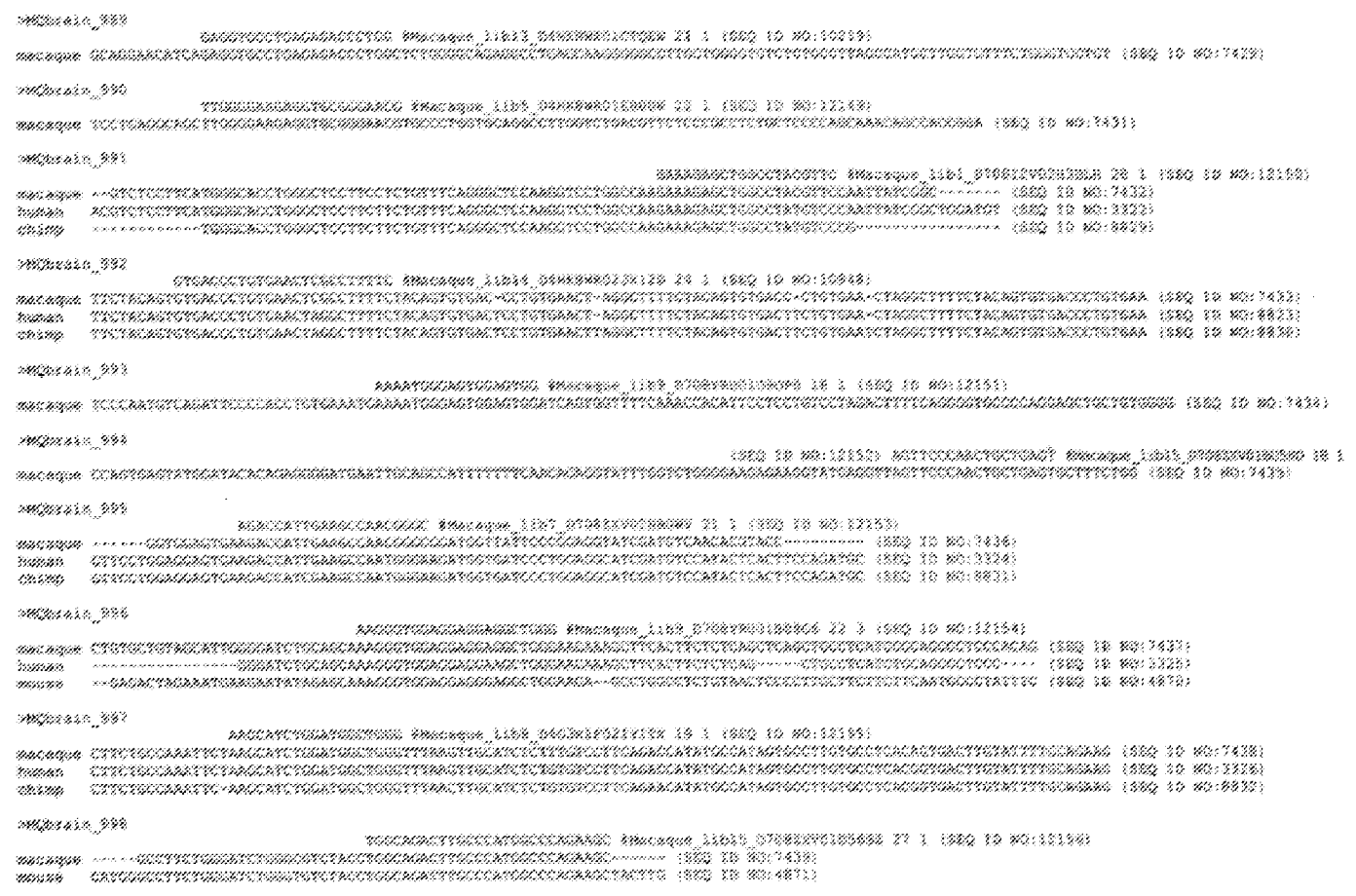
Figure 1C:
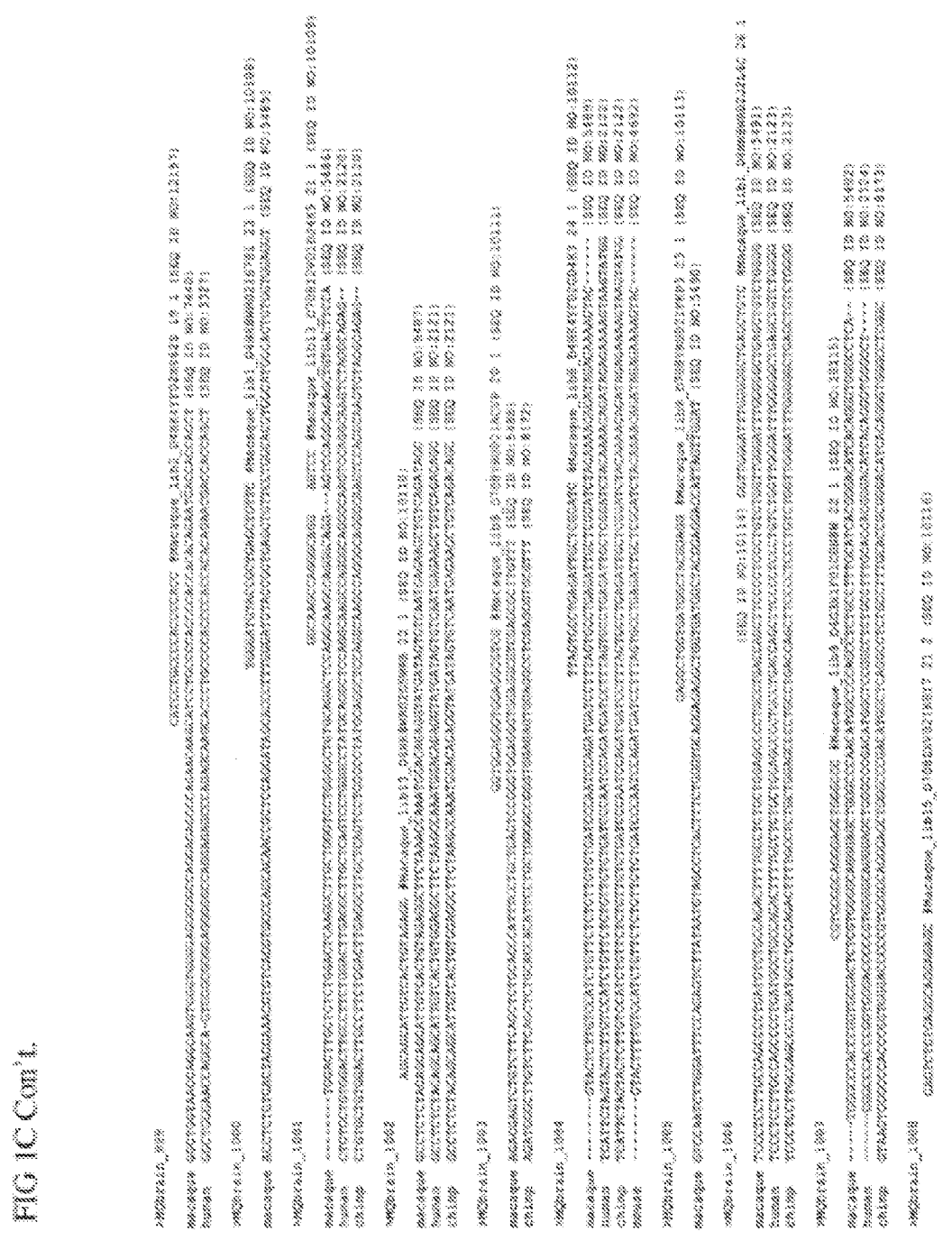
Figure 1C:
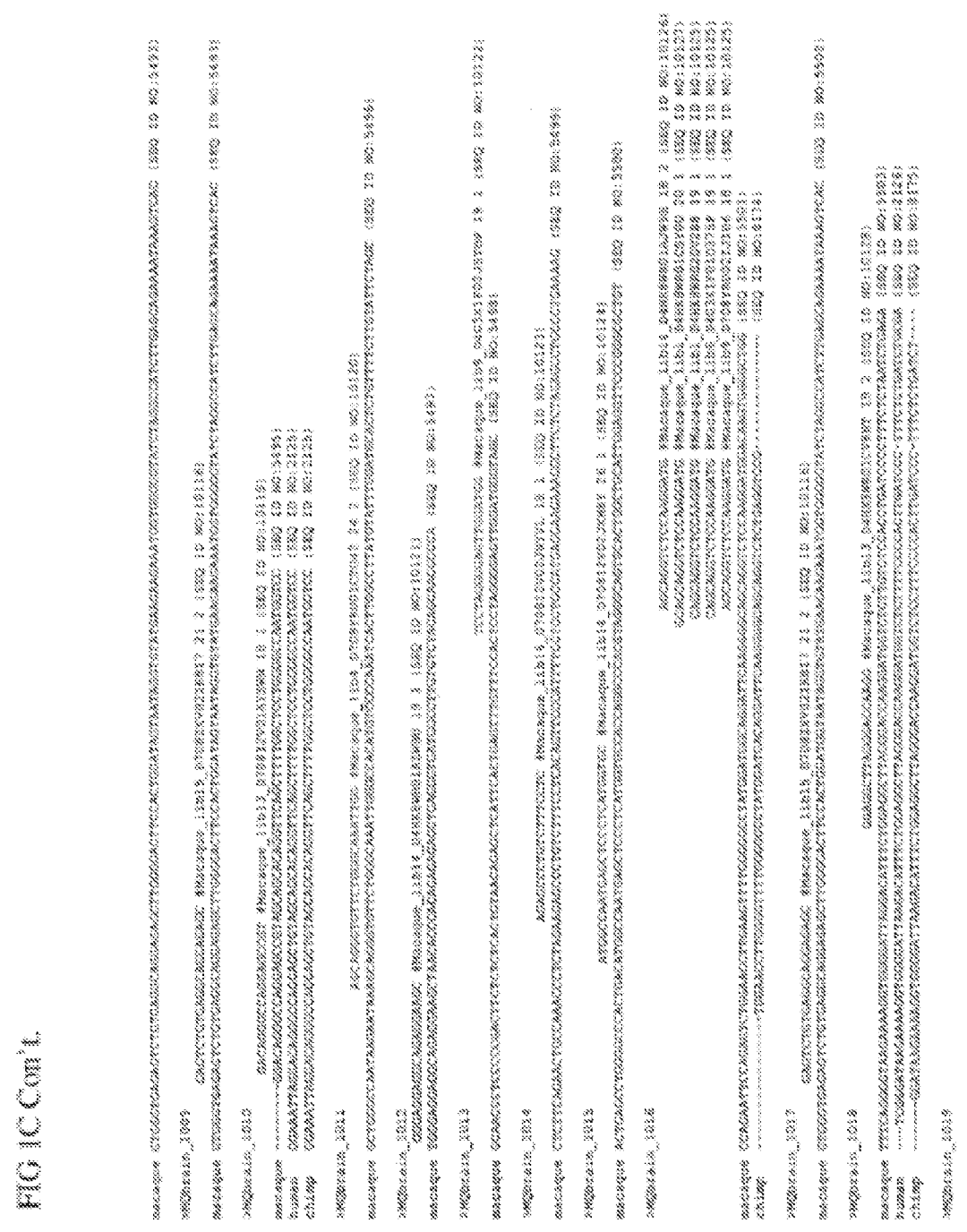
Figure 1C:
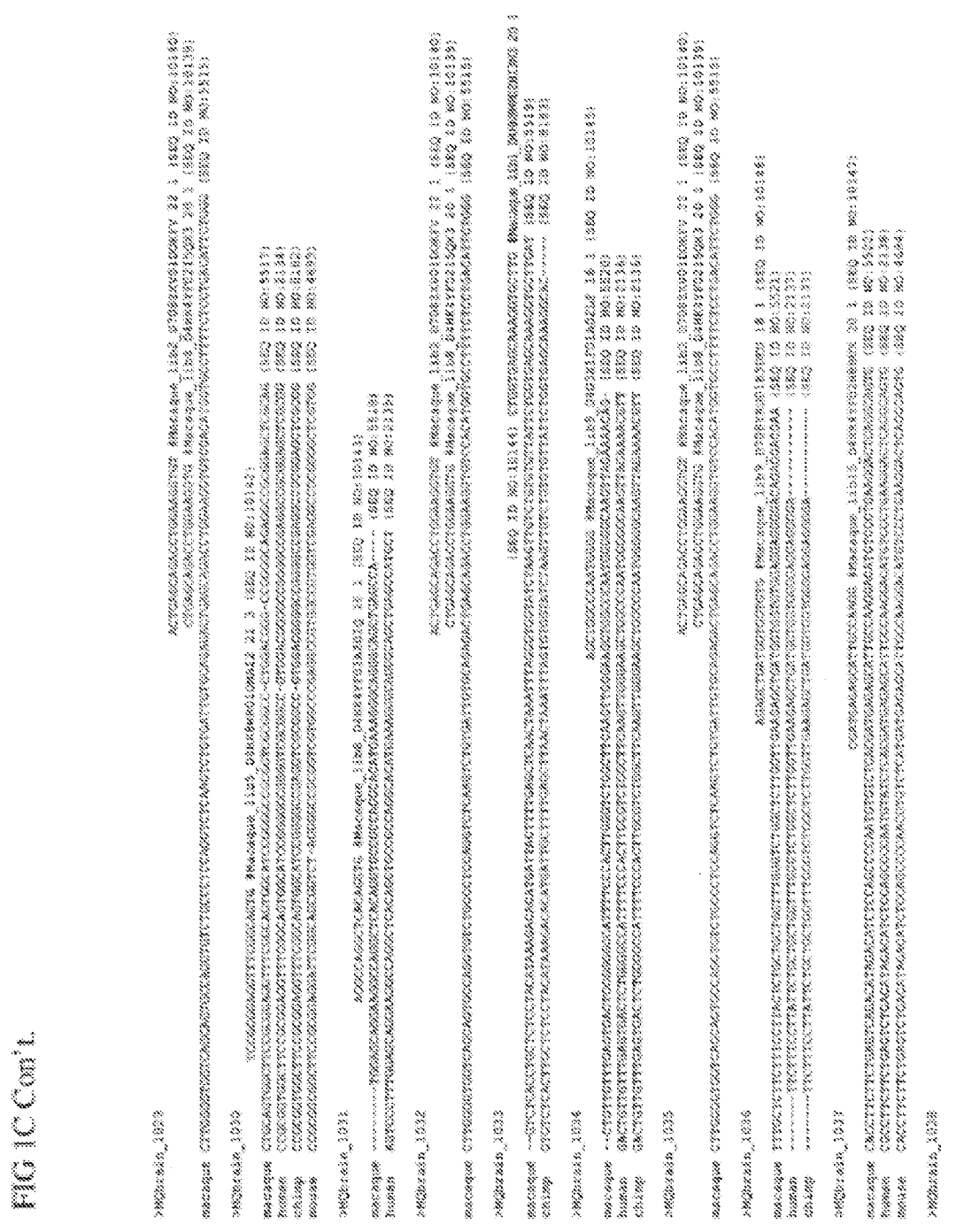
Figure 1C:
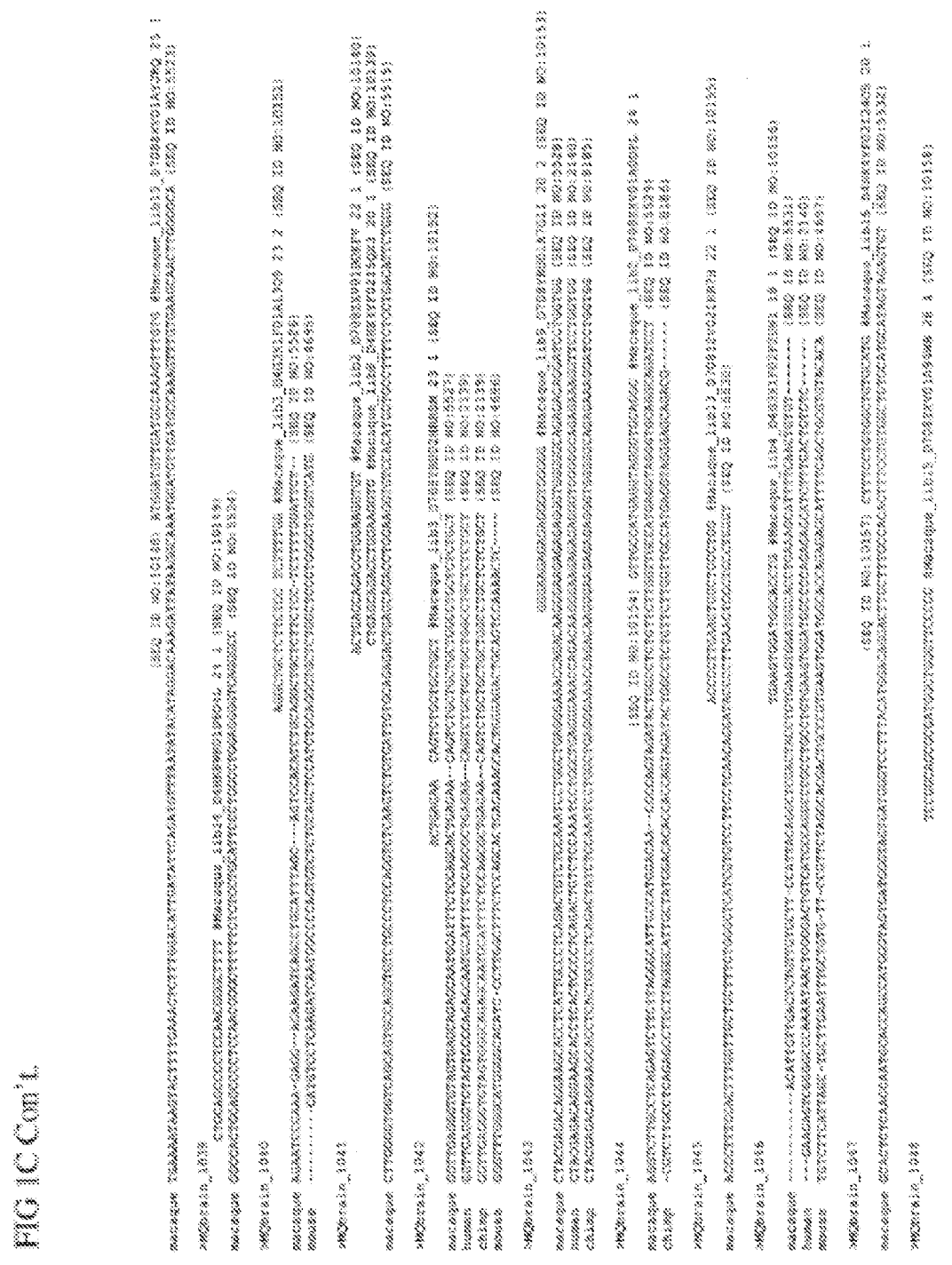
Figure 1C:
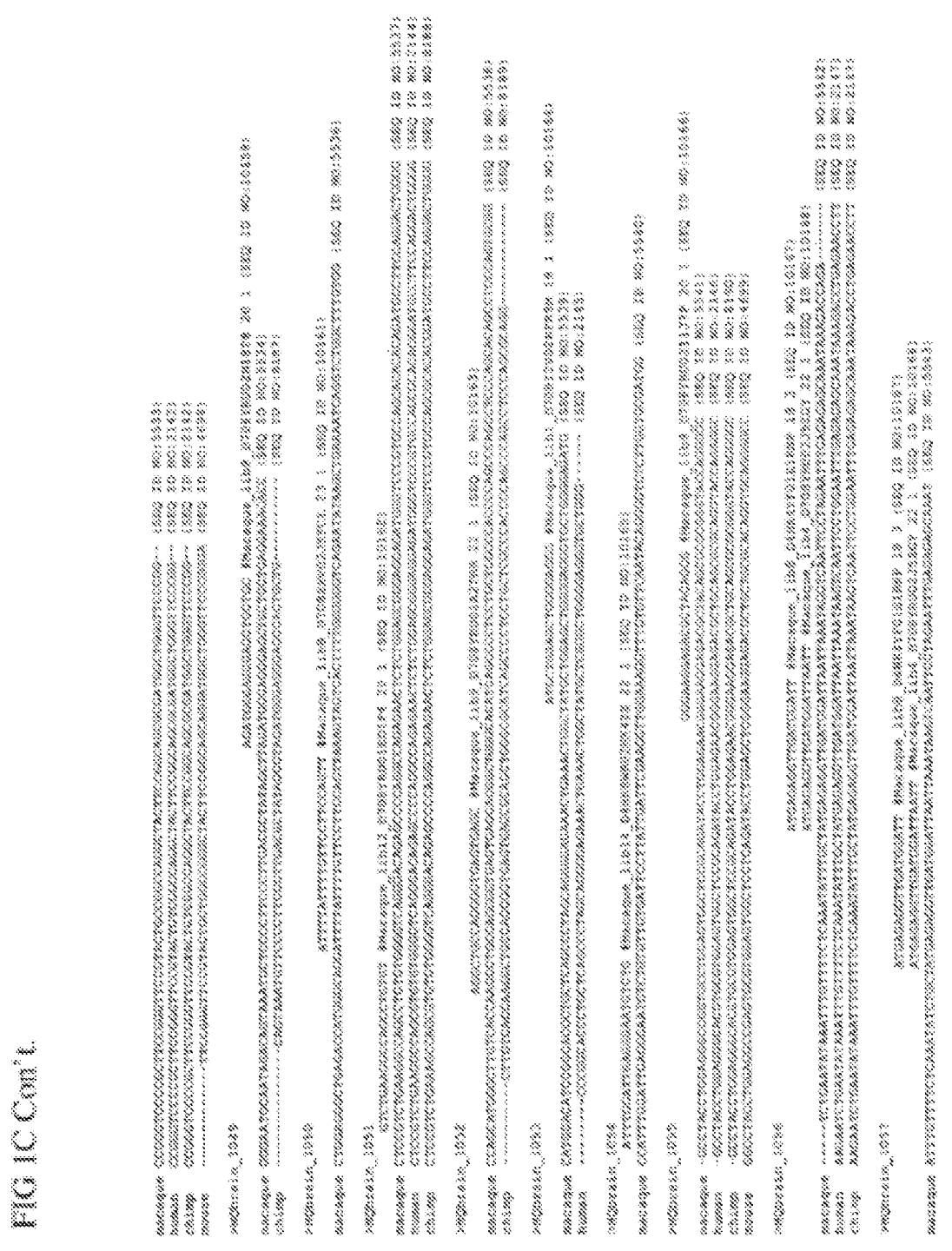
Figure 1C:
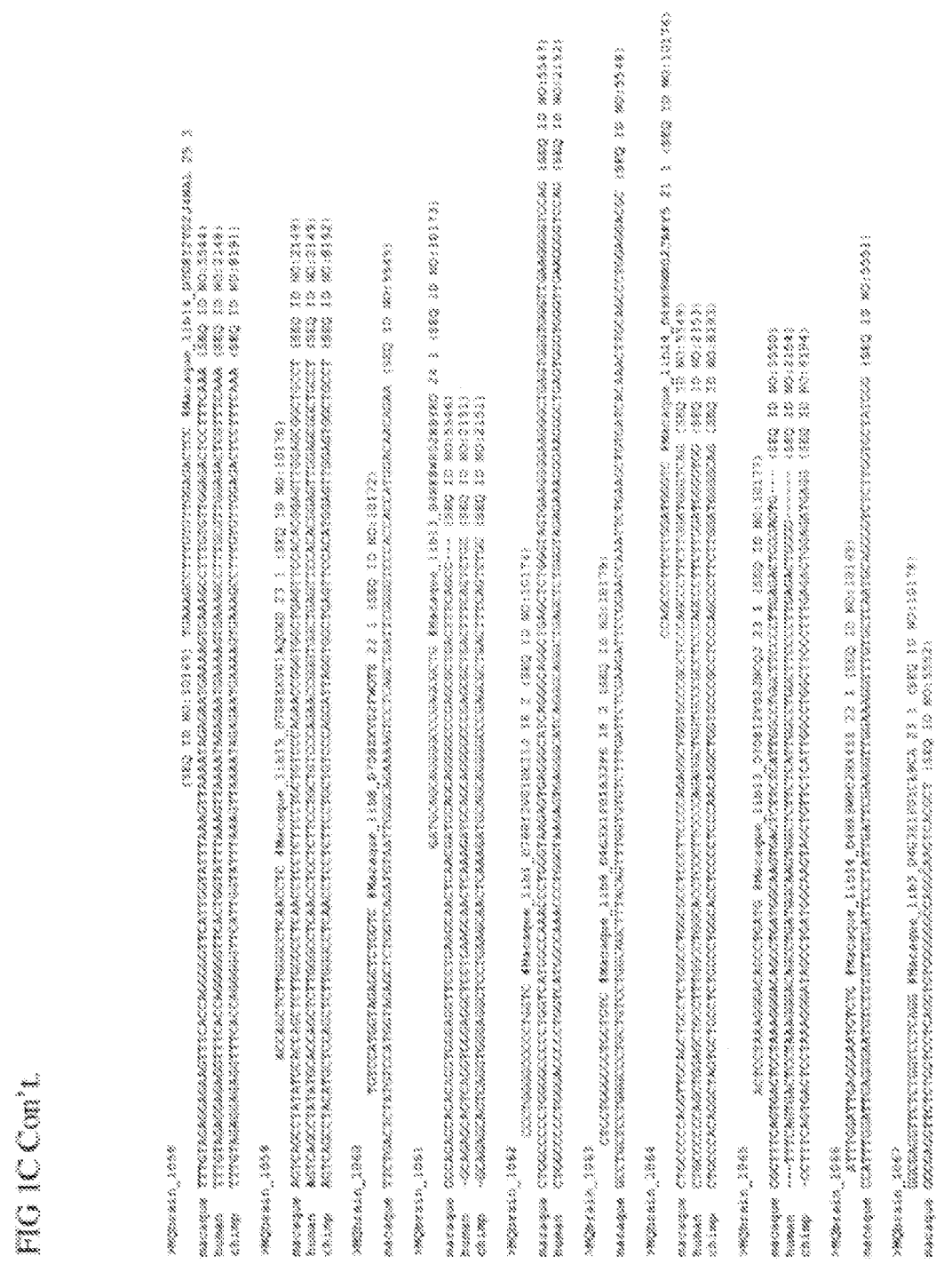
Figure 1C:
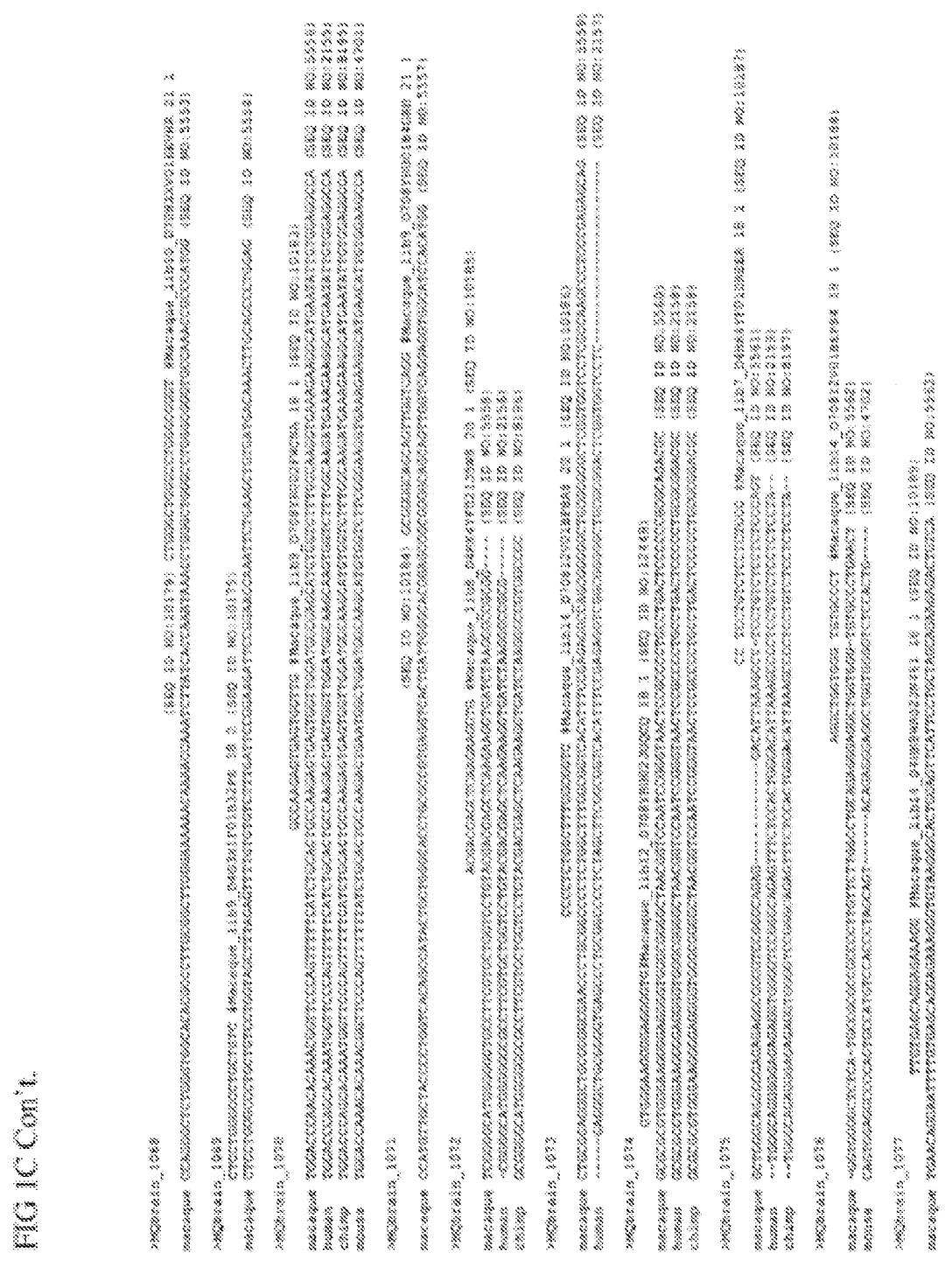
Figure 1C:
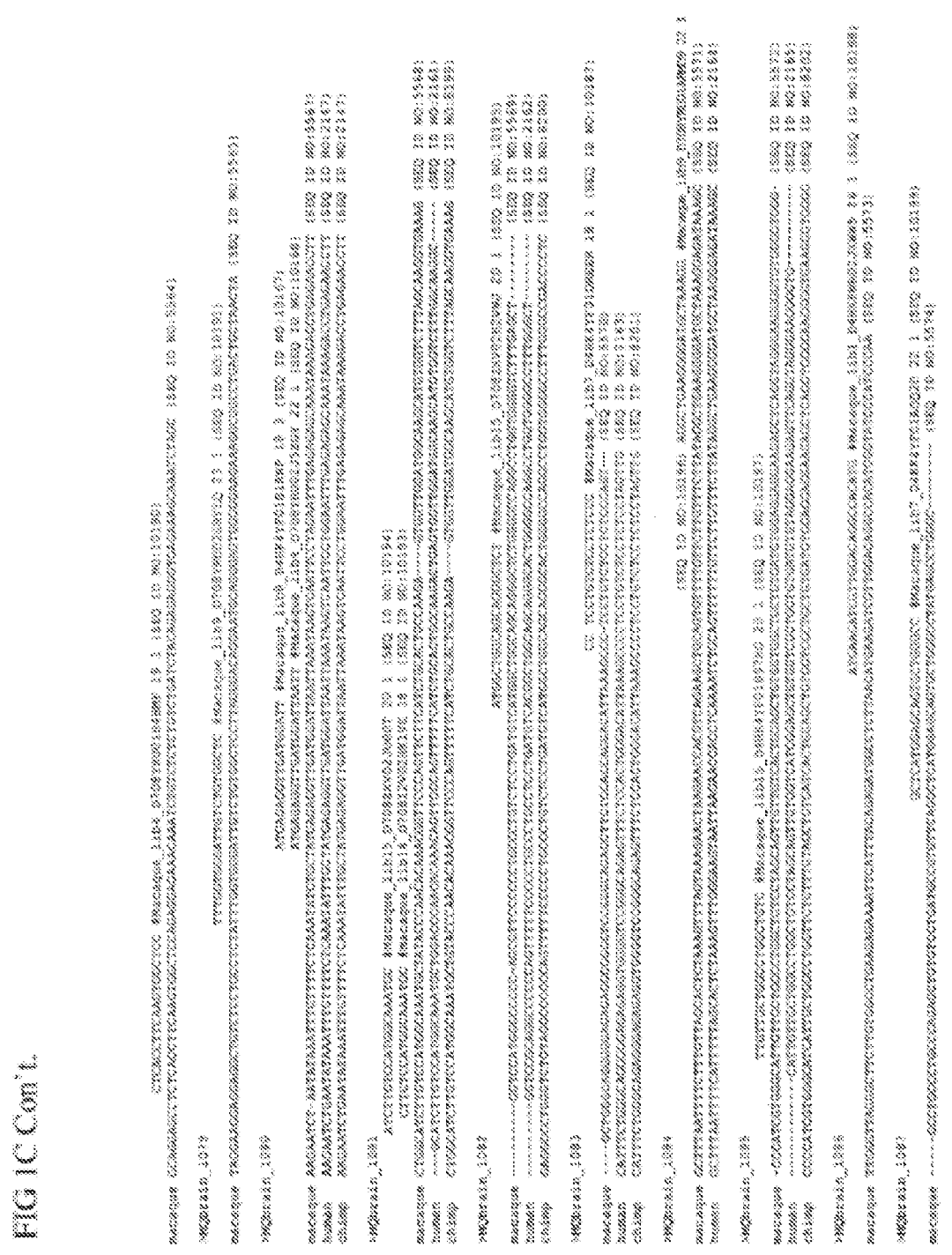
Figure 1C:
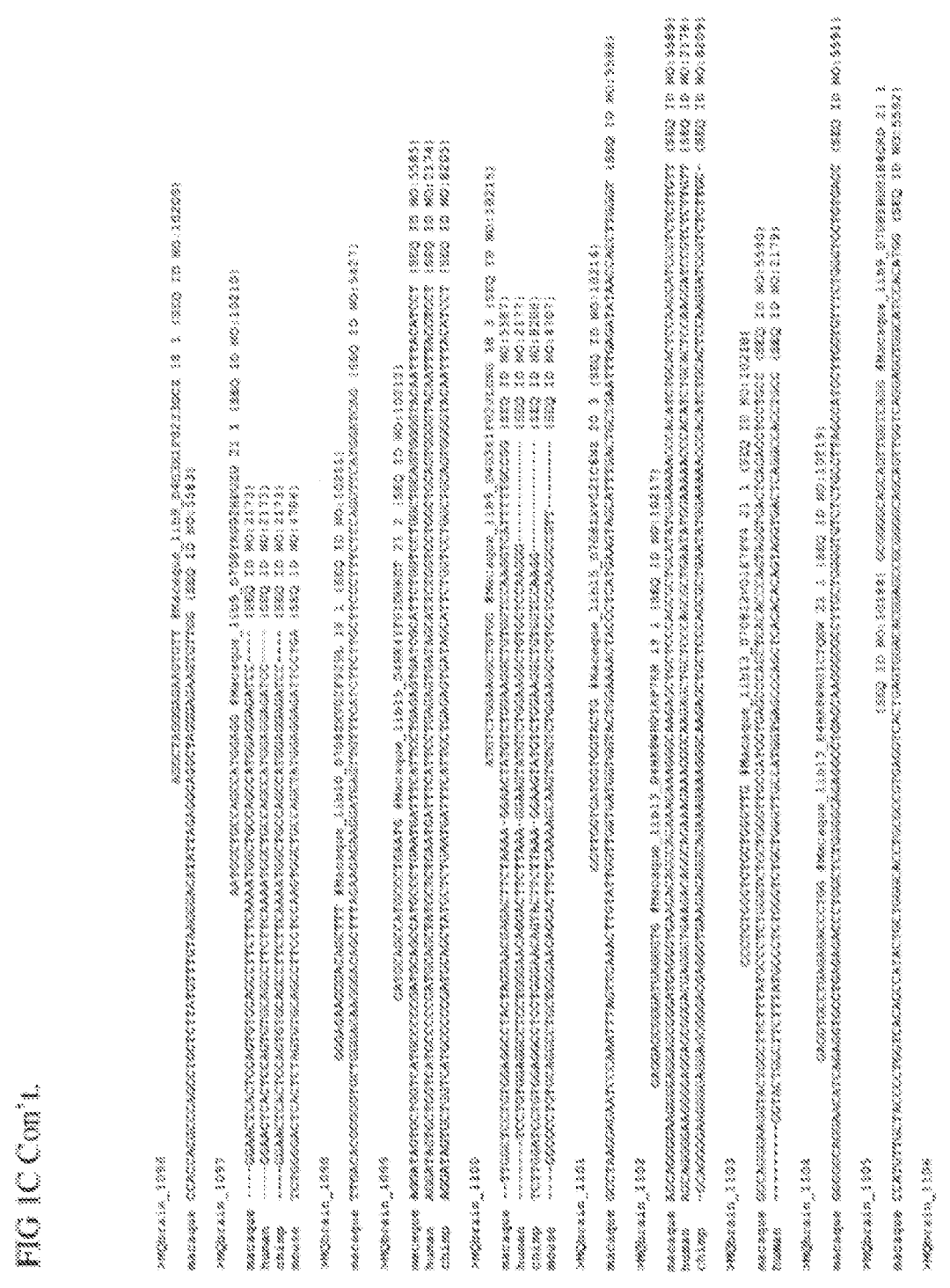
Figure 1C:
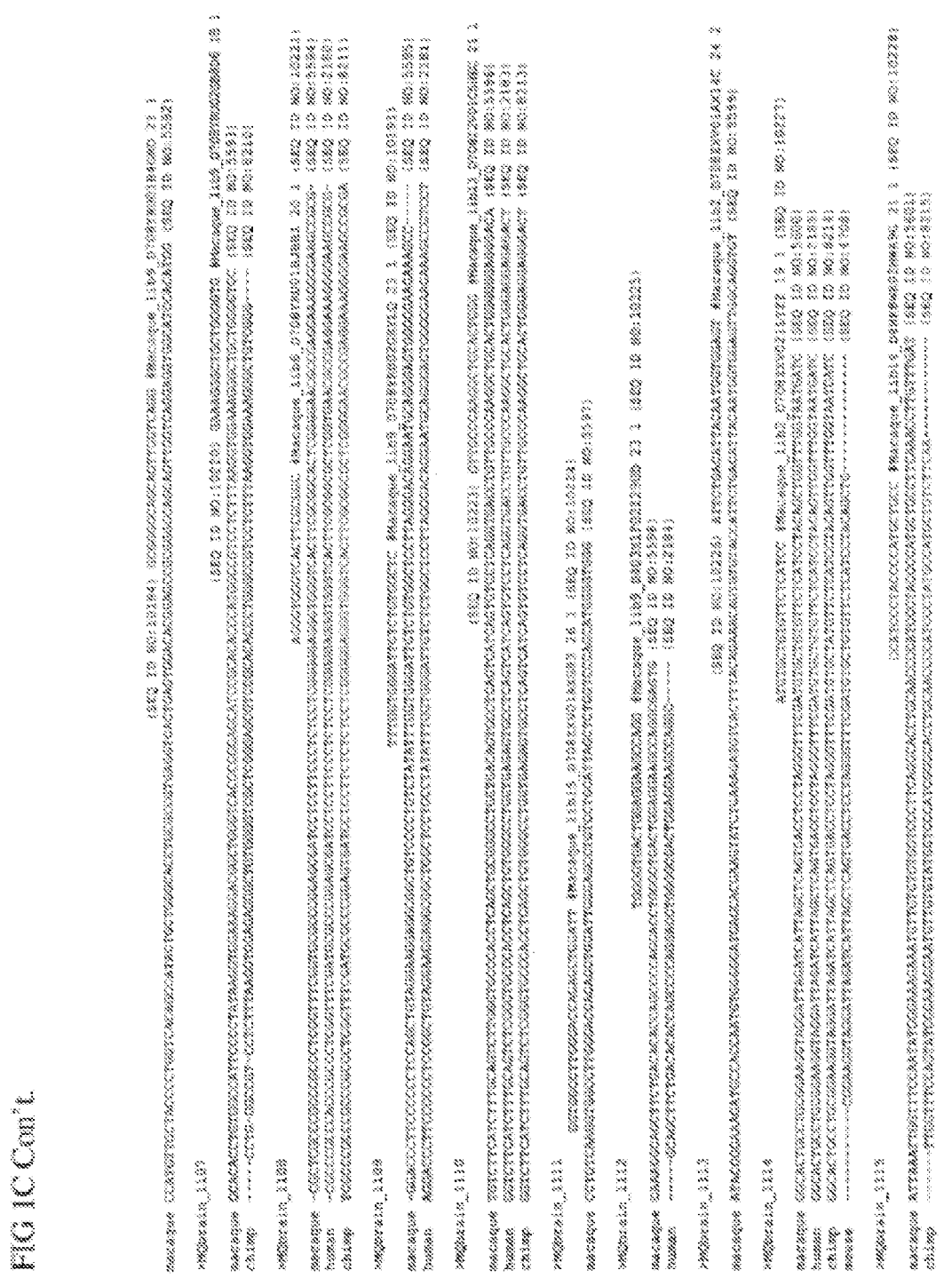
Figure 1C:
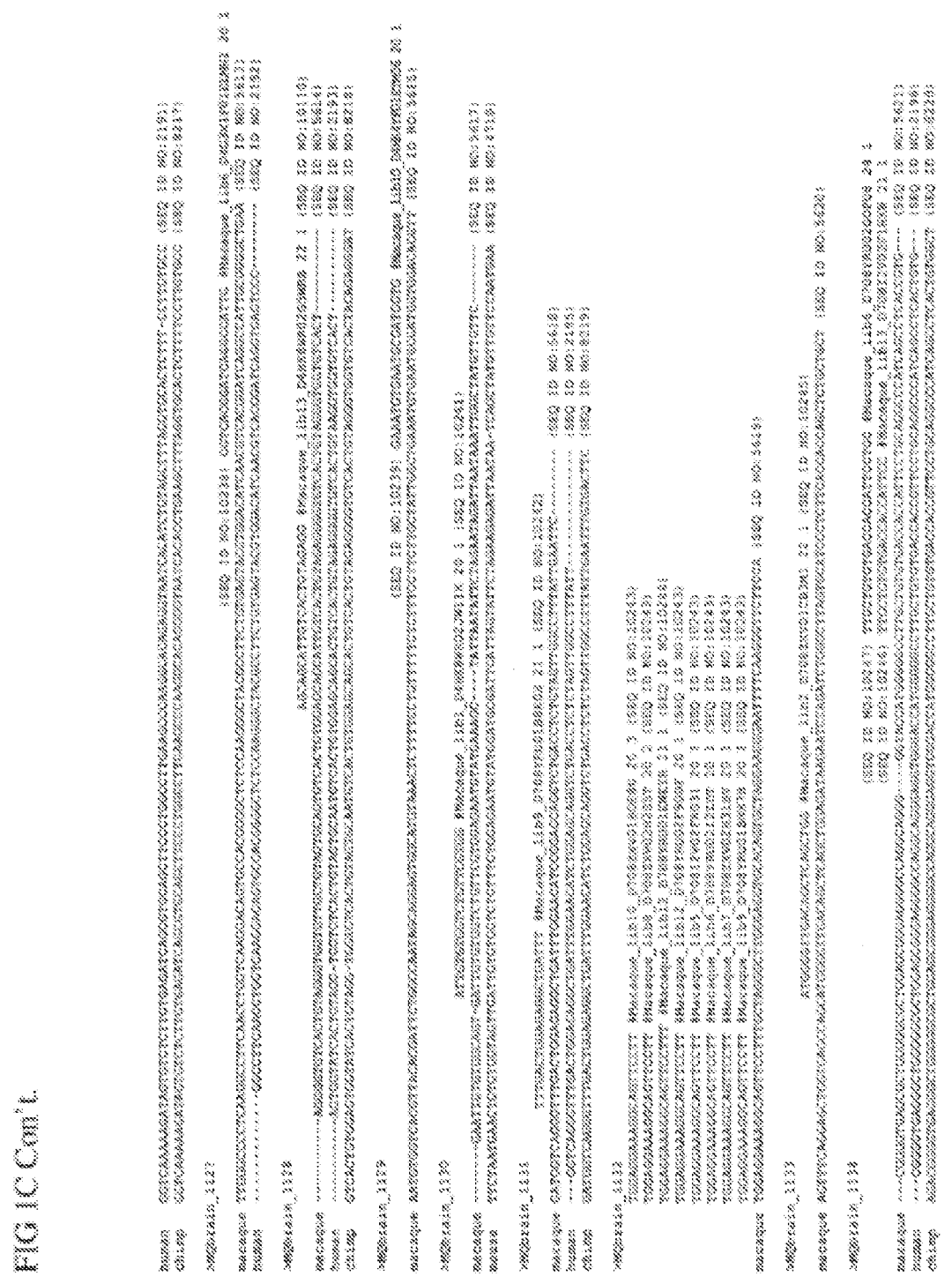
Figure 1C:
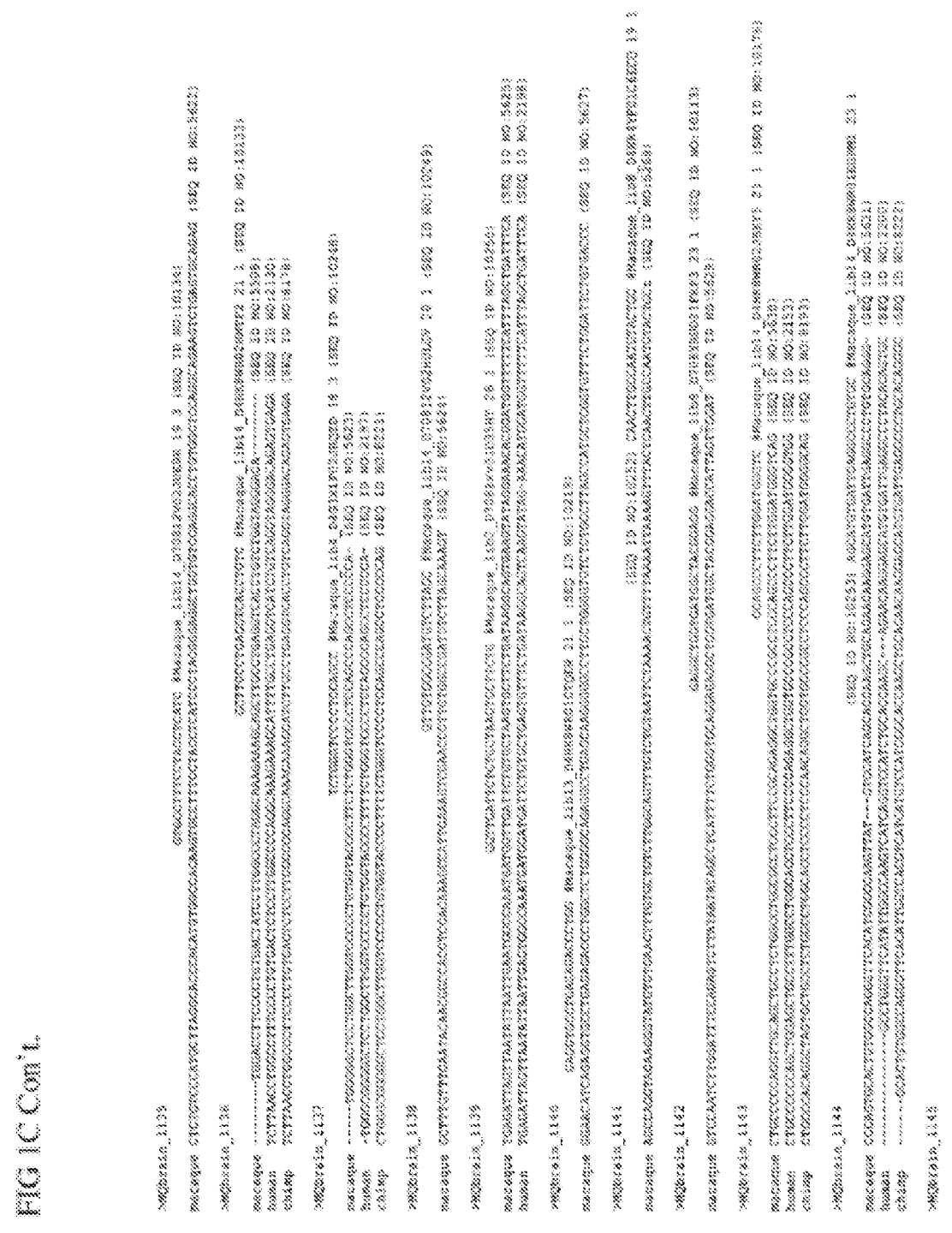
Figure 1C:
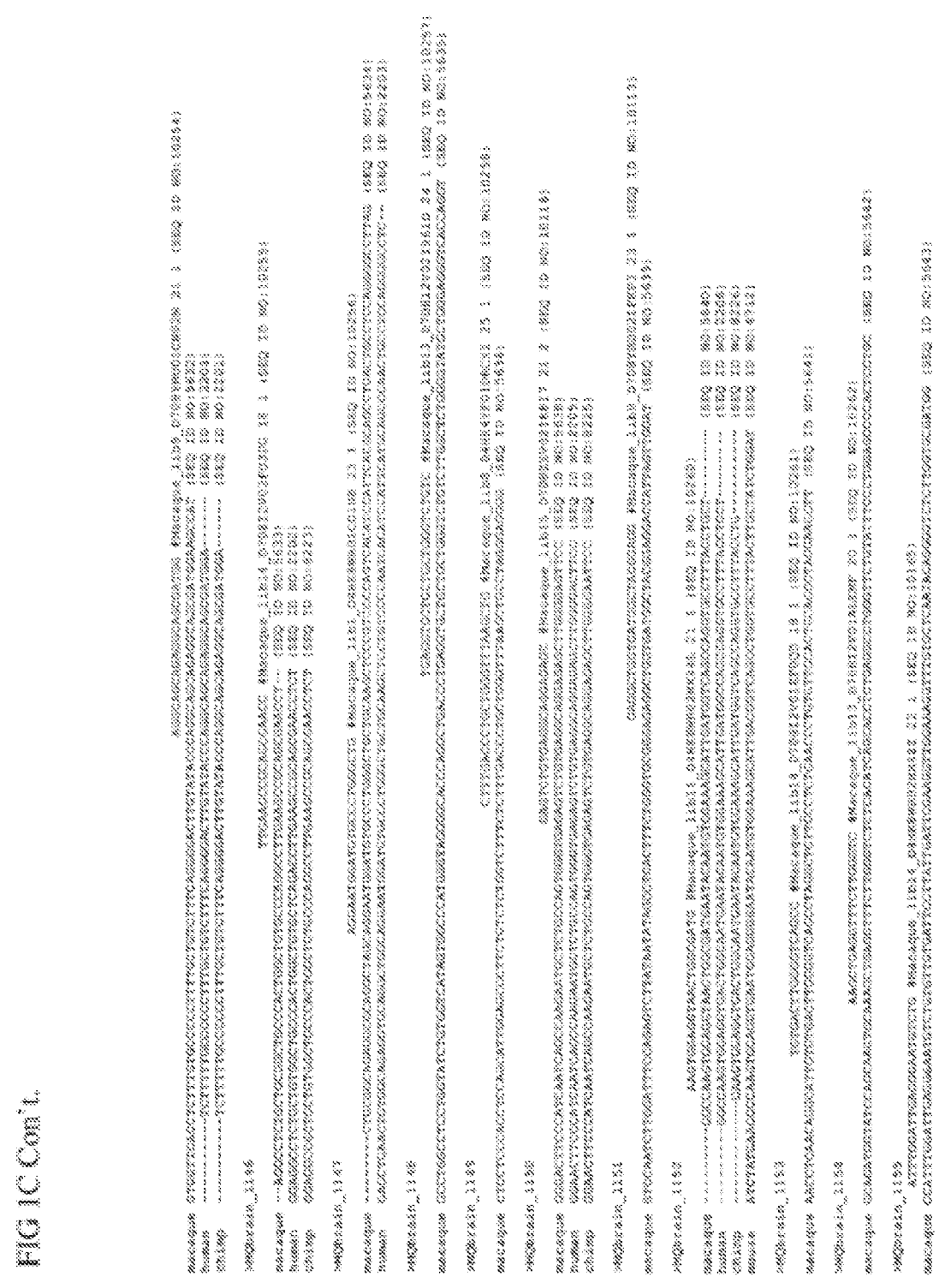
Figure 1C:
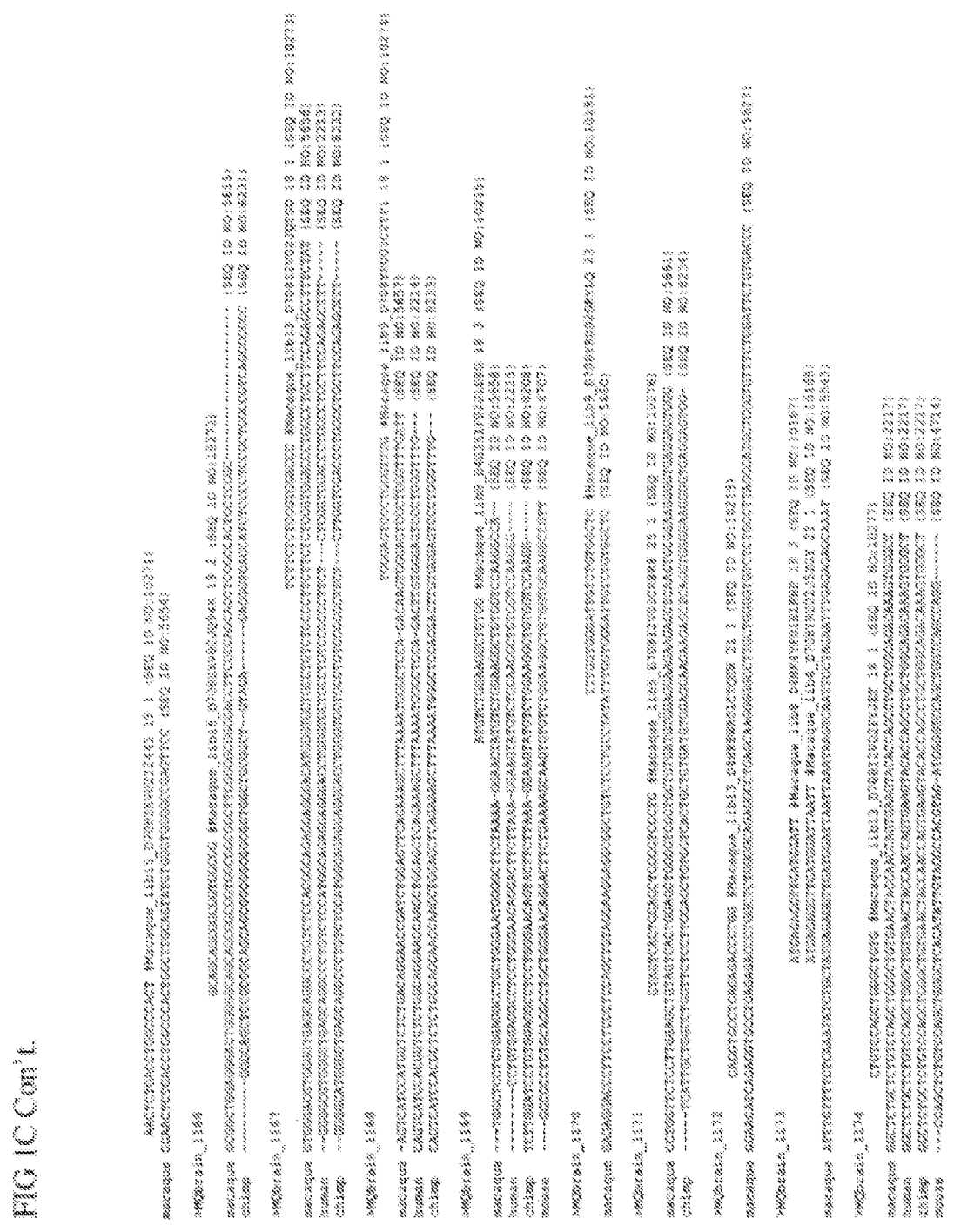
Figure 1C:
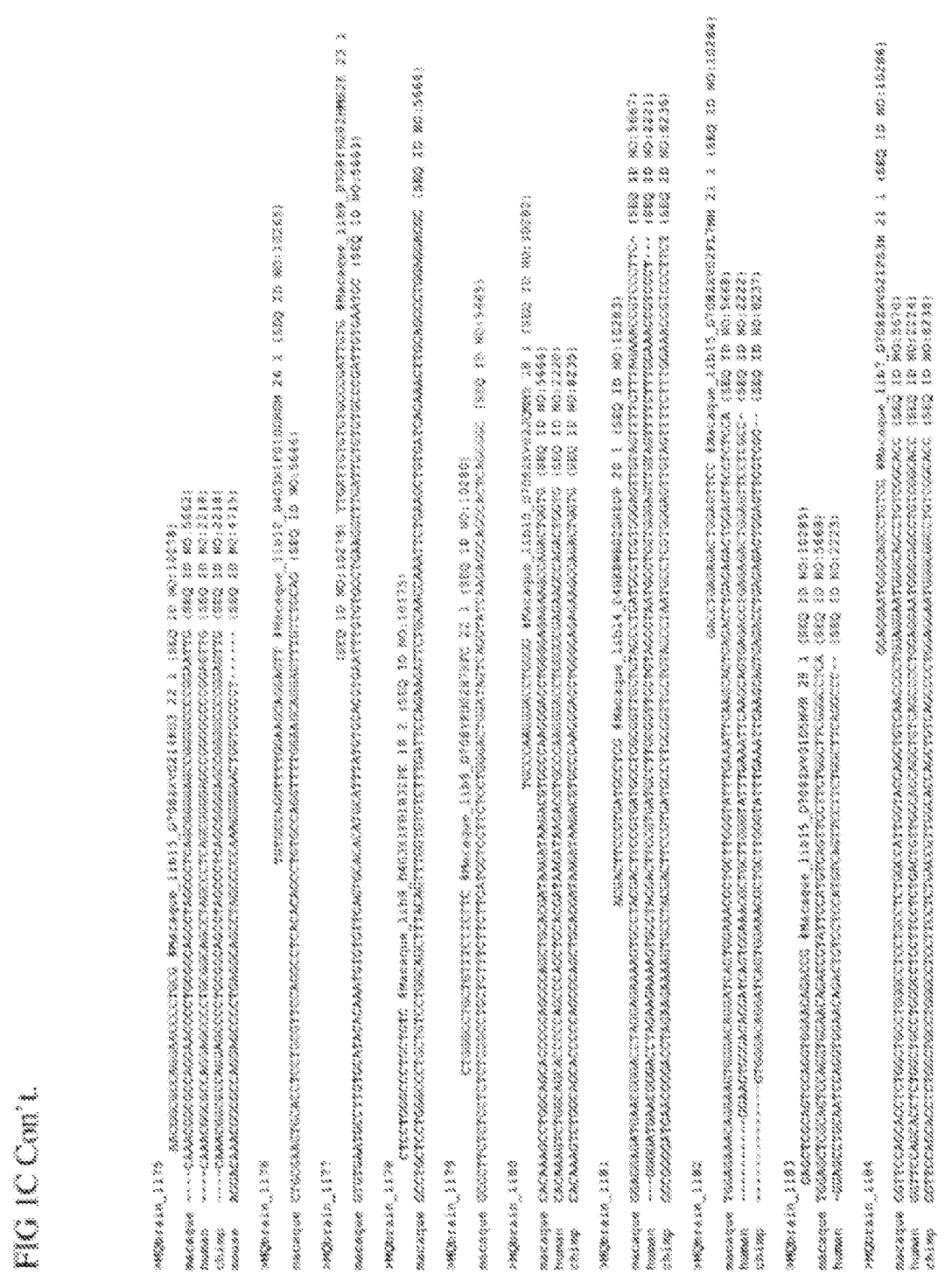
Figure 1C:
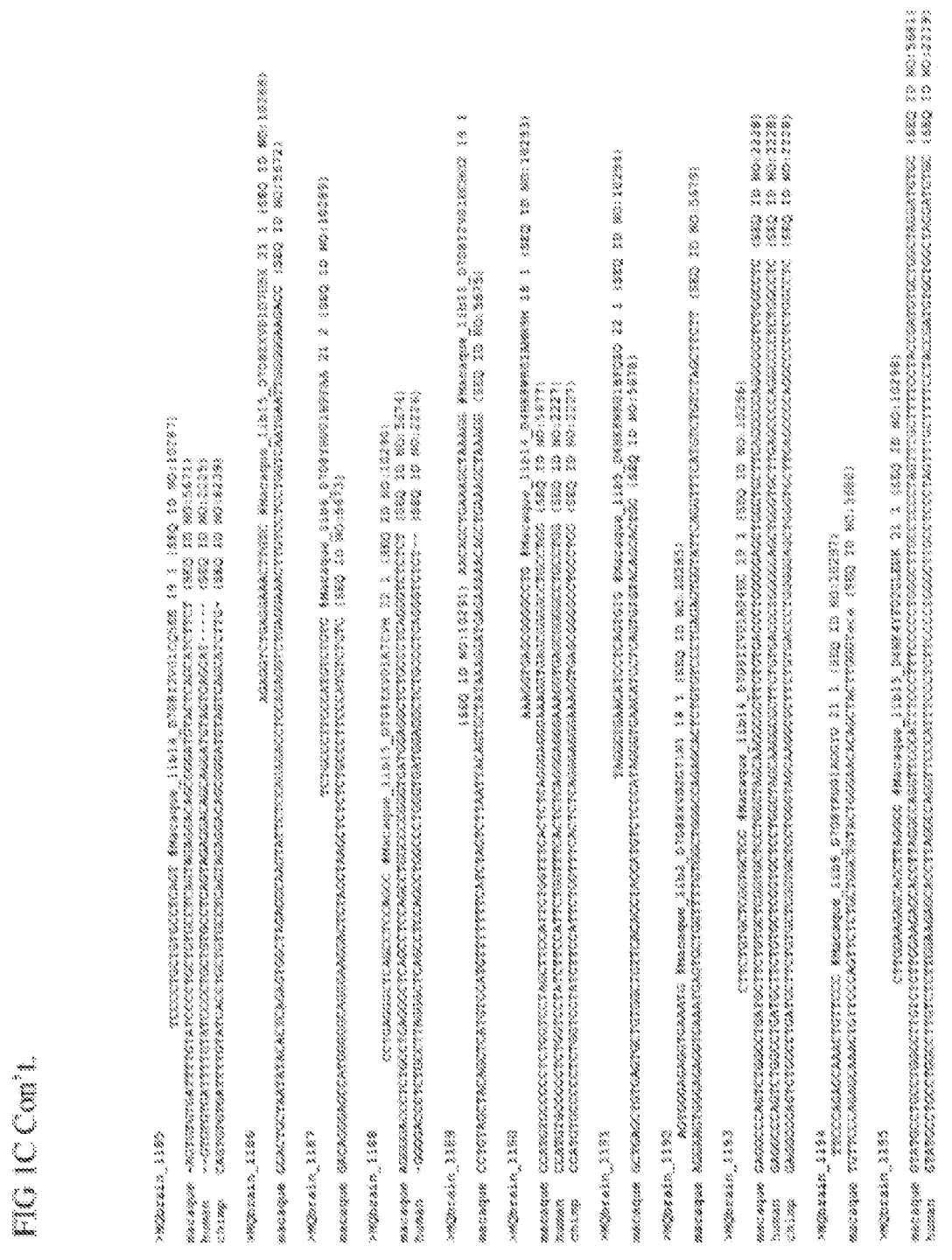
Figure 1C:
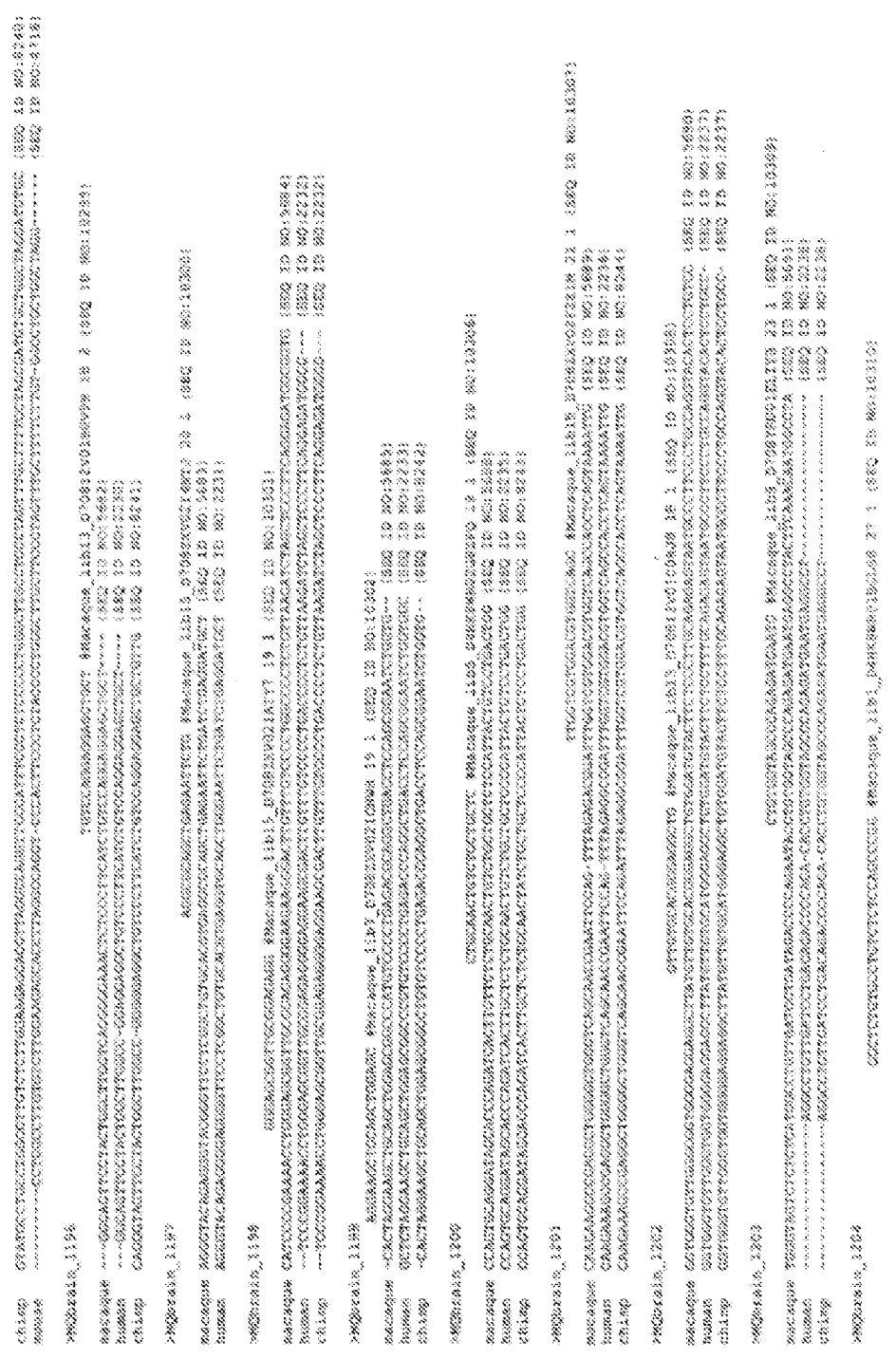
Figure 1C:
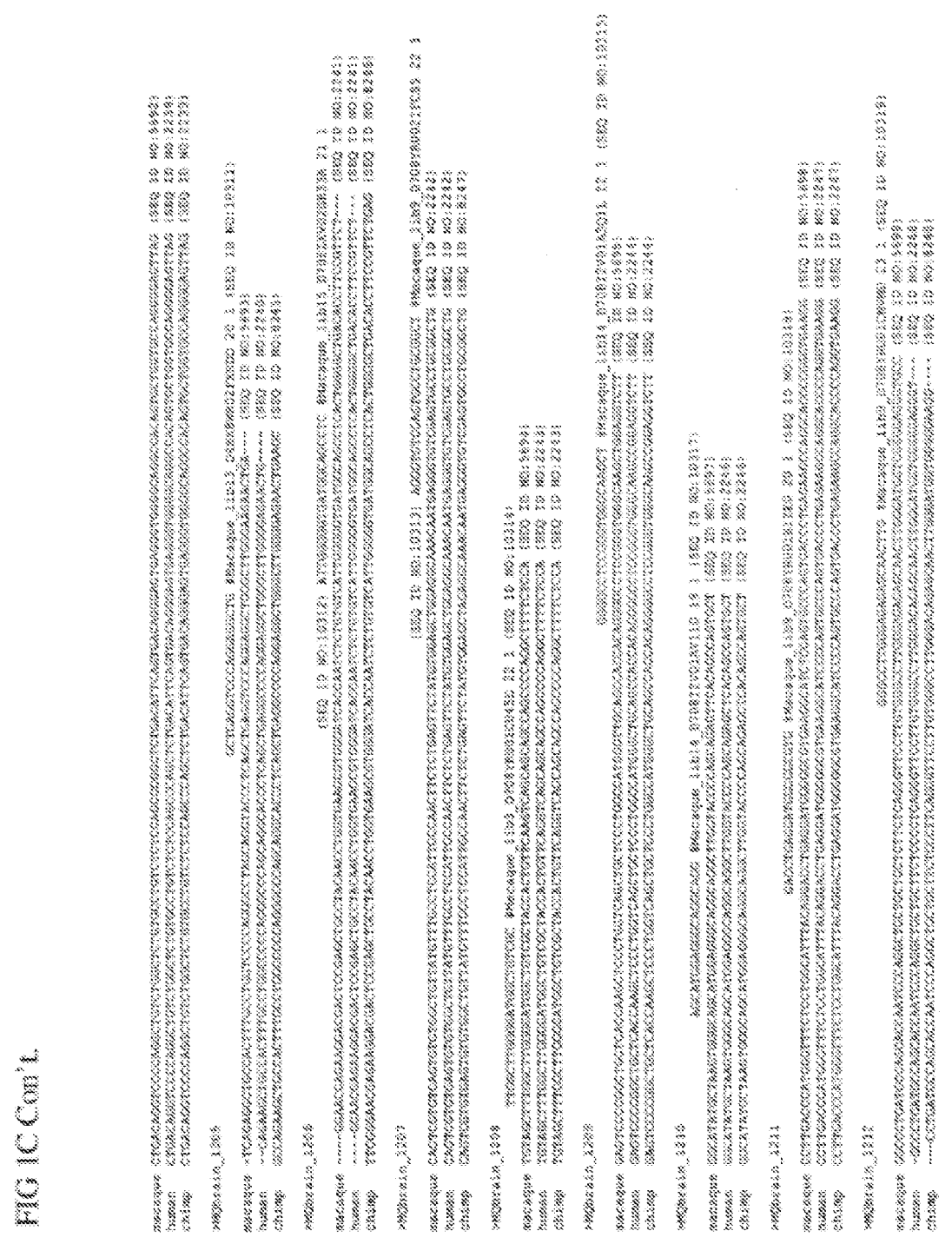
Figure 1C:
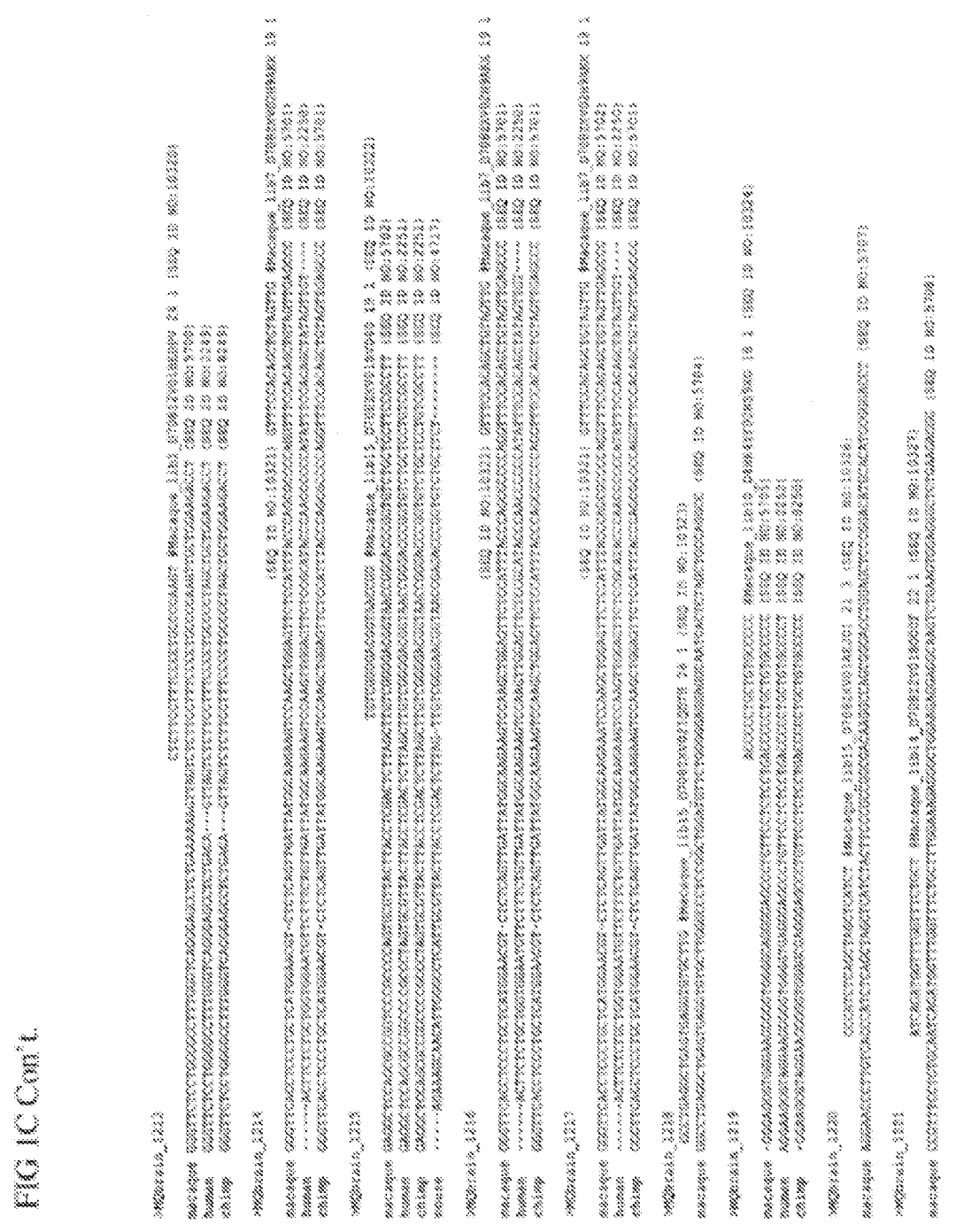
Figure 1C:
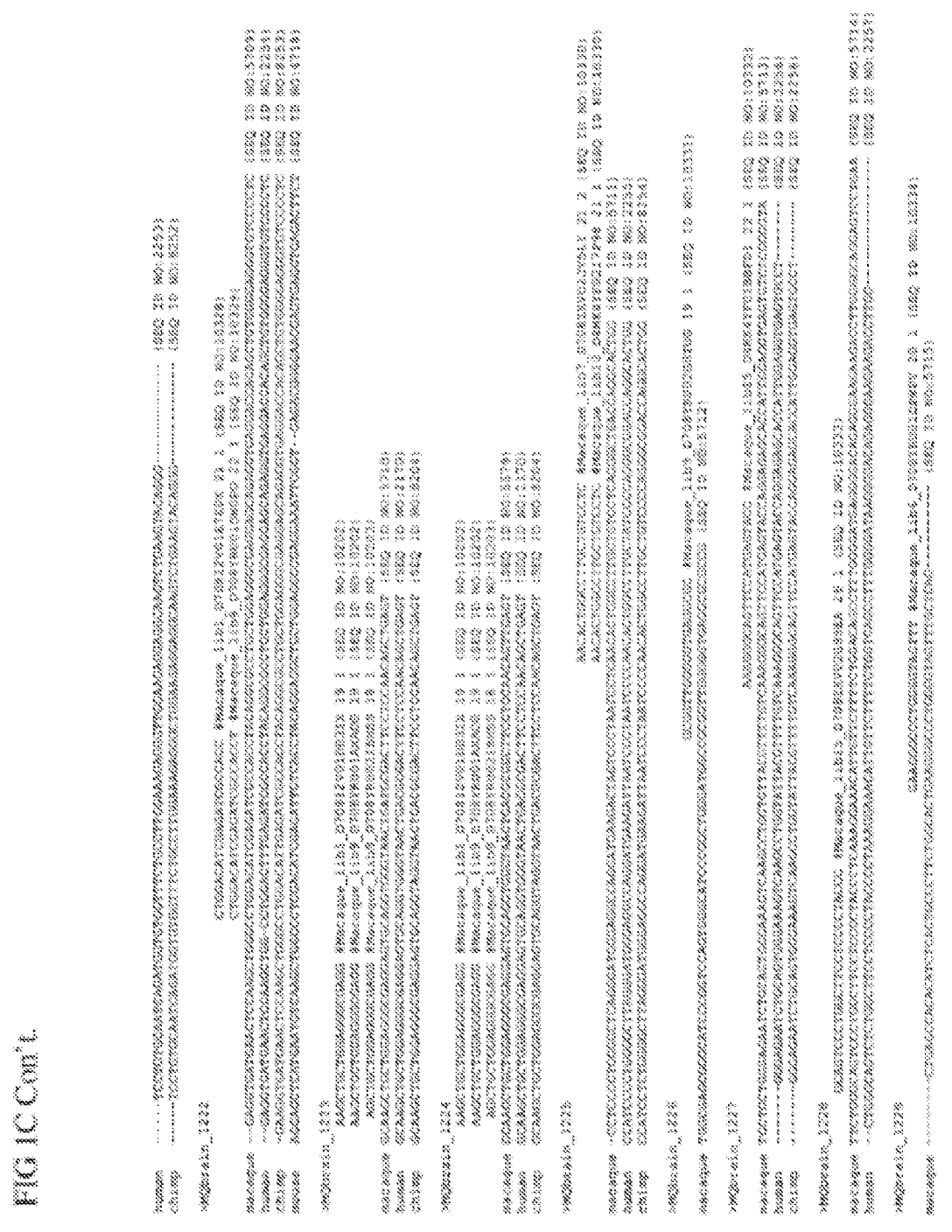
Figure 1C:
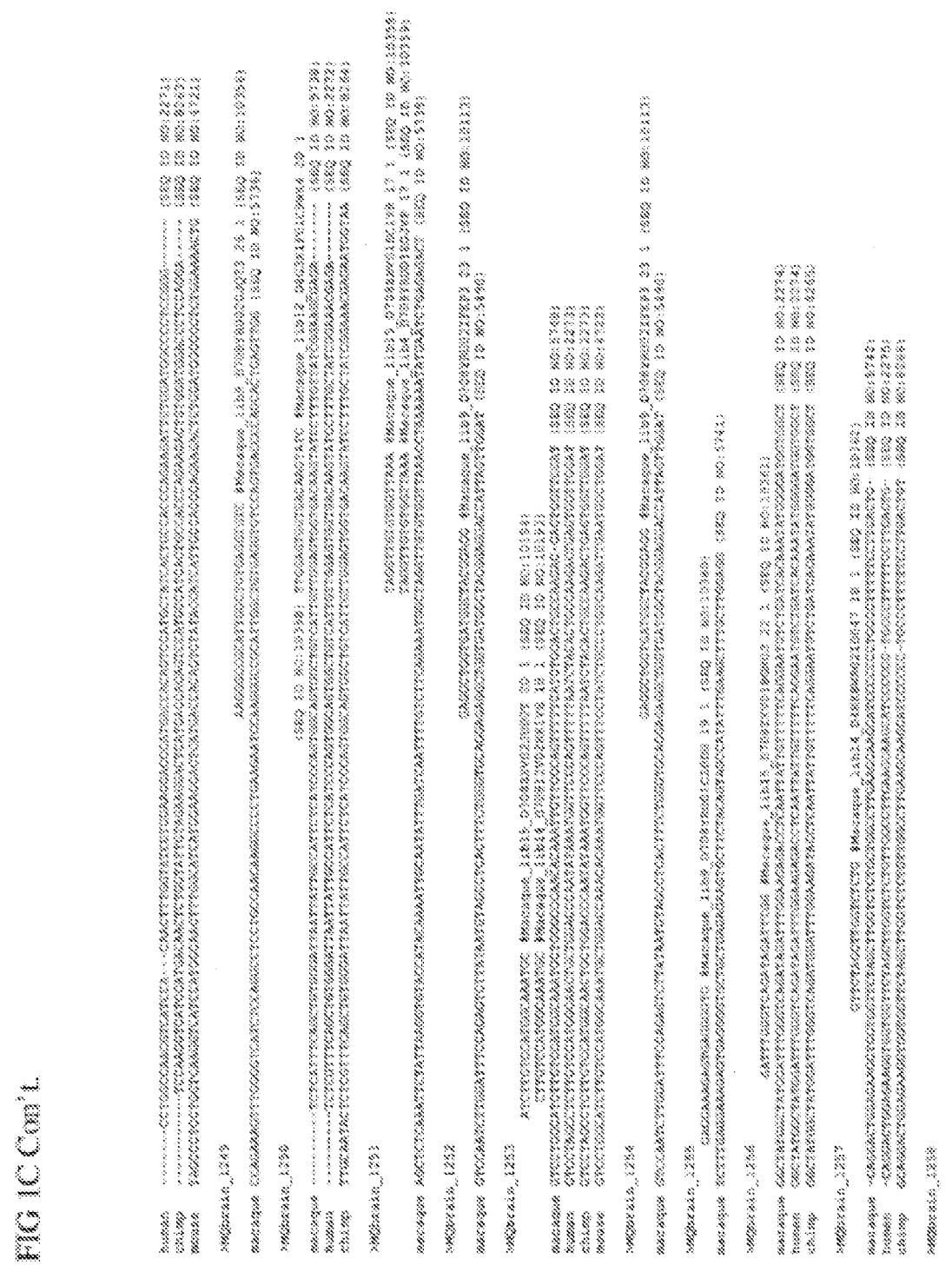
Figure 1C:
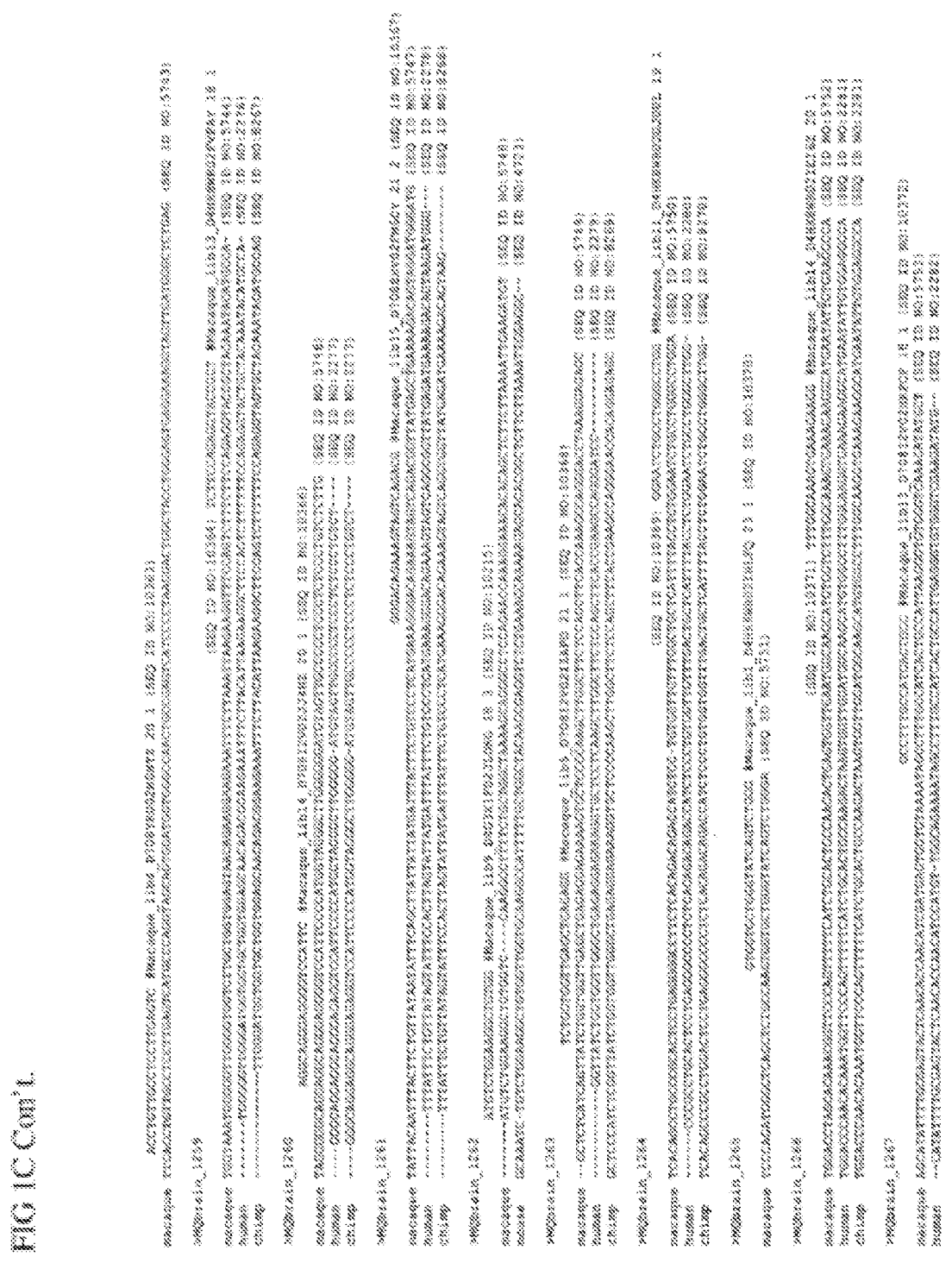
Figure 1C:
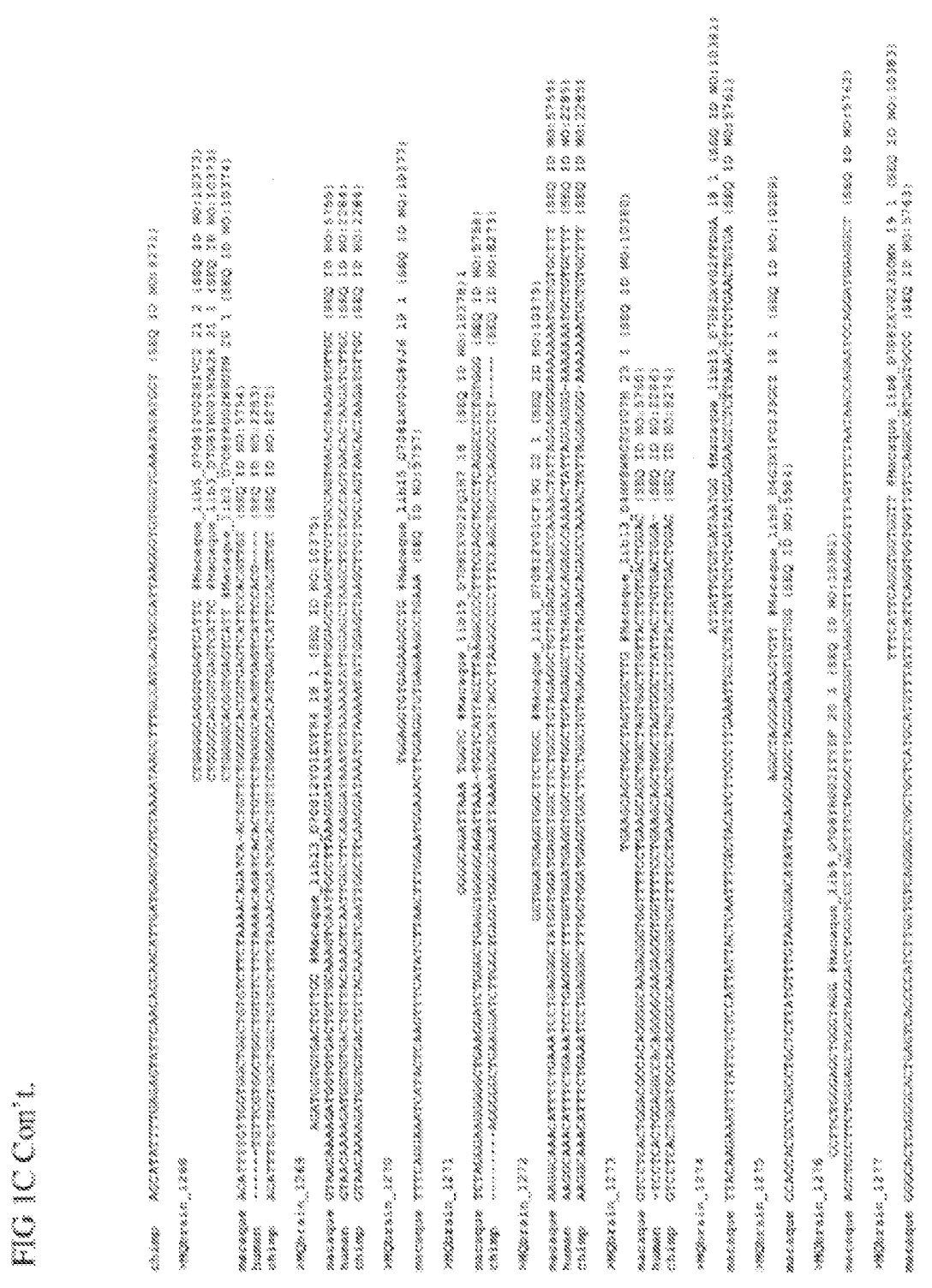
Figure 1C:
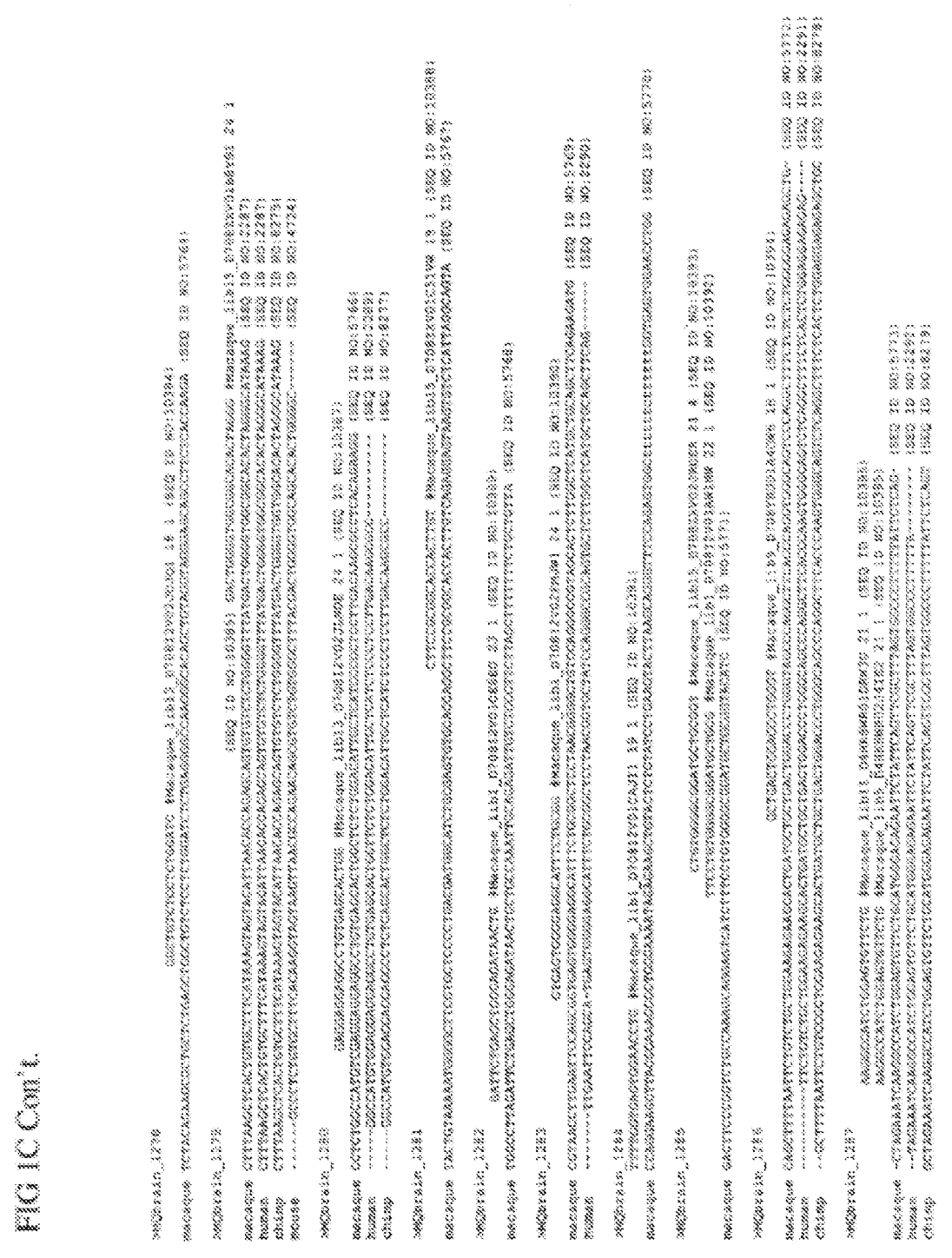
Figure 1C:
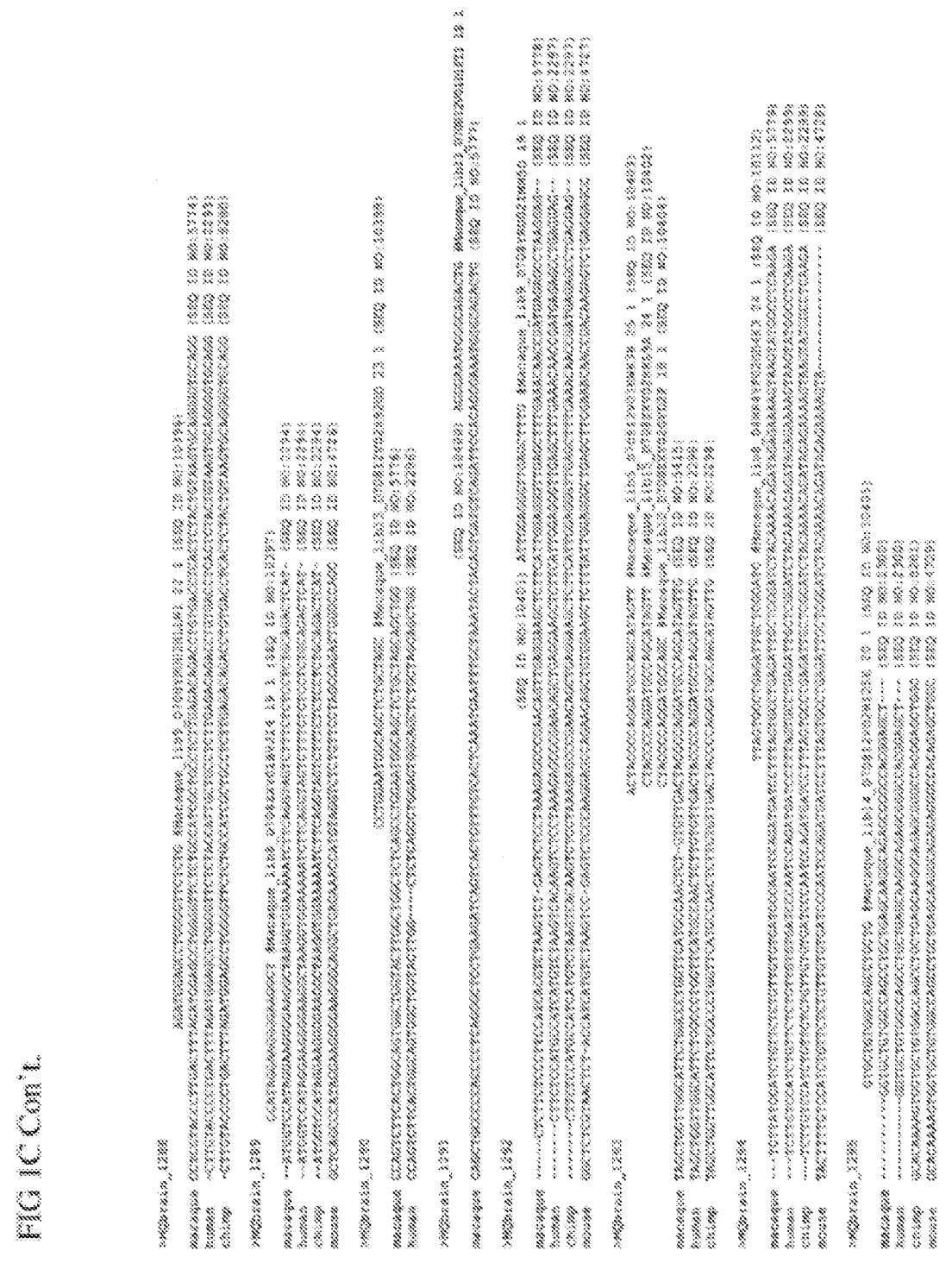
Figure 1C:
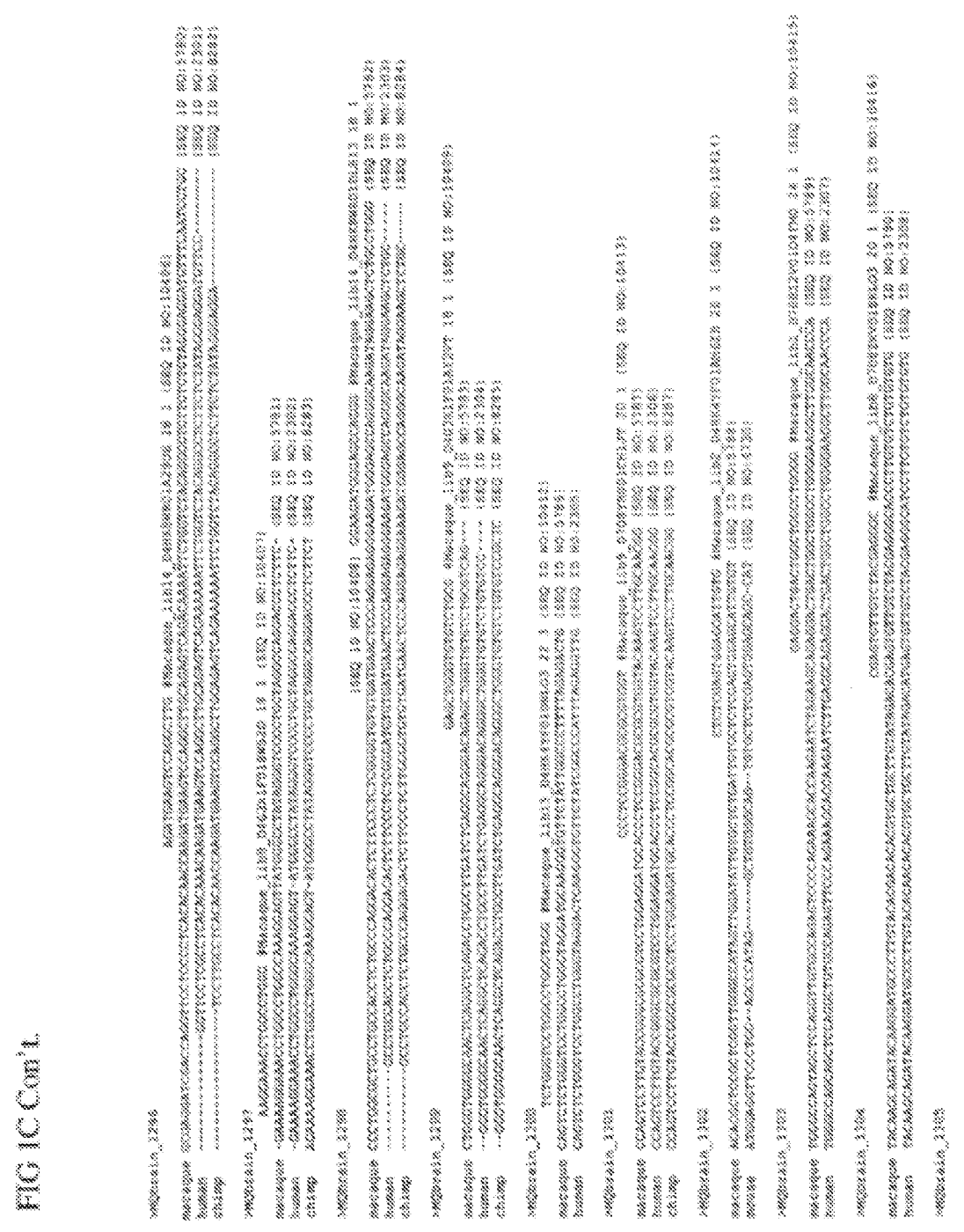
Figure 1C:
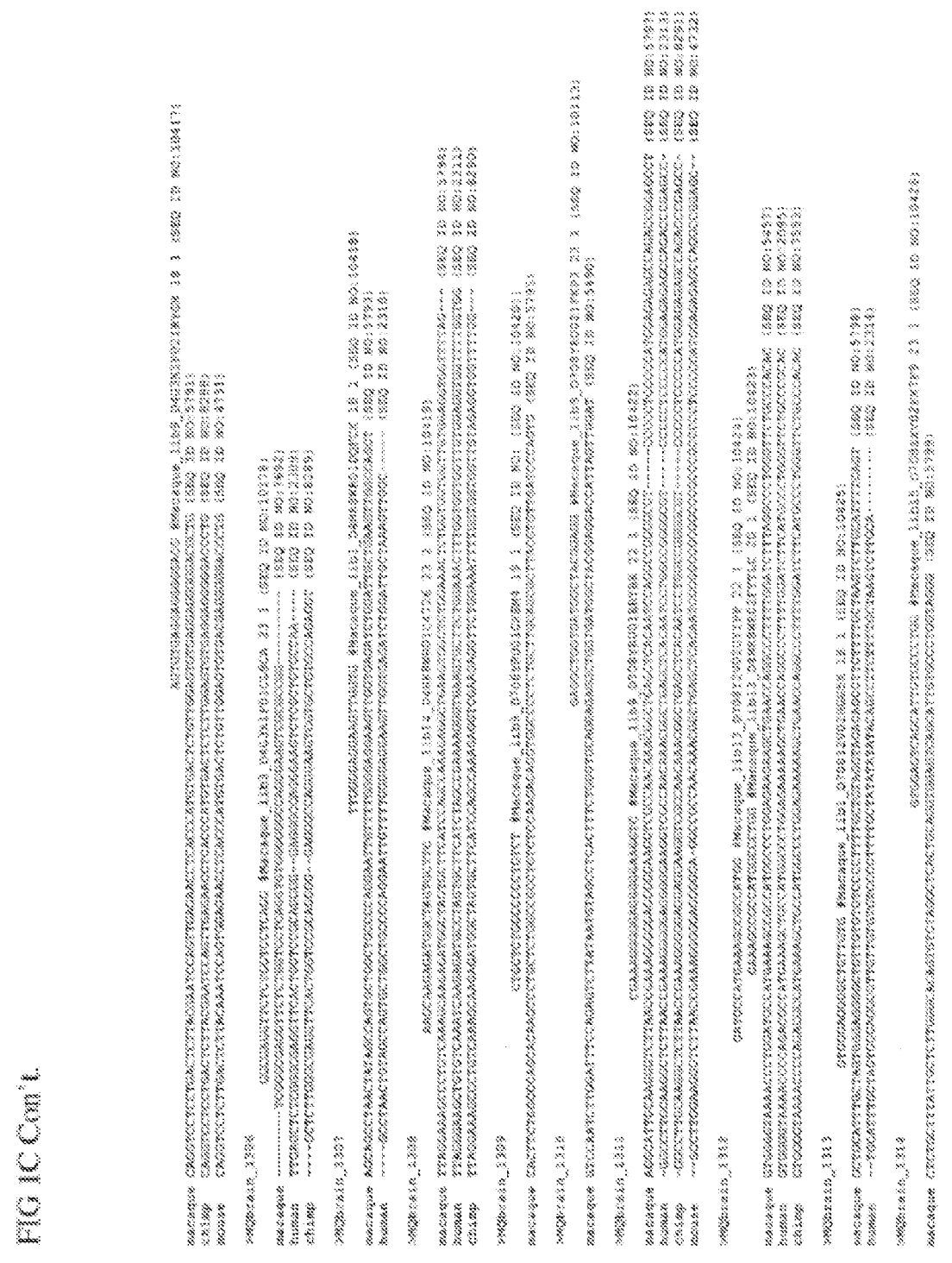
Figure 1C:
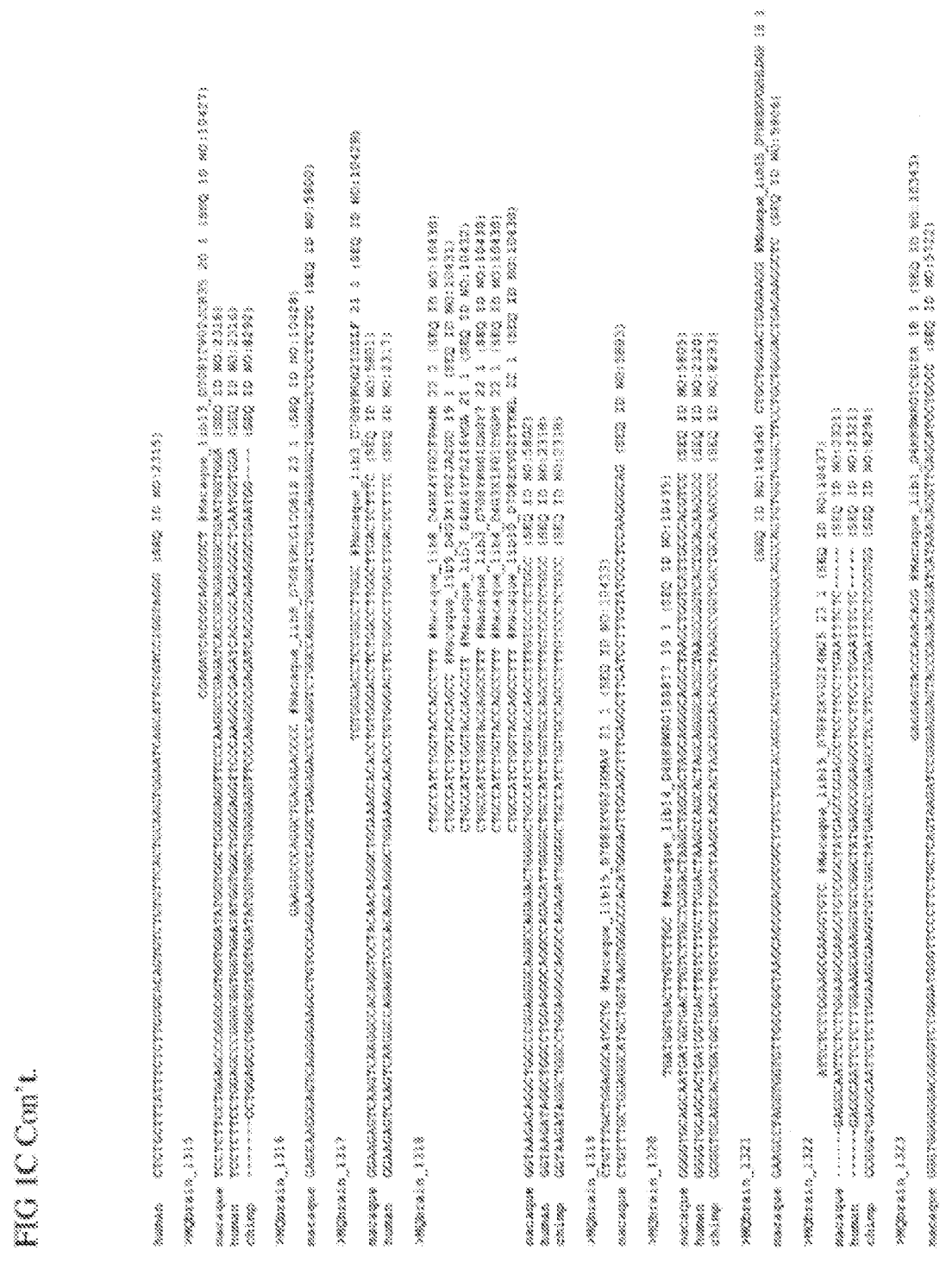
Figure 1C:
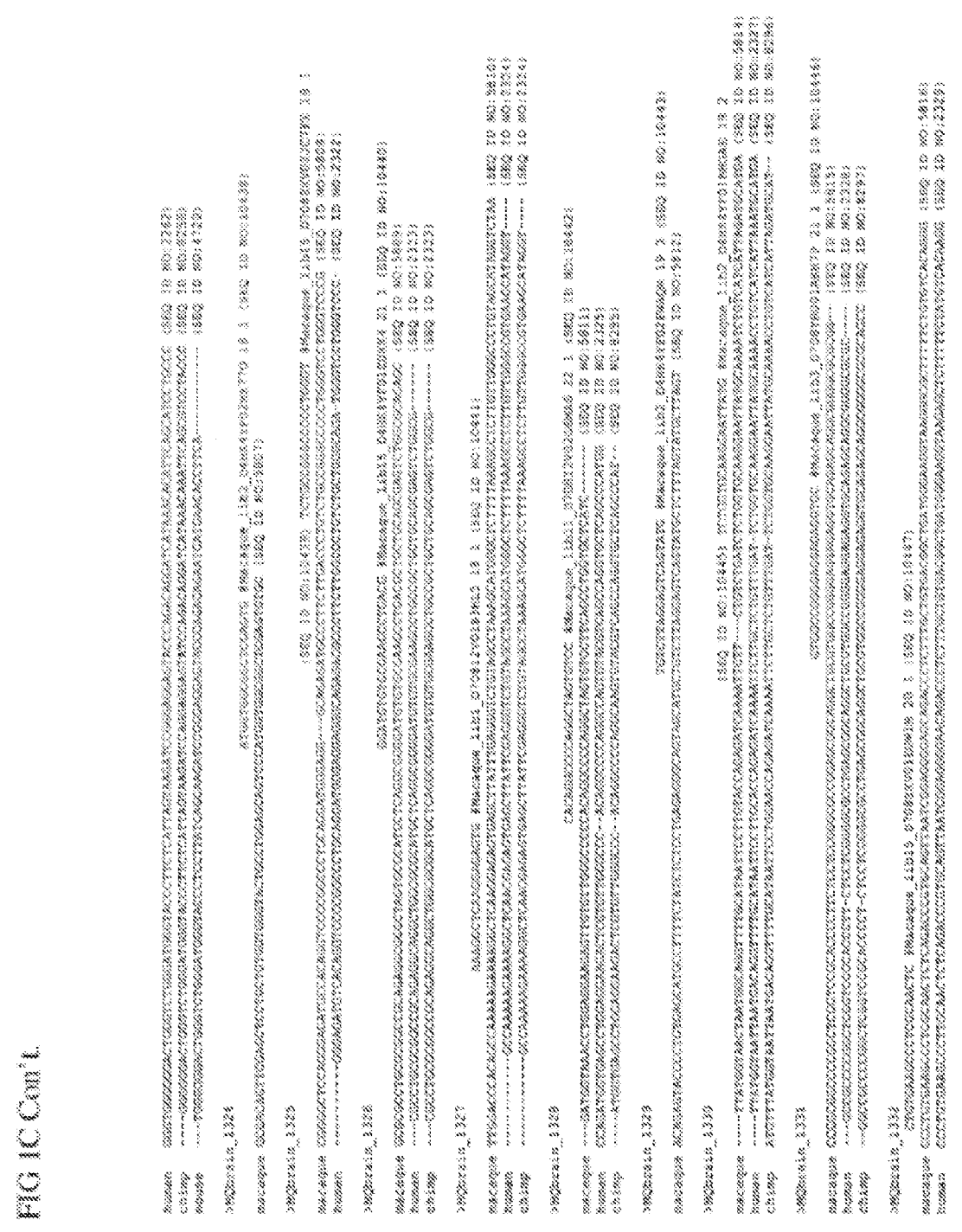
Figure 1C:
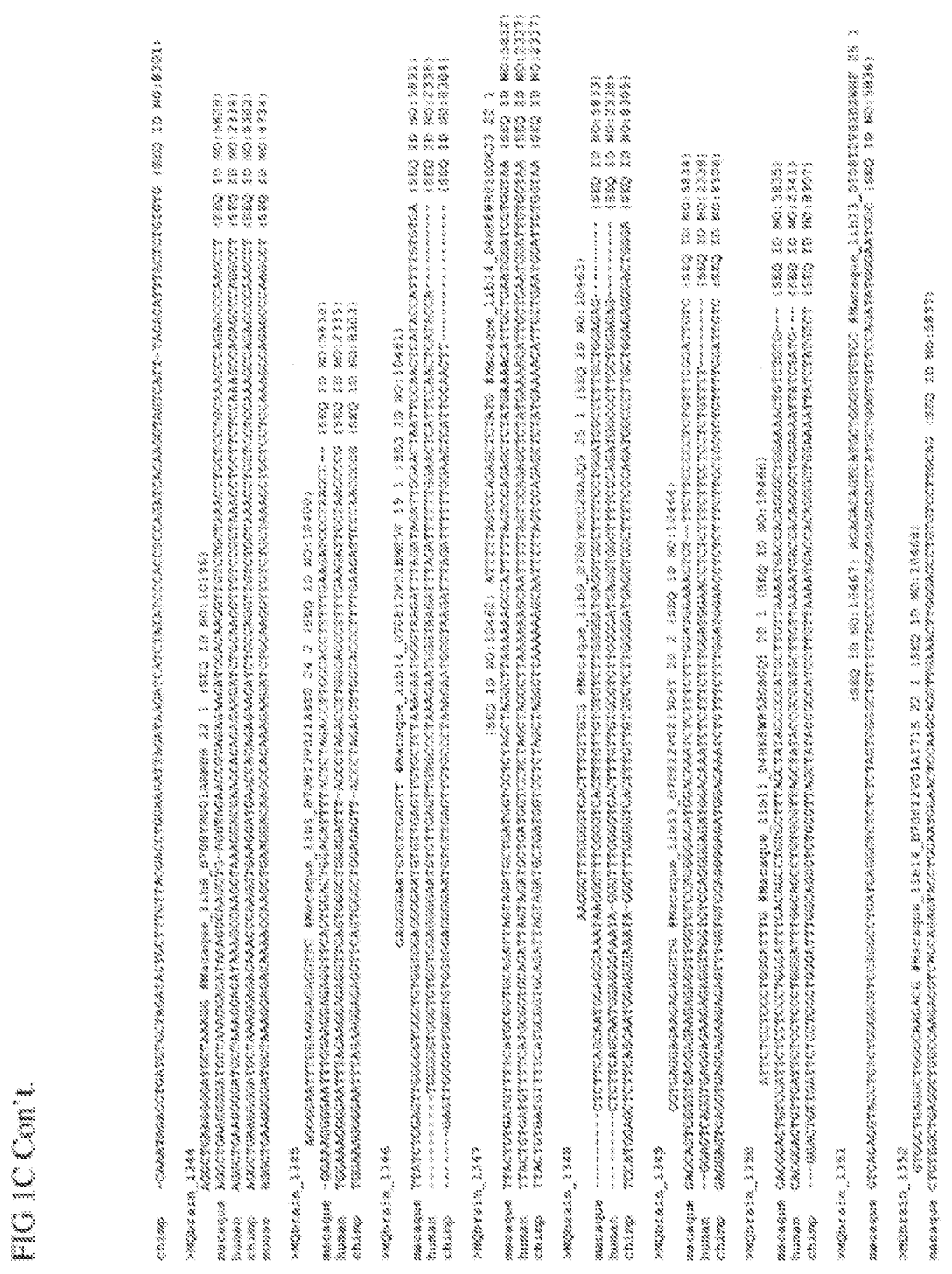
Figure 1C:
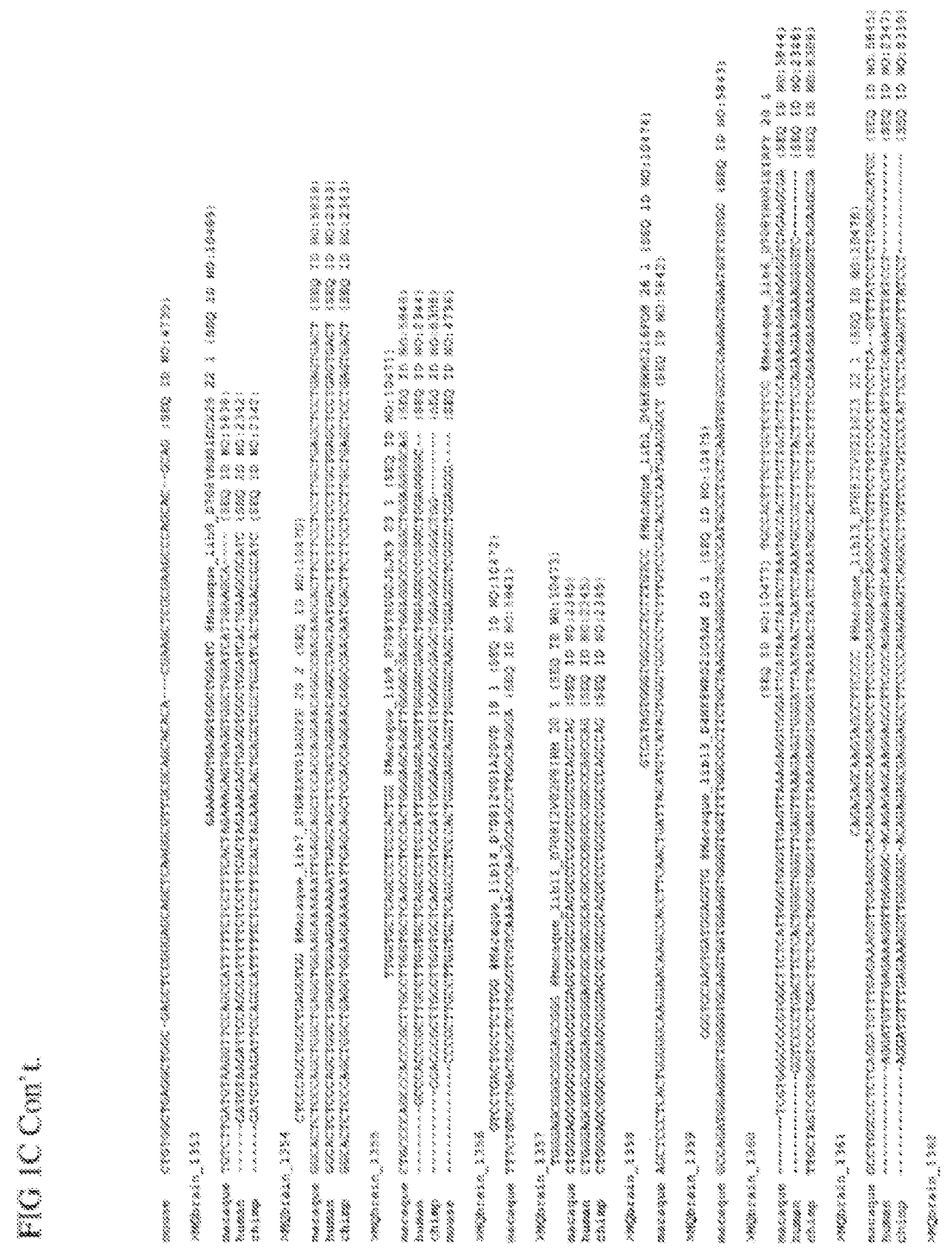
Figure 1C:
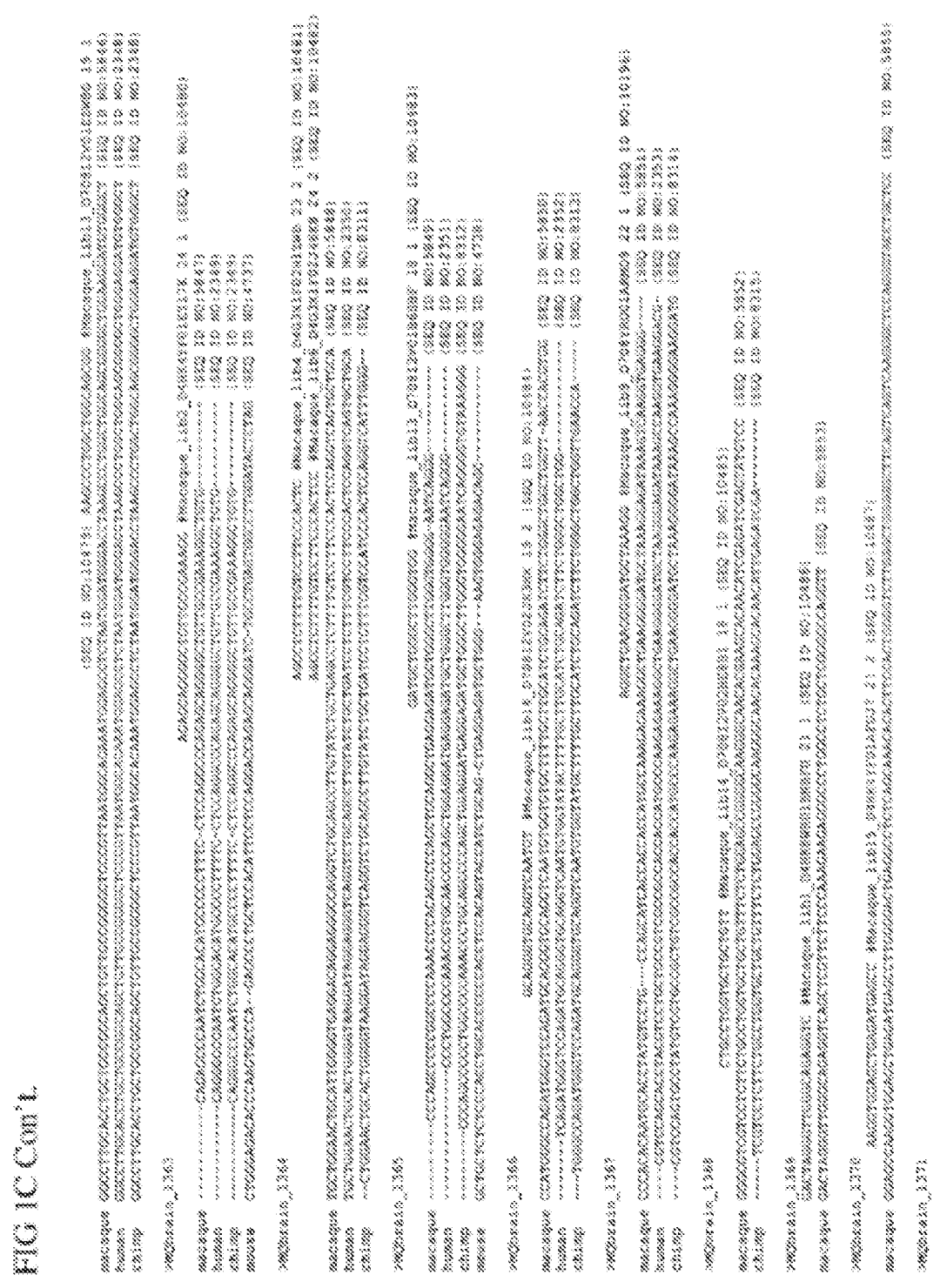
Figure 1C:
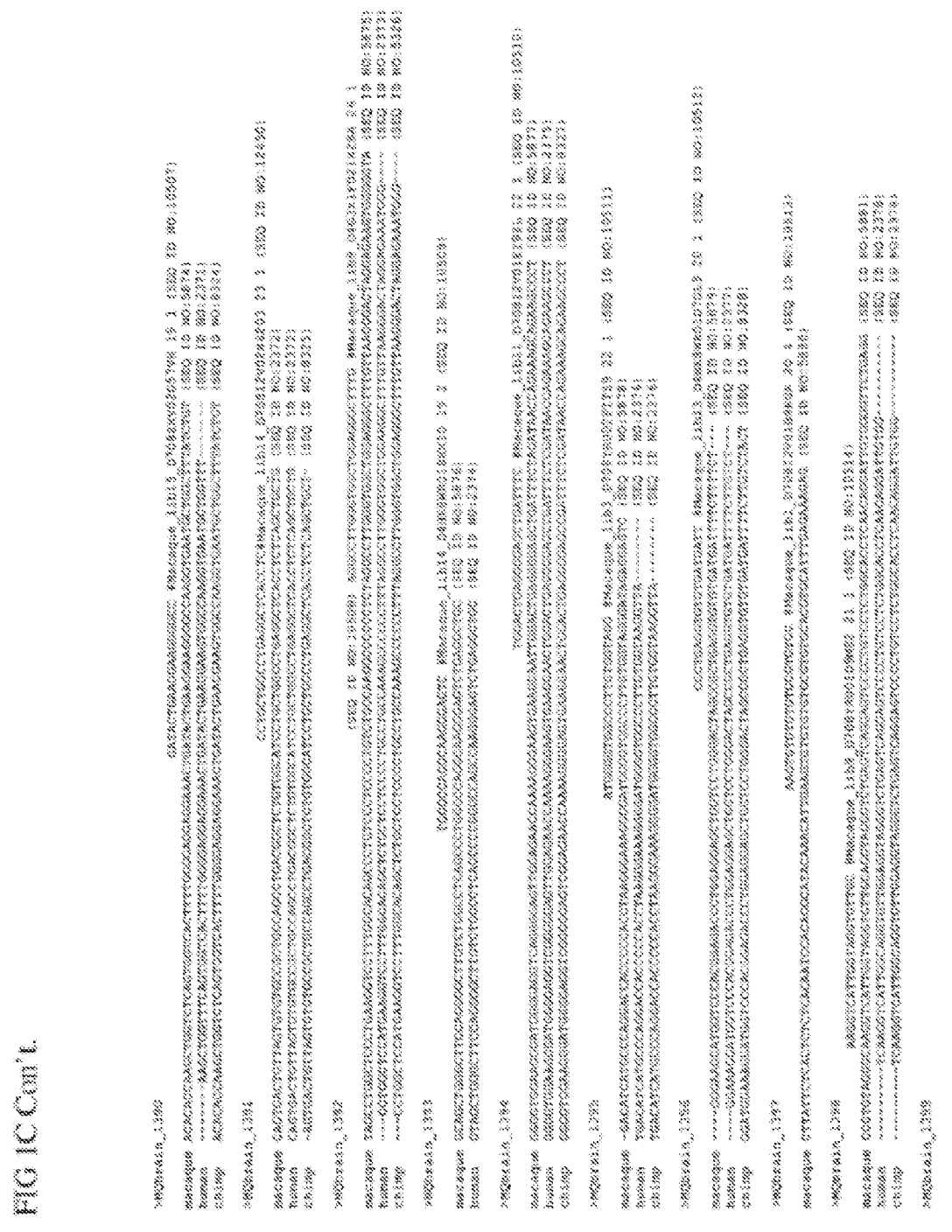
Figure 1C:
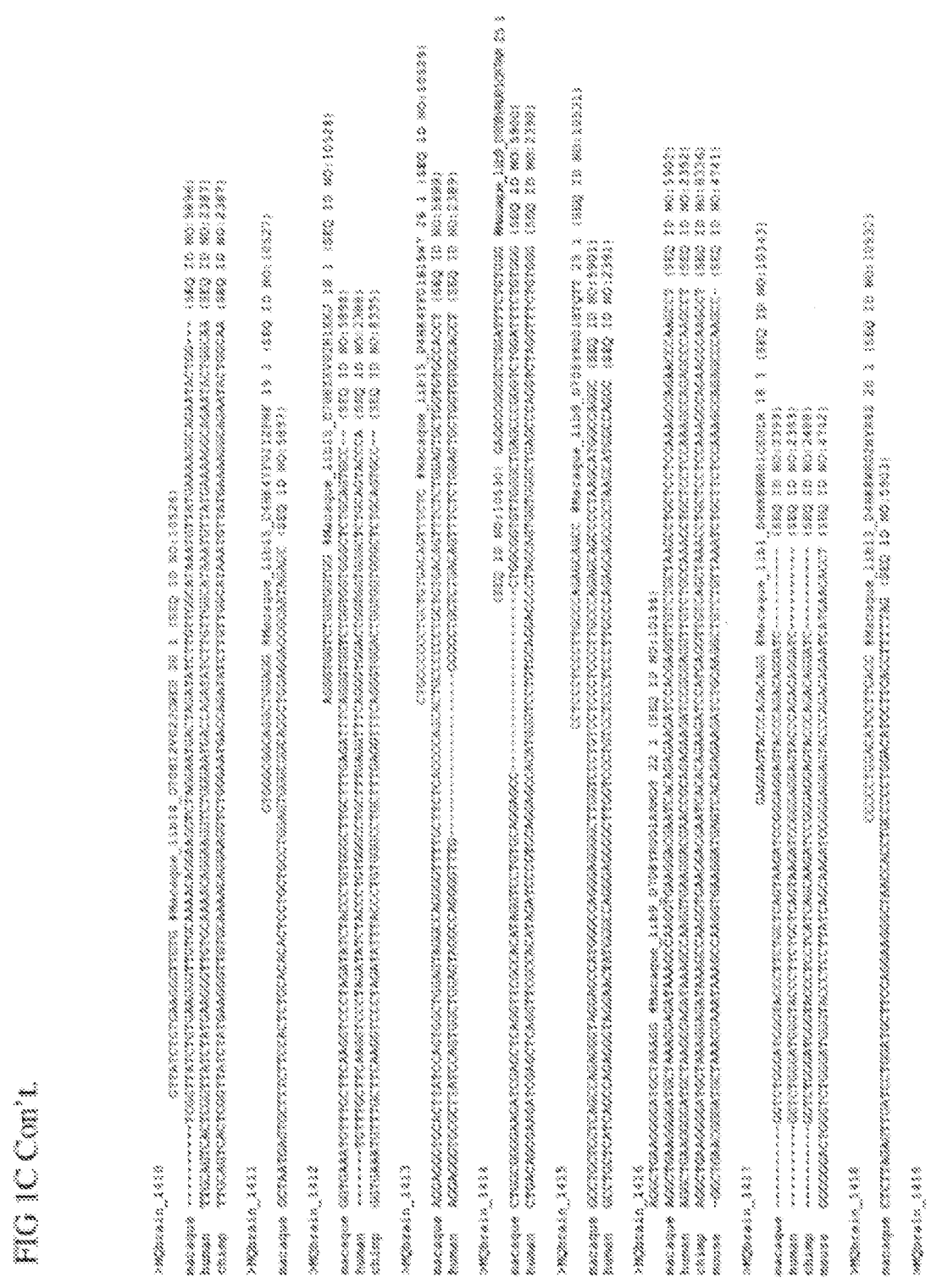
Figure 1C:
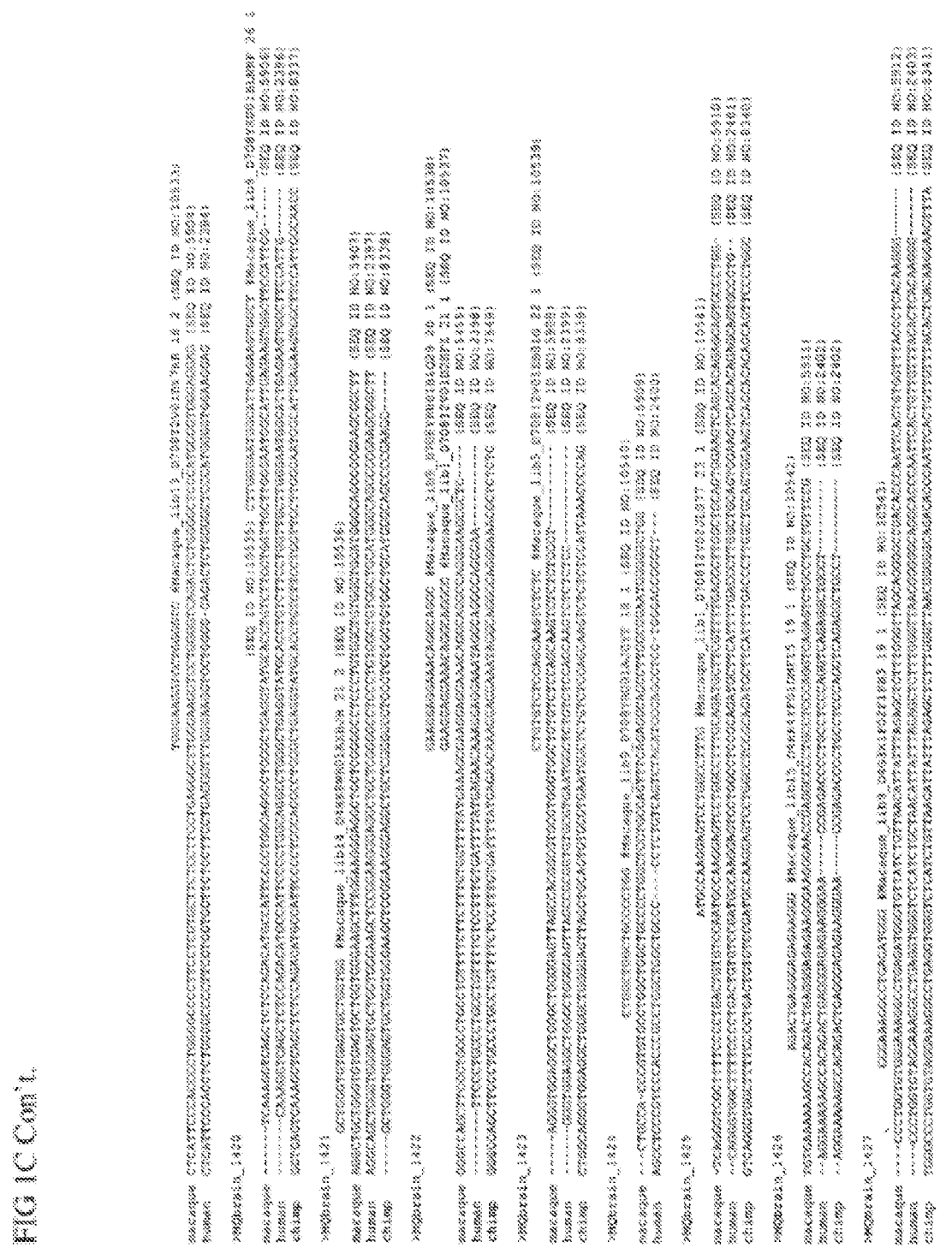
Figure 1C:
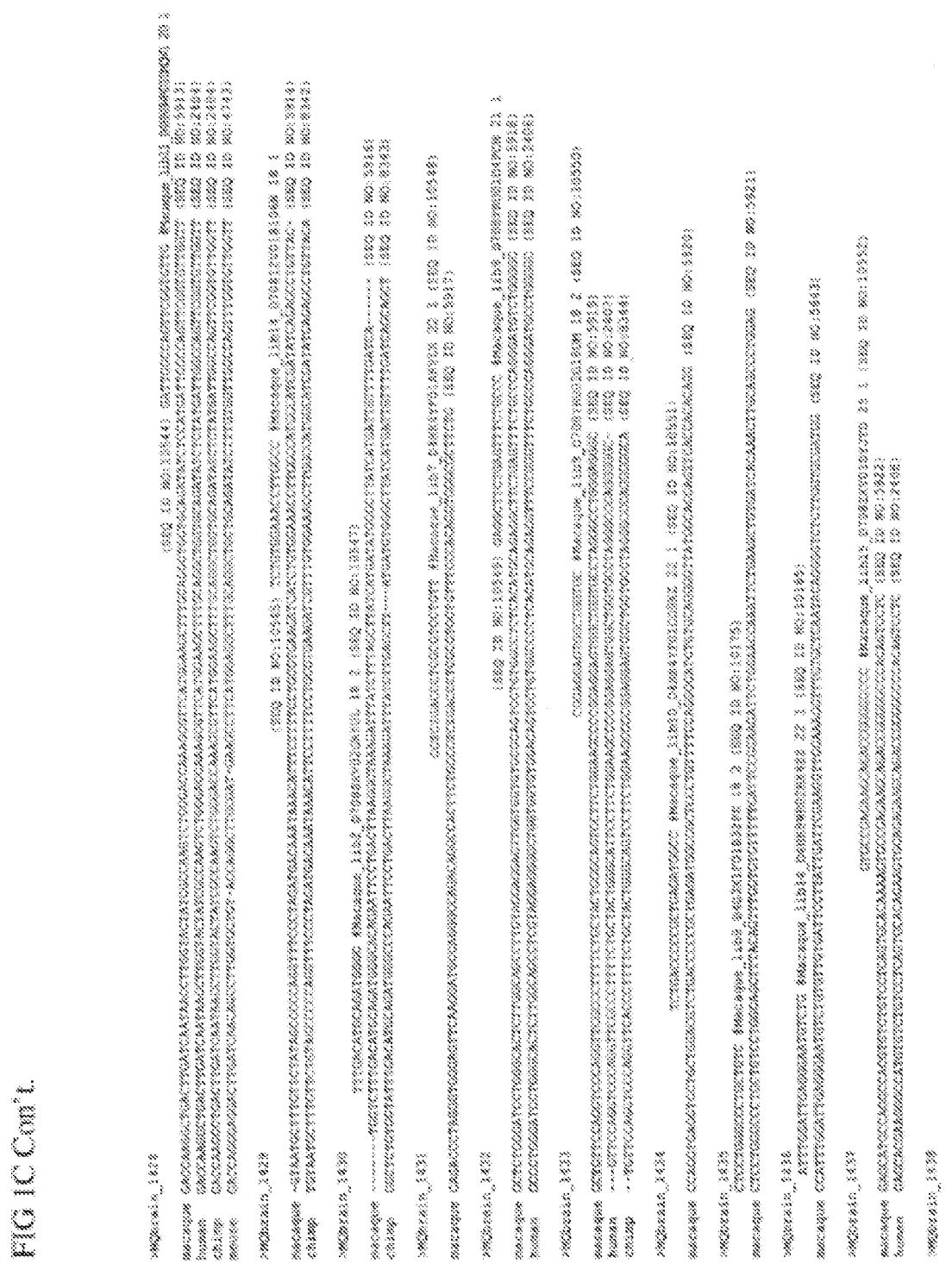
Figure 1C:
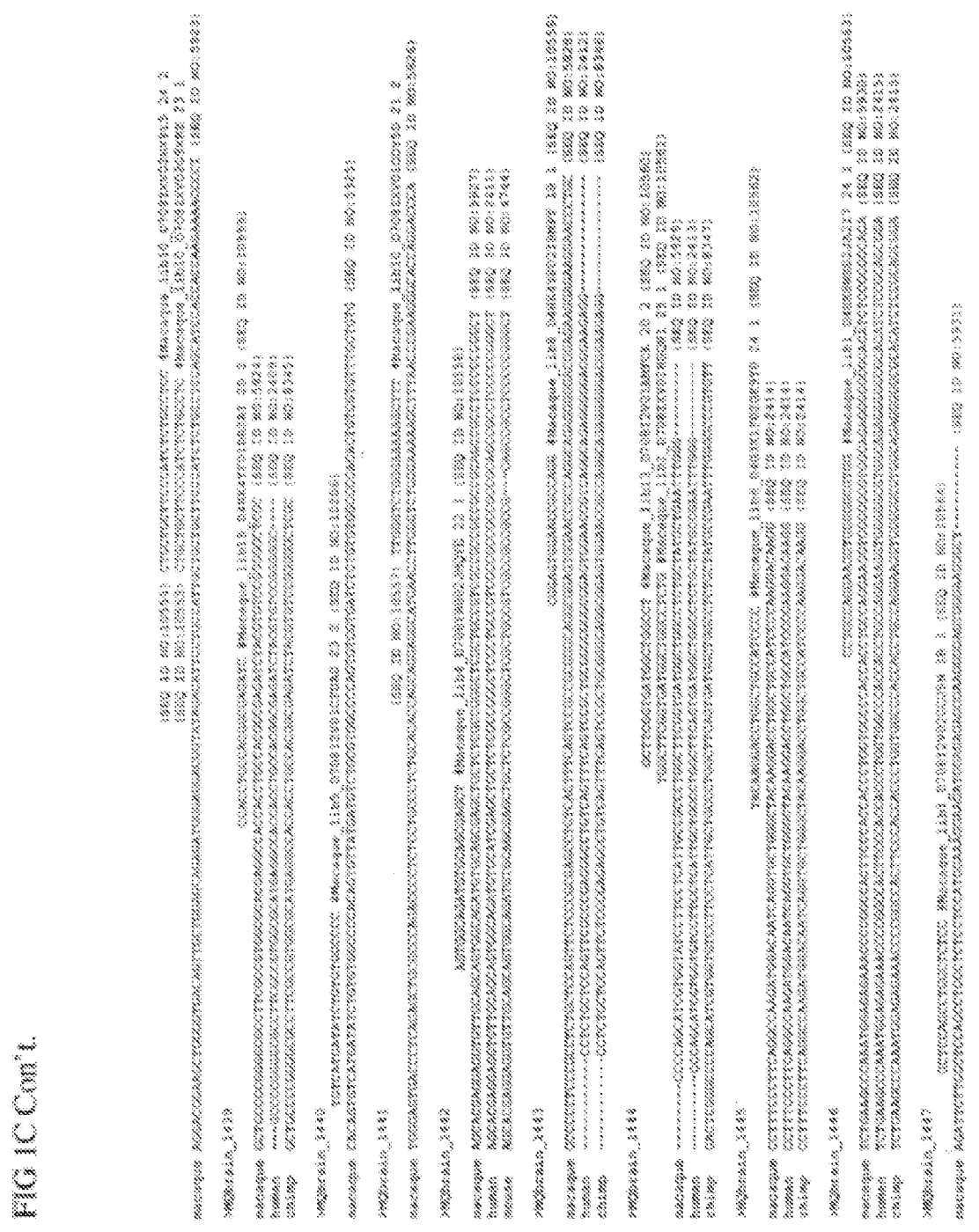
Figure 1C:
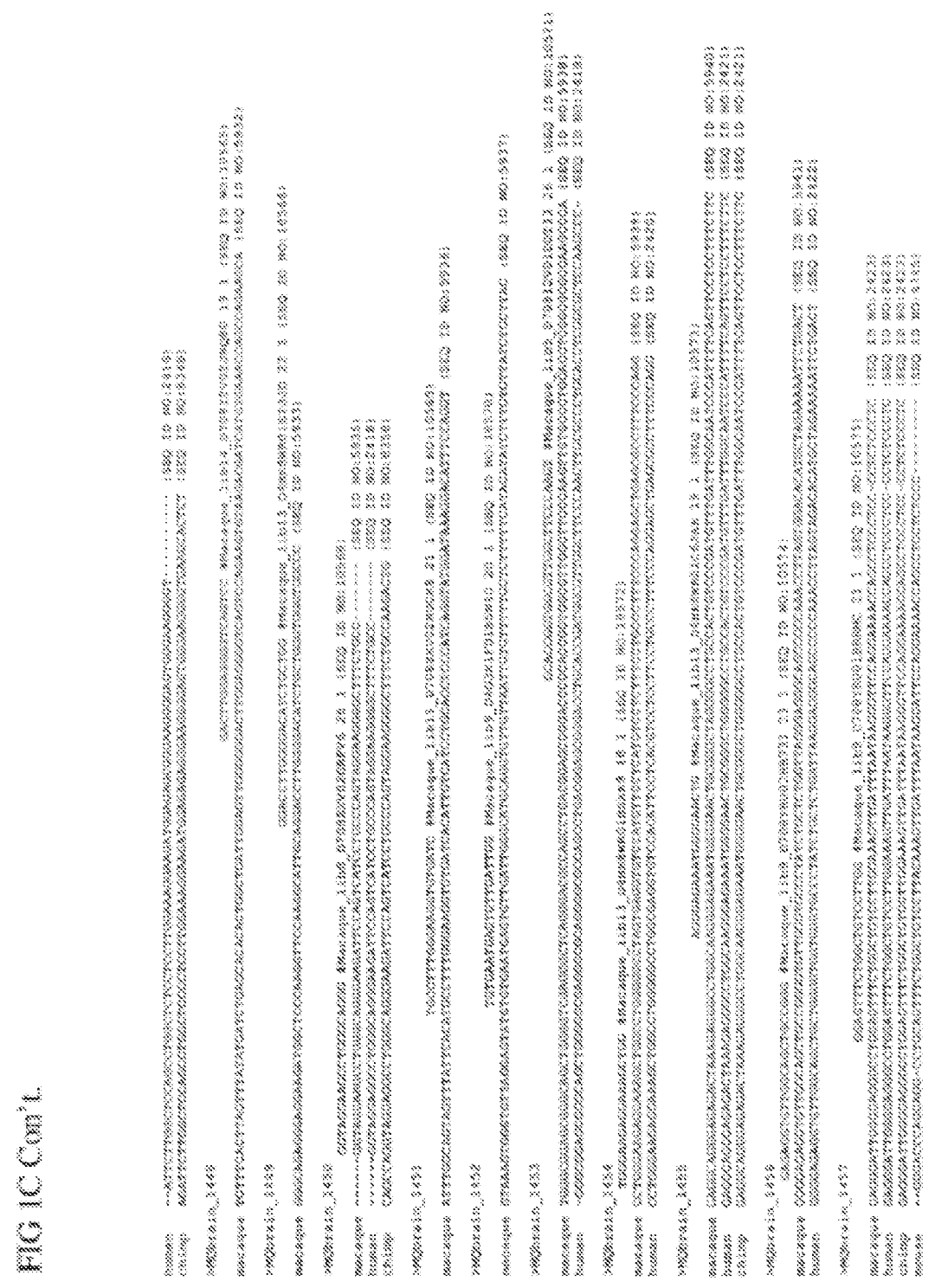
Figure 1C:
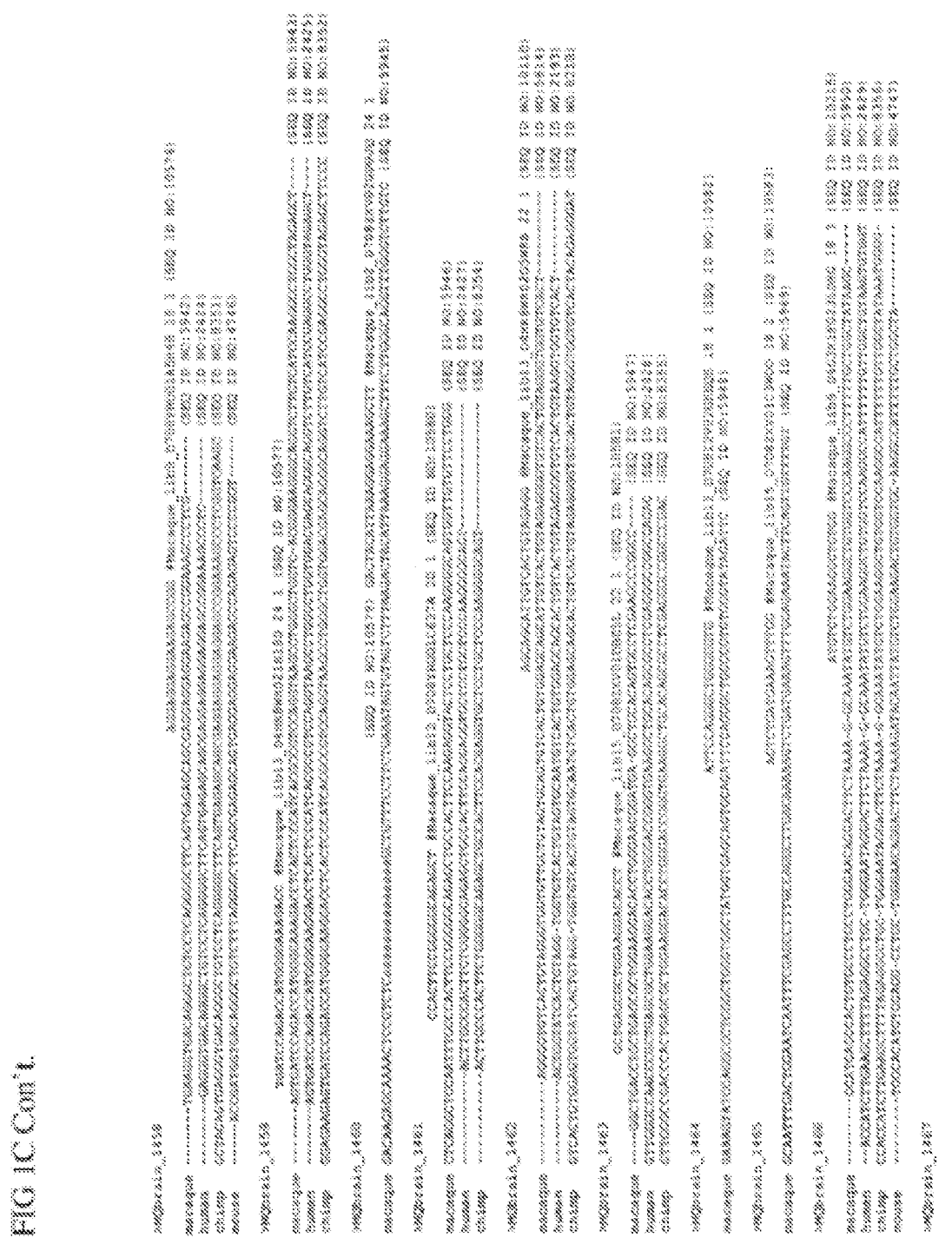
Figure 1C:
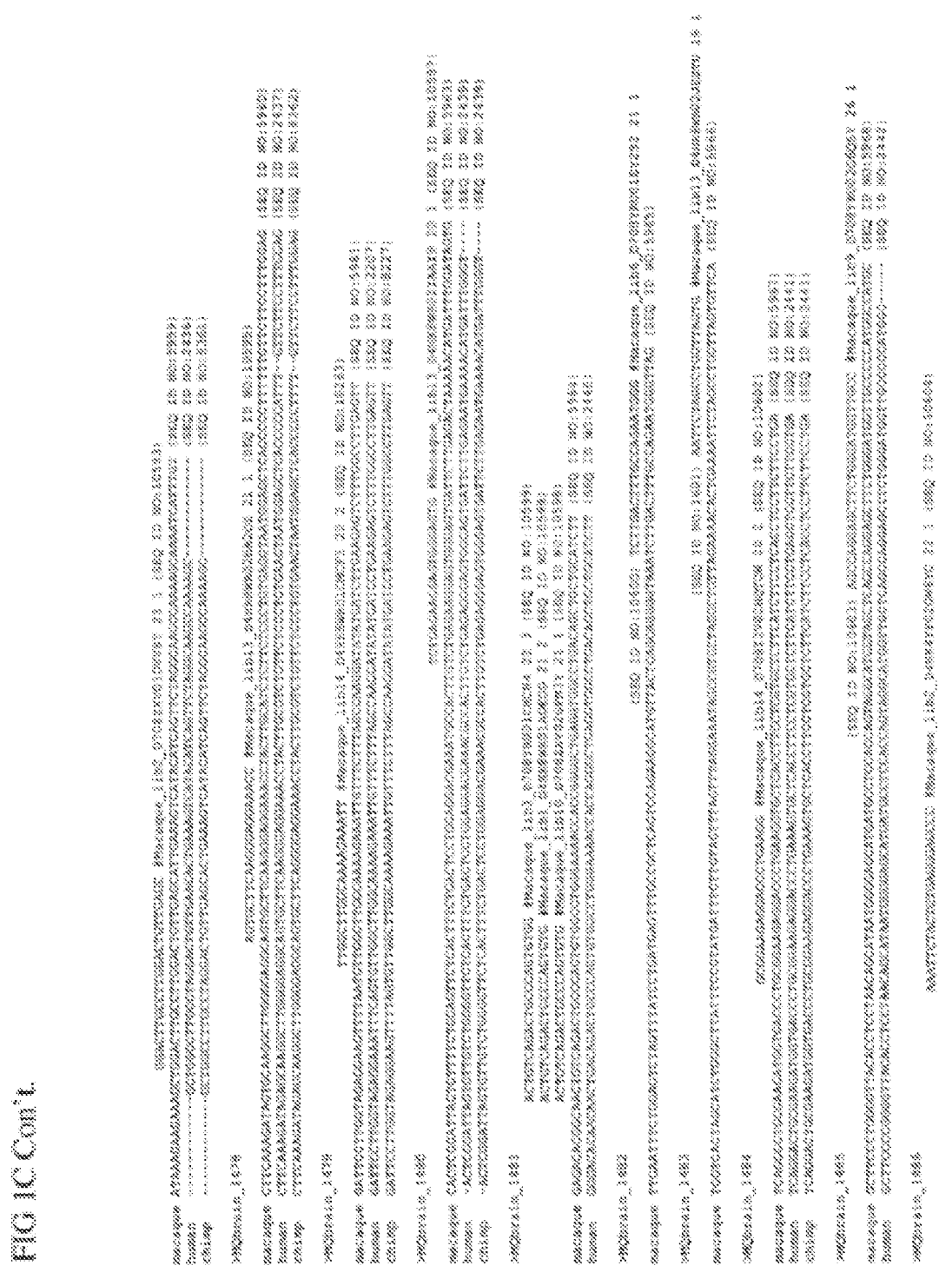
Figure 1C:
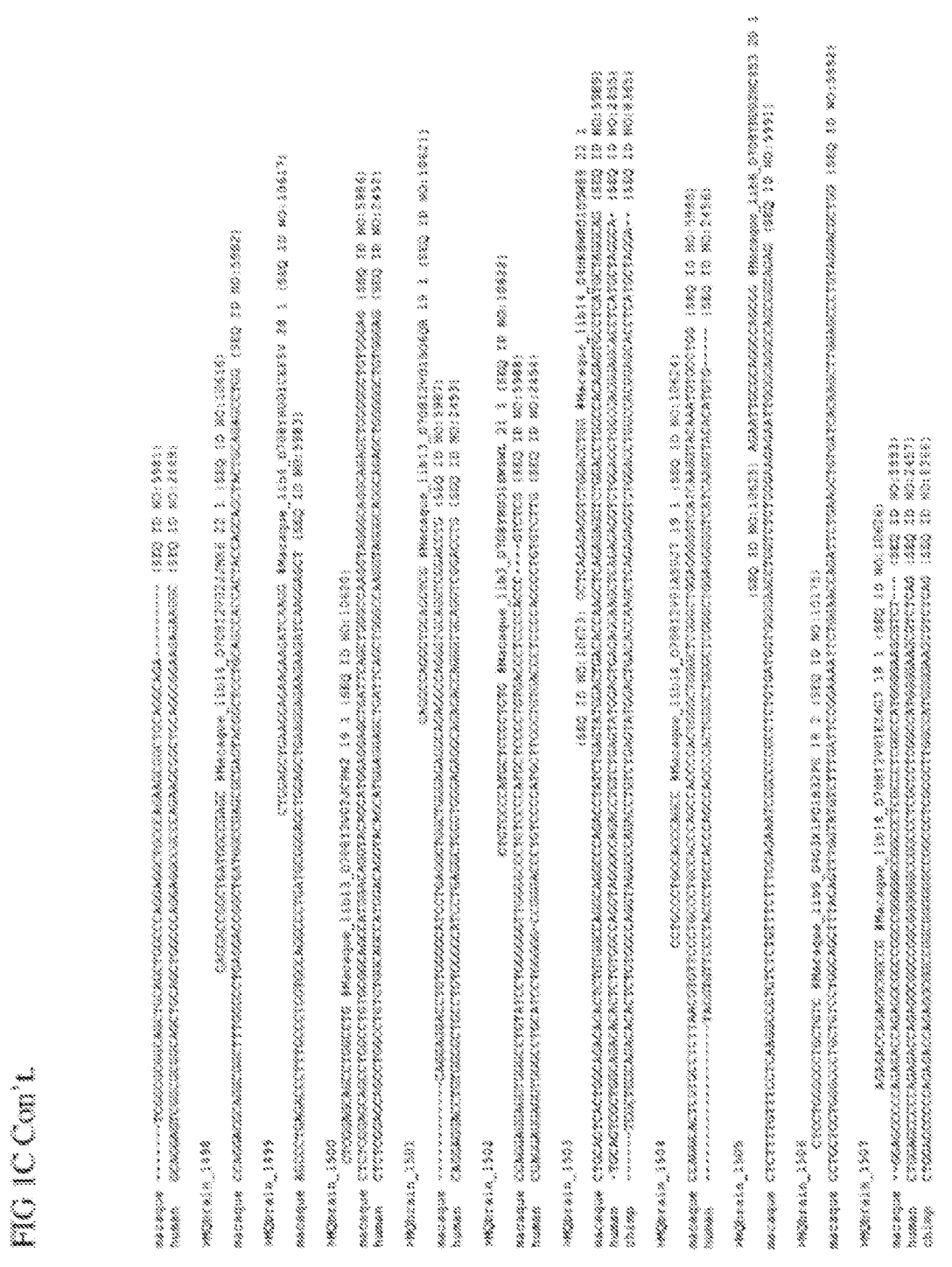
Figure 1C:
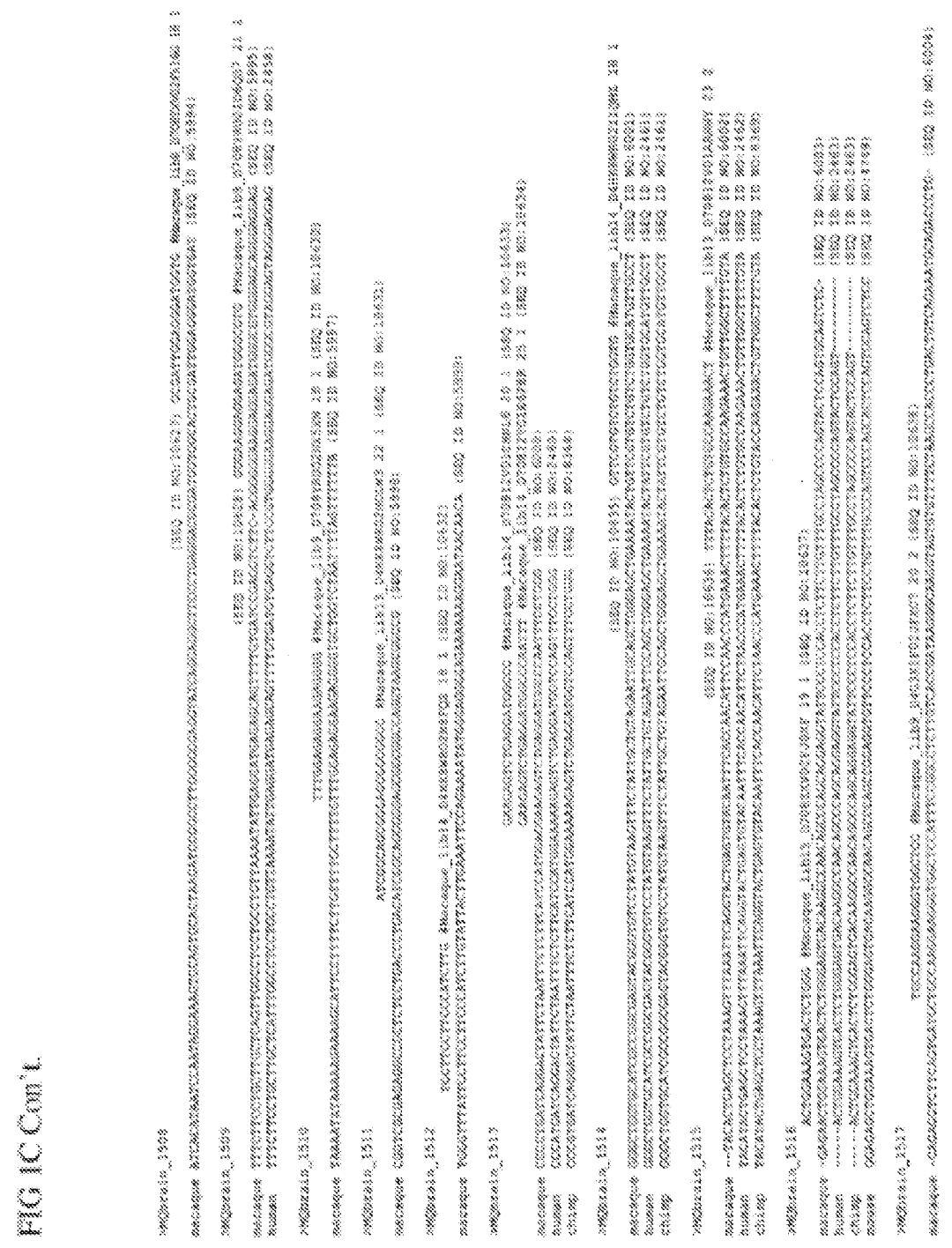
Figure 1C:
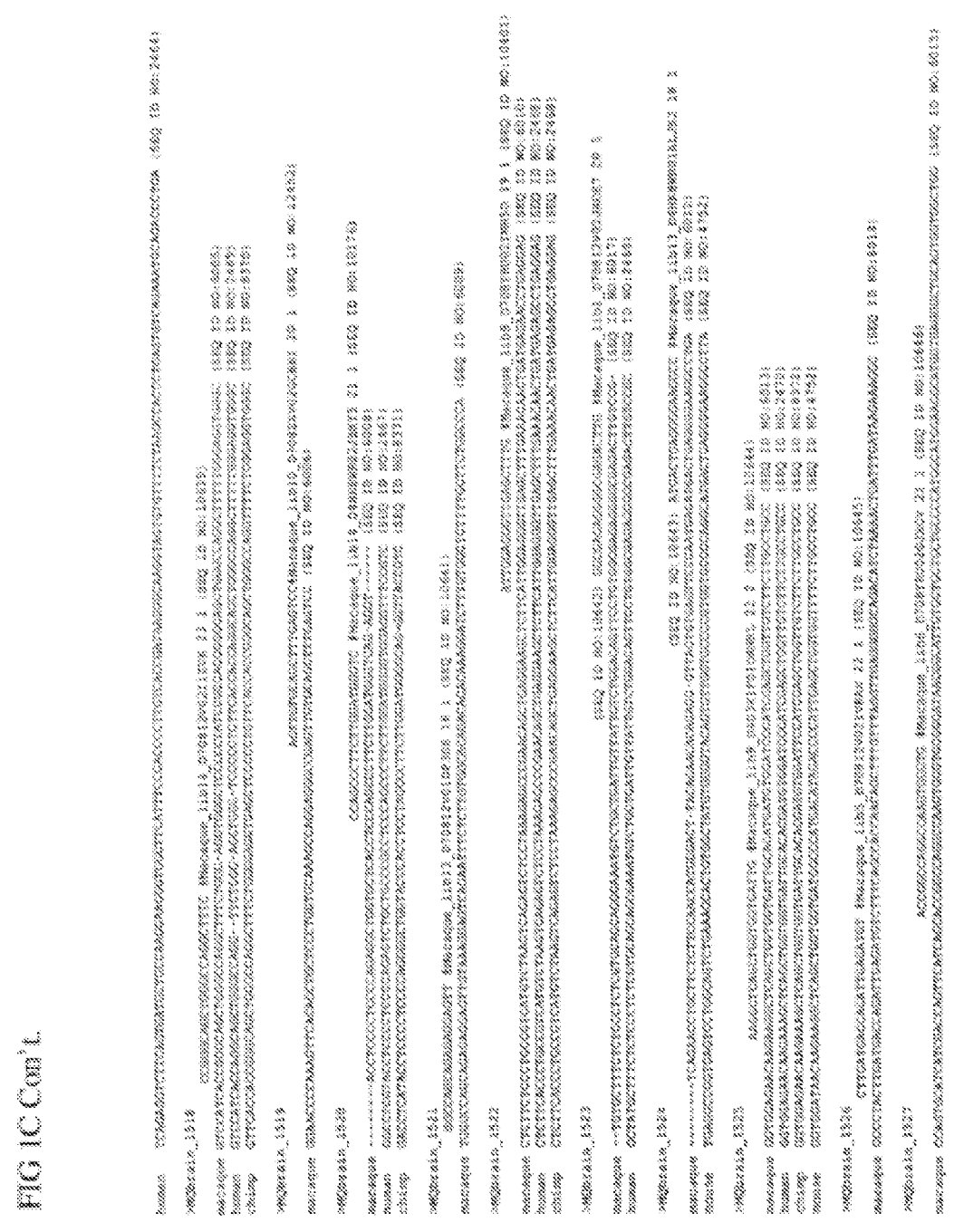
Figure 1C:
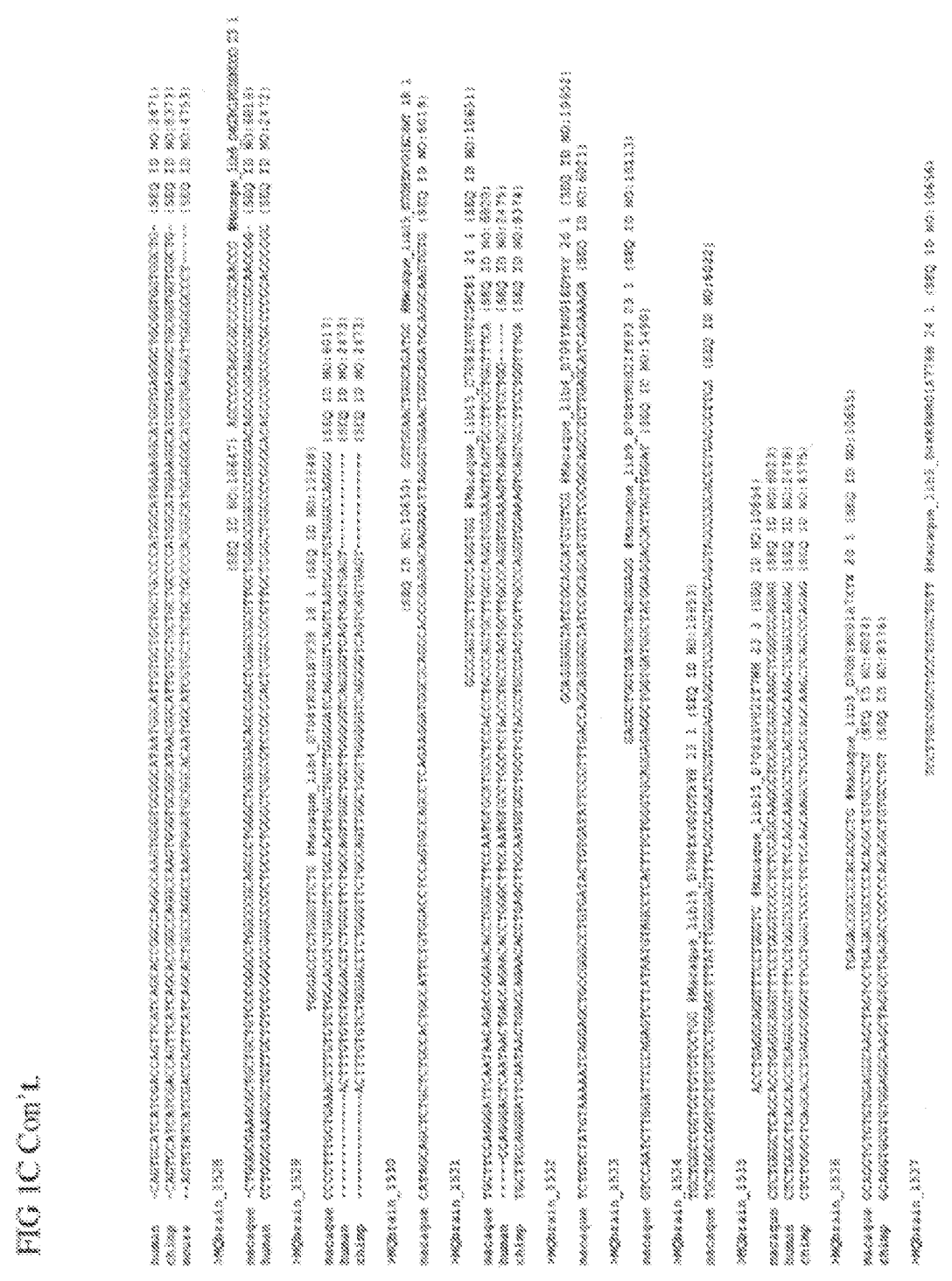
Figure 1C:
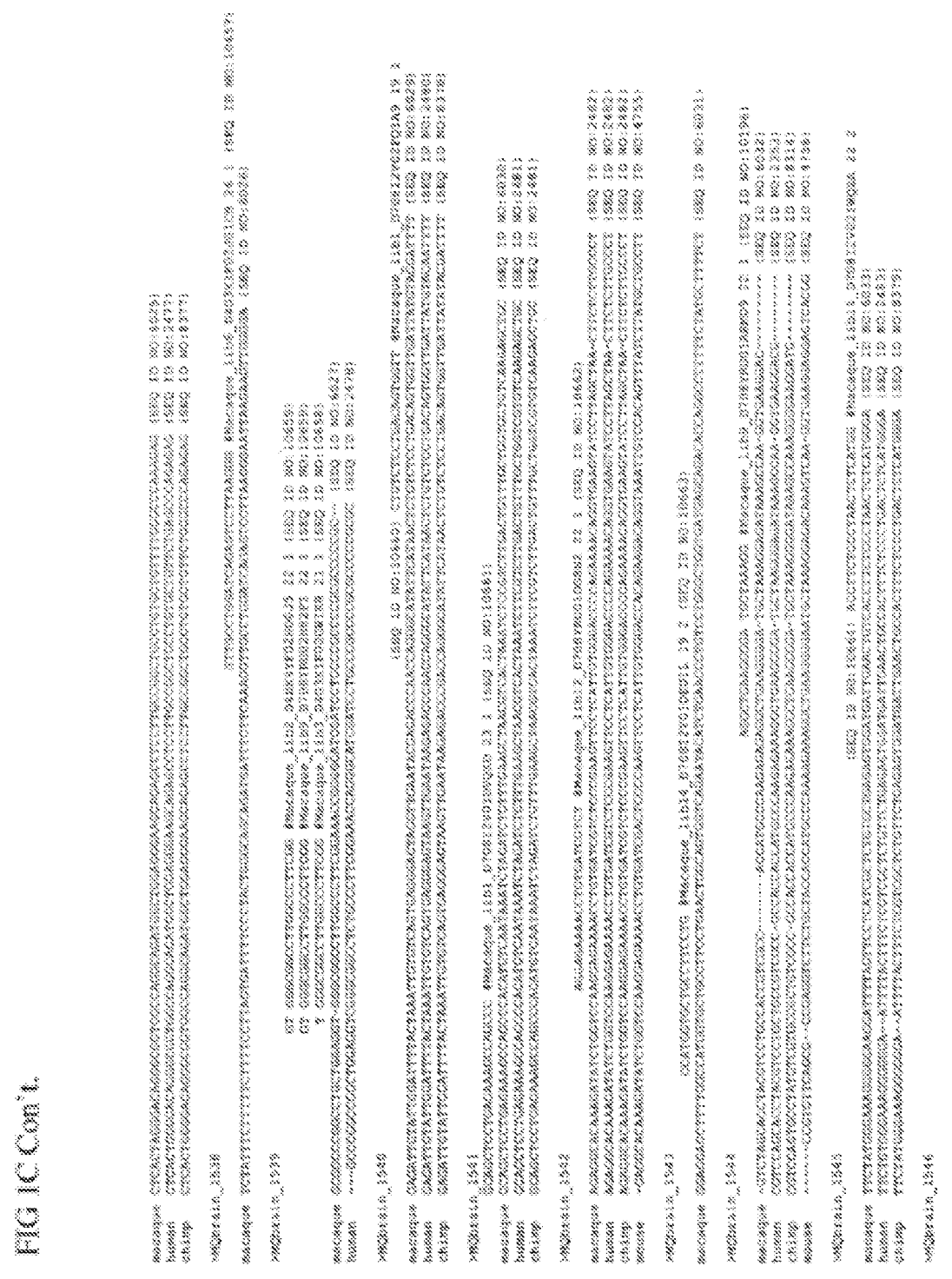
Figure 1C:
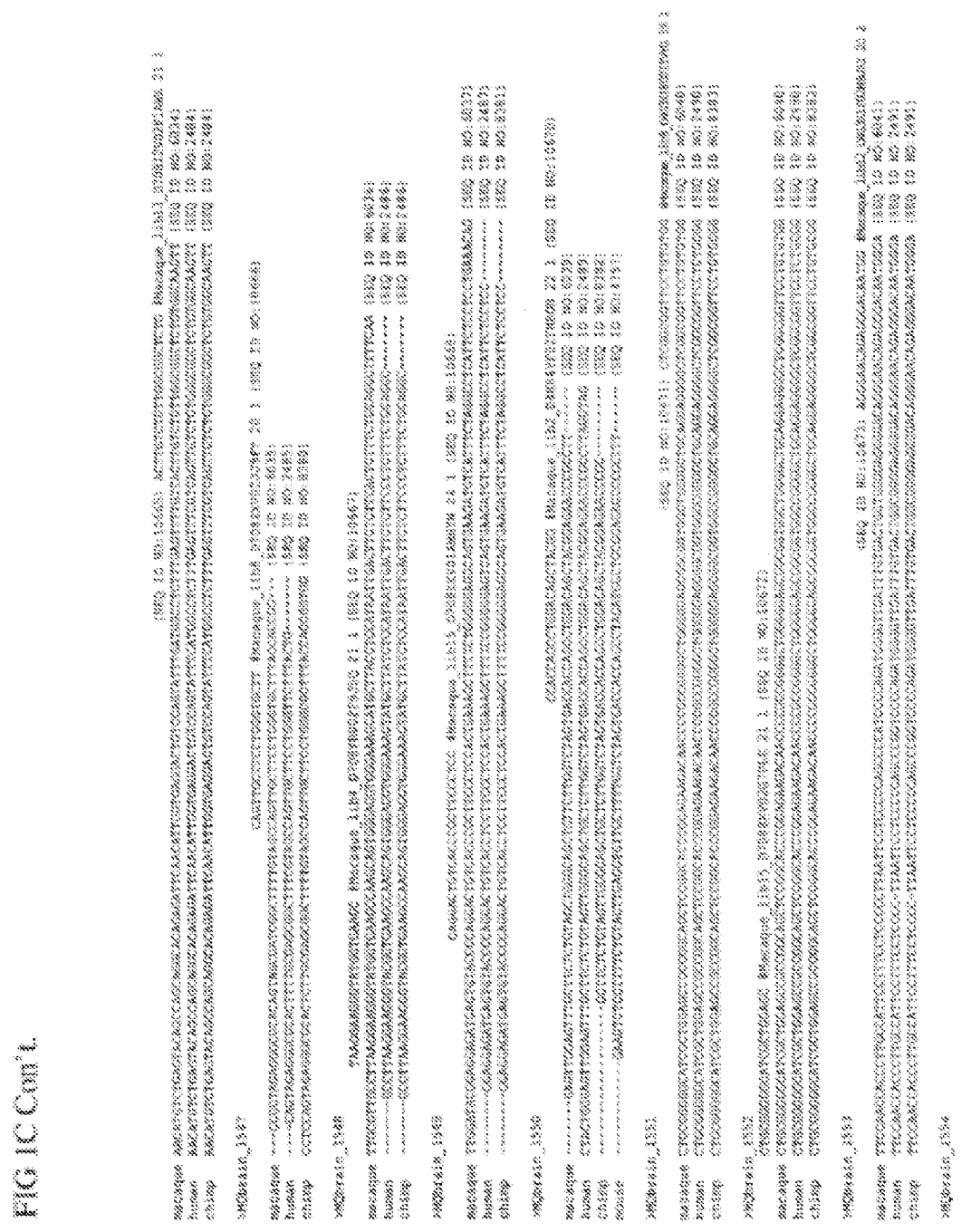
Figure 1C:
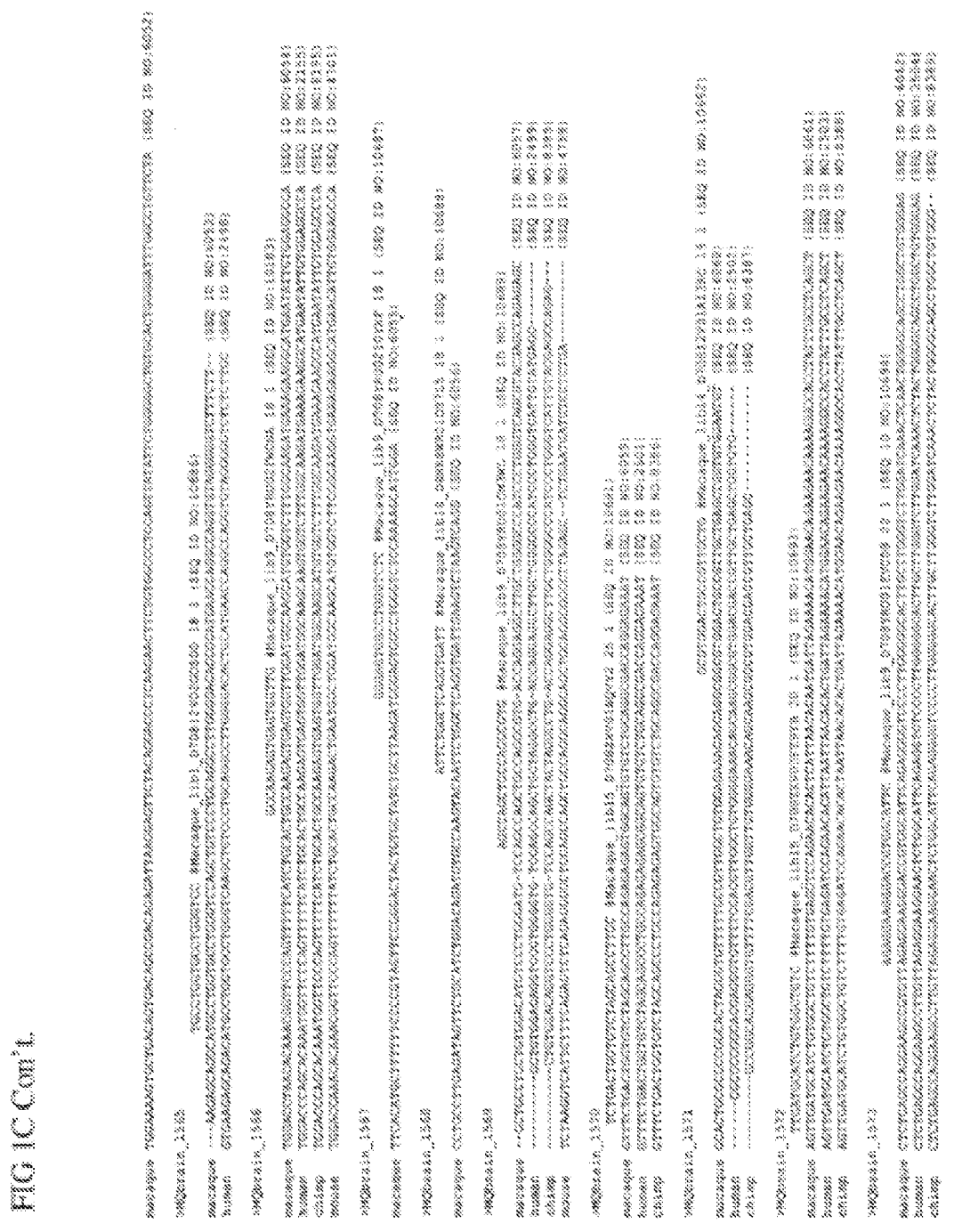
Figure 1C:
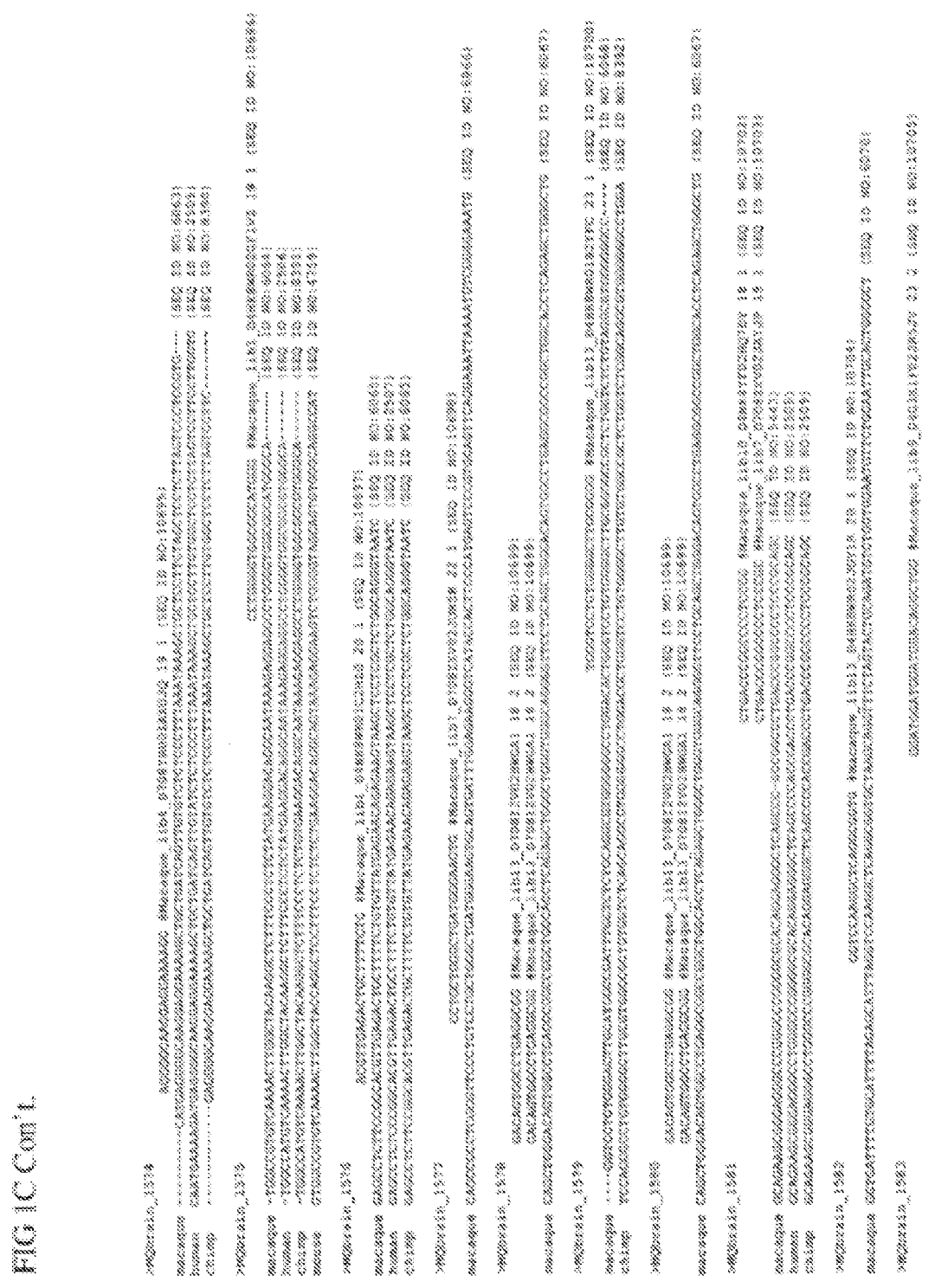
Figure 1C:
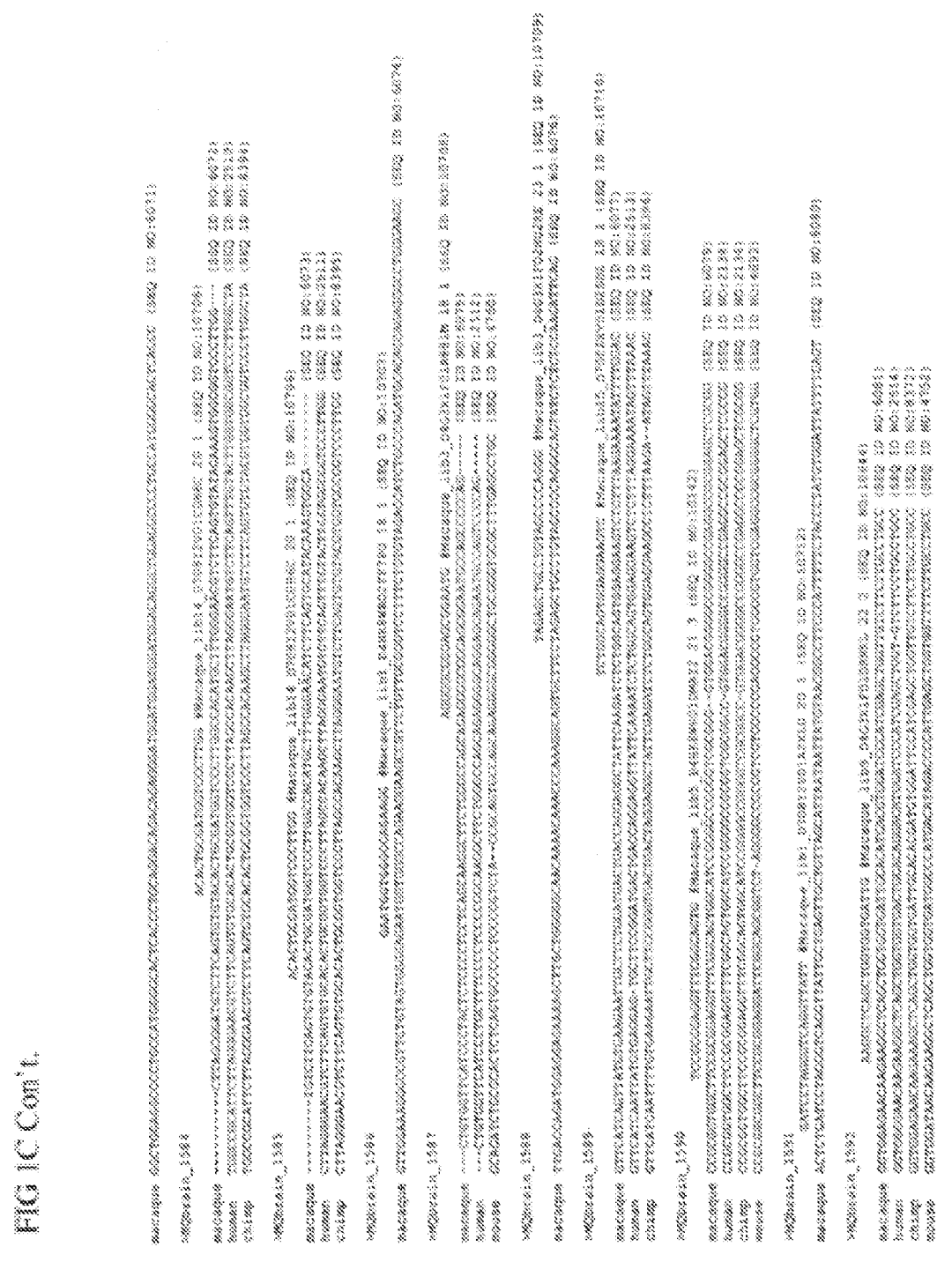
Figure 1C:
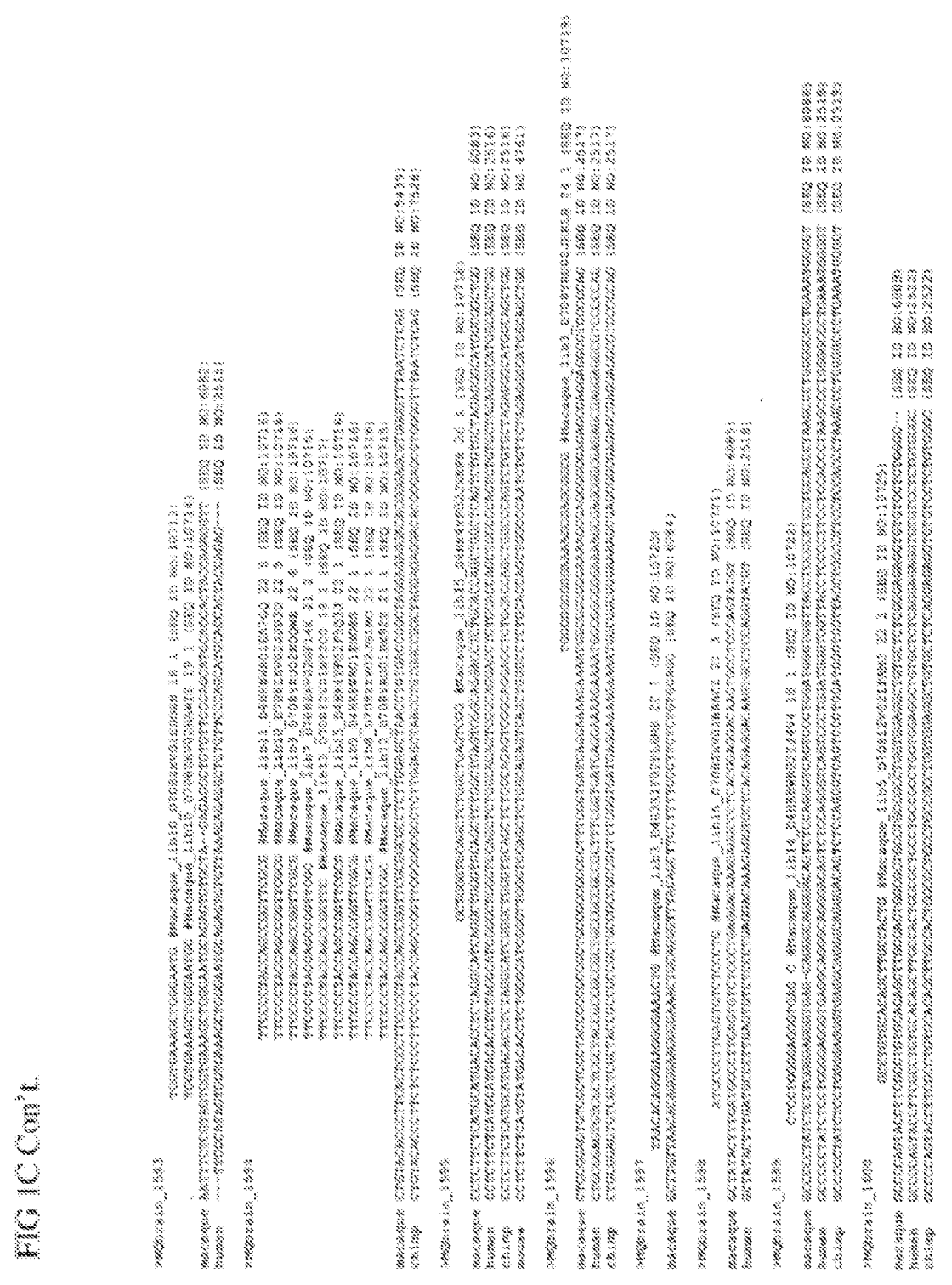
Figure 1C:
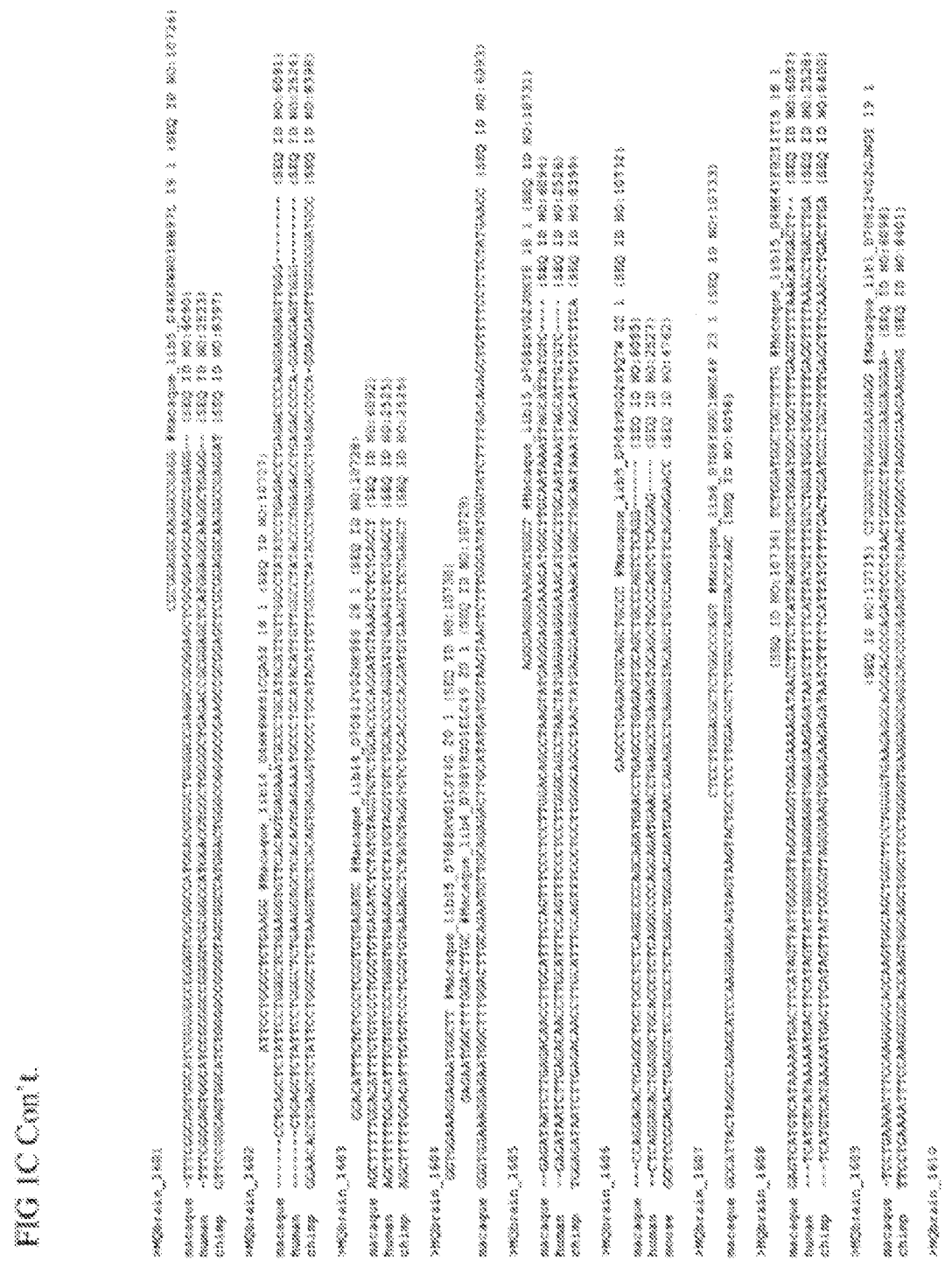
Figure 1C:
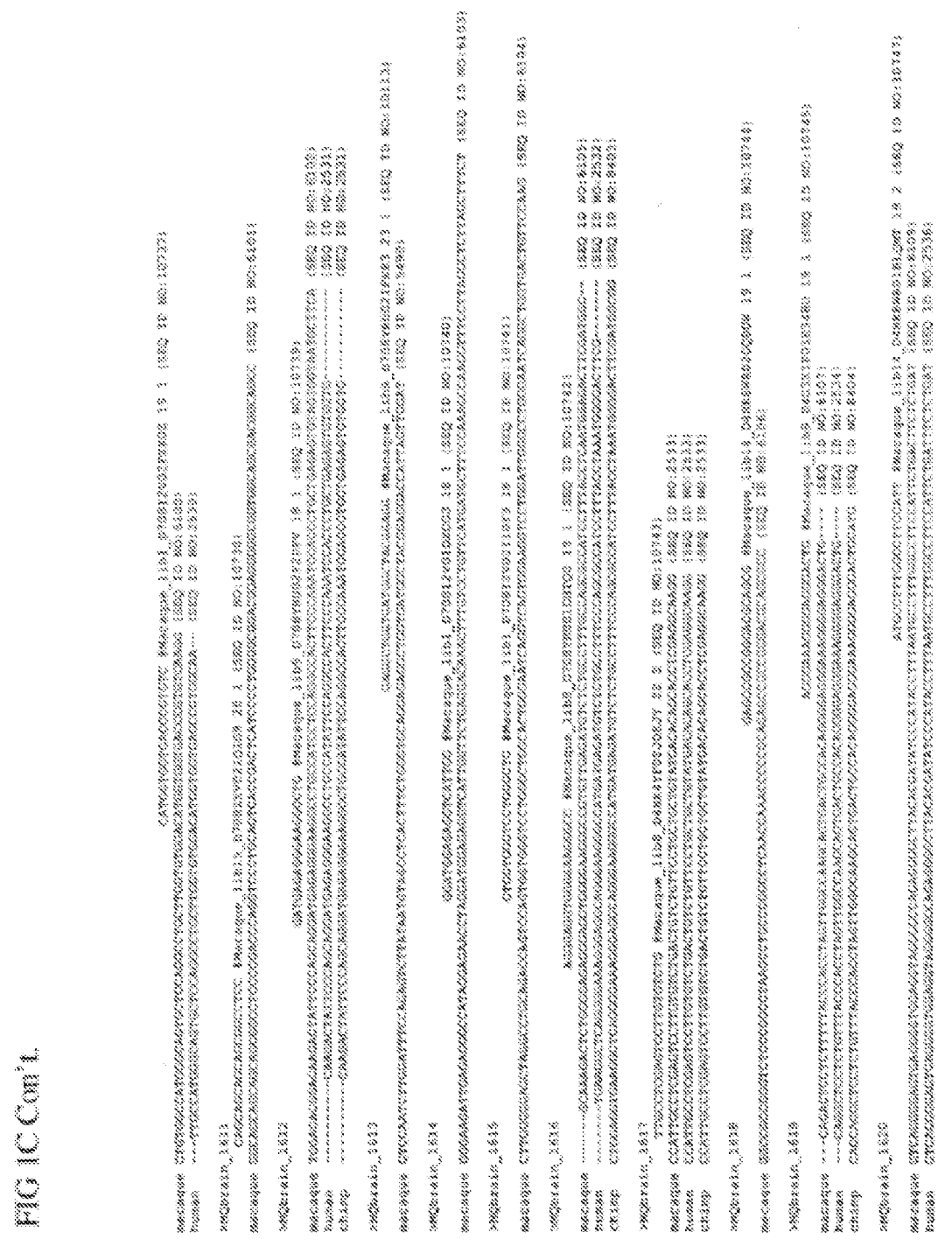
Figure 1C:
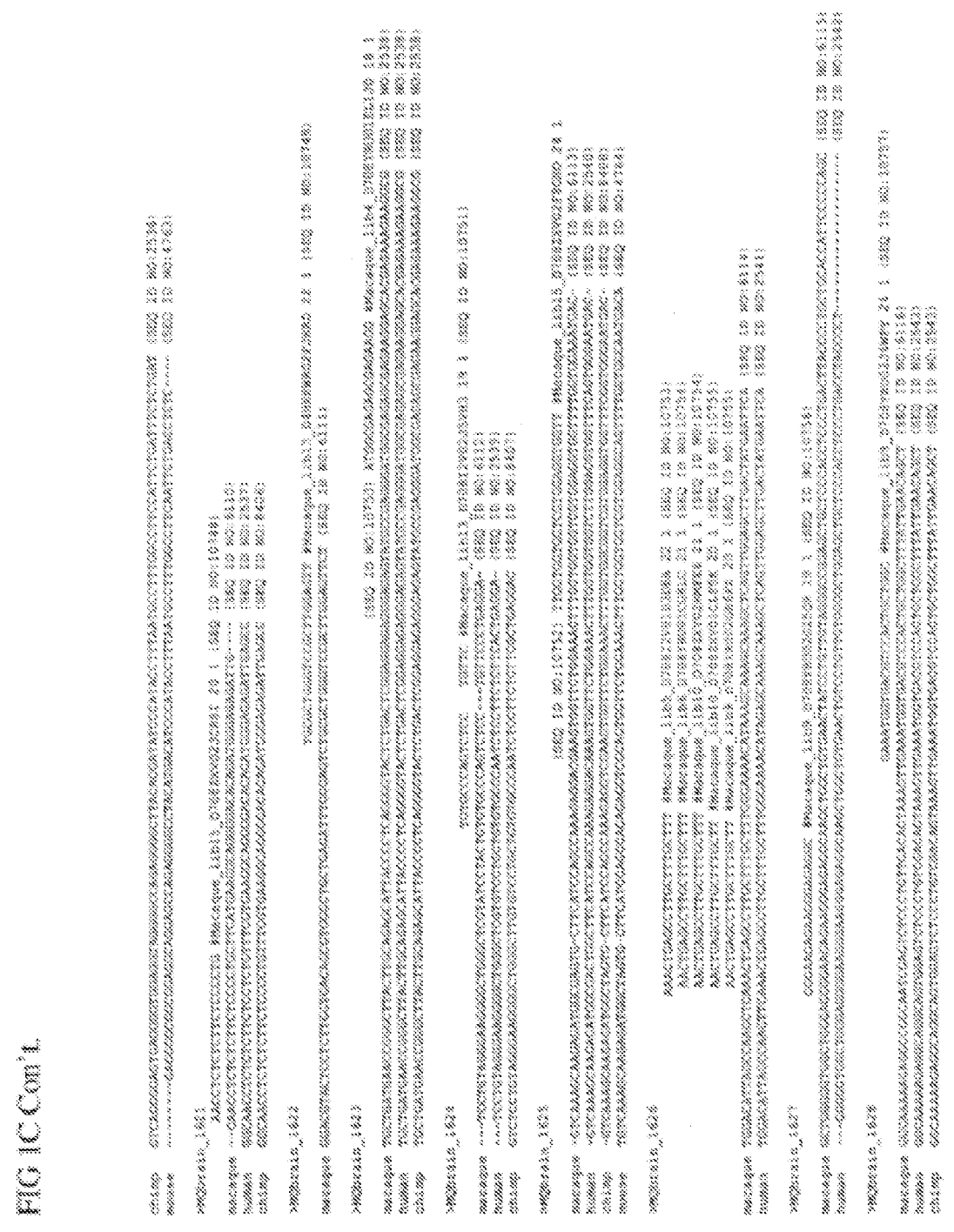
Figure 1C:
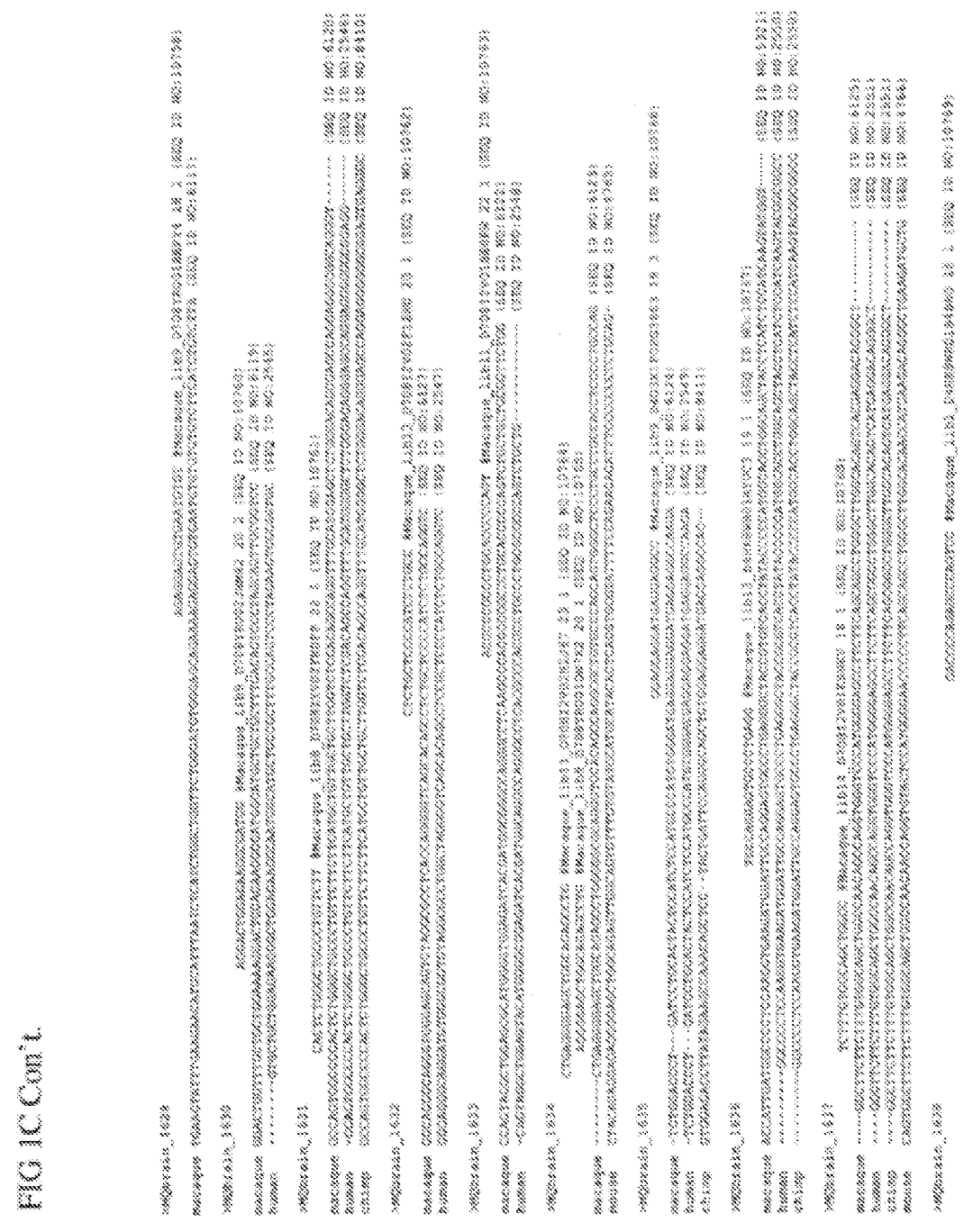
Figure 1C:
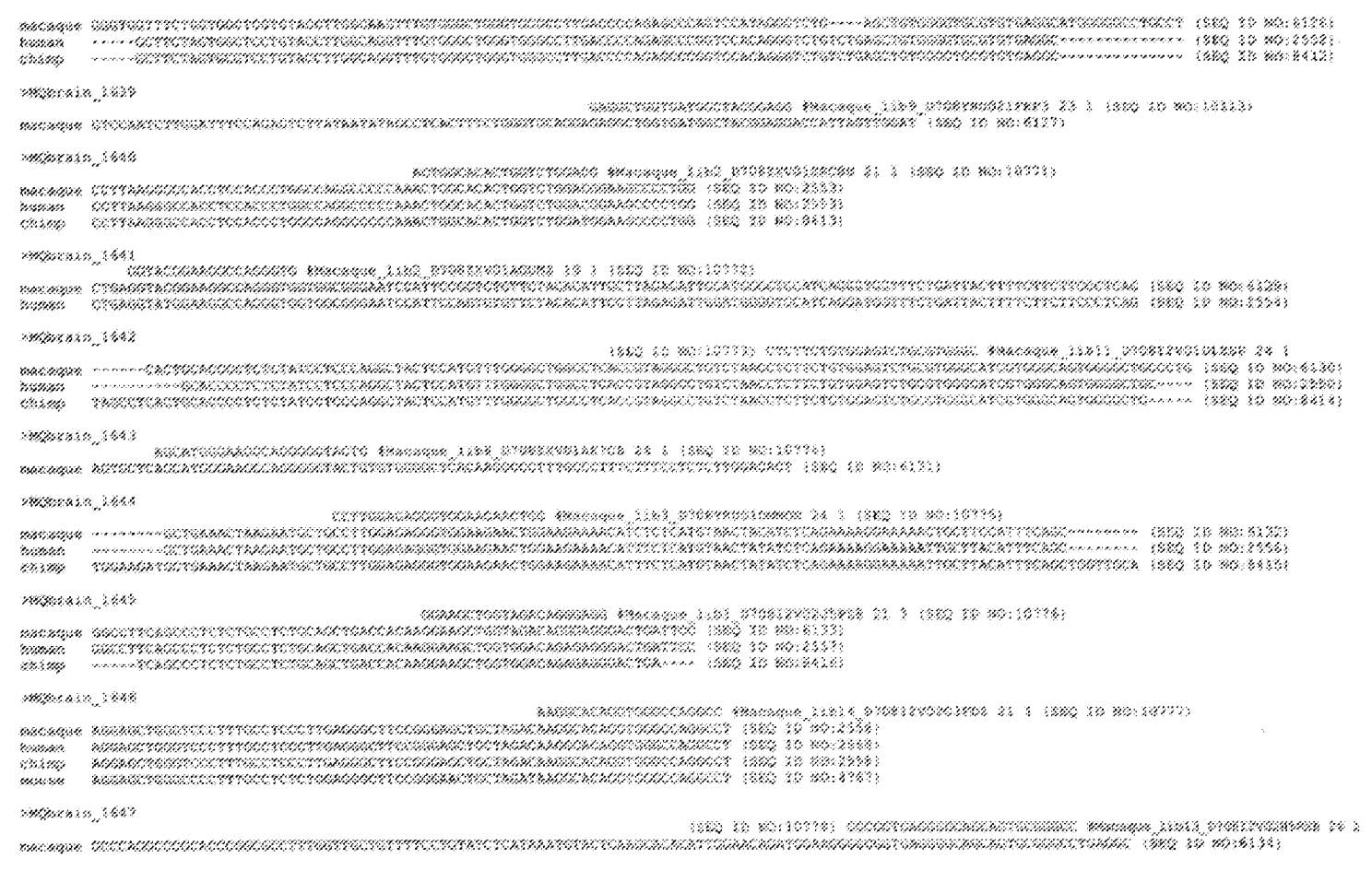
Figure 1C:
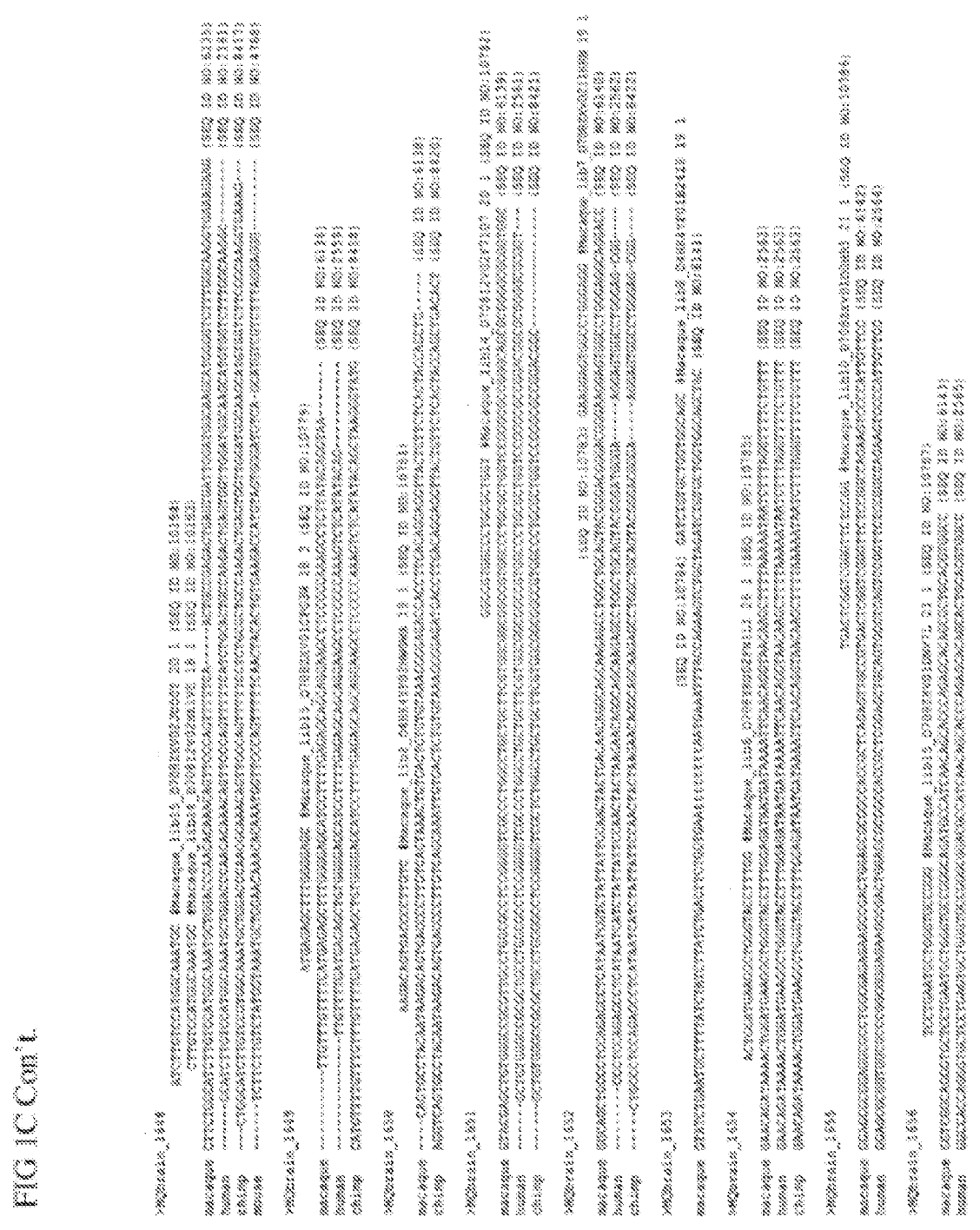
Figure 1C:
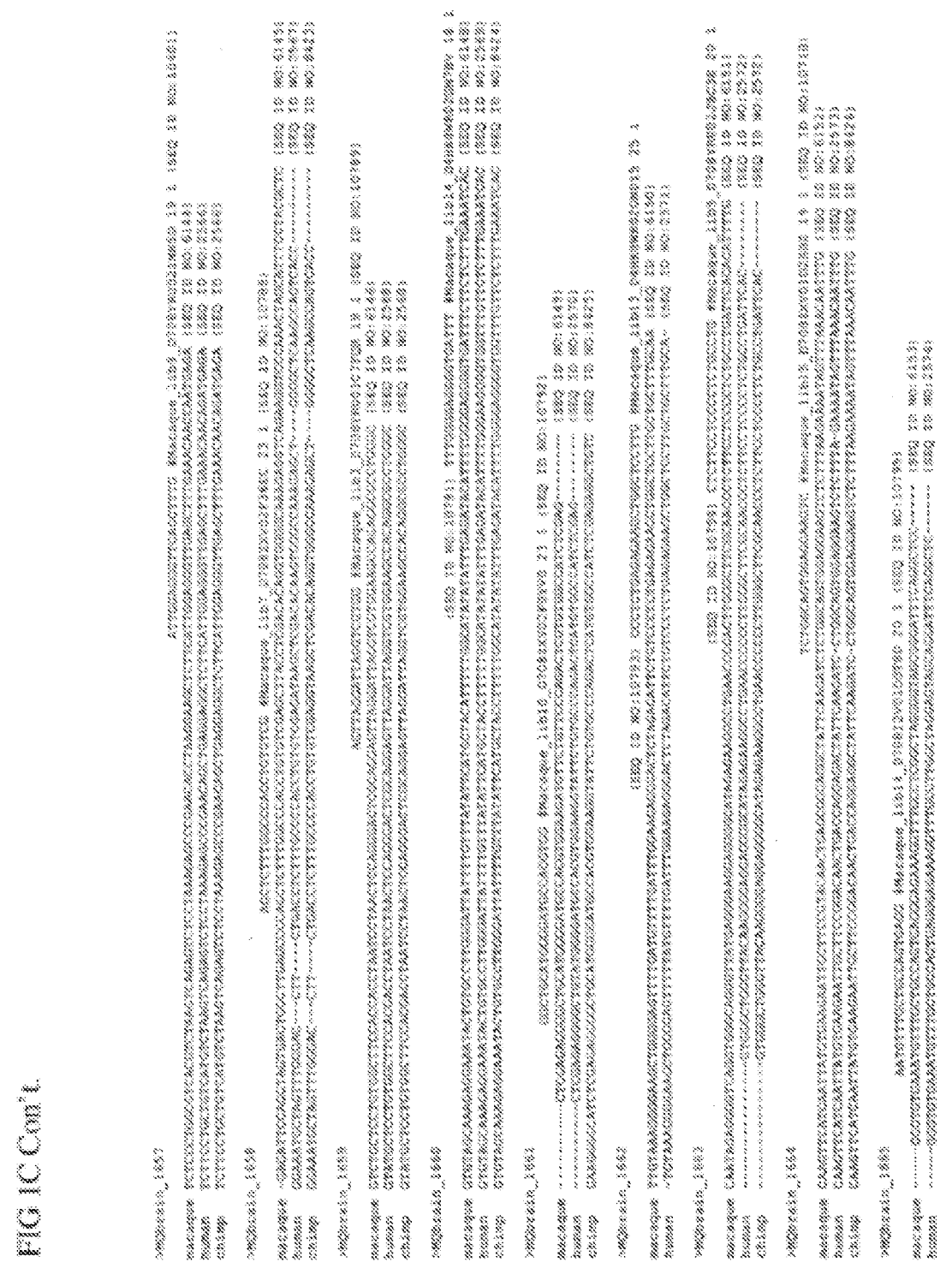
Figure 1C:
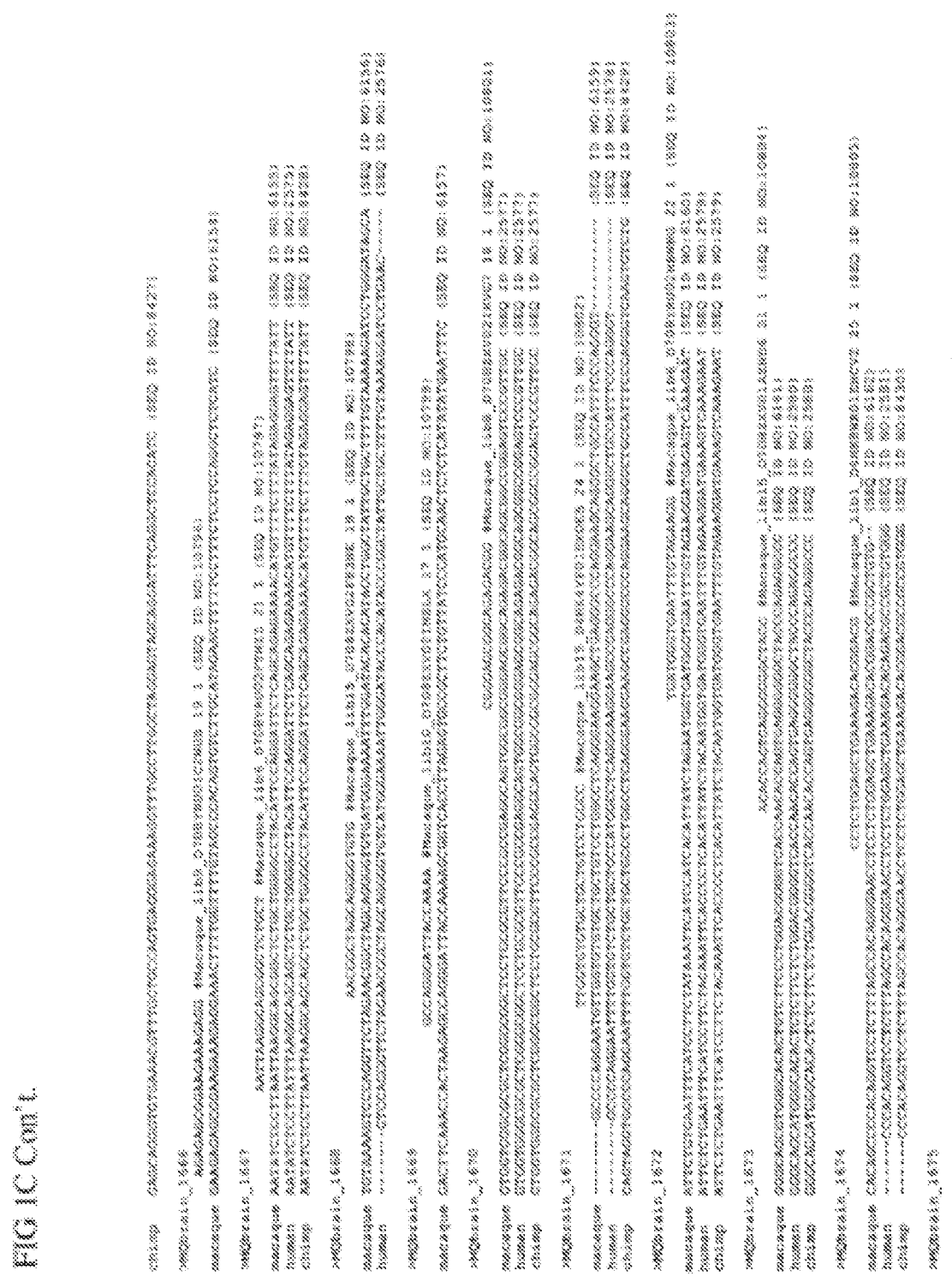
Figure 1C:
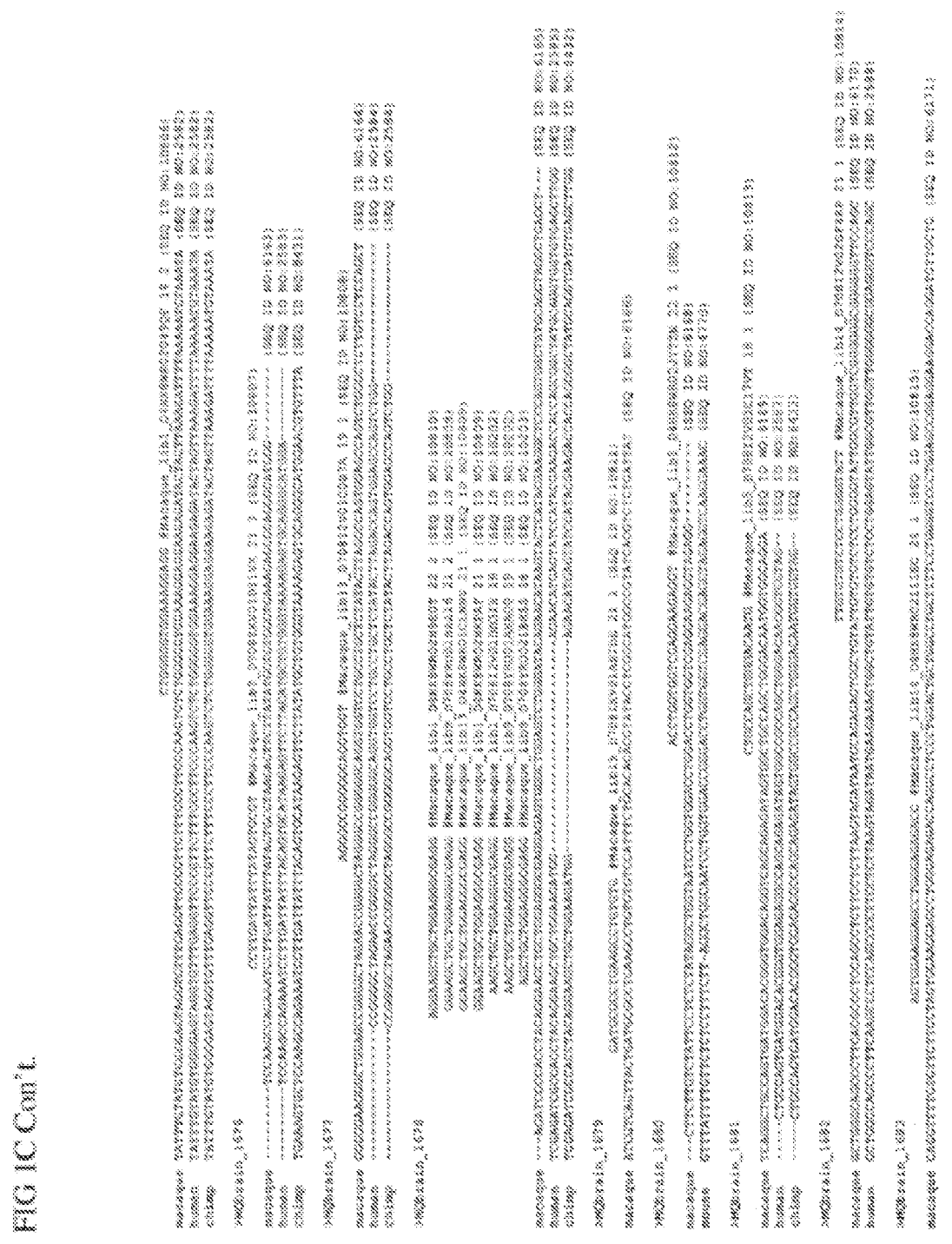
Figure 1C:
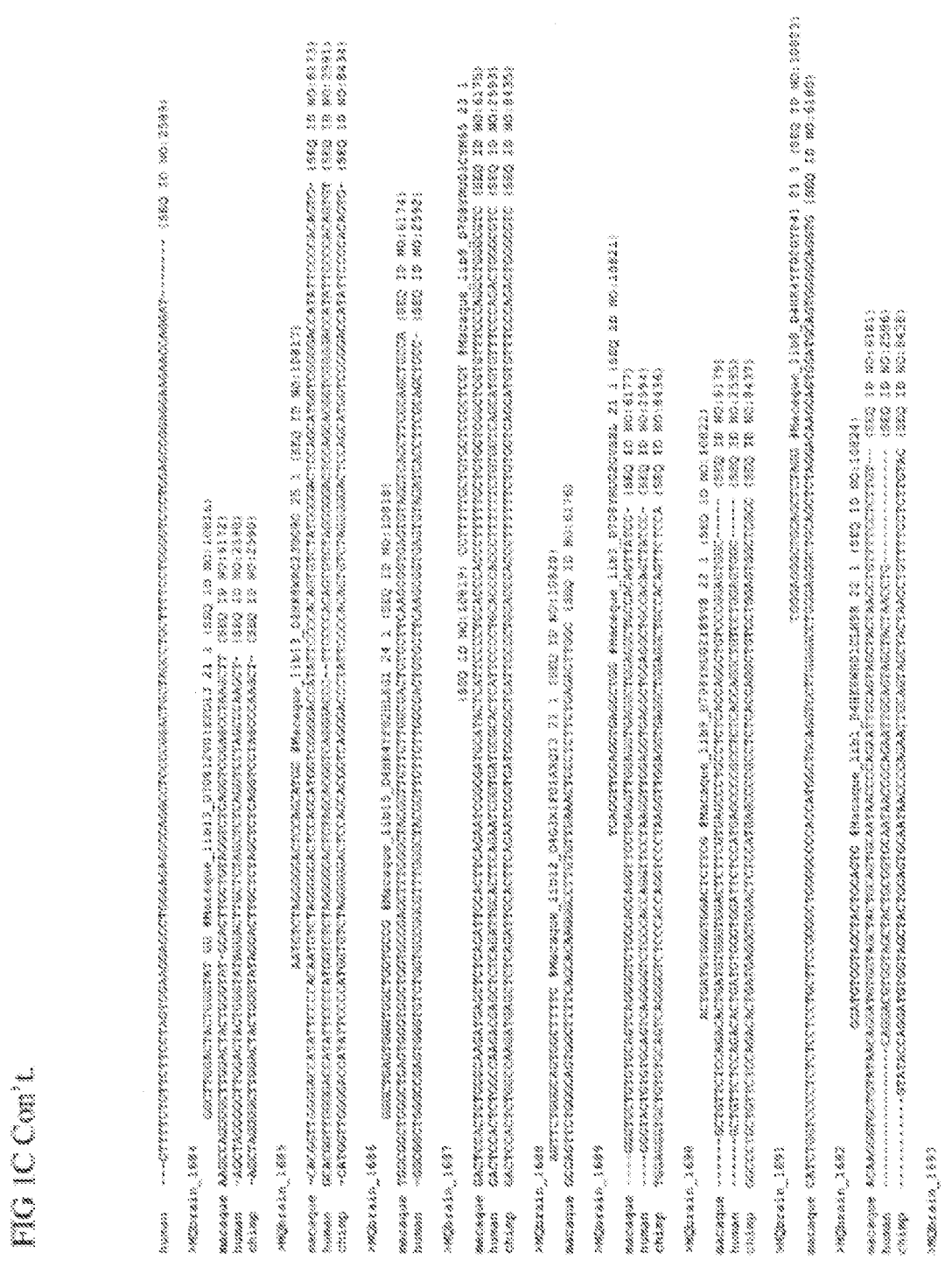
Figure 1C:
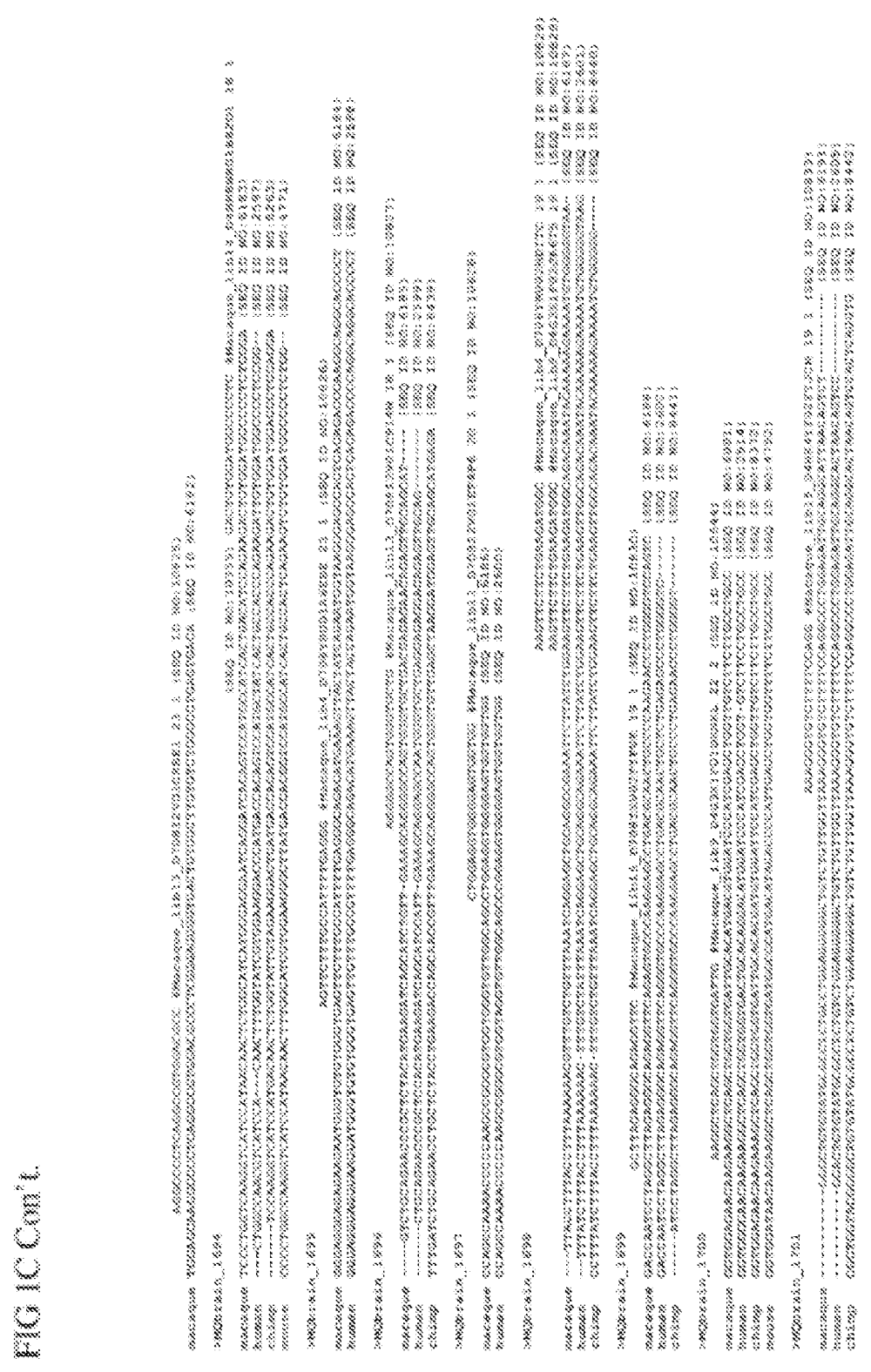
Figure 1C:
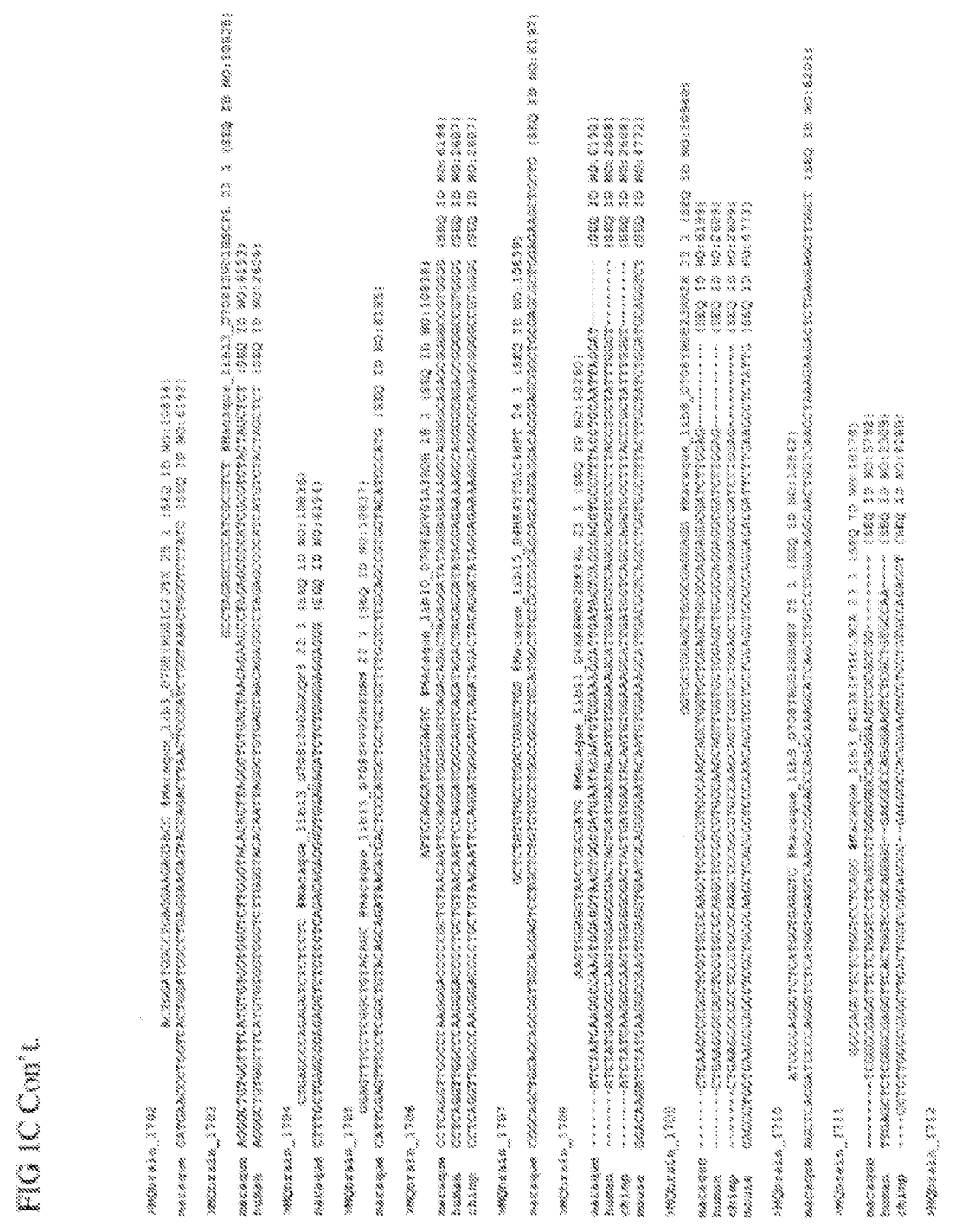
Figure 1C:
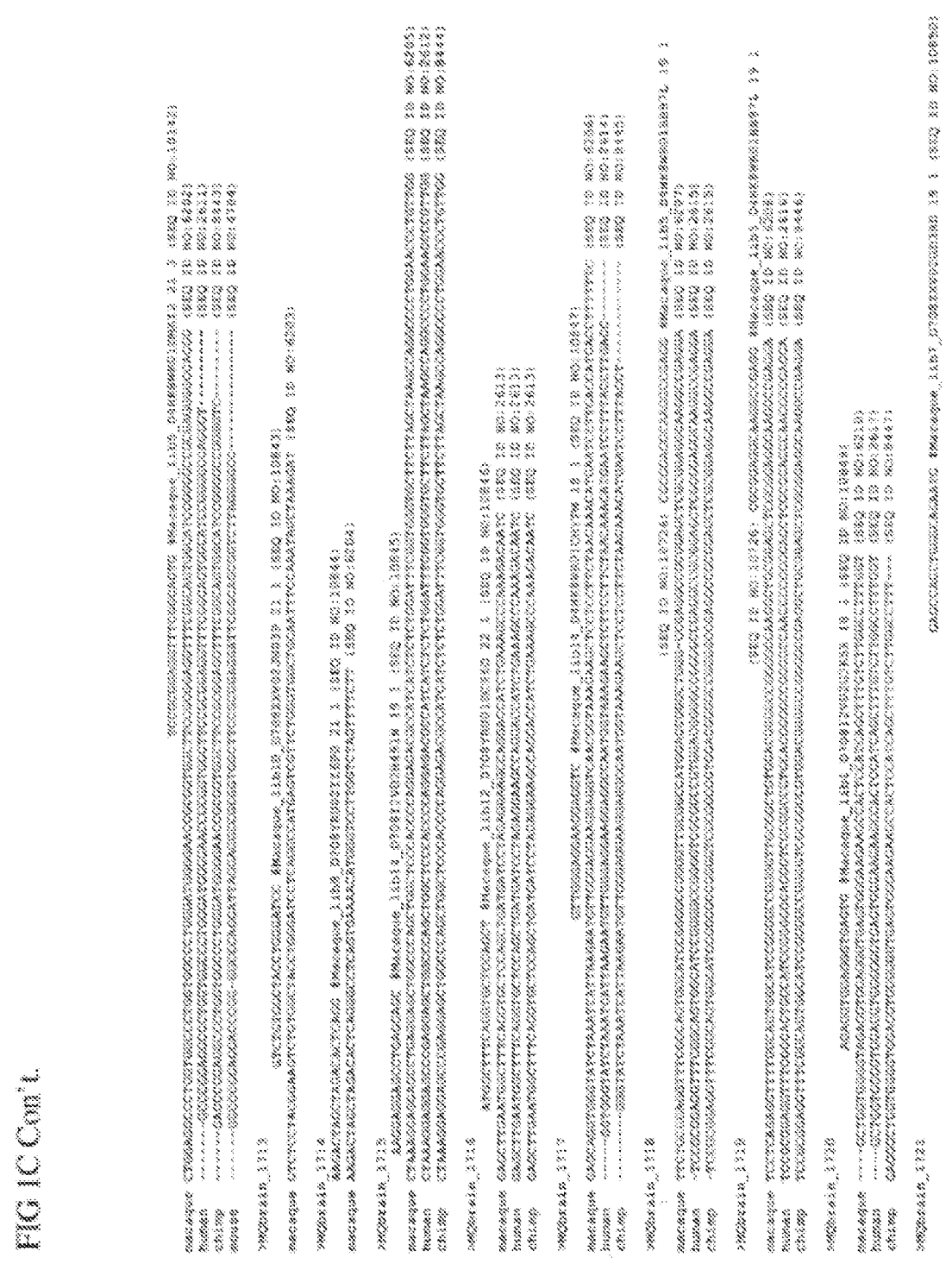
Figure 1C:
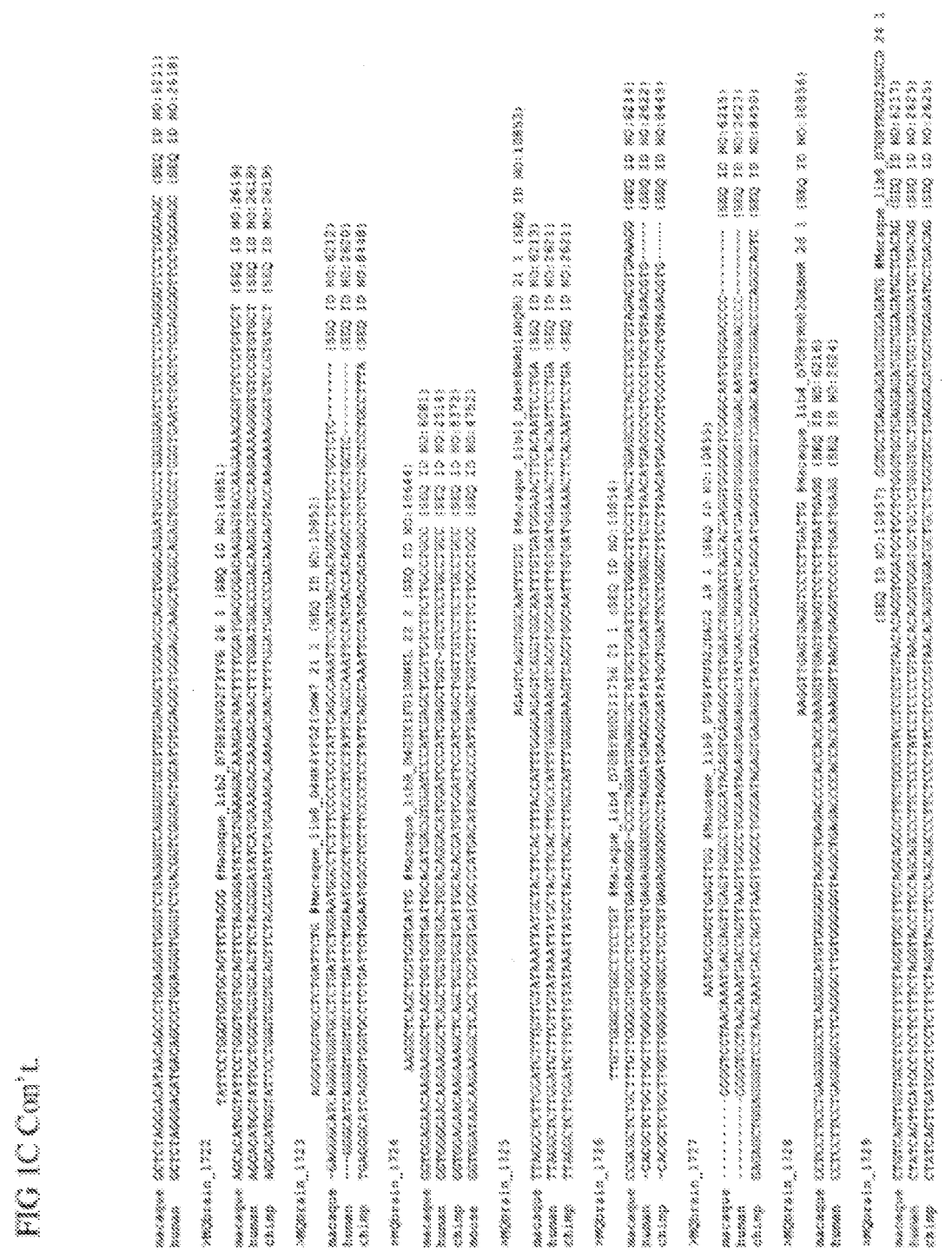
Figure 1C:
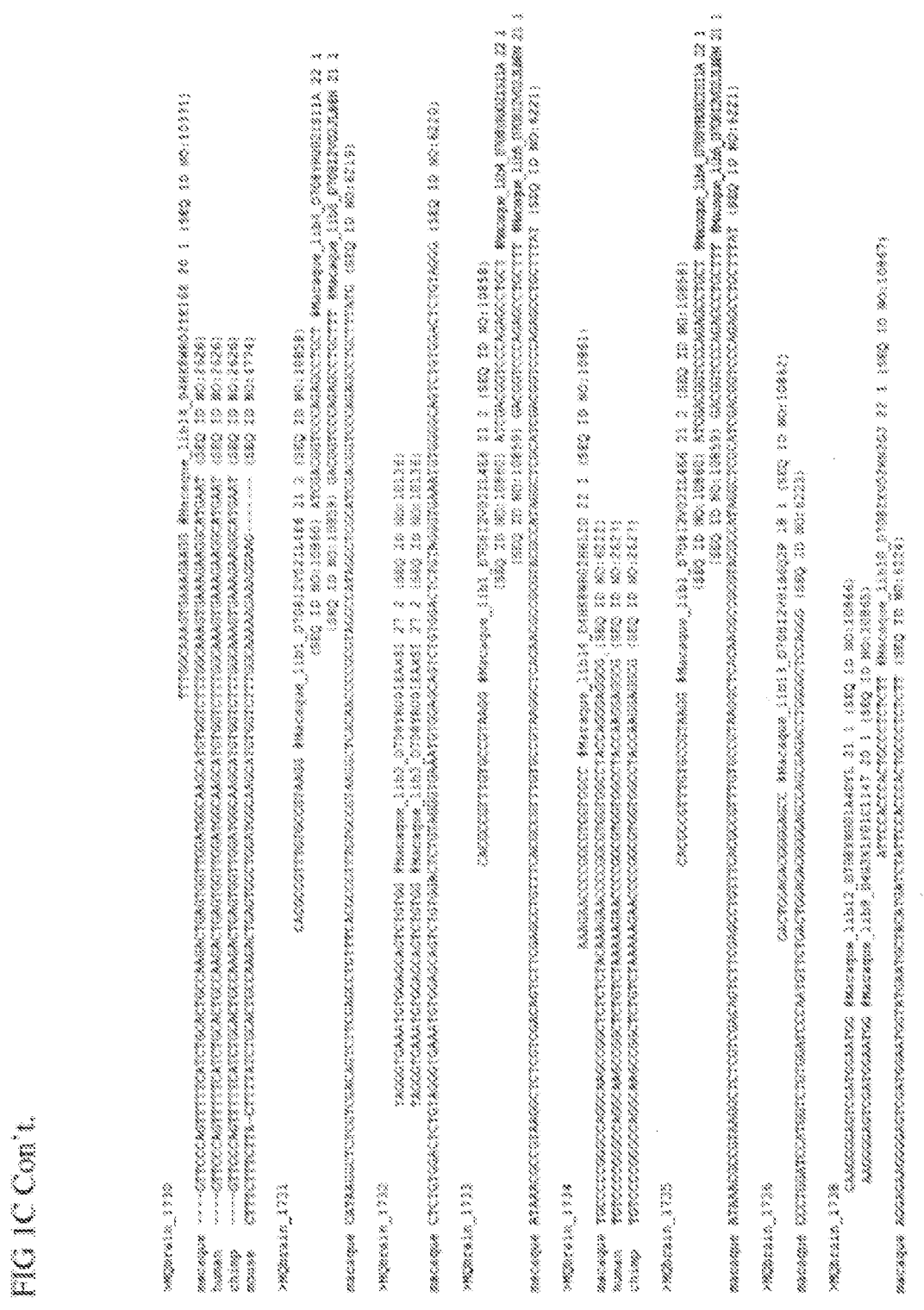
Figure 1C:
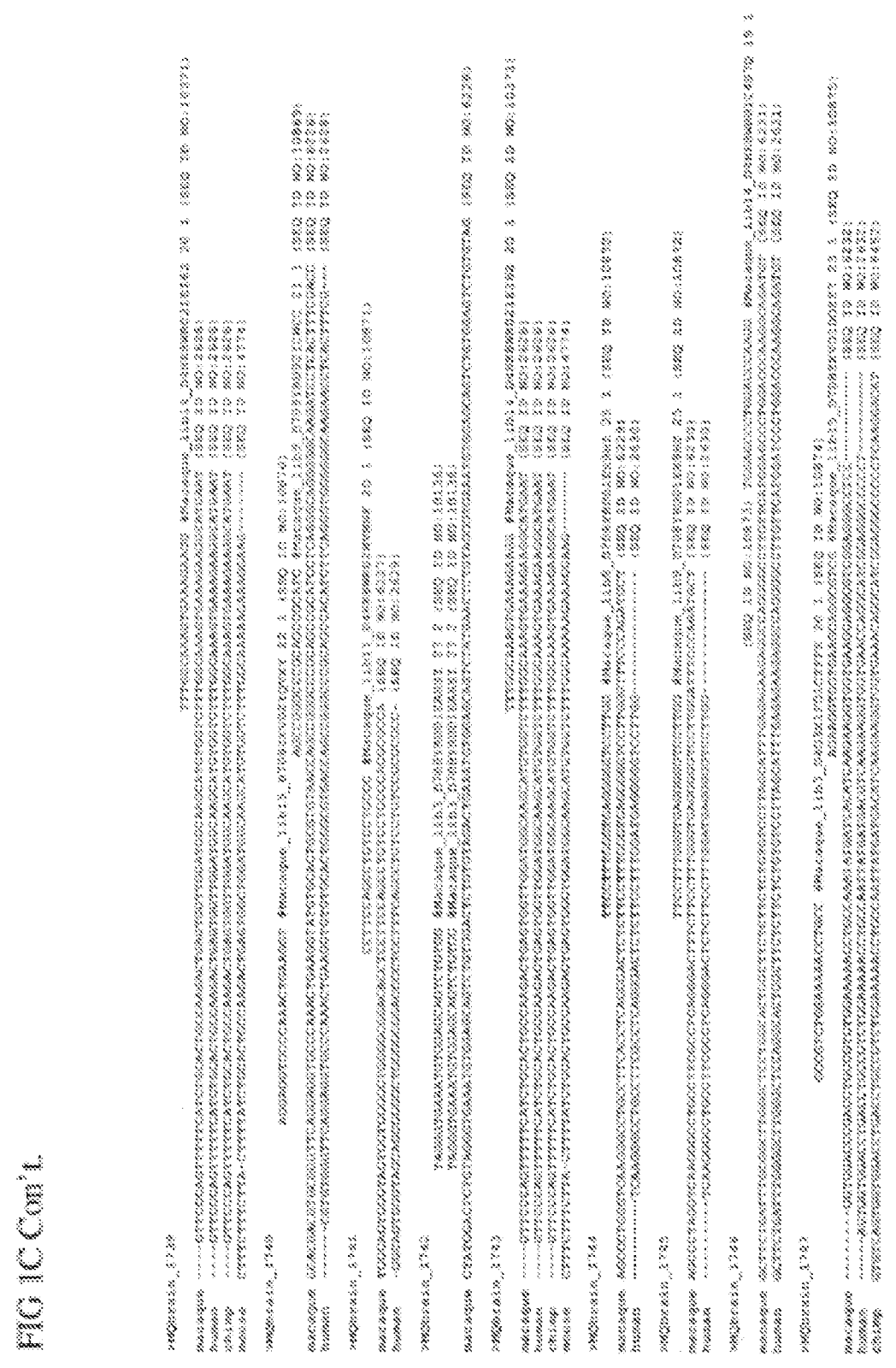
Figure 1C:
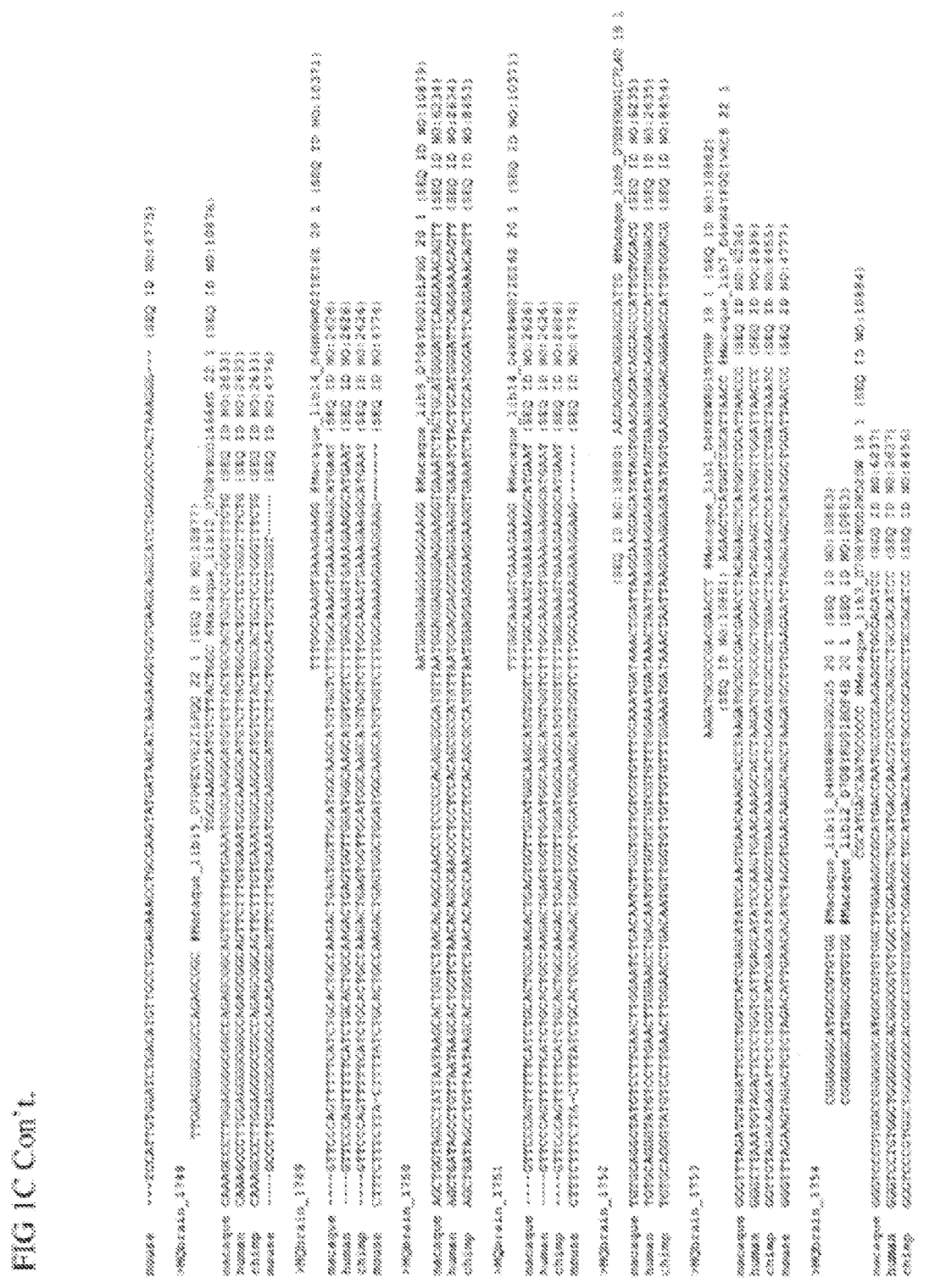
Figure 1C:
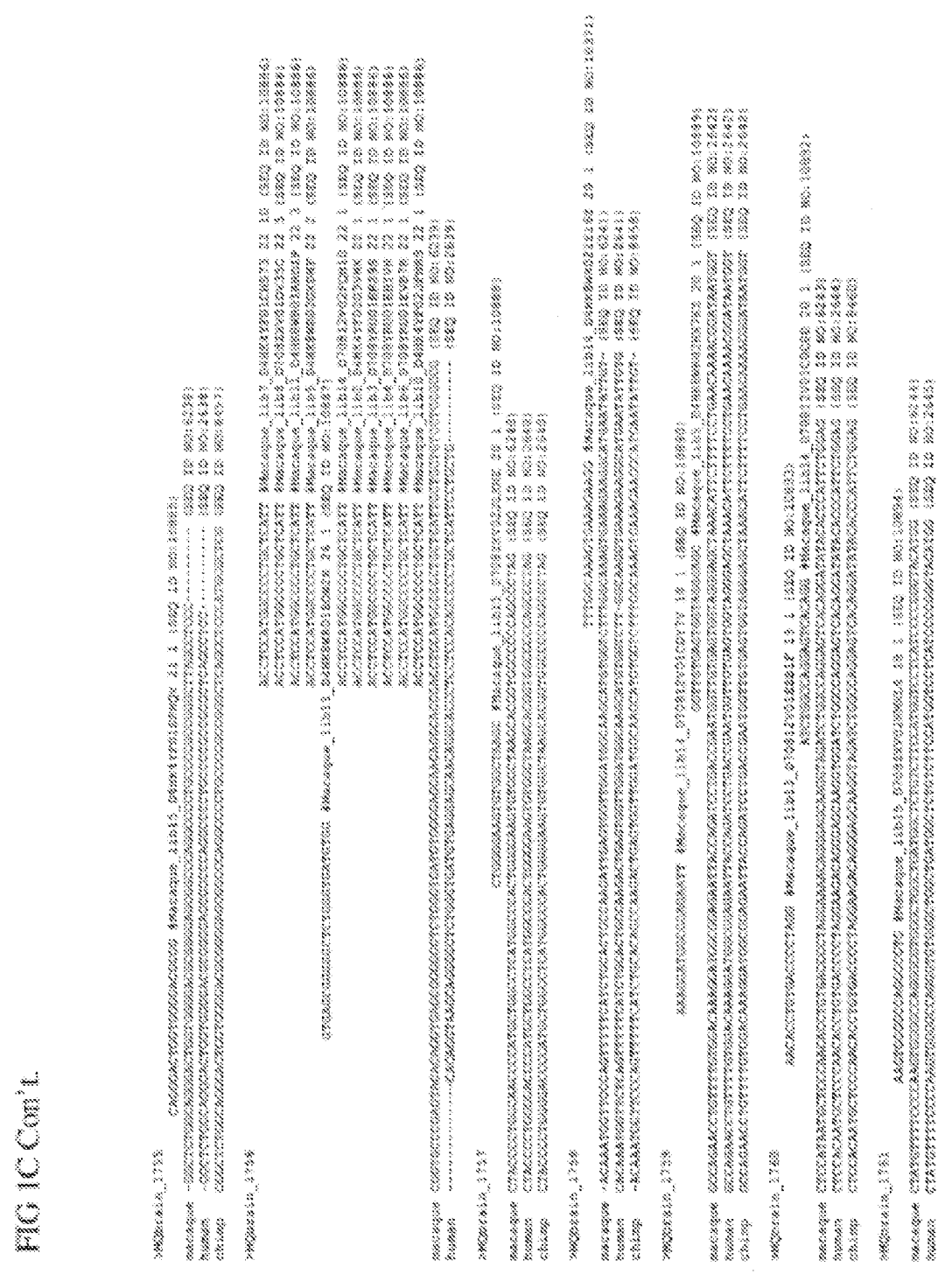
Figure 1C:
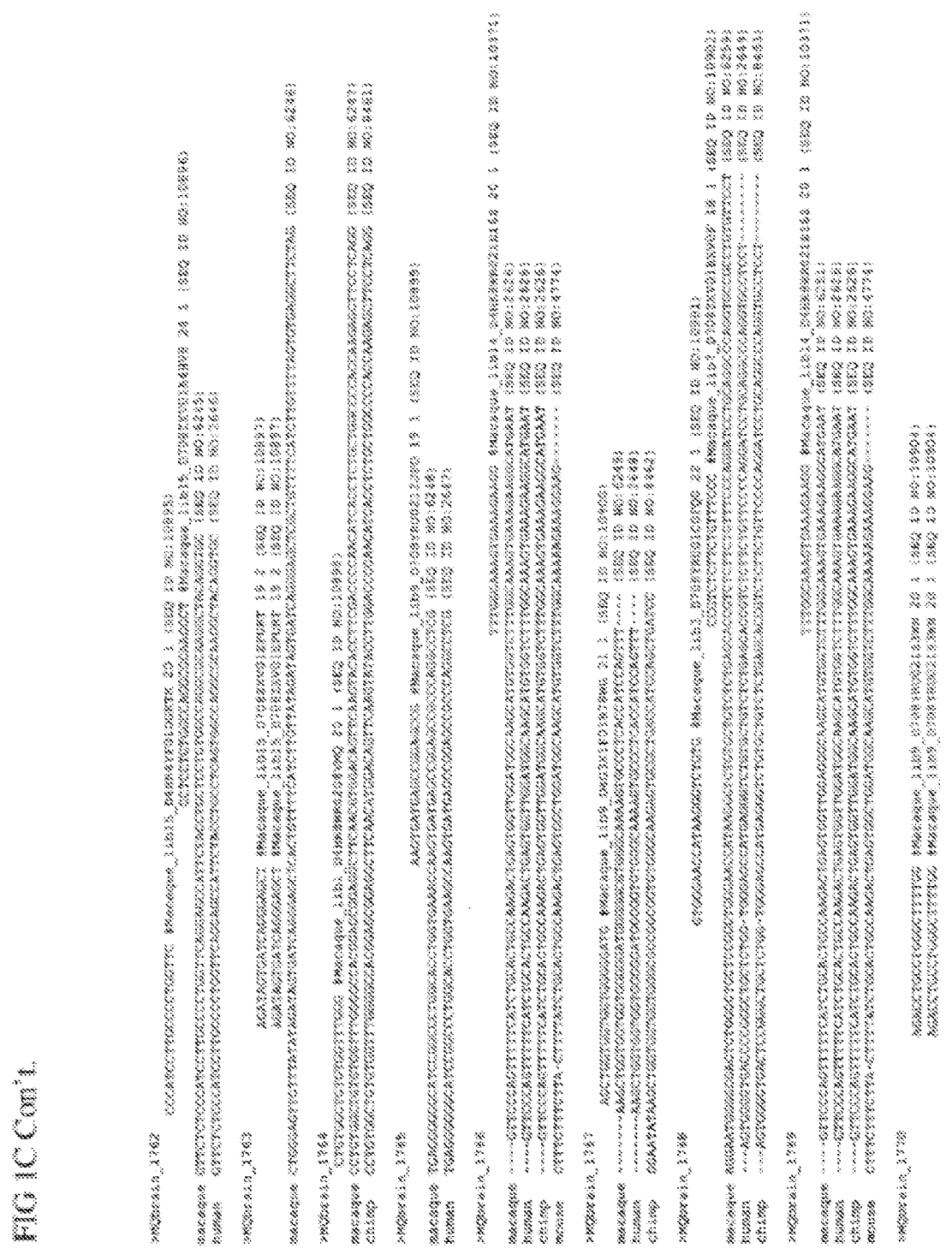
Figure 1C:
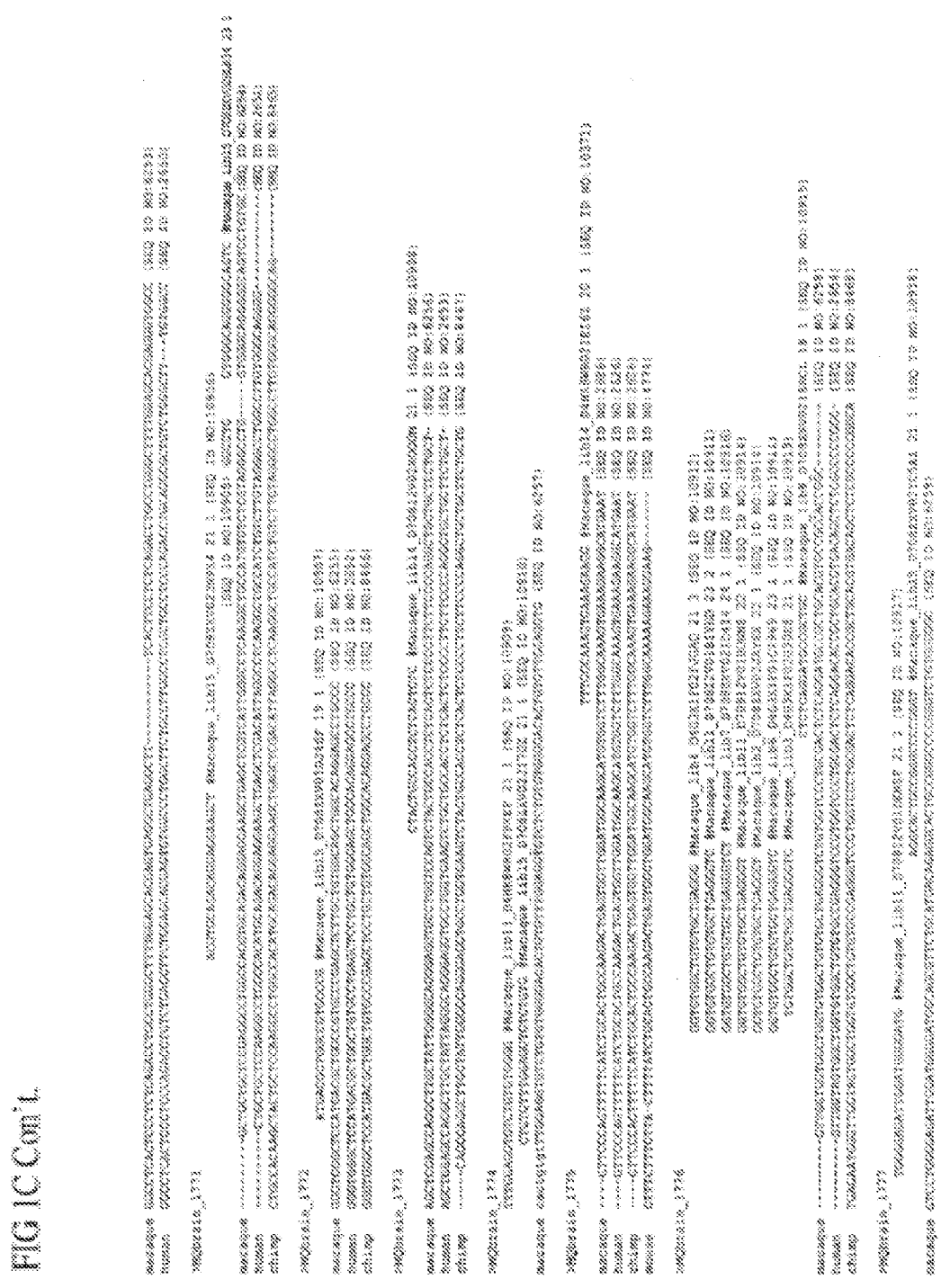
Figure 1C:
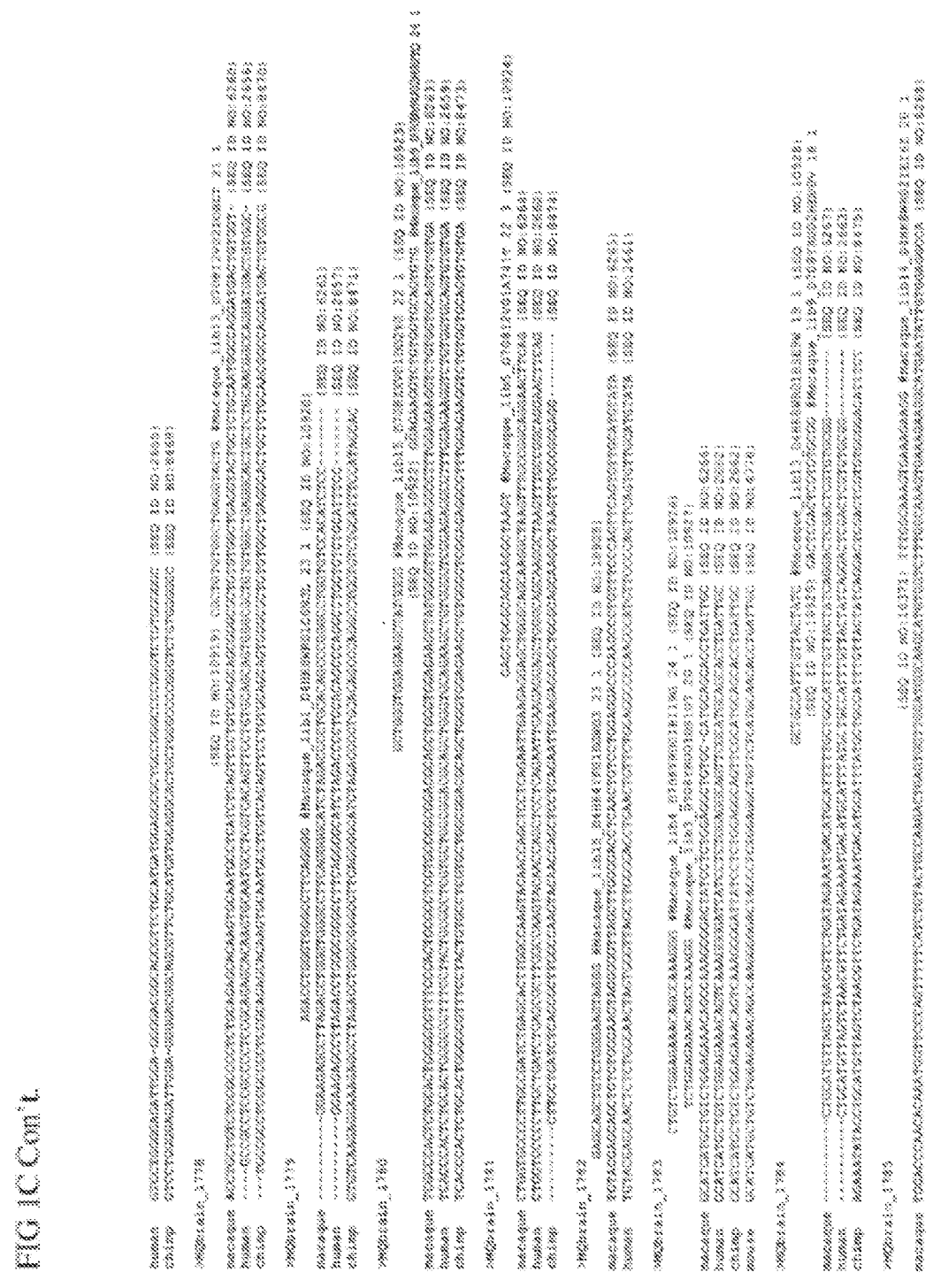
Figure 1C:
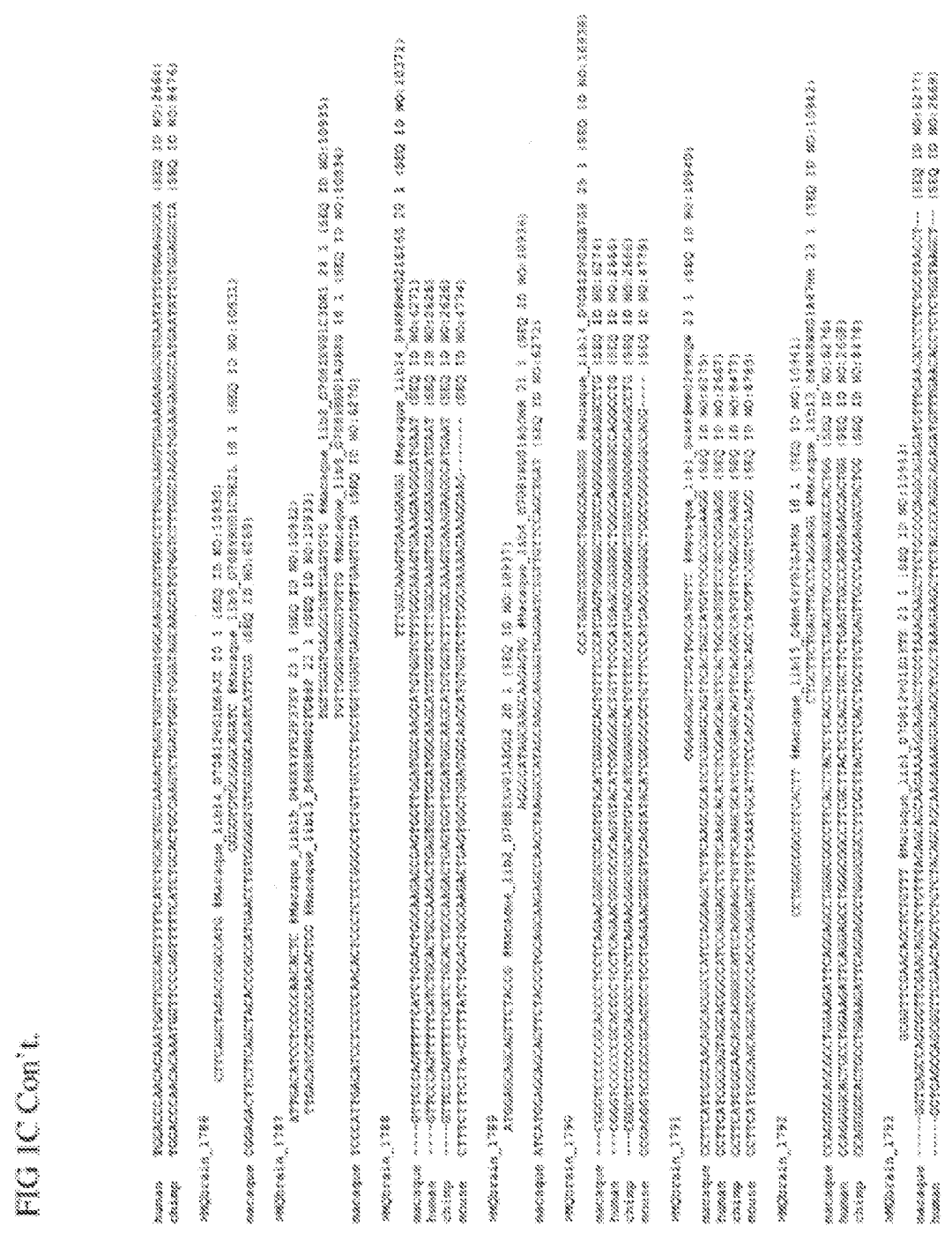
Figure 1C:
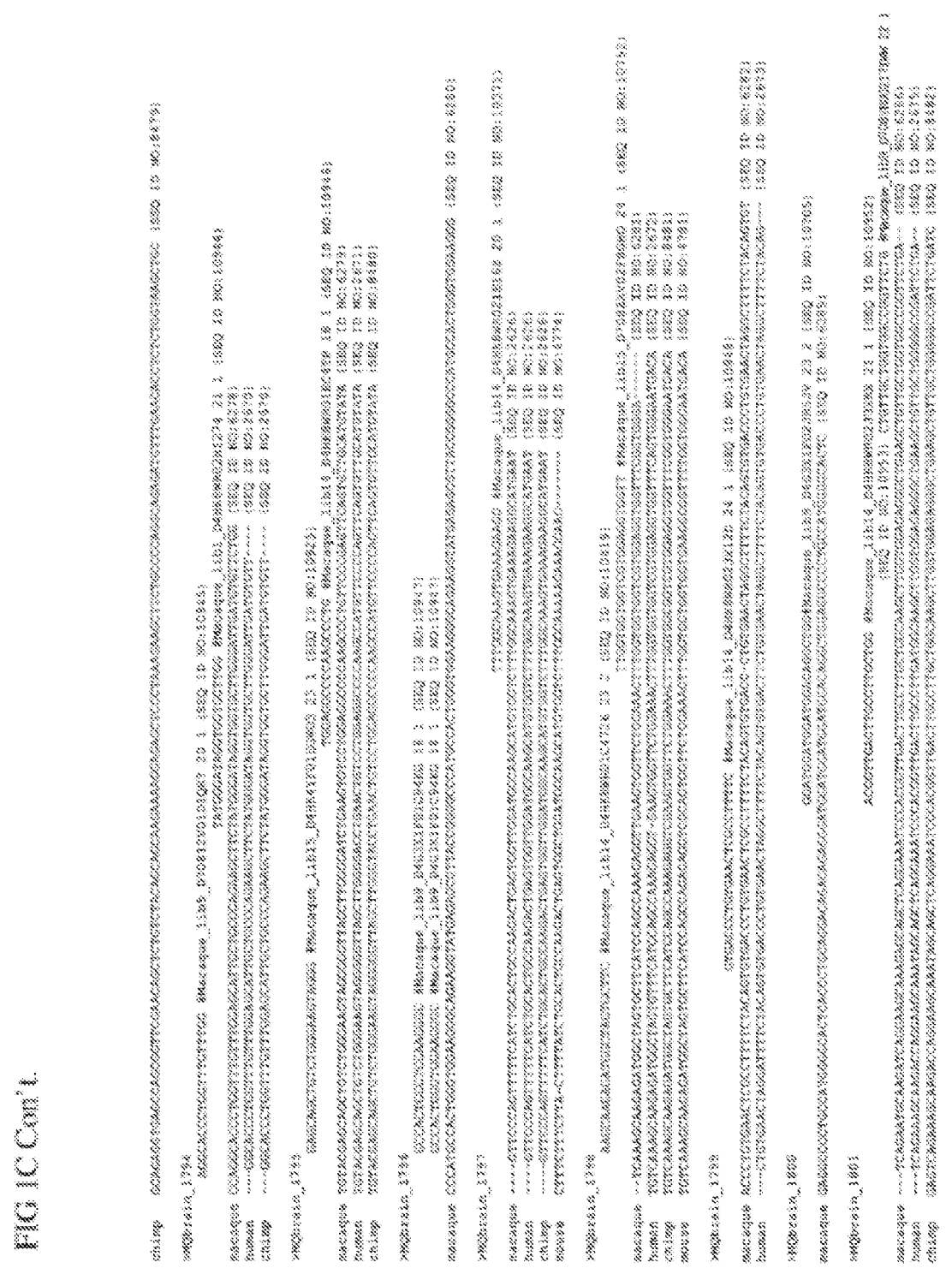
Figure 1C:
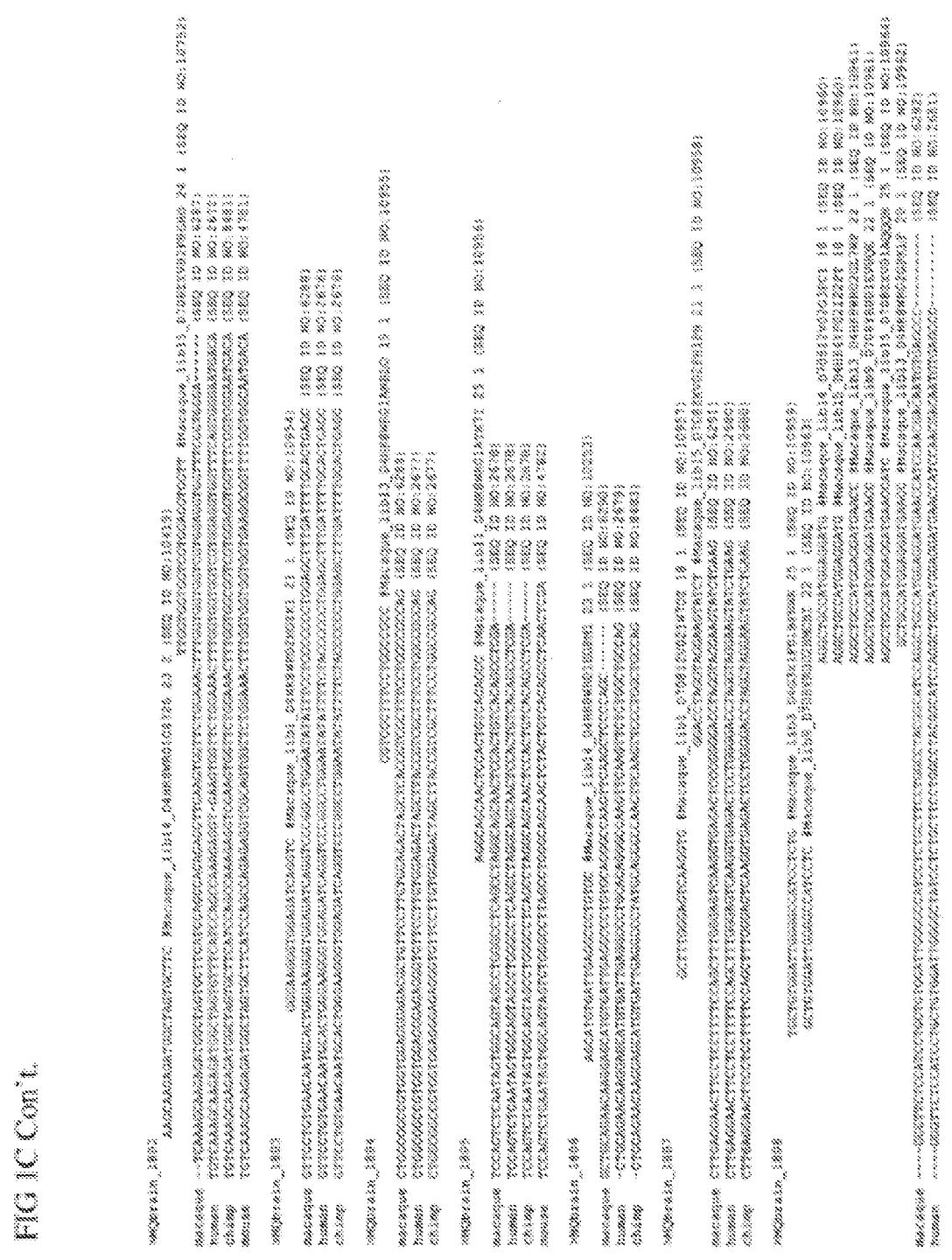
Figure 1C:
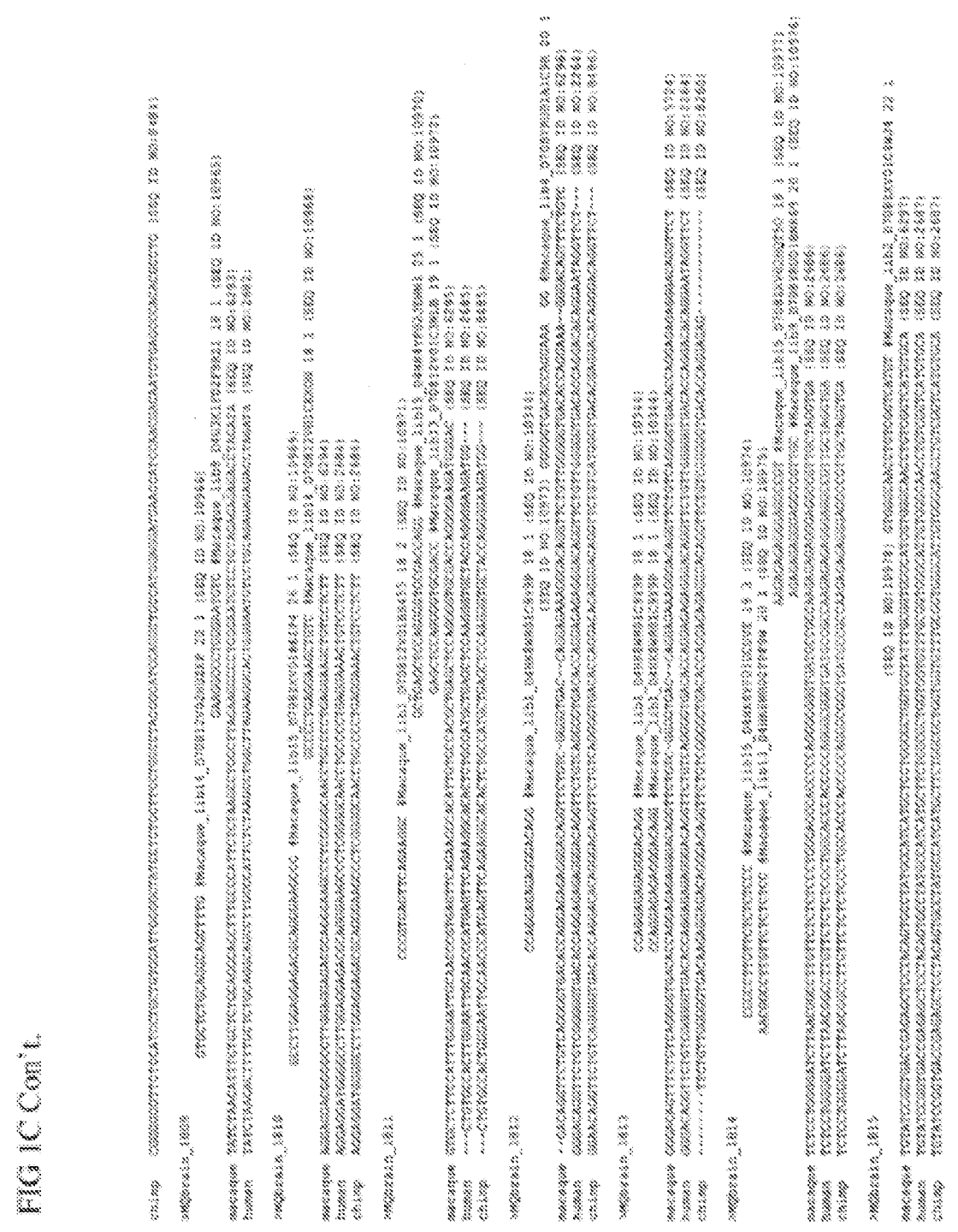
Figure 1C:
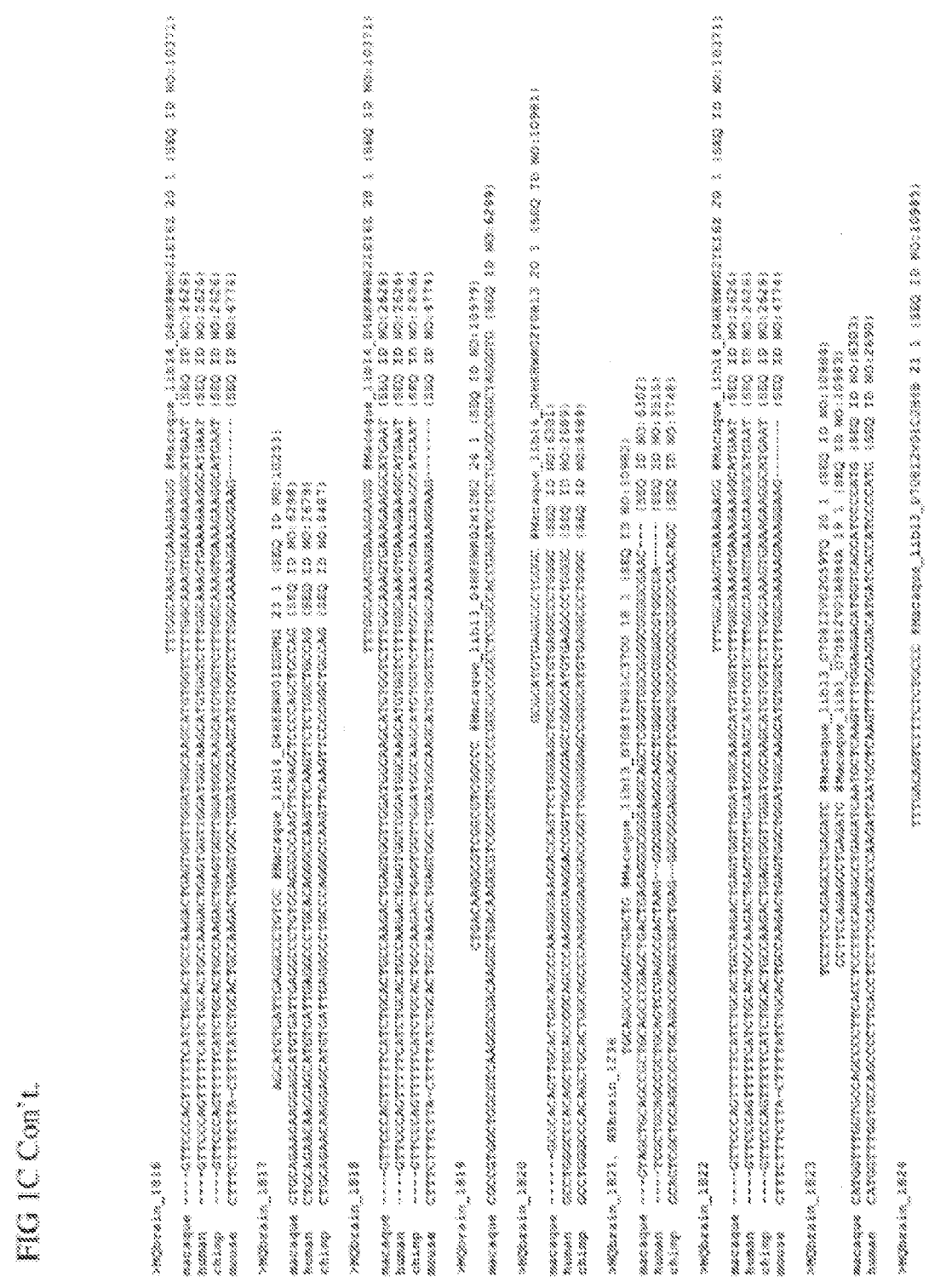
Figure 1C:
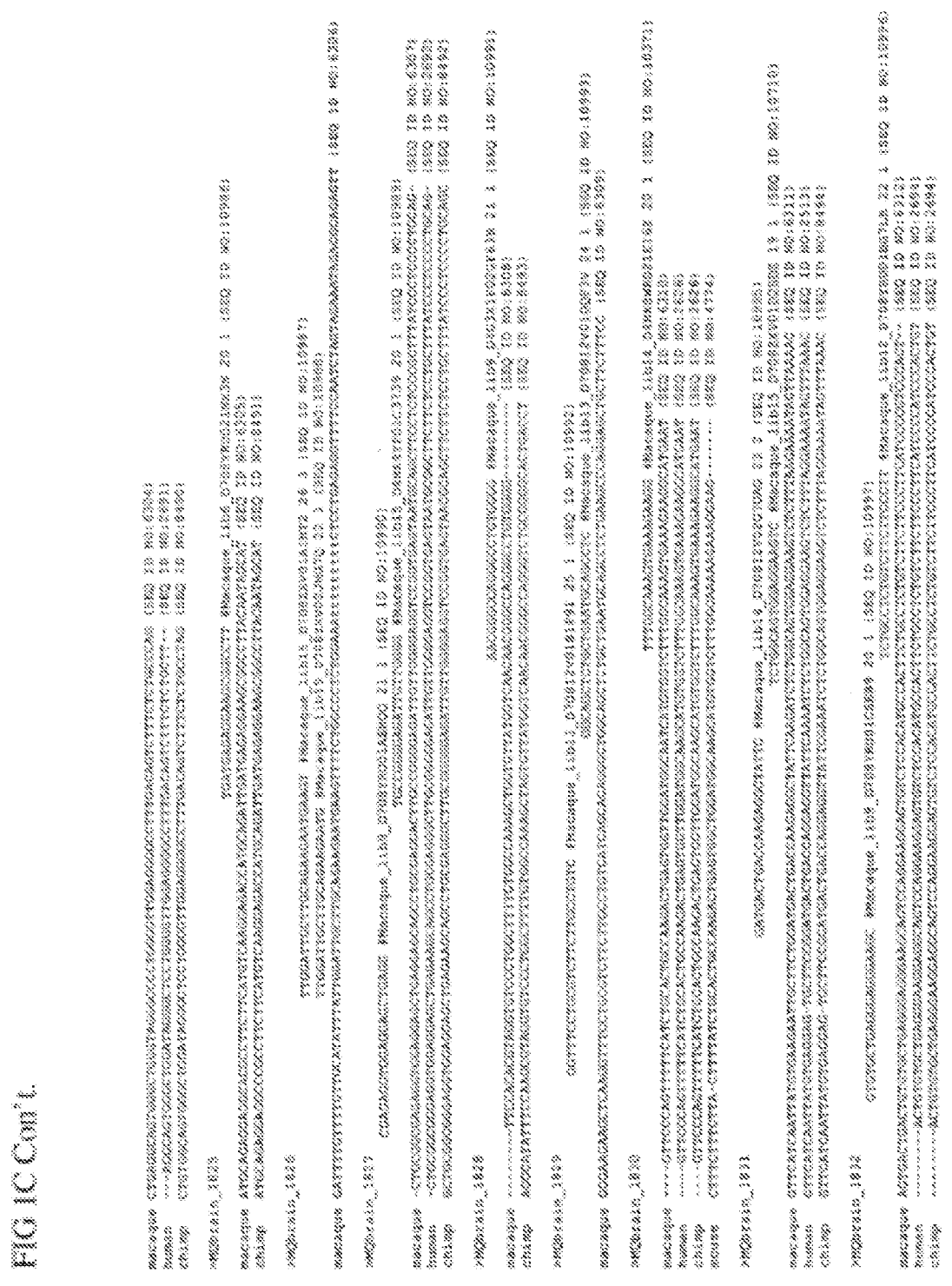
Figure 1C:
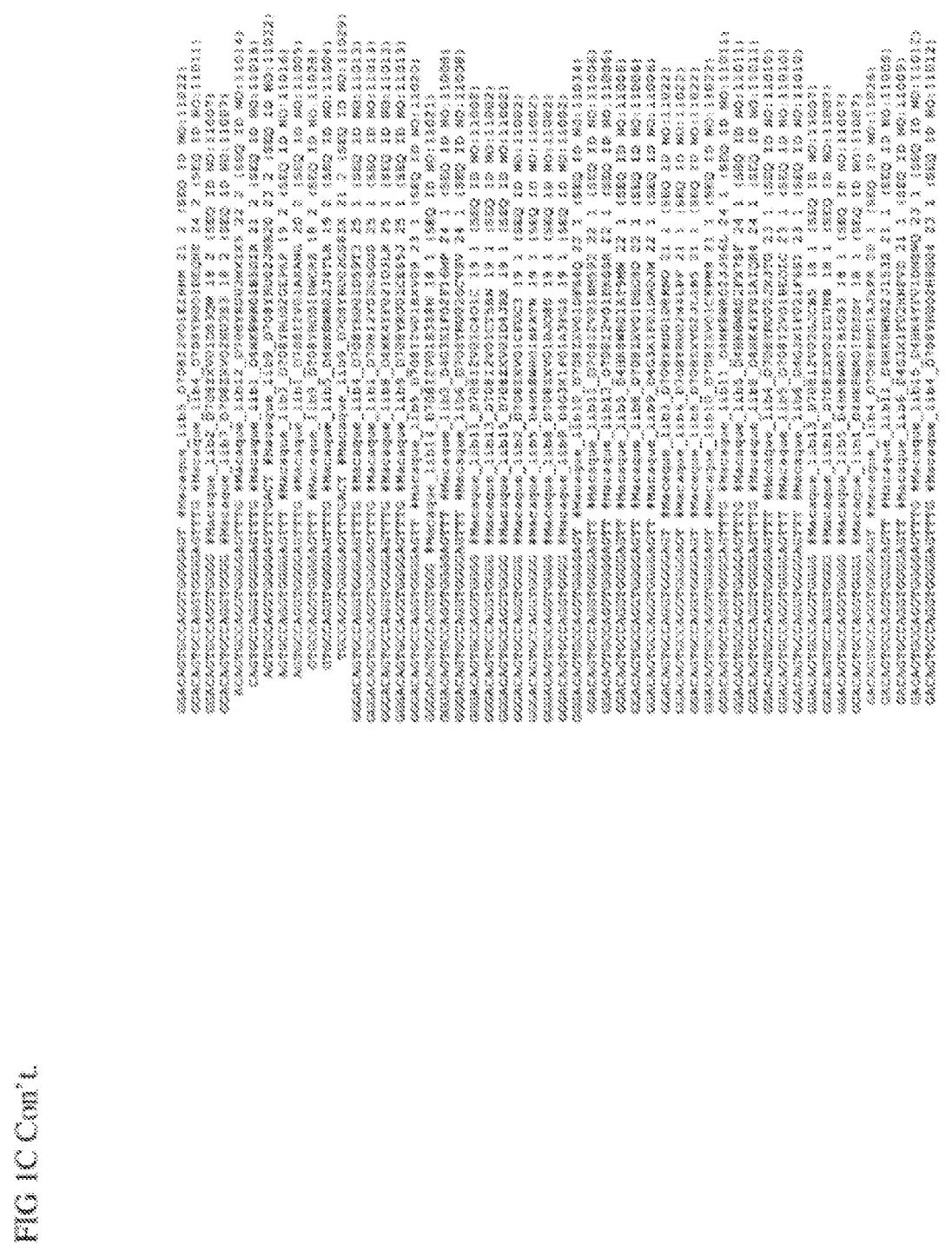
Figure 1C:
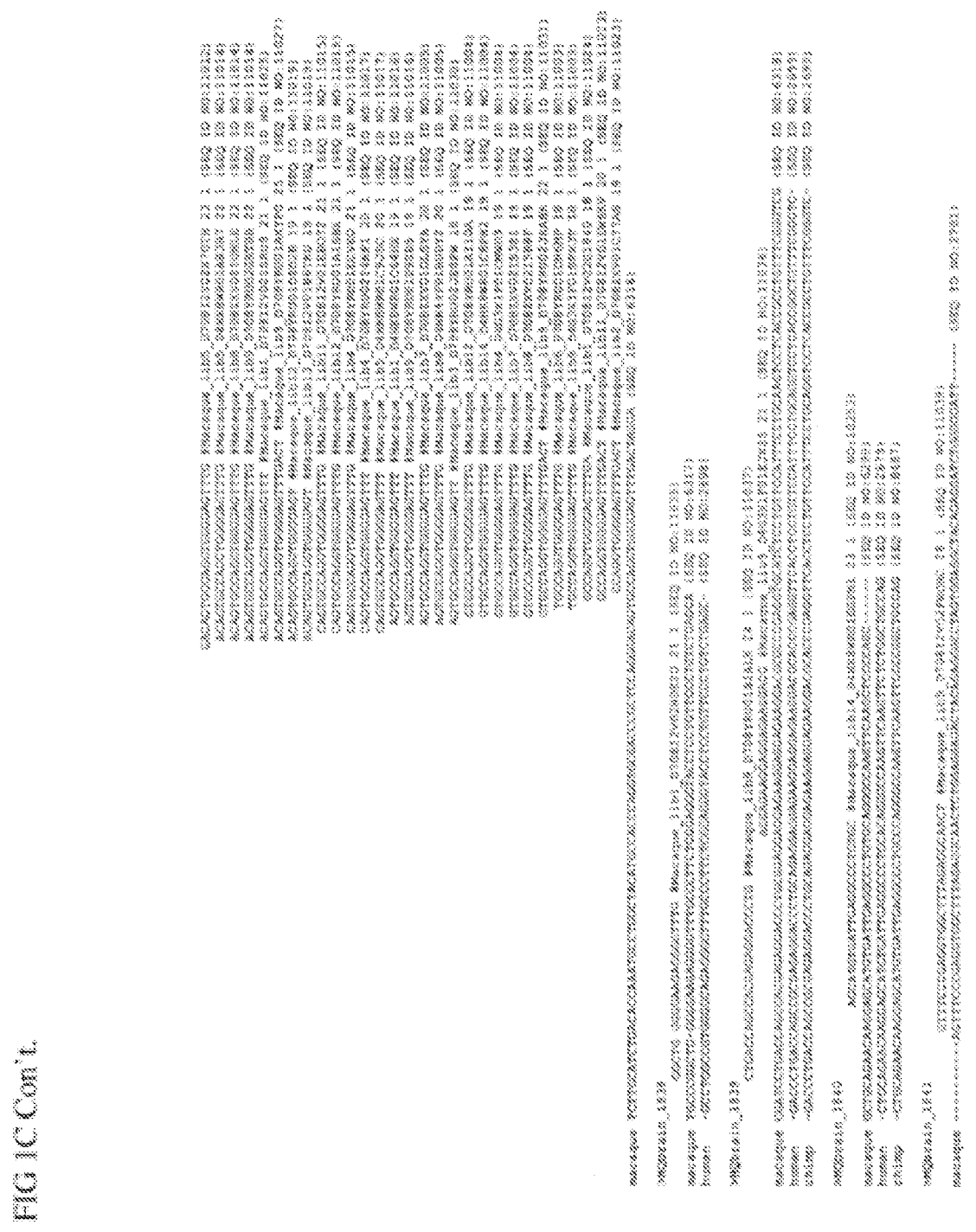
Figure 1C:
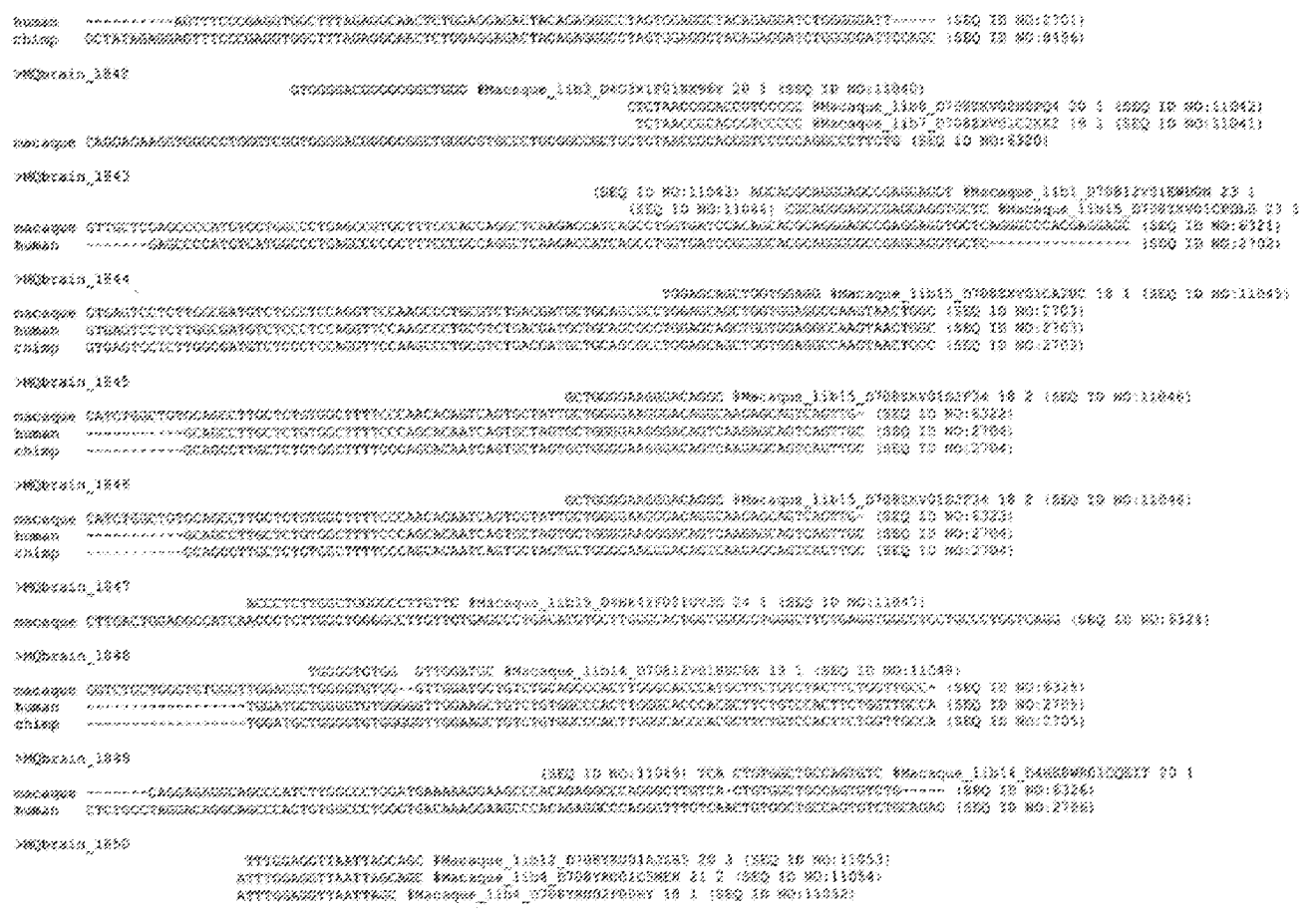
Figure 1C:
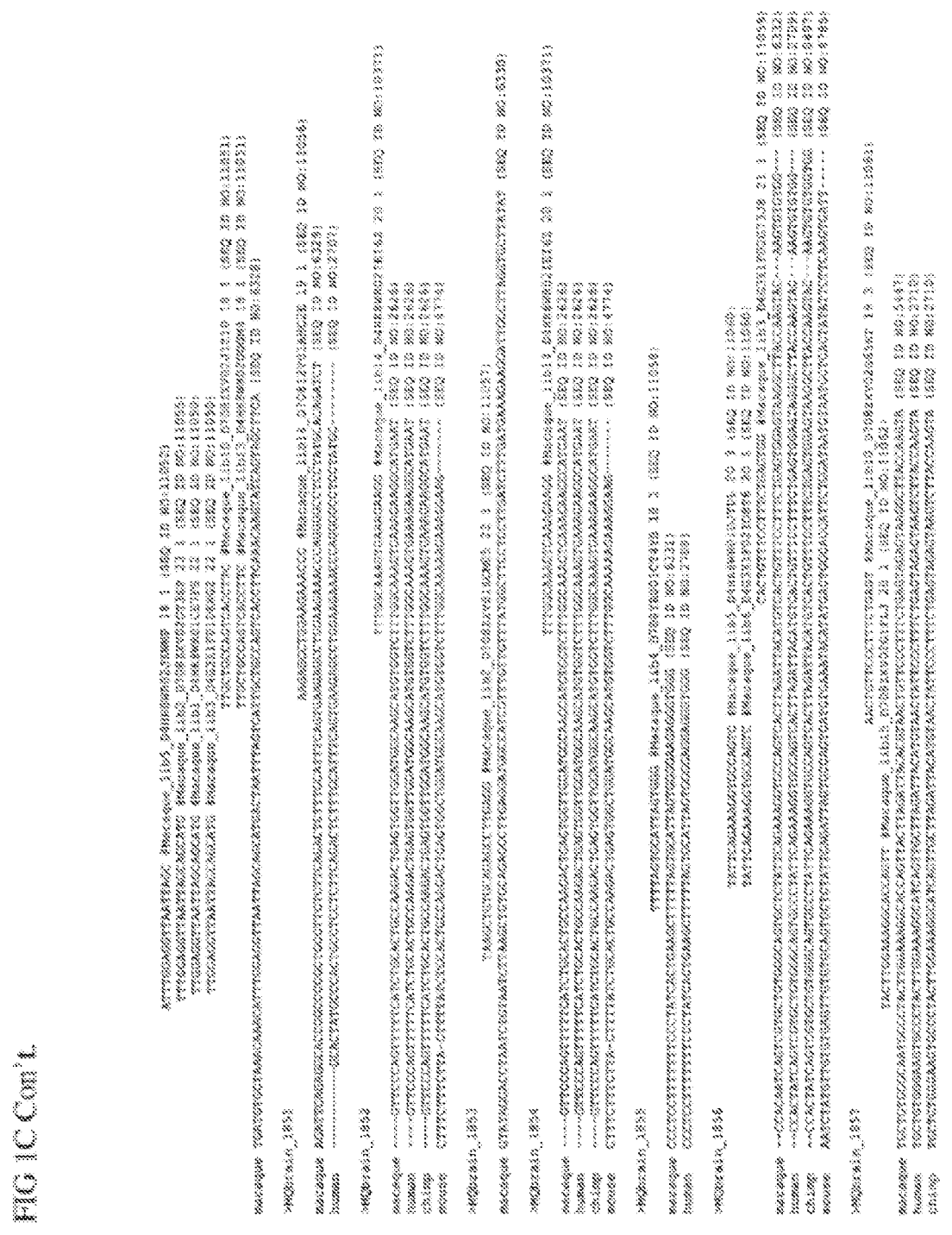
Figure 1C:
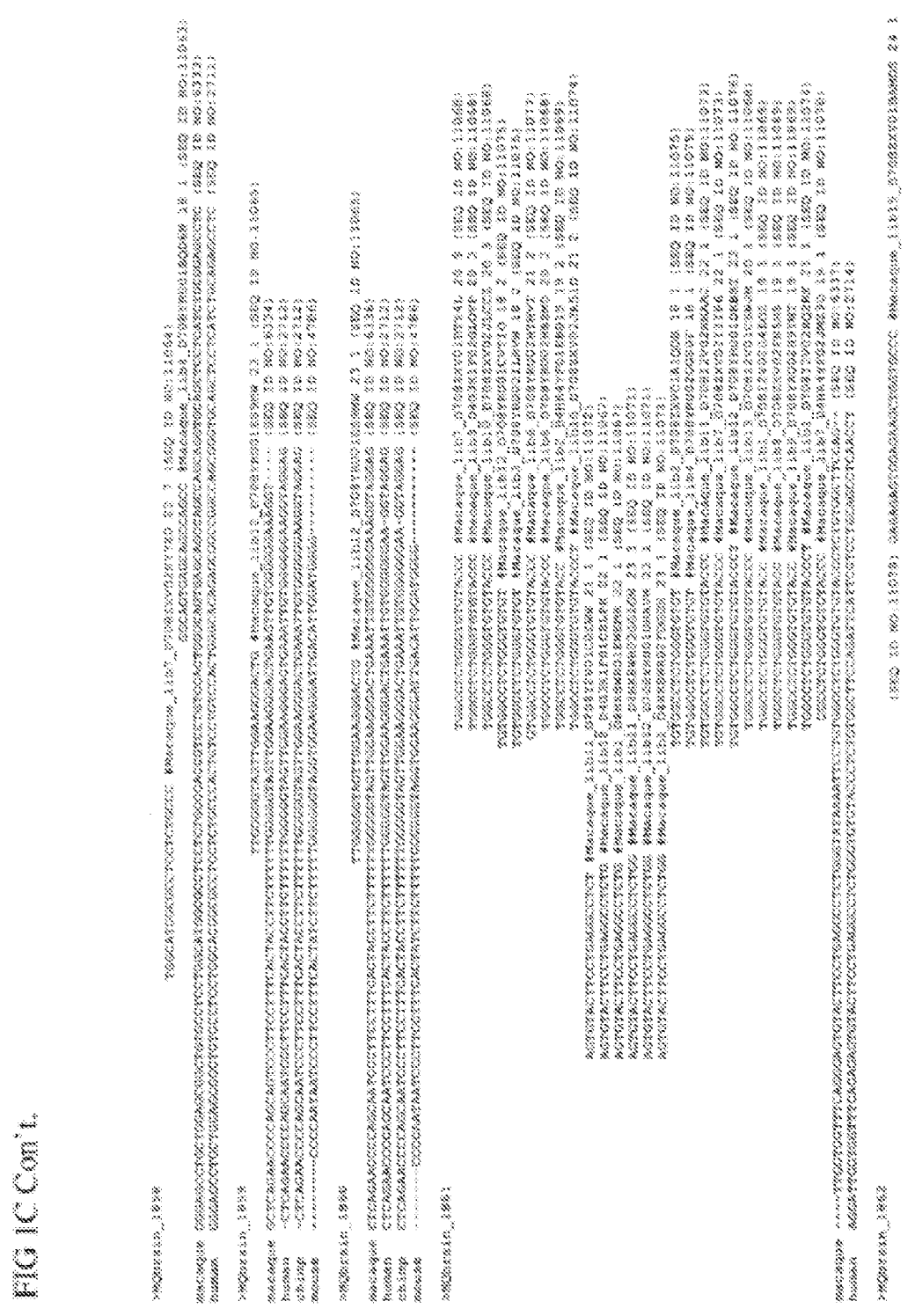
Figure 1C:
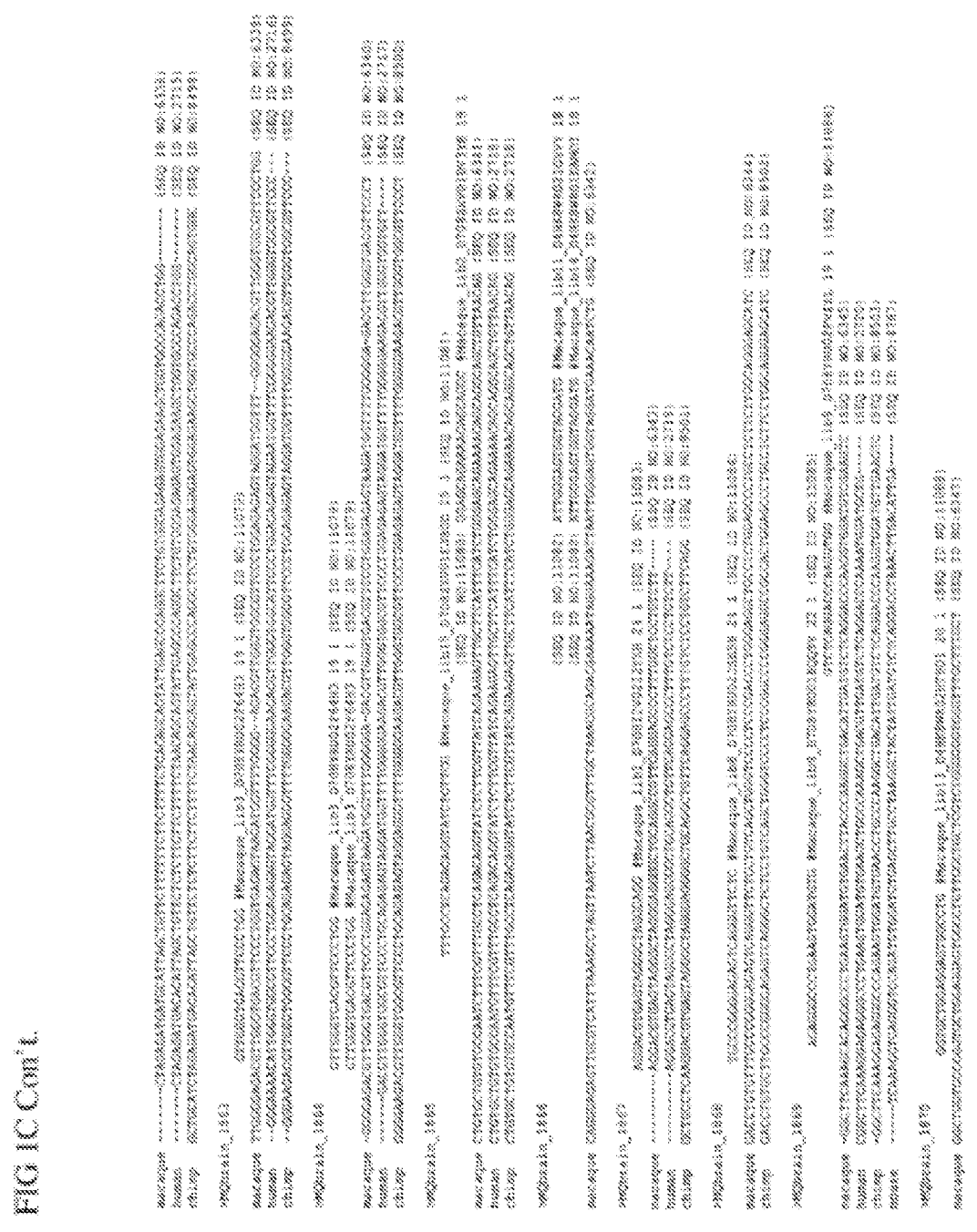
Figure 1C:
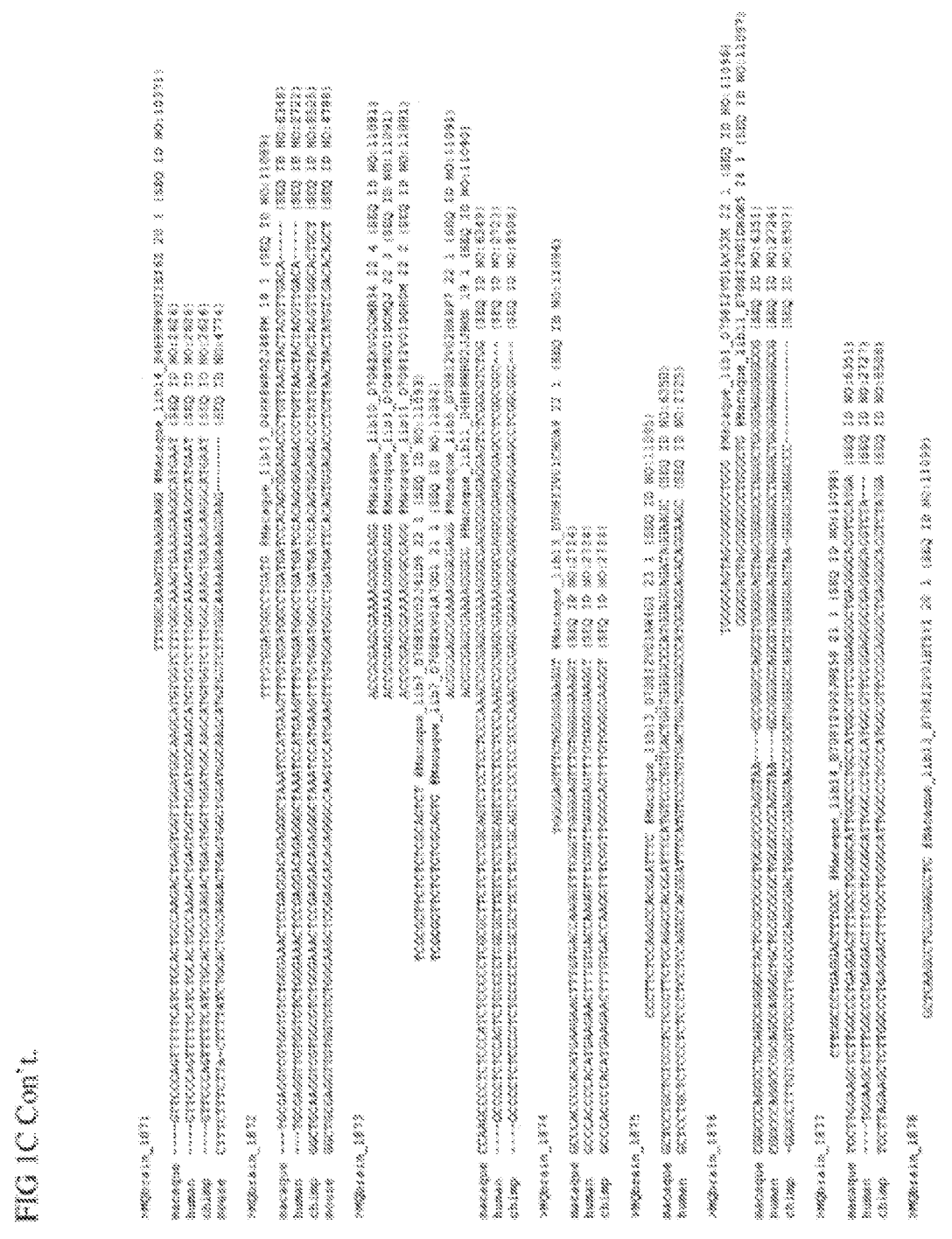
Figure 1C:
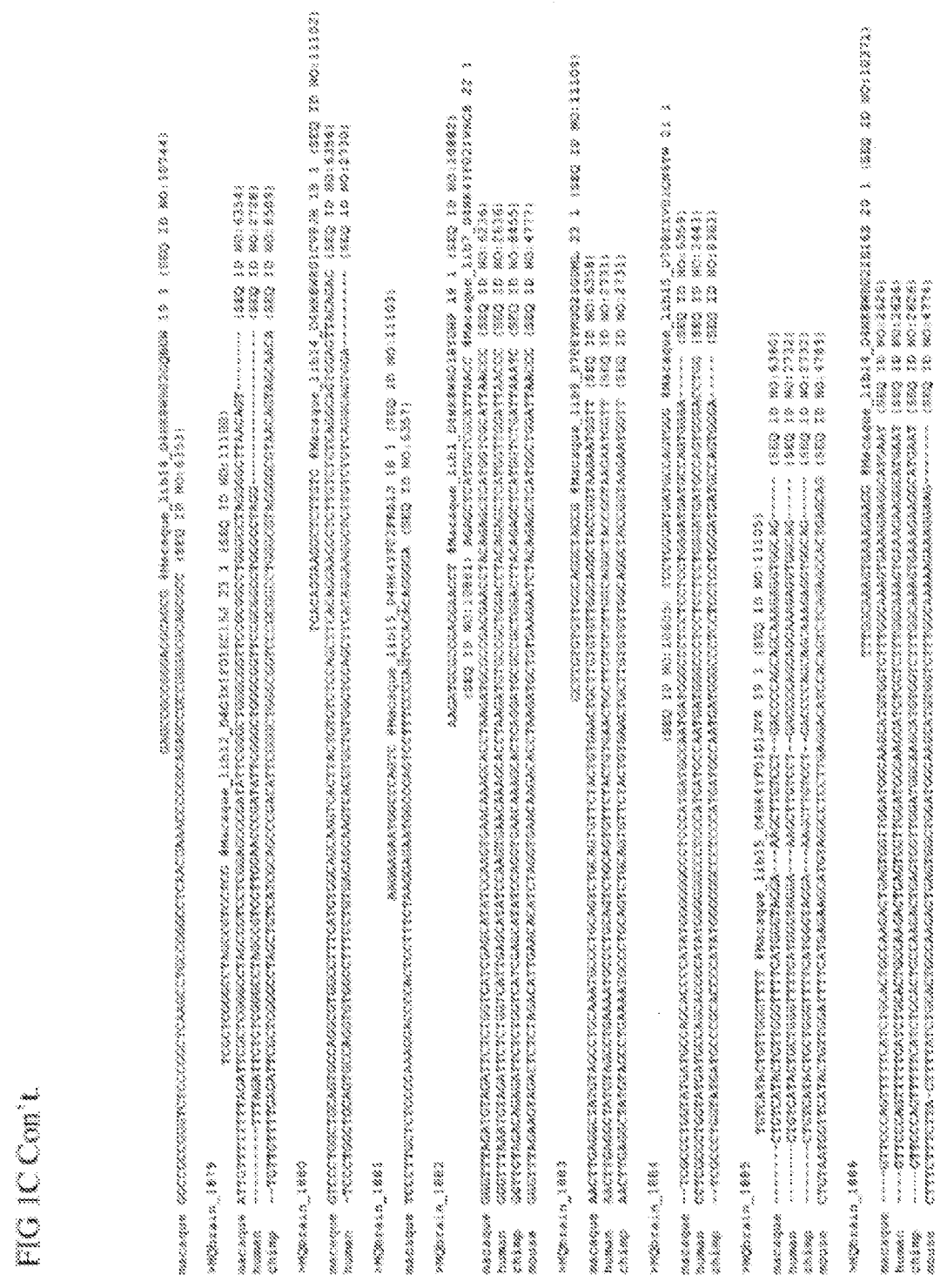
Figure 1C:
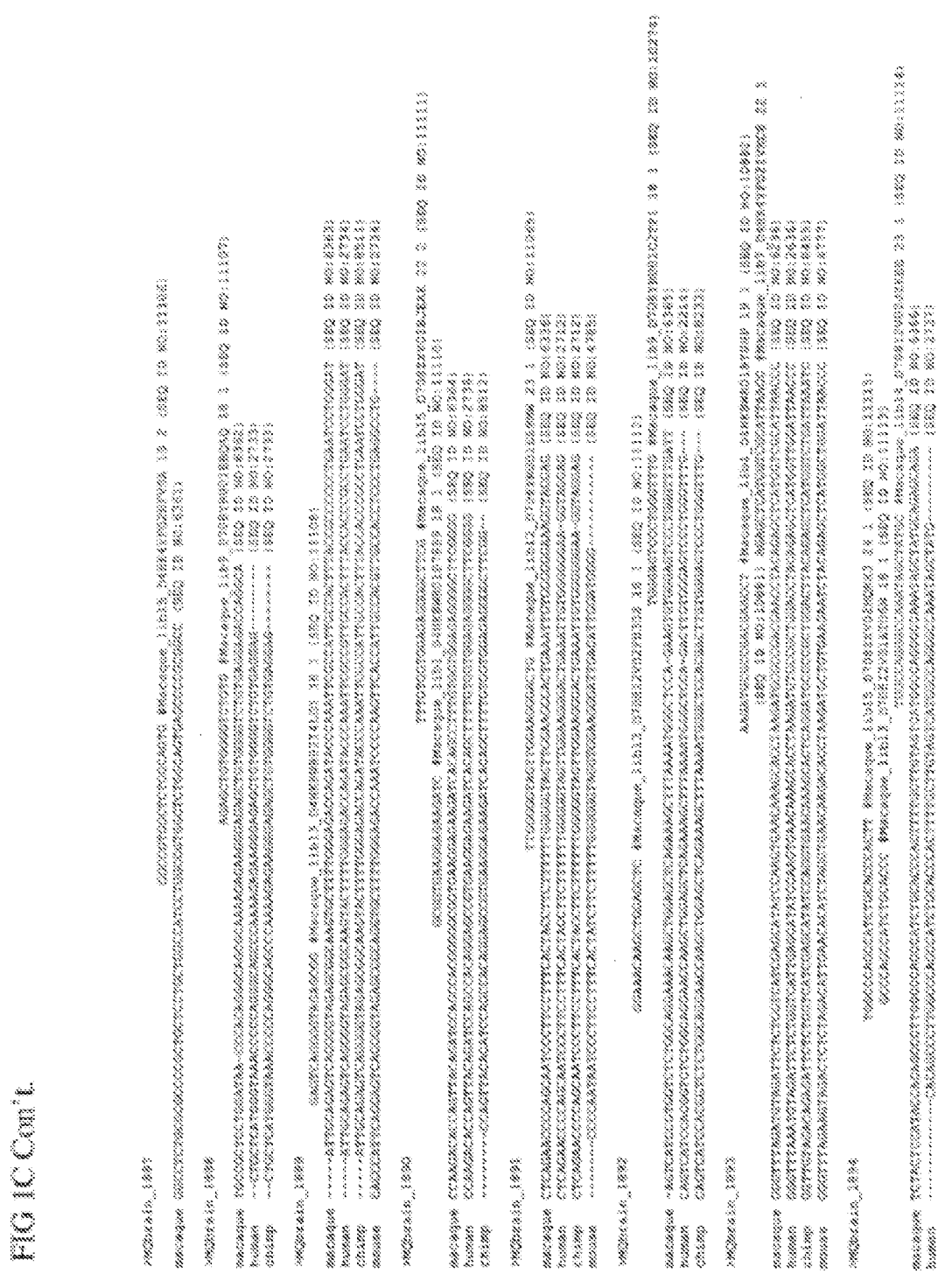
Figure 1C:
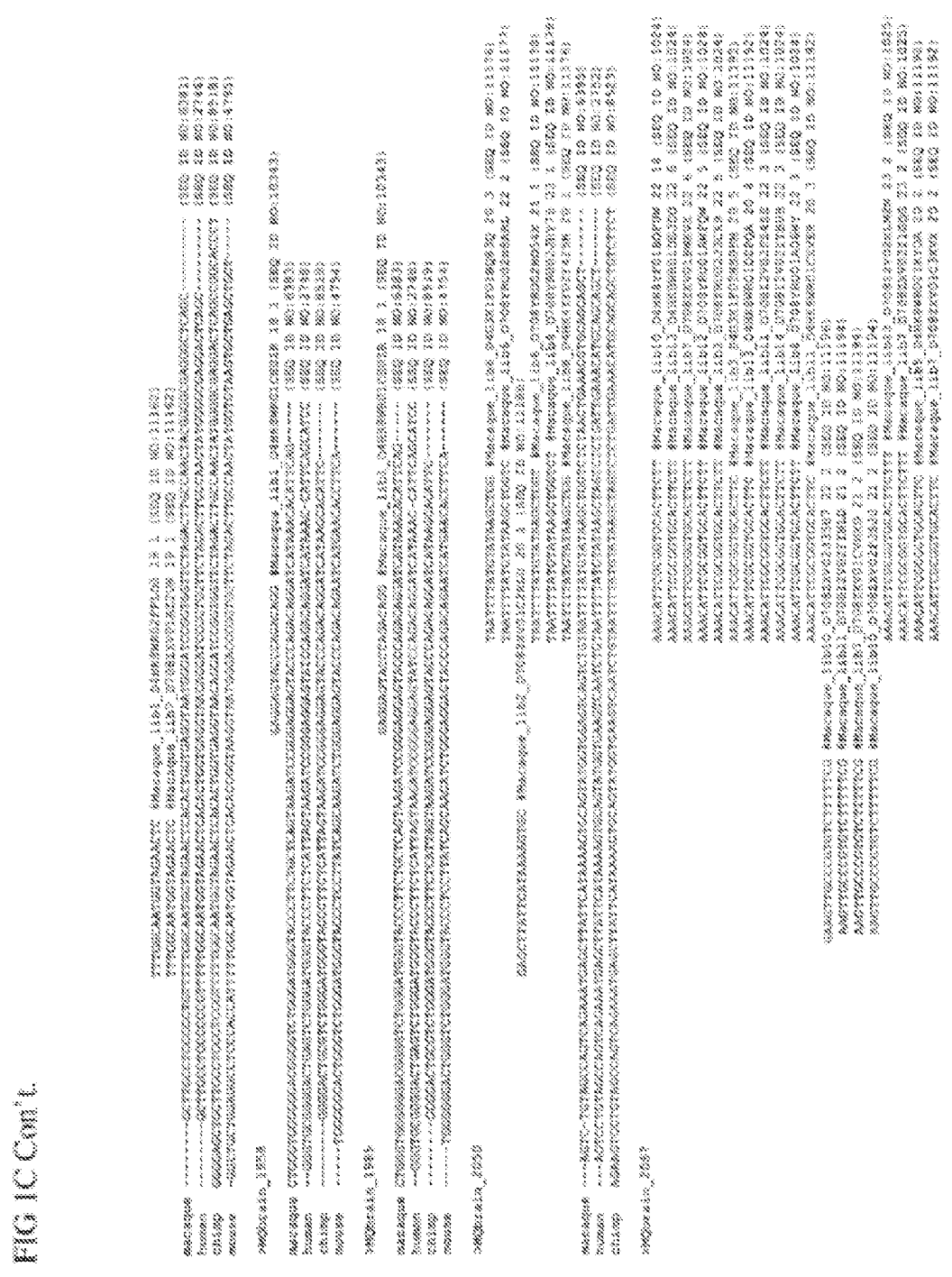
Figure 1C:
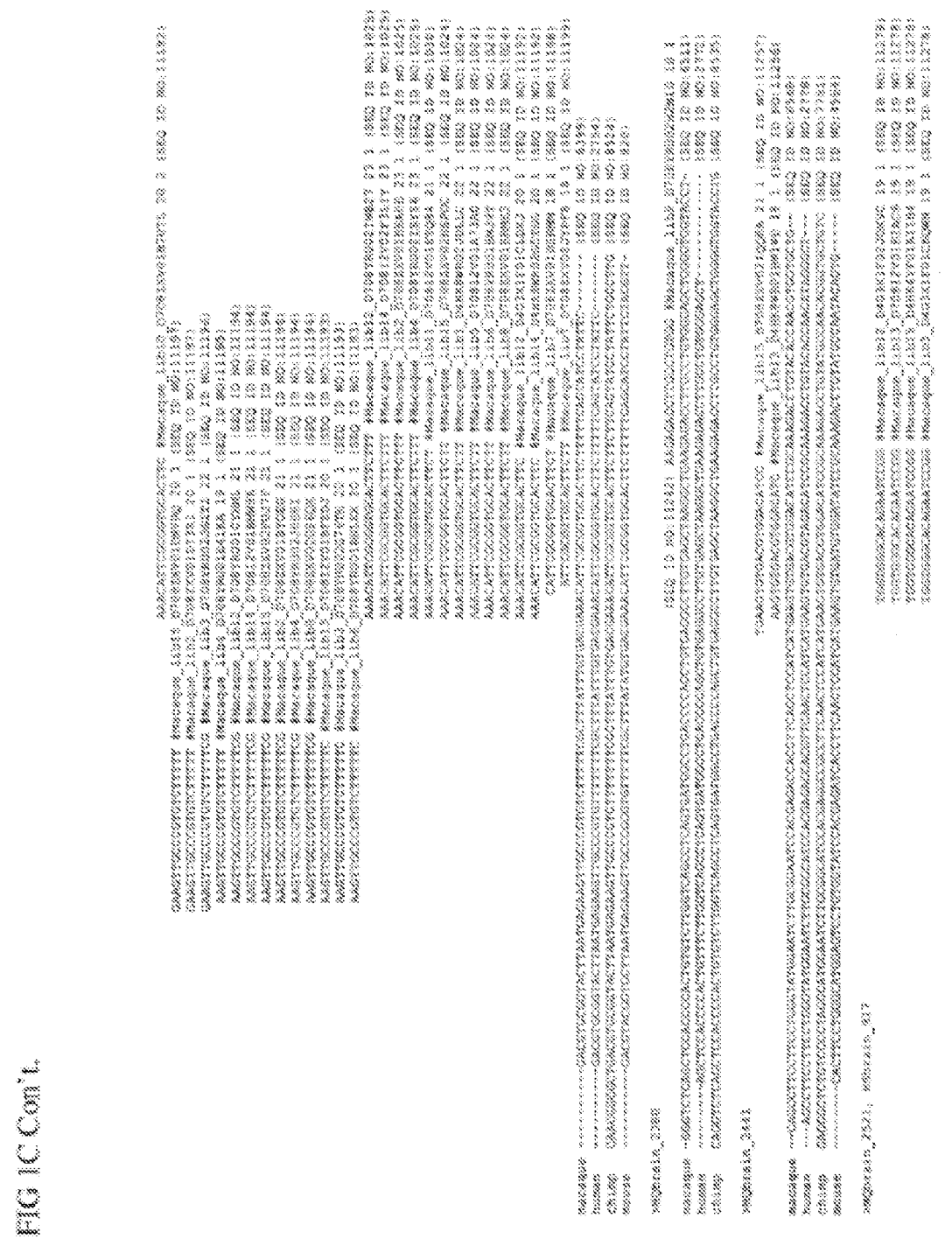
Figure 1C:
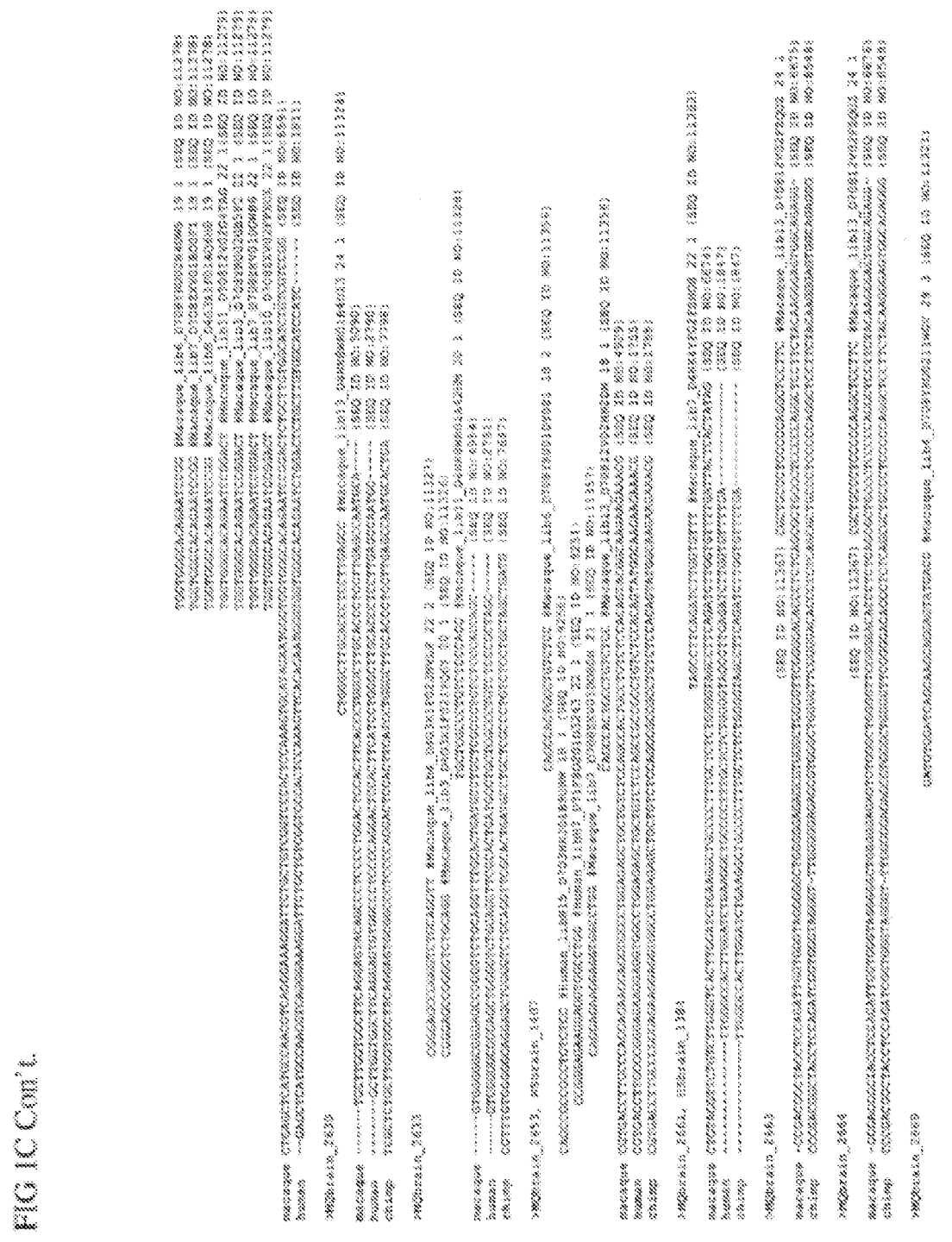
Figure 1C:
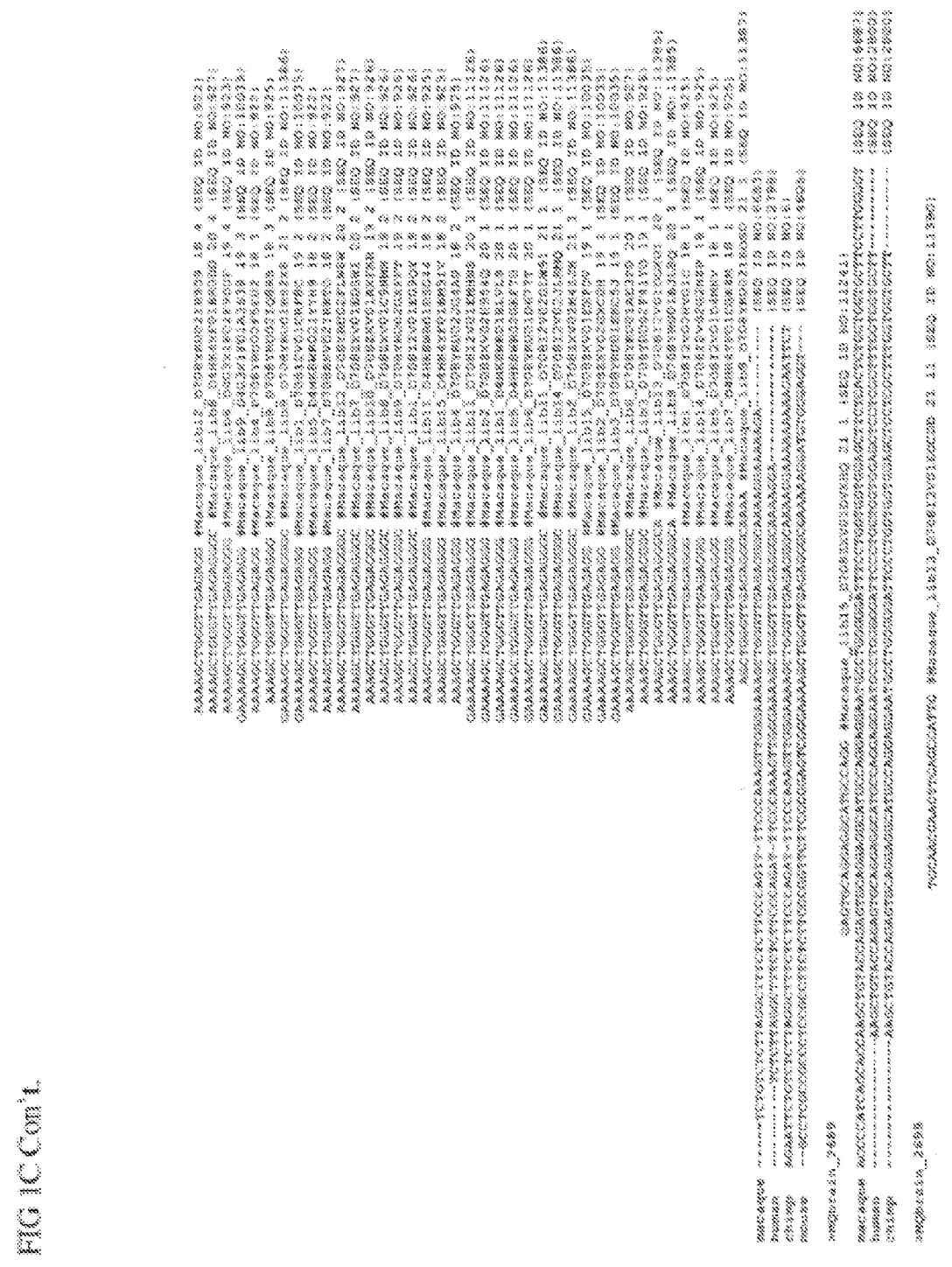
Figure 1C:
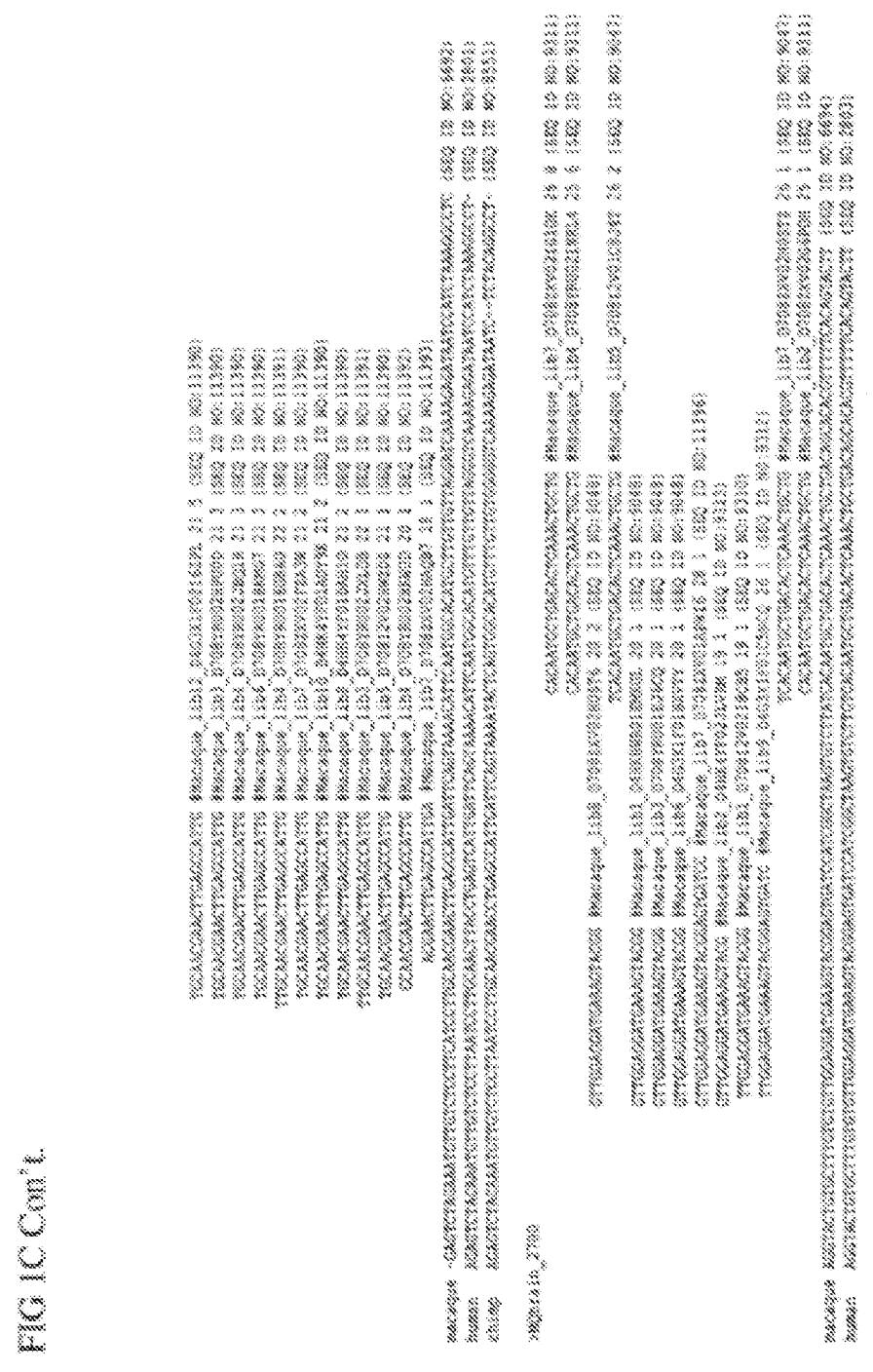

Modified RAKE microarray results. Hybridization results for a single positive tissue (mouse 8.5 dpc embryo, 16.5 dpc embryo, brain or embryonic stem (ES) cells) doe all probes in a tiling path are shown for every novel miRNA. Hairpin sequences are shown where numbers indicate the most '3 end of the respective probe on the RAKE microarray. The small images show the raw results for the respective probes. Annotation (cand*** probe %%) refers to the positive probe and matches experimental evidence annotation for the mature miRNAs in FIG. 1.

FIG. 3

Schematic representation of mature miRNA and the corresponding hairpin RNA. The miRNA is depicted as a light box and the remainder of the hairpin as a dark (box/line). The scheme is not to scale.

FIG. 4

List of sequence ID numbers of the sequence listing for the most abundant or longest human mature sequence as determined by cloning.

FIG. 5

List of sequence ID numbers of the sequence listing for the most abundant or longest mouse mature sequence as determined by cloning.

FIG. 6

Figure 2:
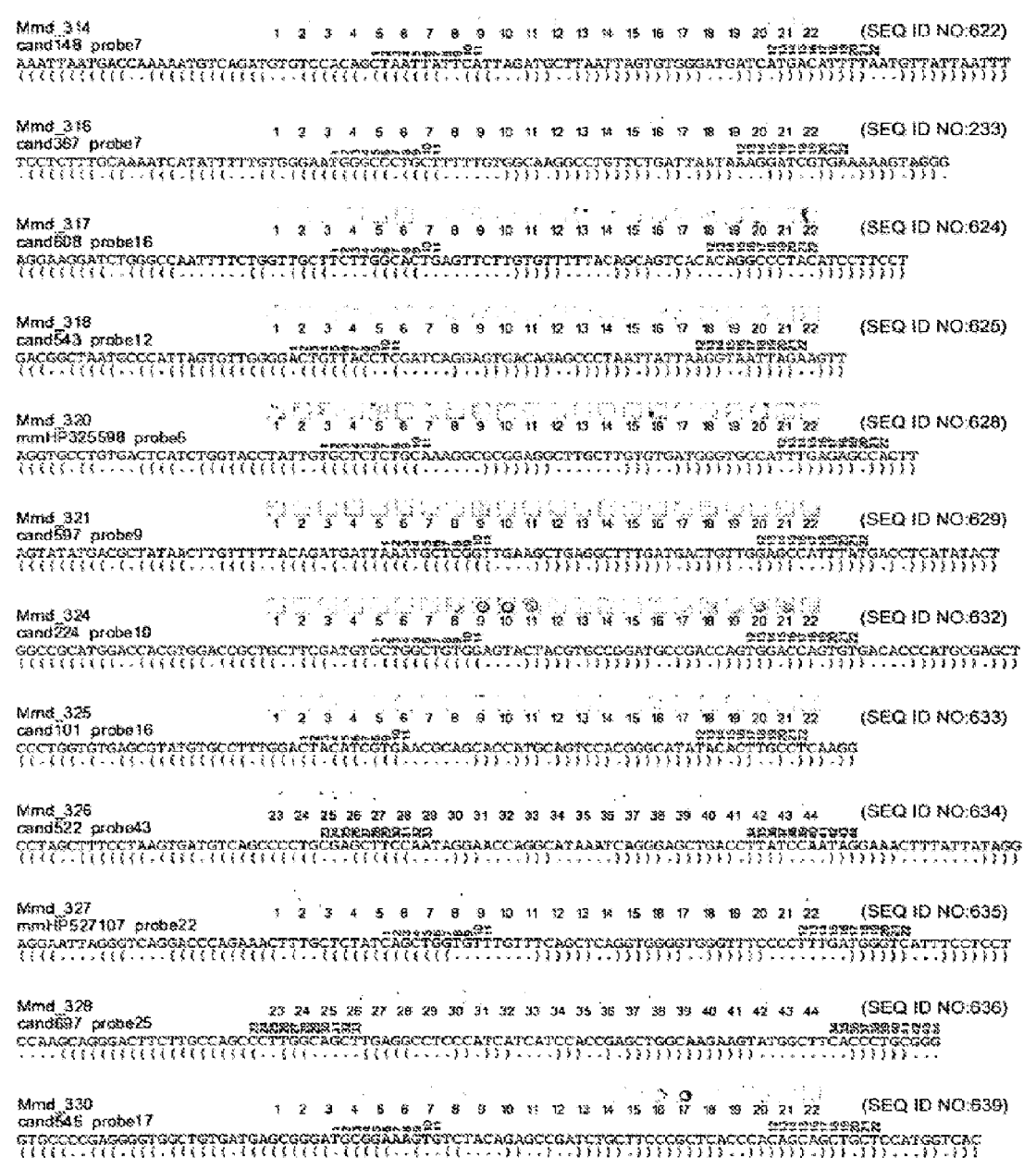

List of sequence ID numbers of the sequence listing from the human mature sequences from FIG. 2 for which the mouse orthologs have evidence for differential expression in RAKE experiments (mouse embryo 8.5 dpc, mouse embryo 16.5 dpc, mouse brain, mouse ES cells). Only mature sequences that were cloned in human are included here.

FIG. 7

Figure 3:
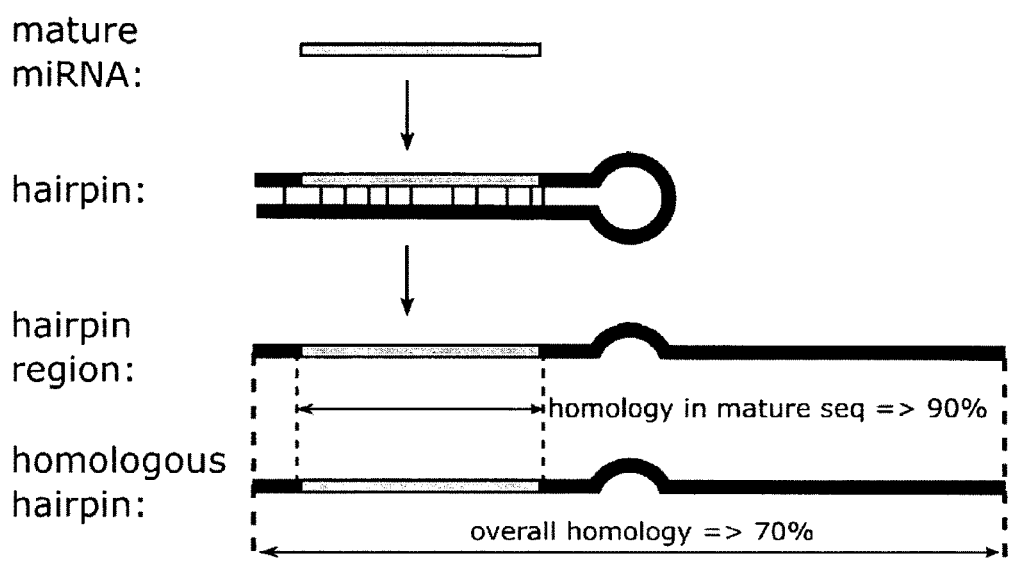
Figure 10:
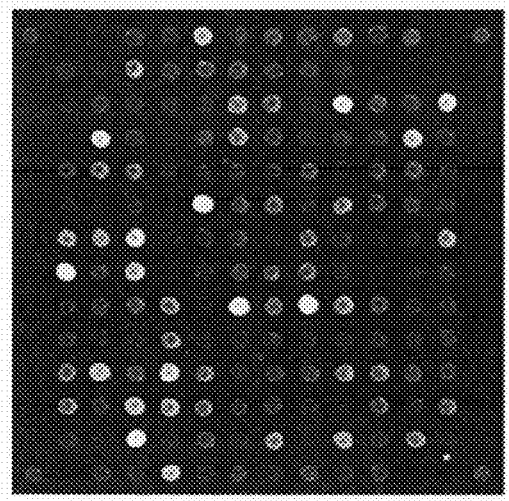

List of sequence ID numbers of the sequence listing the mouse mature sequences from FIG. 3 that have evidence for differential expression in RAKE experiments (mouse embryo 8.5 dpc, mouse embryo 16.5 dpc, mouse brain, mouse ES cells). Probe sequences that were not necessarily cloned in mouse are included.

FIG. 8

List of sequence ID numbers of the sequence listing human mature microRNA sequences that are differentially expressed (more than 2-fold up or down) in either glioblastoma versus normal brain tissue or adenoma versus normal lung tissue or in both (from FIGS. 11 and 12).

FIG. 9

List of sequence ID numbers of the sequence listing of human mature microRNA sequences that are differentially expressed (more than 2-fold up or down) in both glioblastoma versus normal brain tissue and adenoma versus normal lung tissue (from FIGS. 11 and 12).

FIG. 10

Dual color image of part of the raw microarray expression results for normal lung tissue (red) compared to adenoma tumor material (green). microRNAs that are upregulated or downregulated in tumor material show up as green and red, respectively. microRNAs that do not change expression are yellow and non-expressed microRNAs appear black.

FIG. 11

Differential expressed microRNAs between glioblastoma and normal control brain tissue.

FIG. 12

Differential expressed microRNAs between adenoma and normal control lung tissue.

EXAMPLES

Material and Methods

Sequencing and Analysis of miRNA Regions in Primates.

Nested primer sets for PCR amplification of ~700 bp regions for 144 known miRNA genes were designed using custom interface to primer3 software (http://primers.niob.knaw.nl). Primer selection was based solely on human sequences. Genomic DNAs of 10 primate species (NA Aging Cell Repository DNA Panel PRP00001) were purchased from Coriell Cell Repositories (Camden, N.J.). All PCR reactions were carried out in a total volume of 10 μl with 0.5 Units Taq Polymerase (Invitrogen, Carlsbad Calif.) according to the manufacturer's conditions and universal cycling conditions (60 seconds 94° C., followed by 30 cycles of 94° C. for 20 seconds, 58° C. for 20 seconds and 72° C. for 60 seconds). PCR products were sequenced from both ends using an ABI3700 capillary sequencer (Applied Biosystems, Foster City Calif.). Sequences were quality trimmed and assembled using phred/phrap software (Ewing et al., 1998, Gordon et al., 1998) and aligned using POA (ee et al., 2002).

Computational Prediction of miRNA Genes

All the analyses were performed using in-house developed software (Perl) when not stated otherwise. Whole-genome alignments (WGA) for human (July 2003 assembly), mouse (October 2003 assembly) and rat (June 2003 assembly) were downloaded from the UCSC Genome Bioinformatics site (at the Worldwide Web URL genome.uscsc.edu). We first screened WGAs for blocks that fit miRNA-like conservation profile, i.e. have a conserved stem-loop region of .about.100 nt and non-conserved flanks of .about.50 nt. Technically, for every position we first calculated the percentage of conservation over a sliding window of 15 nt and assigned a value from 0 to 9 and 'o', where 'o' represents 100% identity, 9 between 90 and 100%, etcetera. Next, the resulting conservation string was searched by the following regular expression to define the conservation profile: /([0-8]{50,60})([o98]{53,260})([0-8]{50,60})/. At the next step we used RNAfold software (Hofacker, 2003) to evaluate the potential of conserved regions to form fold-back structures. The secondary structures matching the following regular expression were accepted: /((\((?:\.*\( ) {24,})(\.{2,17}|\.*\({1,8}\.*\){1,8}\.*\({1,8}\.*\){1,8}\.*\)(\)(?:\.*\))–{50,})/x (detailed scripts are available from the authors upon request). This step resulted in 12,958 candidate regions from human/mouse alignments and 12,530 candidate regions from human/rat alignments, which included 167 and 154 known human miRNAs, respectively. The original human/mouse and human/rat WGAs contained 187 and 172 annotated human miRNAs (miRNA registry v.3.1), respectively. Thus, the combined sensitivity of conservation profiling and fold-back structure selection steps is almost 90%. We did not calculate directly the contribution of the first, conservation-profiling, step to the filtering of candidate miRNA regions. It was reported previously, however, that about 800,000 stem-loops could be identified in conserved human/mouse non-coding regions (Lim et al., 2003). Therefore, we can estimate that conservation profiling is a very efficient filter that removes more than 98% of all potential fold-back structures while retaining 90% of real miRNAs. In cases where overlapping candidate regions were predicted on different DNA strands, the candidate with lower free folding energy was selected. This 'naive' approach correctly identified the orientation of 144 known miRNAs out of 165 tested (87%).

As the third filtering step we used a recently discovered property of miRNAs to have lower folding free energies than random sequences with the same nucleotide content (Bonnet et al., 2004). Application of the Randfold program (filtering for regions with $p<=0.005$) further reduced the number of candidates 18-fold, to 716 for human/mouse and 639 for human/rat datasets. The sensitivity of this filtering step, when using p<=0.005 cutoff for randfold value, is about 85% (143 of 167 known miRNAs retained in human/mouse-, and 134 of 154—in human/rat dataset). The cutoff value of 0.005 is very stringent but provides an optimal sensitivity/specificity ratio for filtering.

Next, we intersected human/mouse and human/rat predictions using human genomic coordinates and orientation. It appeared that only 379 candidate regions that included 119 known miRNAs, were predicted in both datasets, and a substantial fraction of the predictions was set-specific, i.e. 337 candidates that include 24 known miRNAs, were found in human/mouse but not in human/rat WGA, whereas 260 candidates (including 15 known miRNAs) were found in human/rat but not human/mouse datasets. The detailed analysis of non-overlapping predictions revealed that about two thirds of them actually could be mapped to the corresponding genomic regions in the second rodent species (mouse predictions to the rat genome and vice versa) but failed to satisfy either conservation profiling or randfold criteria (for rodent sequences) or were simply not present in the initial WGA and hence were not picked up by our computational pipeline in a particular dataset. This analysis illustrates the value of combining data from two rodent species rather than concentrating on one, e.g. human/mouse, dataset.

In total, we have identified 976 candidate miRNA regions that satisfy the following criteria: (1) have characteristic miRNA-like conservation profiles in human/mouse or human/rat alignments; (2) form fold-back structures, and (3) have randfold value $p<=0.005$ for both human and rodent sequences. These 976 candidate regions included 158 known miRNAs (based on data from miRNA registry v.3.1). The initial whole-genome human/murine alignments, then combined, covered 189 known miRNAs. Therefore, the sensitivity of our analysis, based on this dataset, is 83% (158/189). At the same time, the specificity of the predictions ideally should be inferred from experimental verifications of all predictions. It is possible, however, to use conservation of candidate regions in additional genomes as an indirect measure of robustness of predictions. We have used zebrafish, chicken, opossum, cow and dog genomes to search for orthologs of our predicted candidates. Since opossum and cow genomes were not assembled at the time of analysis, we utilized Genotrace software (Berezikov et al., 2002) to make partial assemblies of regions of interest from trace data. The region from a genome was considered as orthologous to the candidate region if it (1) had at least 16 identical matches to the candidate sequence in at least 18 bp long hit, (2) was folded into a hairpin and (3) passed the randfold free energy criterion. It appeared that 678 out of 976 candidates (~70%) are conserved in at least one more species besides rodents.

To produce additional candidate microRNA genes, the mouse genome was scanned for potential hairpins with a sliding window of 100 nt, and randfold values were calculated for resulting hairpins (mononucleotide shuffling, 1000 iterations). From a large set of hairpins that have low randfold values but are not necessarily conserved in other species, a subset of 199 was randomly selected.

Characterization of Candidate miRNA Regions

To put the predicted miRNA candidates into genomic context, we used the Ensembl (version 24) annotation of the human genome. We have searched our candidates against the ncRNA subset of the FANTOM database (Okazaki et cd., 2002) and found that 3 regions (cand428, cand523 and cand420) overlap with or reside next to non-coding RNAs. Data for Affymetrix high-resolution tiling arrays (Kapranov et al., 2002) were downloaded from the UCSC Genome web site hgdownload.cse.ucsc.edu/goldenPath/10april2003/database/affyTranscription.txt.gz and affyTransfrags.txt.gz), remapped to the July 2003 human genome assembly and intersected with candidate region predictions. Candidate regions that overlapped or resided within 50 bp from an annotated Transfrag region were associated with a given Transfrag fragment.

Northern Blot Analysis of Predicted miRNA Regions

We performed Northern blot analysis of 69 candidates representing different subgroups of candidates, such as broadly (zebrafish) or narrowly (rodents only) conserved, clustered or in families, located in introns, exons or intergenic. We limited our analysis to testing the expression of miRNAs in 3 mouse embryonic stages (8.5, 12.5 and 16.5 dpc), mouse ES cells, and mouse brain. Since we cannot predict the exact position of the mature miRNA in a stem, we used 35 nt-long probes that cover most of the hairpin arm. The arm containing a mature miRNA sequence was predicted on the basis of conservation level. For some candidate regions both arms of the hairpin were tested. For the candidates conserved in zebrafish, we also performed Northern blot analysis on RNA from zebrafish embryos (7, 14, 21 and 28 days) and a Dicer mutant (Wienholds et al., 2003).

RNA was isolated using mirVana miRNA isolation kit (Ambion, Austin Tex.), separated on 12% denaturing polyacrylamide gels alongside RNA Decadeä marker (Ambion, Austin Tex.), transferred by electroblotting to positively charged nylone membranes (Roche, Basel). Blots were hybridized overnight at 37° C. with radioactively (32P) labeled DNA oligo probes in modified Church and Gilbert buffer, washed three times with 2×SSC, 0.1% SDS at 37° C., and visualized using phosphoimaging (Typhoon, Amersham, UK). In some cases (cand181 and cand707), mature bands were detected only after a weeklong exposure of a blot, indicating the sensitivity limits of Northern blot analysis.

RAKE Microarray Design and Analysis

The microarray for verification of candidate microRNAs using the RAKE assay was designed as a 44K custom microarray (Agilent Technologies, Palo Alto Calif., USA). 60-mer probes that are attached to the glass surface with their 3'-end were designed to include a fully matching probe sequence of 25 nucleotides complementary to the predicted microRNA with universal spacers on each side (5'-end, 5'-spacer: CGATCTTT (SEQ ID NO:12413), sequence of nt complementary to the microRNA candidate region (tiling path), 3'-spacer: TAGGGTCCGATAAGGGTCAGT-GCTCGCTCTA (SEQ ID NO:12414), 3'-end attached to glass surface). The three T's in the 5'-spacer function as a template for Klenow-mediated microRNA extension using biotin-dATP. A tiling path of 11 nucleotides was designed to cover the most likely Dicer/Drosha cleavage site determined at 22 nt upstream and downstream from the terminal loop extended to contain at least 11 unpaired nucleotides. For all cases, probes were designed for both arms of the hairpin sequence and for 648 candidates an additional set of 2×11 probes was designed as the transcript originating from the antisense genomic sequence can also efficiently fold into a stable hairpin structure. All 22/44 probes for a candidate microRNA were located in clusters on the array to exclude regional background effects. 10 different hybridization controls complementary to plant microRNAs (miR-402, UUC-GAGGCCUAUUAAACCUCUG (SEQ ID NO:12415); miR-418, UAAUGUGAUGAUGAACUGACCU (SEQ ID NO:12416); miR-167, UGAAGCUGCCAGCAUGAT-CUGG (SEQ ID NO:12417); miR-416, GGUUCGUACGUACACUGUUCAU (SEQ ID NO:12418); miR-173, UUCGCUUGCAGAGAGAAAUCAC (SEQ ID NO:12419); miR-417, GAAGGUAGUGAAUUUGUUC- GAC (SEQ ID NO:12420); miR-163, GAAGAGGACUUG-GAACUUCGAU (SEQ ID NO:12421); miR-419, UUAUGAAUGCUGAGGAUGUUGU (SEQ ID NO:12422); miR-405, GAGUUGGGUCUAAC-CCAUAACU (SEQ ID NO:12423); miR-420, UAAAC-UAAUCACGGAAAUGCAC (SEQ ID NO:12424)) were represented 10 times randomly distributed on the array. Microarrays were scanned on an Agilent scanner model G2565B at 10μm resolution and spot identification and intensity determination was done using Agilent Feature Extraction software (Image Analysis version A.7.5.1) with standard settings. To permit manual inspection and annotation of mature microRNA sequences, the raw images and spot intensity data were processed using custom scripts and visualized together with tiling path sequence information. Web-based interfaces were designed for annotation of single experiments and for summarizing all experiments. After manual inspection, all novel mature microRNA sequences that were positive were fed into the bioinformatic analysis pipeline set up for the evaluation of the cloned small RNAs, to filter out signal originating from repetitive elements and structural RNAs and to find homologous miRNAs in other species.

Modified RAKE Assay

The original RAKE assay (Nelson et al., 2004) was modified for use with high-density custom-printed microarrays in the Agilent platform. Most importantly, in contrast to most custom-spotted micro-arrays, custom-printed probes are attached with their 3'-end to the glass surface. This excludes the need for the exonuclease that was included in the original protocol to reduce background signal from fold-backs of the free 3-ends of the probes that result in double-stranded DNA structures that can function as a template for the Klenow extension, resulting in aspecific background signal. Furthermore, hybridization, washing, and incubation conditions were adapted. All hybridization and wash buffers were made fresh from autoclaved stock solutions using DEPC-treated water, filter-sterilized and pre-heated. Microarray slides and coverslips were pre-washed two times for 2 minutes at 37° C. with preheated wash buffer (2×SSPE, 0.025% N-lauroylsarcosine), followed by 5 minute incubation with pre-hybridization buffer (5×SSPE, 40% formamide, 0.025% N-lauroylsarcosine). Next, the Agilent hybridization chamber was completely filled with hybridization mix, leaving no air-bubbles, as the usual air-bubble for mixing does not move around at low temperature and with the hybridization mix used. The hybridization mix (750 μl total per slide) consists of 500 μl 1.5× hybridization buffer (7.5×SSPE, 60% formamide, 0.0375% N-lauroylsarcosine), 10 μl spike-in RNA (control plant microRNAs stock: miR-402, $1 \times 10^{-6}$ M; miR-418, $3.3 \times 10^{-7}$ M; miR-167, $1 \times 10^{-7}$ M; miR-416, $3.3 \times 10^{-8}$ M; miR-173, $1 \times 10^{-8}$ M; miR-417, $3.3 \times 10^{-9}$ M; miR-163, $1 \times 10^{-9}$ M; miR-419, $3.3 \times 10^{-10}$ M; miR-405, $1 \times 10^{-10}$ M; miR-420, $3.3 \times 10^{-11}$ M), and 20 μg small RNA sample (8.5 dpc and 16.5 dpc mouse embryo, mouse embryonic stem (ES) cells and total brain), isolated using the MirVana microRNA isolation kit (Ambion, Austin Tex., USA) and supplemented with DEPC-treated water up to 240 μl. The hybridization mix was heated to 75° C. for 5 minutes and cooled on ice before application to the array. The array was incubated overnight at 37° C., followed by 4 washes of 2 minutes in wash buffer and 1 wash for 2 minutes in 1×Klenow buffer (10 mM Tris pH7.9, 50 mM NaCl, 10 mM MgCl$_2$, 1 mM DTT, 0.025% N-lauroylsarcosine). For the Klenow extension, an enzyme mix (750 μl total per slide) containing 375 μl 2×Klenow buffer, 365 μl DEPC-treated water, 2.5 μl Klenow Exo-(50,000 U/μl, NEB, Ipswich Mass., USA), and 7.5 μl biotin-14-dATP (4 μM stock, Perkin Elmer, Wellesley Mass., USA) was applied to the array in a clean incubation chamber and incubated for 1 hour at 37° C. Next, the array was washed four times for 2 minutes with wash buffer and once for 2 minutes with 1×Klenow buffer. Next, the dye conjugation mix (total volume 750 μl) consisting of 375 μL 2×Klenow buffer, 368 μl DEPC-treated water and 20 μl streptavidin-conjugated Alexa fluor-647 (2 mg/ml stock, Invitrogen, Carlsbad Calif., USA) was applied in a new incubation chamber for 30 minutes at 37° C., followed by four washes of 2 minutes at 37° C. with wash buffer and 5 brief dips in DEPC water to remove salts. Slides were dried by centrifugation in a 50 ml tube by spinning for 5 minutes at 1000 rpm (180×g).

Small RNA Library Construction by Bacterial Cloning and Dideoxy Sequencing of Inserts.

Seven high-titer small RNA libraries were made. Briefly, the small RNA fraction from adult mouse brain (12 weeks) and various human fetal tissues (17 weeks of development: brain; heart; skin; lung; mix 1: multiple fetal tissues; mix 2: liver, stomach, bowel) was isolated using the mirVana microRNA isolation kit (Ambion), followed by an additional enrichment by excision of the 15 to 30 nt fraction from a polyacrylamide gel. For cDNA synthesis the RNA molecules in this fraction were first poly A-tailed using yeast poly(A) polymerase followed by ligation of a RNA linker oligo to the 5' phosphate of the miRNAs. First strand cDNA synthesis was then performed using an oligo(dT)-linker primer and M-MLV-RNase H-reverse transcriptase. The resulting cDNA was then PCR amplified for 15 to 22 cycles (depending on the start material quality and quantity), followed by restriction nuclease treatment, gel purification of the 95-110 bp fraction, and cloning in the EcoRI and BamHI sites of the pBSII SK+ plasmid vector. Ligations were electroporated into T1 Phage resistant TransforMaxTMEC100™ electrocompetent cells (Epicentre), resulting in titers between 1.2 and 3.3×10$^6$ recombinant clones per library. A total of 83,328 colonies were automatically picked into 384-well plates (Genetix QPix2, New Milton Hampshire, UK) containing 75 μl LB-Amp and grown overnight at 37° C. with continuous shaking. All following pipetting steps were performed using liquid handling robots (Tecan (Mannedorf, Switzerland) Genesis RSP200 with integrated TeMo96 and Velocity11 (Menlo Park Calif., USA) Vprep with BenchCell 4×). 5 μl of culture was transferred to a 384-well PCR plate (Greiner, Mannheim, Germany) containing 20 μl water, and cells were lysed by heating for 15 minutes at 95° C. in a PCR machine. 1 μl of lysed suspension was transferred to a fresh 384-wells plate containing 4 μl PCR mix (final concentrations: 0.2 μM M13 forward, TGTAAAACGACGGCCAGT (SEQ ID NO:12425); 0.2 μM M 13reverse, AGGAAACAGCTAT-GACCAT (SEQ ID NO:12426), 400 μM of each dNTP, 25 mM tricine, 7.0% glycerol (w/v), 1.6% DMSO (w/v), 2 mM MgCl2, 85 mM ammonium acetate pH 8.7 and 0.2 U Taq Polymerase in a total volume of 10 μl) and the insert was amplified by 35 cycles of 20" 94° C., 10" 58° C., 30" 72° C. After adding 30 μl water, 1 μl of PCR product was directly used for dideoxy sequencing by transferring to a new 384-well PCR plate containing 4 μl sequencing mix (0.027 μl BigDye terminator mix v3.1 (Applied Biosystems, Foster City, Calif., USA), 1.96 μl 2.5× dilution buffer (Applied Biosystems), 0.01 μl sequencing oligo (100 μM stock T7, GTAATACGACTCACTATAGGGC (SEQ ID NO:12427)), and 2 μl water). Thermocycling was performed for 35 cycles of 10" 94° C., 10" 50° C., 20" 60° C. and final products were purified by ethanol precipitation in 384-well plates as recommended by the manufacturer (Applied Biosystems) and analyzed on ABI3730XL sequencers with a modified protocol for generating approximately 100 nt sequencing reads.

Library Construction for Massively Parallel Sequencing

High-titer small RNA libraries were made by Vertis Biotechnology AG (Freising-Weihenstephan, Germany) from human male fetal brain and juvenile male chimpanzee brain (7 years). For human fetal tissue, individual permission using standard informed consent procedures and prior approval of the ethics committee of the University Medical Center Utrecht were obtained. Chimpanzee material was obtained from a cryopreserved resource (BPRC). Briefly, the small RNA fraction from adult chimpanzee brain sections (temporal, frontal, and oxcipital lobes and brain stem) and from human fetal brain (mixed composition) was isolated using the mirVana microRNA isolation kit (Ambion), followed by an additional enrichment by excision of the 15 to 30 nt fraction from a polyacrylamide gel. For cDNA synthesis the RNA molecules in this fraction were first poly A-tailed using poly(A)polymerase followed by ligation of synthetic RNA adapter to the 5' phosphate of the miRNAs. First strand cDNA synthesis was then performed using an oligo(dT)-linker primer and M-MLV-RNase H-reverse transcriptase. cDNA was PCR-amplified with adapter-specific primers and used in single-molecule sequencing. Massively parallel sequencing was performed by 454 Life Sciences (Branford, USA) using the Genome Sequencer 20 system.

Computational Analysis of Cloned Small RNAs Sequencing Reads

Base calling and quality trimming of sequence chromatograms was done by phred software (Ewing et al., 1998). After masking of vector and adapter sequences, and removing redundancy, inserts of length 18 bases and longer were mapped to genomes (ncbi35 assembly for human and ncbim34 assembly for mouse) using megablast software (ftp://ftp.ncbi.nlm.nih.gov/blast/). Not all inserts matched perfectly to a genome, and detailed analysis of non-matching sequences indicated that many of them represent known microRNAs with several additional nucleotides added to one of the ends. These non-genomic sequences may be artifacts of the cloning procedure or a result of non-templated modification of mature microRNAs (Aravin et al., 2005). Such sequences were corrected according to the best blast hit to a genome. Next, for every genomic locus matching to an insert, repeat annotations were retrieved from the Ensembl database (Worldwide web URL ensembl.org) and repetitive regions were discarded from further analysis, with the exception of the following repeats: MIR, MER, L2, MARNA, MON, Arthur and trf, since these repeat annotations overlap with some known microRNAs. Genomic regions containing inserts with 100 nt flanks were retrieved from Ensembl and a sliding window of 100 nt was used to calculate RNA secondary structures by RNAfold (Hofacker, 2003). Only regions that folded into hairpins and contained an insert in one of the hairpin arms, we used in further analysis. Since every non-redundant insert produced independent hits at this stage, hairpins with overlapping genomic coordinates were merged into one region, tracing locations of matching inserts. In cases when several inserts overlapped, the complete region covered by overlapping inserts was used in downstream calculations as a mature sequence. Next, gene and repeat annotations for hairpin genomic regions were retrieved from Ensembl, and repetitive regions (with above mentioned exceptions) as well as ribosomal RNAs, tRNAs and snoRNAs were discarded. To find homologous hairpins in other genomes, mature regions were blasted against human, mouse, rat, dog, cow, opossum, chicken, zebrafish and fugu genomes. Hits with length of at least 20 nt and identity of at least 70% were extracted from genomes along with flanking sequences of length similar to that observed in original hairpins to which a certain mature query sequence belonged. Extracted sequences were checked for hairpin structures using RNAfold, and positive hairpins were aligned with the original hairpin using clustalw (Thompson et al., 1994). Only homologs with at least 70% overall identity and 90% identity within mature sequence were considered. In cases were several homologous hairpins in a species were identified, the best clustalw-scoring hairpin was retained. Next, homologs from different organisms were aligned with the original hairpin by clustalw to produce a final multiple alignment of the hairpin region. Chromosomal location of homologous sequences were used to retrieve gene and repeat annotations from respective species Ensembl databases. Hairpins that contained repeat/RNA annotations in one of the species, as well as hairpins containing mature regions longer that 25 nt or with GC-content higher than 85% were discarded. For remaining hairpins, randfold values were calculated for every sequence in an alignment using mononucleotide shuffling and 1000 iterations. The cut-off of 0.01 was used for randfold and only regions that contained a hairpin below this cut-off for at least one species in an alignment, were considered as microRNA genes. Finally, positive hairpins were split into known and novel microRNAs according annotations. To facilitate these annotations and also to track performance of the pipeline, mature sequences of known microRNAs from miRBase (Griffiths-Jones, 2004) were included into the analysis.

The sequences obtained by massively parallel pyrosequencing were analyzed with the same computational pipeline, but homologs in other genomes were identified slightly differently, although similar parameters were used. Homologous hairpins in other genomes were identified by comparing mature miRNA regions using BLAST against human, chimpanzee, macaque, mouse, rat, dog, cow, opossum, chicken, zebrafish, fugu, tetraodon, *xenopus*, anopheles, *drosophila*, bee and ciona genomes. Where available, BLASTZ_NET aligned regions were also retrieved from Ensembl. All hits matching to at least 7 continuous nucleotides starting from 1.sup.st, 2.sup.nd or 3.sup.rd nucleotide of the mature sequence were extracted and folded using the RNAshapes program (Steffen et al., 2005; sliding windows of 80, 100 and 120 nt). Only regions that 1) folded into hairpins with the abstract shape '☐', 2) had a probability of folding greater than 0.8, and 3) contained a homologous sequence in one of the hairpin arms, were used in further analysis. Next, similarity between all potential homologous hairpins and the original hairpin was calculated using RNAforester software (at the Worldwide web URL bibiserv.techfak.uni-bielefeld.de/rnaforester). If a BLASTZ_NET aligned region folded into a hairpin and had an RNAforetsre score above 0.3, it was assigned as an orthologous hairpin in a particular species; otherwise, the highest scoring hairpin above score of 0.3 was defined as an ortholog. Next, homologs from different organisms were aligned with the original hairpin by clustalw (Thompson et al., 1994) to produce a final multiple alignment of the hairpin region. Chromosomal locations of homologous sequences were used to retrieve gene and repeat annotations from the respective species in the Ensembl database. Hairpins that contained repeat/RNA annotations in one of the species, as well as hairpins containing mature regions longer that 25 nt or with GC-content higher than 85% were discarded. For remaining hairpins, randfold values were calculated for every sequence in an alignment using mononucleotide shuffling and 1000 iterations (Bonnet at al., 2004). The cut-off of 0.005 was used for randfold and only regions that contained a hairpin below this cut-off for at least one species in an alignment were considered as microRNA genes. Finally, positive hairpins were split into known and novel microRNAs according to annotations. To facilitate these annotations and also to track performance of the pipeline, mature sequences of known microRNAs from miRBase v.8.0 (Griffiths-Jones et al., 2006) were included into the analysis.

Expression of miRNA in Tissue Samples

Custom microarrays (Amersham CodeLink) were made by spotting 3'-aminolinked oligonucleotides (60-mers, as described above for the custom Agilent microarrays) for detection of all known and novel mature microRNAs. At this point, no tiling path is needed anymore, resulting in a slide with about 15,000 spots that represent the full human, mouse and rat miRNA repertoire in 8-fold. These slides were hybridized with small RNA from mouse heart and mouse thymus (isolated using the Ambion MirVana small RNA isolation kit) as described above for the custom Agilent microarrays. In the table below, normalized intensities (arbitrary values, average of 8 spots, normalized by assuming a constant total amount of microRNA molecules per sample) for thymus and heart are shown for the those miRNAs that are more than two-fold differentially expressed. It should be noted that low values may indicate background signal and absense of this particular miRNA in a sample. Clearly, eight out of the 24 miRNAs that are differentially expressed between thymus and heart and hence provide a characteristic signature of the respective tissues, are novel miRNAs as described in FIG. 1.

TABLE expression of miRNAs as detected by microarray analysis

| rank | miRNA | signal intensity | | fold difference |
|------|-------|--------|-------|-----------------|
|      |       | thymus | heart |                 |
| 1 | mmu-mir-133b | 0.2767 | 5.3531 | 19.3 |
| 2 | novel Mmd__532 | 3.5050 | 0.2970 | −11.8 |
| 3 | mmu-mir-125b | 1.3814 | 11.9810 | 8.7 |
| 4 | mmu-mir-99a | 0.8470 | 6.1479 | 7.3 |
| 5 | novel Mmd__524 | 0.0117 | 0.0527 | 4.5 |
| 6 | novel Mmd__124 | 0.0094 | 0.0412 | 4.4 |
| 7 | mmu-mir-126 | 4.2831 | 16.3321 | 3.8 |
| 8 | mmu-mir-145 | 1.1160 | 4.1833 | 3.7 |
| 9 | mmu-mir-30a | 2.1039 | 7.3289 | 3.5 |
| 10 | mmu-mir-150 | 4.5540 | 1.4430 | −3.2 |
| 11 | mmu-mir-106a | 0.6968 | 0.2245 | −3.1 |
| 12 | mmu-mir-30e | 2.6240 | 7.6983 | 2.9 |
| 13 | novel Mmd__297 | 0.2878 | 0.8431 | 2.9 |
| 14 | mmu-mir-145 | 0.5578 | 1.5293 | 2.7 |
| 15 | mmu-mir-21 | 4.1493 | 1.5676 | −2.6 |
| 16 | novel Mmd__254 | 0.0178 | 0.0461 | 2.6 |
| 17 | novel Mmd__120 | 0.3228 | 0.1308 | −2.5 |
| 18 | mmu-mir-26a | 2.4855 | 5.9199 | 2.4 |
| 19 | mmu-let-7e | 1.1802 | 2.7889 | 2.4 |
| 20 | novel Mmd__45 | 0.3750 | 0.1599 | −2.3 |
| 21 | novel Mmd__93 | 0.0239 | 0.0558 | 2.3 |
| 22 | mmu-mir-185 | 0.6790 | 1.5214 | 2.2 |
| 23 | mmu-mir-149 | 0.1115 | 0.2333 | 2.1 |
| 24 | mmu-mir-18 | 1.9616 | 0.9721 | −2.0 |

REFERENCES

Abbott, A. L., Alvarez-Saavedra, E., Miska, E. A., Lau, N. C., Bartel, D. P., Horvitz, H. R., Ambros, V. (2005). The let-7 microRNA family members mir-48, mir-84 and mir-241 function together to regulate developmental timing in Caenorhabditis elegans. Dev. Cell 9, 403-414.

Alvarez-Garcia, I. & Miska, E. A. MicroRNA functions in animal development and human disease. Development 132, 4653-62 (2005).

Ambros, V. (2004). The functions of animal microRNAs. Nature 431, 350, 355.

Ambros, V., Lee, R. C., Lavanway, A., Williams, P. T. and Jewell, D. (2003). MicroRNAs and Other Tiny Endogenous RNAs in C. elegans. Curr Biol 13: 807-18.

Aravin, A. & Tuschl, T. Identification and characterization of small RNAs involved in RNA silencing. FEBS Lett 579, 5830-40 (2005).

Aravin, A. A., Naumova, N. M., Tulin, A. V., Vagin, V. V., Rozovsky, Y. M. and Gvozdev, V. A. (2001). Double-stranded RNA-mediated silencing of genomic tandem repeats and transposable elements in the D. melanogaster germline. Curr Biol 11: 1017-27.

Bagga, S., Bracht, J., Hunter, S., Massirer, K., Holtz, J., Eachus, R., Pasquinelli, A. E. (2005). Regulation by let-7 and lin-4 miRNAs results in target mRNA degradation. Cell 122, 553-563.

Bartel, D. P. (2004). MicroRNAs: genomics, biogenesis, mechanism, and function. Cell 116, 281-297.

Bentwich I, Avniel A, Karov Y, Aharonov R, Gilad S, Barad O, Barzilai A, Einat P, Einav U, Meiri E, Sharon E, Spector Y, Bentwich Z. (2005) Identification of hundreds of conserved and nonconserved human microRNAs. Nature Genet. 37, 766-770.

Berezikov, E., Plasterk, R. H. and Cuppen, E. (2002). GENOTRACE: cDNA-based local GENOme assembly from TRACE archives. Bioinformatics 18, 1396-1397.

Berezikov, E., Guryev, V., van de Belt, J., Wienholds, E., Plasterk, R. H., Cuppen, E. (2005). Phylogenetic shadowing and computational identification of human microRNA genes. Cell 120, 21-24.

Bernstein, E., Caudy, A. A., Hammond, S. M. and Hannon, G. J. (2001). Role for a bidentate ribonuclease in the initiation step of RNA interference. Nature 409: 363-6.

Boffelli, D., McAuliffe, J., Ovcharenko, D., Lewis, K. D., Ovcharenko, I., Pachter, L. and Rubin, E. M. (2003). Phylogenetic shadowing of primate sequences to find functional regions of the human genome. Science 299, 1391-1394.

Bohnsack, M. T., Czaplinski, K. and Gorlich, D. (2004). Exportin 5 is a RanGTP-dependent dsRNA-binding protein that mediates nuclear export of pre-miRNAs. Rna 10: 185-91.

Bonnet, E., Wuyts, J., Rouze, P. and Van De, P. e. Y. (2004). Evidence that microRNA precursors, unlike other non-coding RNAs, have lower folding free energies than random sequences. Bioinformatics 20, 2911-2917.

Brennecke, J., Hipfner, D. R., Stark, A, Russell, R. B. and Cohen, S. M. (2003). bantam encodes a developmentally regulated microRNA that controls cell proliferation and regulates the proapoptotic gene hid in Drosophila. Cell 113: 25-36.

Cai, X., Hagedorn, C. H. and Cullen, B. R. (2004). Human microRNAs are processed from capped, polyadenylated transcripts that can also function as mRNAs. RNA 10, 1957-1966.

Calin, G. A. et al. A MicroRNA signature associated with prognosis and progression in chronic lymphocytic leukemia. N Engl J Med 353, 1793-801 (2005).

Chen, X. (2004). A microRNA as a translational repressor of APETALA2 in Arabidopsis flower development. Science 303: 2022-5.

Ewing, B., Hillier, L., Wendl, M. C. & Green, P. Base-calling of automated sequencer traces using phred. I. Accuracy assessment. Genome Res 8, 175-85 (1998).

Farh, K. K., Grimson, A., Jan, C., Lewis, B. P., Johnston, W. K., Lim, L. P., Burge, C. B., Bartel, D. P. (2005). The widespread impact of mammalian microRNAs on mRNA repression and evolution. Science 310, 1817-1821.

Fire, A., Xu, S., Montgomery, M. K., Kostas, S. A., Driver, S. E. and Mello, C. C. (1998). Potent and specific genetic interference by double-stranded RNA in Caenorhabditis elegans. Nature 391: 806-11.

Giraldez, A. J., Cinalli, R. M., Glasner, M. E., Enright, A. J., Thomson, J. M., Baskerville, S., Hammond, S. M., Bartel, D. P., Schier, A. F. (2005). MicroRNAs regulate brain morphogenesis in zebrafish. Science 308, 833-838.

Gordon, D., Abajian, C. and Green, P. (1998). Consed: a graphical tool for sequence finishing. Genome Res 8, 195-202.

Griffiths-Jones, S. (2004). The microRNA Registry. Nucleic Acids Res 32 Database issue, D109-11.

Griffiths-Jones, S., Grocock, R. J., van Dongen, S., Bateman, A. & Enright, A. J. miRBase: microRNA sequences, targets and gene nomenclature. 2006. Nucleic Acids Res 34, D140-4.

Grishok, A., Pasquinelli, A. E., Conte, D., Li, N., Parrish, S., Ha, I., Baillie, D. L., Fire, A., Ruvkun, G. and Mello, C. C. (2001). Genes and mechanisms related to RNA interference regulate expression of the small temporal RNAs that control C. elegans developmental timing. Cell 106: 23-34.

Hamilton, A. J. and Baulcombe, D. C. (1999). A species of small antisense RNA in posttranscriptional gene silencing in plants. Science 286: 950-2.

Hammond, S. M. MicroRNAs as oncogenes. Curr Opin Genet Dev (2005).

He L, Thomson J M, Hemann M T, Hernando-Monge E, Mu D, Goodson S, Powers S, Cordon-Cardo C, Lowe S W, Hannon G J, Hammond S M. (2005) A microRNA polycistron as a potential human oncogene. Nature 435, 828-33.

Hofacker, I. L. Vienna RNA secondary structure server. Nucleic Acids Res 31, 3429-31 (2003).

Hornstein, E., Mansfield, J. H., Yekta, S., Kuang-Hsien Hu, J., Harfe, B. D., McManus, M. T., Baskerville, S., Bartel, D. P., Tabin, C. J. (2005). The microRNA miR-196 acts upstream of Hoxb8 and Shh in limb development. Nature 438, 671-674.

Hutvagner, G., Mclachlan, J., Pasquinelli, A. E., Balint, E., Tuschl, T. and Zamore, P. D. (2001). A cellular function for the RNA-interference enzyme Dicer in the maturation of the let-7 small temporal RNA. Science 293: 834-8.

Johnson, S. M., Lin, S. Y. and Slack, F. J. (2003). The time of appearance of the C. elegans let-7 microRNA is transcriptionally controlled utilizing a temporal regulatory element in its promoter. Dev Biol 259: 364-79.

Johnston, R. J. and Hobert, O. (2003). A microRNA controlling left/right neuronal asymmetry in Caenorhabditis elegans. Nature 426: 845-9.

Kapranov, P., Cawley, S. E., Drenkow, J., Bekiranov, S., Strausberg, R. L., Fodor, S. P. and Gingeras, T. R. (2002). Large-scale transcriptional activity in chromosomes 21 and 22. Science 296, 916-919.

Ketting, R. F., Fischer, S. E., Bernstein, E., Sijen, T., Hannon, G. J. and Plasterk, R. H. (2001). Dicer functions in RNA interference and in synthesis of small RNA involved in developmental timing in C. elegans. Genes Dev. 15: 2654-9.

Khvorova, A., Reynolds, A. and Jayasena, S. D. (2003). Functional siRNAs and miRNAs exhibit strand bias. Cell 115: 209-16.

Lagos-Quintana, M., Rauhut, R., Lendeckel, W. & Tuschl, T. Identification of novel genes coding for small expressed RNAs. Science 294, 853-8 (2001).

Lai, E. C., Tam, B., Rubin, G. M. (2005). Pervasive regulation of Drosophila Notch target genes by GY-box-, Brd-Box-, and K-box-class microRNAs. Genes Dev. 19, 1067-1080.

Lee, R. C., Feinbaum, R. L., Ambros, V. (1993). The C. elegans heterochronic gene lin-4 encodes small RNAs with antisense complementarity to lin-14. Cell 75, 843-854.

Lee, C., Grasso, C. and Sharlow, M. F. (2002). Multiple sequence alignment using partial order graphs. Bioinformatics 18, 452-464.

Lee, Y., Ahn, C., Han, J., Choi, H., Kim, J., Yim, J., Lee, J., Provost, P., Radmark, O., Kim, S. and Kim, V. N. (2003). The nuclear RNase III Drosha initiates microRNA processing. Nature 425: 415-9.

Lee, Y., Kim, M., Han, J., Yeom, K. H., Lee, S., Baek, S. H. and Kim, V. N. (2004). MicroRNA genes are transcribed by RNA polymerase II. EMBO J 23, 4051-4060.

Lee, Y. S., Nakahara, K., Pham, J. W., Kim, K., He, Z., Sontheimer, E. J. and Carthew, R. W. (2004). Distinct roles for Drosophila Dicer-1 and Dicer-2 in the siRNA/miRNA silencing pathways. Cell 117: 69-81.

Lewis, B. P., Burge, C. B., Bartel, D. P. (2005). Conserved seed pairing, often flanked by adenosines, indicates that thousands of human genes are microRNA targets. Cell 120, 15-20.

Lim, L. P., Glasner, M. E., Yekta, S., Burge, C. B. and Bartel, D. P. (2003). Vertebrate microRNA genes. Science 299, 1540.

Lim, L. P., Lau, N. C., Garrett-Engele, P., Grimson, A., Schelter, J. M., Castle, J., Bartel, D. P., Linsley, P. S., Johnson, J. M. (2005). Microarray analysis shows that some microRNAs downregulate large numbers of target mRNAs. Nature 433, 769-773.

Lingel, A., Simon, B., Izaurralde, E. and Sattler, M. (2003). Structure and nucleic-acid binding of the Drosophila Argonaute 2 PAZ domain. Nature 426: 465-9.

Lu, J. et al. MicroRNA expression profiles classify human cancers. Nature 435, 834-8 (2005).

Lund, E., Guttinger, S., Calado, A., Dahlberg, J. E. and Kutay, U. (2004). Nuclear export of microRNA precursors. Science 303: 95-8.

Ma, J., Ye, K. and Patel, D. (2004). Structural basis for overhang-specific small interfering RNA recognition by the PAZ domain. Nature in press.

Margulies, M. Eghold, M. et al. Genome sequencing in microfabricated high-density picolitre reactors. Nature. 2005 Sep. 15; 437(7057):326-7.

Martinez, J. and Tuschl, T. (2004). RISC is a 5' phosphomonoester-producing RNA endonuclease. Genes Dev.

Nelson, P. T. et al. Microarray-based, high-throughput gene expression profiling of microRNAs. Nat Methods 1, 155-61 (2004).

O'Donnell K A, Wentzel E A, Zeller K I, Dang C V, Mendell J T. (2005) c-Myc-regulated microRNAs modulate E2F1 expression. Nature 435:839-43

Ohler, U., Yekta, S., Lim, L. P., Bartel, D. P. and Burge, C. B. (2004). Patterns of flanking sequence conservation and a characteristic upstream motif for microRNA gene identification. RNA 10, 1309-1322.

Okazaki, Y., Furuno, M., Kasukawa, T., Adachi, J., Bono, H., Kondo, S., Nikaido, I., Osato, N., Saito, R., Suzuki, H., Yamanaka, I., Kiyosawa, H., Yagi, K., Tomaru, Y., Hasegawa, Y., Nogami, A., Schonbach, C., Gojobori, T., Baldarelli, R. and Hill, D. P. (2002). Analysis of the mouse transcriptome based on functional annotation of 60,770 full-length cDNAs. Nature 420, 563-573.

Park, W., Li, J., Song, R., Messing, J. and Chen, X. (2002). CARPEL FACTORY, a Dicer homolog, and HEN1, a novel protein, act in microRNA metabolism in Arabidopsis thaliana. Curr Biol 12: 1484-95.

Pham, J. W., Pellino, J. L., Lee, Y. S., Carthew, R. W. and Sontheimer, E. J. (2004). A Dicer-2-dependent 80s complex cleaves targeted mRNAs during RNAi in Drosophila. Cell 117: 83-94.

Pillai, R. S., Bhattacharyya, S. N., Artus, C. G., Zoller, T., Cougot, N., Basyuk, E., Bertrand, E., Filipowicz, W. (2005). Inhibition of translational initiation by let-7 microRNA in human cells. Science 309, 1573-1576.

Poy, M. N., Eliasson, L., Krutzfeldt, J., Kuwajima, S., Ma, X., Macdonald, P. E., Pfeffer, S., Tuschl, T., Rajewsky, N., Rorsman, P. and Stoffel, M. (2004). A pancreatic islet-specific microRNA regulates insulin secretion. Nature 432, 226-230.

Reinhart, B. J. and Bartel, D. P. (2002). Small RNAs correspond to centromere heterochromatic repeats. Science 297: 1831.

Reinhart, B. J., Slack, F. J., Basson, M., Pasquinelli, A. E., Bettinger, J. C., Rougvie, A. E., Horvitz, H. R., Ruvkun, G. (2000). The 21-nucleotide let-7 RNA regulates developmental timing in Caenorhabditis elegans. Nature 403, 901-906.

Reinhart, B. J., Weinstein, E. G., Rhoades, M. W., Bartel, B. and Bartel, D. P. (2002). MicroRNAs in plants. Genes Dev 16: 1616-26.

Rodriguez, A., Griffiths-Jones, S., Ashurst, J. L. and Bradley, A. (2004). Identification of Mammalian microRNA Host Genes and Transcription Units. Genome Res 14, 1902-1910.

Schwarz, D. S., Hutvagner, G., Du, T., Xu, Z., Aronin, N. and Zamore, P. D. (2003). Asymmetry in the assembly of the RNAi enzyme complex. Cell 115: 199-208.

Schwarz, D. S., Tomari, Y. and Zamore, P. D. (2004). The RNA-Induced Silencing Complex Is a Mg(2+)-Dependent Endonuclease. Curr Biol 14: 787-91.

Song, J. J., Liu, J., Tolia, N. H., Schneiderman, J., Smith, S. K., Martienssen, R. A., Hannon, G. J. and Joshua-Tor, L. (2003). The crystal structure of the Argonaute2 PAZ domain reveals an RNA binding motif in RNAi effector complexes. Nat Struct Biol 10: 1026-1032.

Stark, A., Brennecke, J., Bushati, N., Russell, R. B., Cohen, S. M. (2005). Animal microRNAs confer robustness to gene expression and have a significant impact on 3'-UTR evolution. Cell 123, 1133-1146.

Steffen, P., Voss, B., Rehmsmeier, M., Reeder, J., Giegerich, R. 2006. RNAshapes: an integrated RNA analysis package based on abstract shapes. Bioinformatics 22:500-3.

Thompson, J. D., Higgins, D. G. & Gibson, T. J. CLUSTAL W: improving the sensitivity of progressive multiple sequence alignment through sequence weighting, position-specific gap penalties and weight matrix choice. Nucleic Acids Res 22, 4673-80 (1994).

Tomari, Y., Du, T., Haley, B., Schwarz, D. S., Bennett, R., Cook, H. A., Koppetsch, B. S., Theurkauf, W. E. and Zamore, P. D. (2004). RISC assembly defects in the Drosophila RNAI mutant armitage. Cell 116: 831-41.

Wienholds, E., Kloosterman, W. P., Miska, E., Alvarez-Saavedra, E., Berezikov, E., de Bruijn, E., Horvitz, H. R., Kauppinen, S., Plasterk, R. H. (2005). MicroRNA expression in zebrafish embryonic development. Science 309, 310-311.

Wienholds, E., Koudijs, M. J., van Eeden, F. J., Cuppen, E., Plasterk, R. H. (2003). The microRNA-producing enzyme Dicer 1 is essential for zebrafish development. Nat. Genet. 35, 217-218.

Xie, Z., Johansen, L. K., Gustafson, A. M., Kasschau, K. D., Lellis, A. D., Zilberman, D., Jacobsen, S. E. and Carrington, J. C. (2004). Genetic and Functional Diversification of Small RNA Pathways in Plants. PLoS Biol 2: E104.

Yan, K. S., Yan, S., Farooq, A., Han, A., Zeng, L. and Zhou, M. M. (2003). Structure and conserved RNA binding of the PAZ domain. Nature 426: 468-74.

Yekta, S., Shih, I. H. and Bartel, D. P. (2004). MicroRNA-directed cleavage of HOXB8 mRNA. Science 304: 594-6.

Yi, R., Qin, Y., Macara, I. G. and Cullen, B. R. (2003). Exportin-5 mediates the nuclear export of pre-microRNAs and short hairpin RNAS. Genes Dev 17: 3011-6.

Yoo, A. S., Greenwald, I. (2005). Lin-12/Notch activation leads to microRNA-mediated down-regulation of Vav in *C. elegans*. Science 310, 1330-1333.

Zhang, H., Kolb, F. A., Jaskiewisz, L., Westhof, E. and Filipowicz, W. (2004). Single processing center models for human Dicer and bacterial RNase III. Cell in press.

SEQUENCE LISTING (12452 sequences)

SEQ ID NO: 1 - DNA, 100 bp, Artificial
  Hairpin sequence Hsd_1, human
ggttgggcaaggtgcggggctagggctaacagcagtcttactgaaggtttcctggaaaccacgcacatgctgttgccactaacctcaaccttactcggtc

SEQ ID NO: 2 - DNA, 96 bp, Artificial
  Hairpin sequence Hsd_10, human
ttctccatgcctggcatatagcaggtcctcaataagtatttgttgaaagaataaataaaccaacaagtcttatttgagcacctgttatgtggagga

SEQ ID NO: 3 - DNA, 93 bp, Artificial
  Hairpin sequence Hsd_100, human
gacctgggcttgggtggtaggaggaattggtgctggtctttcattttggatttgactccagccccacagcctcagccaccccagccaattgtc

SEQ ID NO: 4 - DNA, 92 bp, Artificial
  Hairpin sequence Hsd_101, human
ggctatgaggctgctggcctttttcctgtgctgtgctgccccttttggcttctttgagtgtgctagcaggagagccagctgcttttcatccc

SEQ ID NO: 5 - DNA, 81 bp, Artificial
  Hairpin sequence Hsd_102, human
cccagccctgcagtgggtgctggagacattcacacacagtgaattacaccagcatggttcctatcctgctggagcttaggg

SEQ ID NO: 6 - DNA, 90 bp, Artificial
  Hairpin sequence Hsd_103, human
agaattctgtctcttaggctttctcttcccagatttcccaaagttgggaaaagctgggttgagagggcaaaaggaaaaaaaaagaattct

SEQ ID NO: 7 - DNA, 98 bp, Artificial
  Hairpin sequence Hsd_104, human
gaatggttacaaggagagaacactggacttggagtcagaaaactttcatccaagtcattccctgctctaagtcccatttctgttccatgagattgttt

SEQ ID NO: 8 - DNA, 72 bp, Artificial
  Hairpin sequence Hsd_105, human
agccatatctgggctgctgtctcagaatatctaagcgagtagagaagaggaggaaaggagtttggaatggct

SEQ ID NO: 9 - DNA, 95 bp, Artificial
  Hairpin sequence Hsd_106, human
tgtcctggttccccctctctaatccttgctacctgggtgagagtgctttctgaatgcagtgcacccaggcaaggattctgcaagggggagtgaca

SEQ ID NO: 10 - DNA, 85 bp, Artificial
  Hairpin sequence Hsd_107, human
tgtctgccagtgactgcccaggtgtctgctggttcctccccaggagtagggaggaaccaggtgggctggctgggatgggtggata

SEQ ID NO: 11 - DNA, 98 bp, Artificial
  Hairpin sequence Hsd_108, human
gagccactctttggtacttgaagagaggataccctttgtatgttcacttgattaatggcgaatatacagggggagactcttatttgcgtatcaaactc

SEQ ID NO: 12 - DNA, 71 bp, Artificial
  Hairpin sequence Hsd_109, human; Hsd_56, human; Hsd_68, human
tcacagtcatcaggtaagtgagtcaagagaaggaatctggagactctgacttgcccgaggtgggcatgtgg

SEQ ID NO: 13 - DNA, 96 bp, Artificial
  Hairpin sequence Hsd_11, human
tgctctcctggcccatgaaatcaagcgtgggtgagacctggtgcagaacgggaaggcgacccatacttggtttcagaggctgtgagaataactgca

SEQ ID NO: 14 - DNA, 98 bp, Artificial
  Hairpin sequence Hsd_110, human
atgaactgctccttctcccatacccattgcatatcggagttgtgaattctcaaaacacctcctgtgtgcatggattacaggagggtgagccttgtcat

SEQ ID NO: 15 - DNA, 81 bp, Artificial
  Hairpin sequence Hsd_111, human
ttcacacacaacacactgagaggcatcgtggttgaataacccatctgaggccaatagctactgagtagtgtagtgggtgaa

SEQ ID NO: 16 - DNA, 81 bp, Artificial
  Hairpin sequence Hsd_12, human
gttggcatggggaggagggaggagatgggccaagttccctctggctggaacgcccttcccccccttcttcacctggcgaac

SEQ ID NO: 17 - DNA, 98 bp, Artificial
  Hairpin sequence Hsd_13, human
tggcaggccaggaagaggaggaagccctggaggggctggaggtgatggatgttttcctccggttctcagggctccacctctttcgggccgtagagcca

SEQ ID NO: 18 - DNA, 99 bp, Artificial
  Hairpin sequence Hsd_14, human
gatgcacagatctcagacatctcggggatcatcatgtcacgagataccagtgtgcacttgtgacagattgataactgaaaggtctgggagccactcatc

SEQ ID NO: 19 - DNA, 93 bp, Artificial
  Hairpin sequence Hsd_15, human
ggtaactgccctcaaggagcttacaatctagctgggggtaaatgacttgcacatgaacacaactagactgtgagcttctagagggcagggacc

SEQ ID NO: 20 - DNA, 96 bp, Artificial
  Hairpin sequence Hsd_16, human
gctgtttcatacttgaggagaaattatccttggtgtgttcgctttatttatgatgaatcatacaaggacaatttctttttgagtatcaaatcttgc

SEQ ID NO: 21 - DNA, 66 bp, Artificial
  Hairpin sequence Hsd_17, human
ggtaagtgcgcctcgggtgagcatgcacttaatgtgggtgtatgtcactcggctcggcccactacc

SEQ ID NO: 22 - DNA, 95 bp, Artificial
  Hairpin sequence Hsd_18, human
gatgctttgctggctggtgcagtgcctgagggagtaagagtcctgttgttgtaagatagtgtcttactccctcaggcacatctccaacaagtctc

SEQ ID NO: 23 - DNA, 103 bp, Artificial
  Hairpin sequence Hsd_19, human
agccctccagggtaagtggaaagatggtgggccgcagaacatgtgctgagttcgtgccatatgtctgctgaccatcacctttagaagccccctttcgctgagg

SEQ ID NO: 24 - DNA, 95 bp, Artificial
  Hairpin sequence Hsd_2, human
gaagaaatcctactcggatggatataatacaacctgctaagtgtcctagcacttagcaggttgtattatcattgtccgtgtctatggctctcgtc

SEQ ID NO: 25 - DNA, 96 bp, Artificial
  Hairpin sequence Hsd_20, human
atattgtaggtttttgctcatgcaccatggttgtctgagcatgcagcatgcttgtctgctcataccccatggtttctgagcaggaaccttcattgt

SEQ ID NO: 26 - DNA, 96 bp, Artificial
  Hairpin sequence Hsd_21, human
gcccttggtgaggactcgggaggtggagggtggtgccgccggggccgggcgctgtttcagctcgcttctccccccacctcctctctcctcaggtgc

SEQ ID NO: 27 - DNA, 95 bp, Artificial
  Hairpin sequence Hsd_22, human
ggagggtaagtcattattagtgaaagccatggattcaggagccagatagcccaggttcaagtcctggcttcaagtatgtgactttgggcacttct

SEQ ID NO: 28 - DNA, 98 bp, Artificial
  Hairpin sequence Hsd_23, human
ctgtagccagtcagaaatgagcttattcataaaagtgcagtatggtgaagtcaatctgtaattttatgtataagctagtctctgattgaaacatgcag

SEQ ID NO: 29 - DNA, 98 bp, Artificial
  Hairpin sequence Hsd_24, human
cggtgcggtttgataagtggtcggttcctggagctgcggtcttctgctagcctgatccgcagcttcagcctccgccgcctcctcagccctcggcgccg

SEQ ID NO: 30 - DNA, 97 bp, Artificial
  Hairpin sequence Hsd_25, human
tgaagaaggggaggtggagctcgttcttgtgtgcaaactacagggttaaggctcagaactgtggcttgtccaagaacgttcataccactgcttctca

SEQ ID NO: 31 - DNA, 99 bp, Artificial
  Hairpin sequence Hsd_26, human
cactggctgggccagtgtgtggtgcaggcagtctgtctacactggtggggccagtgcatggggcaggcagtccgcctacactgacggagccagcacgtg

SEQ ID NO: 32 - DNA, 100 bp, Artificial
  Hairpin sequence Hsd_27, human
ggctcgtgcctccatccttccaggaggaaacaaggacacaaaggtggcacacctgcctcccaagttcctccctgtcctccaggagctggatctcagagct

SEQ ID NO: 33 - DNA, 97 bp, Artificial
  Hairpin sequence Hsd_28, human
gaacttgagaaataaggcttctgtctactactggagacactggtagtataaaacccagagtctccagtaatggacgggagccttatttctatcactc

SEQ ID NO: 34 - DNA, 92 bp, Artificial
  Hairpin sequence Hsd_29, human
ttcccccatcctccttacgtcccaccccccactcctgtttctggtgaaatattcaaacaggagtgggggtgggacataaggaggatagggaa

SEQ ID NO: 35 - DNA, 100 bp, Artificial
  Hairpin sequence Hsd_3, human
cttcaaagtggcagactggaaaatctctgcaggcaaatgtgatgtcactgaggaaatcacacacttacccgtagagattctacagtctgacatcttcaag

SEQ ID NO: 36 - DNA, 96 bp, Artificial
  Hairpin sequence Hsd_30, human
acctctgatgtgtcagtctctcttcagggctcccgagacacagaaacagacacctgccctcgaggagctcacagtctagacaaacaaacccagggt

SEQ ID NO: 37 - DNA, 91 bp, Artificial
  Hairpin sequence Hsd_31, human
taaggagcagagcagcatggaaagaagggaggctttgggatcaaccctgggcttaattcccagctcagctgcttcctggatgtgtttctta

SEQ ID NO: 38 - DNA, 96 bp, Artificial
  Hairpin sequence Hsd_32, human
ggggaggtggggttgcgggggttagagctgtgggtgatcagaagggaagggcttcatttctacgctctgcctccgctacctcttccccaccacccc

SEQ ID NO: 39 - DNA, 83 bp, Artificial
  Hairpin sequence Hsd_33, human
tcctcaatgtactaagcgttgggaatgtagagactgaccaaagtatggtctctaccttcaaggagctcacagtctattgggga

SEQ ID NO: 40 - DNA, 79 bp, Artificial
  Hairpin sequence Hsd_34, human
aattaatccctctctttctagttcttcctagagtgaggaaaagctgggttgagagggcaaacaaattaactaattaatt

SEQ ID NO: 41 - DNA, 99 bp, Artificial
  Hairpin sequence Hsd_35, human
tgctgggggcgtgggggcggggacggcgtccgcgccttgcccctggtccattttggacgccgaggctaaggtctgtgcgcgcccccgctgcgtctagca

SEQ ID NO: 42 - DNA, 88 bp, Artificial
  Hairpin sequence Hsd_36, human
tttgcattaaaaatgaggccttctcttcccagttcttcccagagtcaggaaaagctgggttgagagggtagaaaaaaaatgatgtagg

SEQ ID NO: 43 - DNA, 95 bp, Artificial
  Hairpin sequence Hsd_37, human
gctgggtgggaaaagtggctaggagttagcttgggagccgctggtgttctgagcgctcccctctctggccactttttctccacgcccacccccgc

SEQ ID NO: 44 - DNA, 92 bp, Artificial
  Hairpin sequence Hsd_38, human
cacctacctaactgggttagggccctggctccatctcctttaggaaaaccttctgtggggagtggggcttcgaccctaacccaggtgggctg

SEQ ID NO: 45 - DNA, 99 bp, Artificial
  Hairpin sequence Hsd_39, human
agtctgctcaacagcttgttatttggtggattgtggcagtaaatcggggcgagtggggaacccggcgcaggaactgcagccgcggctgggagtggtgct

SEQ ID NO: 46 - DNA, 99 bp, Artificial
  Hairpin sequence Hsd_4, human
tgatgatattatgccatgacattgtgtcaatatgcgatgatgtgttgtgatggcacagcgtcatcacgtggtgacgcaacatcatgacgtaagacgtca

SEQ ID NO: 47 - DNA, 86 bp, Artificial
  Hairpin sequence Hsd_40, human
ggtgggtggtttctccgtttgcctgtttcgctgatgtgcattcaactcattctcagcaaaataagcaaatggaaaattcgtccatc

SEQ ID NO: 48 - DNA, 92 bp, Artificial
  Hairpin sequence Hsd_41, human
gggggtccaggaggctccagggtgagcccactcctccccctagatacaagggagggccctgggaccctgtctgctgttcctcctggactcct

SEQ ID NO: 49 - DNA, 93 bp, Artificial
  Hairpin sequence Hsd_42, human
gacctgacccaggttttagtggctccctctgcctgcagaatggaagaccacgtgcaggtgagggtggagccaccgatacctgggtgatgggtc

SEQ ID NO: 50 - DNA, 98 bp, Artificial
  Hairpin sequence Hsd_43, human
cggtgcggtttgctaagtggtcggttcctggagctgcggtcttctgctagcctgatccgcagcttcagcctccgccgcctcctcagccctcggcgccg

SEQ ID NO: 51 - DNA, 98 bp, Artificial
  Hairpin sequence Hsd_44, human
atgacattcagactgaggtcctcaaaactgaggggcattttctgtggtttgaaaggaaagtgcacccagttttggggatgtcaattgtgaatcctcat

SEQ ID NO: 52 - DNA, 94 bp, Artificial
  Hairpin sequence Hsd_45, human
gataacagcacaatcctattctagagtccatatcaacaataaggtttacgacctcgatgttggatcaggacatcctaatggtgtagctgctatt

SEQ ID NO: 53 - DNA, 99 bp, Artificial
  Hairpin sequence Hsd_46, human
ttcccctgcagcaaggggcggggccaccccaacgccgcttctgcggccaaagtaggttgggagtggaaggtggtggctgctgctccgcagtgtcgggaa

SEQ ID NO: 54 - DNA, 98 bp, Artificial
  Hairpin sequence Hsd_47, human
tctaaacacaactcactgtgcccccaggacatttggagacttctggagacatctttggttatctcagctgggggtagtgggtgcatctagtgggtaga

SEQ ID NO: 55 - DNA, 92 bp, Artificial
  Hairpin sequence Hsd_48, human
gggagtccagctcatctacagagtcatttttattcctggccatggagcccttgaatgccagggtcagggatggctcagttcagccgggcccc

SEQ ID NO: 56 - DNA, 97 bp, Artificial
  Hairpin sequence Hsd_49, human
ctgctactcggcccgcactctctccattacactaccctgcctcttctccatgagaggcagcggggtgtagtggatagagcacgggttcaagtcccgg

SEQ ID NO: 57 - DNA, 99 bp, Artificial
  Hairpin sequence Hsd_5, human
gctgacgtgcggtacttaatgagaagttgcccgtgtttttttcgctttatttgtgacgaaacattcgcggtgcacttctttttcagtatcctattctgc

SEQ ID NO: 58 - DNA, 85 bp, Artificial
  Hairpin sequence Hsd_50, human
gagggaatagtgagggcgagggcacggacagccaggaaggtccggggatgcccggaaccatcatcccgttccttgtccgtccttt

SEQ ID NO: 59 - DNA, 61 bp, Artificial
  Hairpin sequence Hsd_51, human
gctgttccccagcctccttggtattccagagtgtgtggaatacccaagggctattgacagc

SEQ ID NO: 60 - DNA, 99 bp, Artificial
  Hairpin sequence Hsd_52, human
gccggcgggggcgcgggcggcagtggcgggagcggcccctcggccatcctccgtctgcccagttaccgcttccgctaccgccgccgctcccgctctagc

SEQ ID NO: 61 - DNA, 62 bp, Artificial
  Hairpin sequence Hsd_53, human
ggtggtgaagggtgcaggctctaaaaccagaaaacccaggttcaagtcctggccctaccacc

SEQ ID NO: 62 - DNA, 93 bp, Artificial
  Hairpin sequence Hsd_54, human
gtctgtacagataagtcggcttcaggggcgctctgtctctgttgctctaacagaccagacttgctcctgccgttgactctctgctcccagcgc

SEQ ID NO: 63 - DNA, 95 bp, Artificial
  Hairpin sequence Hsd_55, human
agagttggccatagcagccgaggggaccccggcagatctgcccagctggctgtgatctgctgccaacccctggggtcctgcccacccctggctct

SEQ ID NO: 64 - DNA, 91 bp, Artificial
  Hairpin sequence Hsd_57, human
ttctgatttcttcttcatttaaagaagtccttgttactttatattcacactctgtaactgcacaggacttcagaggagggagatatgggaa

SEQ ID NO: 65 - DNA, 97 bp, Artificial
  Hairpin sequence Hsd_58, human
ggcaagggtagccattgtttgggttggggtggtcggccctggagggggtttgtttgcttattcccctctgtgcttcacccctacccagcttcccgcc

SEQ ID NO: 66 - DNA, 54 bp, Artificial
  Hairpin sequence Hsd_59, human
gccgttgcccgcatcccccacctctcgcggcgagagtggatgcgtggccccggc

SEQ ID NO: 67 - DNA, 85 bp, Artificial
  Hairpin sequence Hsd_6, human
cttgctttctctcctccatgccttgagtgtaggaccgttggcatcttaattaccctcccacacccaaggcttgcaaaaaagcgag

SEQ ID NO: 68 - DNA, 91 bp, Artificial
  Hairpin sequence Hsd_60, human
gccccggggtgcagatccttgggagccctgttagactctggattttacacttggagtgaacgggcgccatcccgaggctttgcacaggggc

SEQ ID NO: 69 - DNA, 98 bp, Artificial
  Hairpin sequence Hsd_61, human
aggcacggtccctgccctcgaggagctcacagtctagtaaggaagacatatggggaaccgattccccaaagatgcggggagtaggggaggcagtgctt

SEQ ID NO: 70 - DNA, 98 bp, Artificial
  Hairpin sequence Hsd_62, human
gaagaaaggaaacggggaaaatcaaaaggggttcaaaccccacctcagtaggtggaggggagcgcctgccattggttgtatttttgttctgagttttc

SEQ ID NO: 71 - DNA, 100 bp, Artificial
  Hairpin sequence Hsd_63, human
ctcttcggcccacgcctcctcccctccccaggttcctcattaaaccagcaagaagccctatgcttcaaggggcggggagaatctggtggctgcctgggag

SEQ ID NO: 72 - DNA, 48 bp, Artificial
  Hairpin sequence Hsd_64, human
cttctcttcctggttcttcctgaagtcaggaaaagctgggttgagagg

SEQ ID NO: 73 - DNA, 100 bp, Artificial
  Hairpin sequence Hsd_65, human
gcaggcagccactggggtgtccctgcttactcagtcacagaggaggccctggctggagtggggctgcgggaagagctgggatcactcccggggctcctgc

SEQ ID NO: 74 - DNA, 47 bp, Artificial
  Hairpin sequence Hsd_66, human
ctgccatccctgggagcctggaaccaggcaatgttcgggggaggcag

SEQ ID NO: 75 - DNA, 82 bp, Artificial
  Hairpin sequence Hsd_67, human
cctgaatcaggtaggcagtgtattgttagctggctgcttgggtcaagtcagcagccacaactaccctgccacttgcttctgg

SEQ ID NO: 76 - DNA, 97 bp, Artificial
  Hairpin sequence Hsd_69, human
agctgaagagcctgtgggaaagagaagagcagggcagggtgaaggcccggcggagacactctgcccaccccacaccctgcctatgggccacacagct

SEQ ID NO: 77 - DNA, 87 bp, Artificial
  Hairpin sequence Hsd_7, human
ggctatgcactgcacaaccctaggagagggtgccattcacatagactataattgaatggcgccactagggttgtgcagtgcacaacc

SEQ ID NO: 78 - DNA, 95 bp, Artificial
  Hairpin sequence Hsd_70, human
gatgctttgctggctggtgcagtgcctgagggagtaagagccctgttgttgtaagatagtgtcttactccctcaggcacatctccaacaagtctc

SEQ ID NO: 79 - DNA, 97 bp, Artificial
  Hairpin sequence Hsd_71, human
cagggtcttgtcttgtccctgcggggacaggccagggcatctaggctgtgcacagtgacgcccctcctgcccccacagaagcgcagaccctactctg

SEQ ID NO: 80 - DNA, 94 bp, Artificial
  Hairpin sequence Hsd_72, human
ctgttcccccccaggagggatgcactggggaactggggttggcacggggacttggagttggtgacctcactgctgccttgtgggtggggggcag

SEQ ID NO: 81 - DNA, 85 bp, Artificial
  Hairpin sequence Hsd_73, human
ggccgctgggcgcacccgtcccgttcgtccccggacgttgctctctaccccgggaacgtcgagactggagcgcccgaactgagcc

SEQ ID NO: 82 - DNA, 80 bp, Artificial
  Hairpin sequence Hsd_74, human
gctgtgcagagttattgcctctgttctaacacaagactaggcttccctgtgttagaataggggcaataactctgcactgc

SEQ ID NO: 83 - DNA, 98 bp, Artificial
  Hairpin sequence Hsd_75, human
ctgcagcacccagatcagtgcttggcacctagcaagcactcagtaaatatttgttgagtgcctgctatgtgccaggcattgtgctgagggctttgtgg

SEQ ID NO: 84 - DNA, 94 bp, Artificial
  Hairpin sequence Hsd_76, human
tagaatggggattgtggggggtcgctctaggcaccgcagcactgtgctggggatgttgcagctgcctgggagtgacttcacacagtcctctctg

SEQ ID NO: 85 - DNA, 98 bp, Artificial
  Hairpin sequence Hsd_77, human
agcctcccgcttcgctctctgctcctcctgttcgacagtcagccgcatcttcttttgcgtcgccaggtgaagacgggcggagagaaacccgggaggct

SEQ ID NO: 86 - DNA, 92 bp, Artificial
  Hairpin sequence Hsd_78, human
gggtctgcgggcaagaggcgcacgggggtcgaccagggctccctagggctagatgtgcggccaagcacccccggggcgtcgtccgcagaccc

SEQ ID NO: 87 - DNA, 95 bp, Artificial
  Hairpin sequence Hsd_79, human
ggcaggcgtctgcggaactggagcgcggctgaagaagctgctcttggcagaggaaggggcaggctggcaaagtggattggctgtgggcgcctgcc

SEQ ID NO: 88 - DNA, 88 bp, Artificial
  Hairpin sequence Hsd_8, human
gcctggatacatgagatggttgaccagagagcacacgctttatttgtgccgtttgtgacctggtccactaaccctcagtatctaatgc

SEQ ID NO: 89 - DNA, 99 bp, Artificial
  Hairpin sequence Hsd_80, human
tgtatcacctgccacttgcacctgtatcacacctgtgtgttacacctgtcactcctgtgtgtcactcttgtgtgttgcagatgtgggggcaggtgagca

SEQ ID NO: 90 - DNA, 87 bp, Artificial
  Hairpin sequence Hsd_81, human
ccagatcctagaaccctatcaatattgtctctgctgtgtaaatagttctgagtagtgcaatattgcttatagggttttggtgtttgg

SEQ ID NO: 91 - DNA, 96 bp, Artificial
  Hairpin sequence Hsd_82, human
gctttgctggctggtgcagtgcctgagggagtaagagccctgttgttgtcagatagtgtcttactccctcaggcacatctccagcgagtctcttgc

SEQ ID NO: 92 - DNA, 99 bp, Artificial
  Hairpin sequence Hsd_83, human
ccaccctttggtacttaaagagaggataccctttgtatgttcacttgattaatggcgaatatacagggggagactctcatttgcgtatcaaactgtcgg

SEQ ID NO: 93 - DNA, 92 bp, Artificial
  Hairpin sequence Hsd_84, human
ttagggtgaccagccattatggtttgcctgggactgaggaatttgctgggatatgtcagttccaggccaaccaggctggttggtctccctga

SEQ ID NO: 94 - DNA, 72 bp, Artificial
  Hairpin sequence Hsd_85, human
tgtggcctaaggtggtcaaaggagccccatcaggcctgaggtctgacccttggctctgccacctggaagaca

SEQ ID NO: 95 - DNA, 92 bp, Artificial
  Hairpin sequence Hsd_86, human
gctgggatgtgtcaggtaggcagtgtattgctagcggctgttaatgattttaacagttgctagttgcactcctctctgttgcattcagaagc

SEQ ID NO: 96 - DNA, 54 bp, Artificial
  Hairpin sequence Hsd_87, human
aggtttgaatcctactgggtggcccagcaggggccccctacagggctcagggct

SEQ ID NO: 97 - DNA, 89 bp, Artificial
  Hairpin sequence Hsd_88, human
agtactgaggacaacaggatatgggctctaatgcttggaaaattatagtctctctgcatttagagccctgggaccctgtctgtttggct

SEQ ID NO: 98 - DNA, 98 bp, Artificial
  Hairpin sequence Hsd_89, human
gcaaacattaggagagtatcttctctgttttggccatgtgtgtactcacagcccctcacacatggccgaaacagagaagttactttcctaatatttgc

SEQ ID NO: 99 - DNA, 100 bp, Artificial
  Hairpin sequence Hsd_9, human
gtgctaacctttggtacttggagagtggttatccctgtcctgttcgttttgctcatgtcgaatcgtacagggtcatccactttttcagtatcaagagcgc

SEQ ID NO: 100 - DNA, 99 bp, Artificial
  Hairpin sequence Hsd_90, human
agcataaaccaaaagccccagggggagaaggtgtaagacttgtctgagagccagtggactcgtttggcacaaagggtatctgggggaattggtgtagtt

SEQ ID NO: 101 - DNA, 97 bp, Artificial
  Hairpin sequence Hsd_91, human
ggaagttttttgggaatgcagattccagggcccctccttcagataggcttatttgatgggtccaaaaaagggggtctgaatttgtaataaacgcgcc

SEQ ID NO: 102 - DNA, 74 bp, Artificial
  Hairpin sequence Hsd_92, human
gacacagatggcgcgcgggctcttgggttctgtagttttctcgcgatccaaaaggctccgtgcccaagtgagtc

SEQ ID NO: 103 - DNA, 97 bp, Artificial
  Hairpin sequence Hsd_93, human
taaggtcagagctggtcagtgacgaagccagacccagagcccaggtcaccaggccatggggctttttactgcctcagtgatcgtgagcctggtttta

SEQ ID NO: 104 - DNA, 100 bp, Artificial
  Hairpin sequence Hsd_94, human
tcccccctgctggccgcaggtgctctgacgaggttgcactactgtgctctgagaagcagtgcaatgatattgtcaaagcatctgggaccagccttgggga

SEQ ID NO: 105 - DNA, 83 bp, Artificial
  Hairpin sequence Hsd_95, human
ttctcctctcagggaagctttttgctcgaattatgtttctgatccgaatataagacgaacaaaaggtttgtctgagggcagag

SEQ ID NO: 106 - DNA, 87 bp, Artificial
  Hairpin sequence Hsd_96, human
tctcaagctatgagtctacaaaggaaagcgctttctgttgtcagaaagaagagaaagcgcttcccttttgagggttacggtttgaga

SEQ ID NO: 107 - DNA, 95 bp, Artificial
  Hairpin sequence Hsd_97, human
cgaggcactgcggcccagggtctggtgcggagagggcccacagtggacttggtgacgctgtatgccctcaccgctcagcccctggggctggcttg

SEQ ID NO: 108 - DNA, 95 bp, Artificial
  Hairpin sequence Hsd_98, human
gattcctgggctctgacctgagacctctgggttctgagctgtgatgttgctctcgagctgggatctccggggtcttggttcagggccggggcctc

SEQ ID NO: 109 - DNA, 82 bp, Artificial
  Hairpin sequence Hsd_99, human
aggtggtacaccctttcctctctgccccatagggtgtagctctaactaccctctagggaagagaaggttgggtgaacagcct

SEQ ID NO: 110 - DNA, 96 bp, Artificial
  Hairpin sequence Hsd_from_Mmd_100, human
tcatgggggagggcgggcaagtcaggtgaccgggtgagaatcagagctatgctgaggtggcctggttaccttgacattcctgtgattctgccaagg

SEQ ID NO: 111 - DNA, 99 bp, Artificial
  Hairpin sequence Hsd_from_Mmd_101, human
tggtgaggtggtgagaaattttgtcttcaagcaaaggtcattggaccagacttttggatttagtgacggtggaggctataatttttcctgctggcagca

SEQ ID NO: 112 - DNA, 89 bp, Artificial
  Hairpin sequence Hsd_from_Mmd_105, human
tagggttgatgcaaaagaaaggaaaacatctttgaagttctgaaaaataggacttcaaagatgttttcctttcttctccatcgaatcta

SEQ ID NO: 113 - DNA, 100 bp, Artificial
  Hairpin sequence Hsd_from_Mmd_107, human
tatgaaaaaaatgtctgtaatatgcagtaaatgaggcccataactcattggaacttccaatgagttatgtgttaaattcatatttcacaacatggtcatg

SEQ ID NO: 114 - DNA, 99 bp, Artificial
  Hairpin sequence Hsd_from_Mmd_112, human
gttcctgtttcctcctgtggcccagagtttgatgtgtagggcagtgatgcccagctccttgcacctctgggccacatcctgggtggccagcatggcagc

SEQ ID NO: 115 - DNA, 99 bp, Artificial
  Hairpin sequence Hsd_from_Mmd_115, human
gagaacatttctgtgccgggccagcaggtgttacctgagtaagattgagattctctcaccaggcgacaaggcttgttgtgcccgagacaggcacagctc

SEQ ID NO: 116 - DNA, 98 bp, Artificial
  Hairpin sequence Hsd_from_Mmd_117, human
aggtgctgggcgaggccatgactggcatctcccaaaatgccaagaacggaaacctgccagagtttggagatgccatttccacagcctcaaaggcactt

SEQ ID NO: 117 - DNA, 98 bp, Artificial
  Hairpin sequence Hsd_from_Mmd_119, human
ggcttgtcagaatgaattctagggtgccaagagacattttgcatatttaagagtatgcaaagtgtctcatggcacattagaattcattctgacaagcc

SEQ ID NO: 118 - DNA, 75 bp, Artificial
  Hairpin sequence Hsd_from_Mmd_120, human
ggggtgggactggtcatgcagccgtgtgtcaggagtaatgattgtagaggggcggggcatgaagagtgccgttct

SEQ ID NO: 119 - DNA, 91 bp, Artificial
  Hairpin sequence Hsd_from_Mmd_123, human
ttcctggggattaatgaatagctgggtggagttaattgcctaaagtatagtctcaggccattaacctcagttggtcactaatccctaggaa

SEQ ID NO: 120 - DNA, 77 bp, Artificial
  Hairpin sequence Hsd_from_Mmd_126, human
ggaattagctctctaaatgccctacaatgactggctgccttgtcagtcctctgagggcgatttgagtacctaactcc

SEQ ID NO: 121 - DNA, 100 bp, Artificial
  Hairpin sequence Hsd_from_Mmd_128, human
gagcttttaaaaaaattactggtgtccaagctccaccctggaccaattaaatgagctctctaggggtggggcctggacatcagtaattttttaaaagctc

SEQ ID NO: 122 - DNA, 99 bp, Artificial
  Hairpin sequence Hsd_from_Mmd_129, human
ctgacctccacctccactgactccctcttttccttcttccctcagccaatgctgaggccttgaaggagatgctgggggacagtgaaggagaagggacag

SEQ ID NO: 123 - DNA, 93 bp, Artificial
  Hairpin sequence Hsd_from_Mmd_133, human
tttgcaaggtccagctattaattacactaagtgacaaagattctccttgttgcatgatggacacaaggatgaatctttgttactgactgcaaa

SEQ ID NO: 124 - DNA, 98 bp, Artificial
  Hairpin sequence Hsd_from_Mmd_136, human
cattactagcagttaatgattggtttgttagttaatggcccaaggcaaagctgagggcggttaagactctaacaaacgagttgtgaattgtagcaatg

SEQ ID NO: 125 - DNA, 83 bp, Artificial
  Hairpin sequence Hsd_from_Mmd_137, human
tgtgccatatcatattcttaccaaaacatttgctttgattggtggctcggtcaacaaagactttggctgagatgacgtggcca

SEQ ID NO: 126 - DNA, 96 bp, Artificial
  Hairpin sequence Hsd_from_Mmd_138, human
tcttattgtgtttggttgaggcctagtaattttcgataaagcccttaatccaagtacttgactgaaaattaccaggcttctctgtggaggatgagg

SEQ ID NO: 127 - DNA, 93 bp, Artificial
  Hairpin sequence Hsd_from_Mmd_141, human
gggctgcccaagagaagggcttattttgactcaggatgctgcagaagctgtggcaggcttgtcaaaatacatctgcctcttcttgagcggccc

SEQ ID NO: 128 - DNA, 79 bp, Artificial
  Hairpin sequence Hsd_from_Mmd_145, human
gtccactccatcaaagggtctaatggtcagcagagggggctaaatgtgtcccccgtgacctgacattaacggagtggac

SEQ ID NO: 129 - DNA, 84 bp, Artificial
  Hairpin sequence Hsd_from_Mmd_147, human
ggagagaggcgcagacaagagaaaataagcctgcccagcaatcatgtctggggctgctgggagggctctctctgttctctttcc

SEQ ID NO: 130 - DNA, 81 bp, Artificial
  Hairpin sequence Hsd_from_Mmd_148, human
tggcagctaatgacctactggaggacttatgtgcctaaggcaaagctgaaggccattagcccaacaggtcattaactgaca

SEQ ID NO: 131 - DNA, 100 bp, Artificial
  Hairpin sequence Hsd_from_Mmd_149, human
gctgaattgatttctgtgcataaacggtggcctagattcttgccctgtggaaatccatggaattaagaactctaggttcctggagtgataagaggtaagc

SEQ ID NO: 132 - DNA, 91 bp, Artificial
  Hairpin sequence Hsd_from_Mmd_150, human
ccagatacaagtgaatttaagcccacatgtattgaagctgcaagcttagtttgcaatttatgtgcaagtggttttgtatttattgatctgg

SEQ ID NO: 133 - DNA, 96 bp, Artificial
  Hairpin sequence Hsd_from_Mmd_154, human
gtgaccatcgttgttcaaggtgttgtgttcagggcccttccaggtaattgaggctttggggcggccacagactcgacatctaagaacaacggtctc

SEQ ID NO: 134 - DNA, 77 bp, Artificial
  Hairpin sequence Hsd_from_Mmd_155, human
tggtgtgcctgcccccttccgtcattgctgtgaatgggctggacggaggaggggccggcgaaaatgatgatgaacca

SEQ ID NO: 135 - DNA, 95 bp, Artificial
  Hairpin sequence Hsd_from_Mmd_156, human
ttttcacttccaggtaatctaattccaaggcatcaggagctttttaataaaaatcctgtgtttgctggagtaaggttgcctgaaatcaaggaaag

SEQ ID NO: 136 - DNA, 79 bp, Artificial
  Hairpin sequence Hsd_from_Mmd_157, human
gctgagagcagcaggatgagggttgacctatatctgtcaggtgtaggtcaaaccctgaatttttgttgcaaacttcagt

SEQ ID NO: 137 - DNA, 89 bp, Artificial
  Hairpin sequence Hsd_from_Mmd_159, human
agtaagtggtcagagagcaggaaatggcttctaattagtagtgtcctcacaggatacaactgcagaagataatttcctgtccccttatt

SEQ ID NO: 138 - DNA, 98 bp, Artificial
  Hairpin sequence Hsd_from_Mmd_161, human
gcttgatgatgctgctgatgctggcggtgatcccgatggtgtgagctggaaatggggtgctacgtcatcgttgtcatcgtcatcatcatcatccgagc

SEQ ID NO: 139 - DNA, 72 bp, Artificial
  Hairpin sequence Hsd_from_Mmd_162, human
aaatgagaaatttttagggccattgagcaccatgcattttcagtgttcagtagccctgaaaatttctcattt

SEQ ID NO: 140 - DNA, 86 bp, Artificial
  Hairpin sequence Hsd_from_Mmd_163, human
gctaaatcattgccagtagtttccaggacattccgctaggctaagcaaaattgccctaagcggtagtcagaaaccactggagtagt

SEQ ID NO: 141 - DNA, 88 bp, Artificial
  Hairpin sequence Hsd_from_Mmd_166, human
tgttaaaataaatggctcatgacttatgaagtgttaaaataaacgtttatttcaacactatacatgtcataagccatttatttcaaca

SEQ ID NO: 142 - DNA, 94 bp, Artificial
  Hairpin sequence Hsd_from_Mmd_167, human
ggcggtagcccaagccttgcaggccccagcggaatgaccagggcgatggaaggaagtcgtgctcgttgcgggcgtggggaatgggcttaccggc

SEQ ID NO: 143 - DNA, 93 bp, Artificial
  Hairpin sequence Hsd_from_Mmd_169, human
gtcaatatctgtgcctcactgtttgttaaatattttgacccagttgccatgggtcagggtgagtgacctgaagggtgggcaggaaggagtgat

SEQ ID NO: 144 - DNA, 94 bp, Artificial
  Hairpin sequence Hsd_from_Mmd_170, human
tttgctgtgaaaattgcaaatgtttgcctggagcaaatacgtgaaaatttgcaatttgttgtaggtgtggaattttgctatttttcacagtgga

SEQ ID NO: 145 - DNA, 97 bp, Artificial
  Hairpin sequence Hsd_from_Mmd_172, human; Hsd_from_Mmd_96, human
ttttcaagtagtcaaactctggttcatggctctggaaggtgctgtaaacattatattctcctctgctatgagactggattttgttctaaaatgaaaa

SEQ ID NO: 146 - DNA, 89 bp, Artificial
  Hairpin sequence Hsd_from_Mmd_173, human
ggtatggattttctttctcaattgctctggagtcaccccgaggctcttaatttgggctattagccgtgggtgatttcaaaatccatatt

SEQ ID NO: 147 - DNA, 81 bp, Artificial
  Hairpin sequence Hsd_from_Mmd_174, human
gaaaacagctttaaagtttagtcattctgatggaatgtaaaagcttgtatcagtgacaggttgacagaaaaagctgttttc

SEQ ID NO: 148 - DNA, 81 bp, Artificial
  Hairpin sequence Hsd_from_Mmd_176, human
gagtctccaaagacaattgtgaaggggattgtgtttgactgatcaatcaaaagcaacccccttgcttgtcttctgagactc

SEQ ID NO: 149 - DNA, 85 bp, Artificial
  Hairpin sequence Hsd_from_Mmd_178, human
cactggaattatgttttatcttaagtccacactggatcctcaggatggatccagtgaggattttgaaagaagcataattcctttg

SEQ ID NO: 150 - DNA, 94 bp, Artificial
  Hairpin sequence Hsd_from_Mmd_180, human
gaggaagggagcggcagcagtgaaggatttgacccccctgccactgataggcagttctctggggcccggaatcagctgcgccgcccccagtatc

SEQ ID NO: 151 - DNA, 94 bp, Artificial
  Hairpin sequence Hsd_from_Mmd_181, human; Hsd_from_Mmd_276, human
gagacttcgaaaatgaacgagaacgagatcttgatgcagatcttgagcgagaagagcgagatccagacttggatttgtttgtttttgacatctc

SEQ ID NO: 152 - DNA, 98 bp, Artificial
  Hairpin sequence Hsd_from_Mmd_182, human
gtttaggggtggacctgatgtccctgagtgtatgtggtgaacctgaatttgccttgggtttcctcatattcattcaggagtgtcagttgccccttcac

SEQ ID NO: 153 - DNA, 94 bp, Artificial
  Hairpin sequence Hsd_from_Mmd_183, human
ggattccactcttgaatctgaacacaggaaataagcttaggaaccatctatgtctgttggttcctgggcattcttgggactggagagtgtttct

SEQ ID NO: 154 - DNA, 87 bp, Artificial
  Hairpin sequence Hsd_from_Mmd_184, human
gaatgactaaacagtcttgcatatatttctggaatacttggaaatgcctctgttatttttggaaatgtgtgcttgttcaggttattc

SEQ ID NO: 155 - DNA, 75 bp, Artificial
  Hairpin sequence Hsd_from_Mmd_185, human
gaccgaccaccagacagacagaggggacgctgctgccaccgcagggactaatctgtctgtggggatgggagagtc

SEQ ID NO: 156 - DNA, 99 bp, Artificial
  Hairpin sequence Hsd_from_Mmd_186, human
ctgcctgctctgcaaaacttaggaggctacttttgattggaataaaagtgcacacactgactttttaaaatgtggctttaattaatggtgggtgggcag

SEQ ID NO: 157 - DNA, 100 bp, Artificial
  Hairpin sequence Hsd_from_Mmd_187, human; Hsd_from_Mmd_525, human
gaggagttaagagttcattcggctgtccagatgtatccaagtaccctgtgttatttggcaataaatacatctgggcaactgactgaacttttcacttttc

SEQ ID NO: 158 - DNA, 91 bp, Artificial
  Hairpin sequence Hsd_from_Mmd_189, human
ttttcaaagcaatgtgtgacaggtacagggacaaatcccgttaataagtaagaggatttgtgcttggctctgtcacatgccactttgaaaa

SEQ ID NO: 159 - DNA, 93 bp, Artificial
  Hairpin sequence Hsd_from_Mmd_19, human
cgcagccgctgctgctgccggcccccctagccttgagggttccgcccacggccgggccccctccgggccggcagcagccgccgaacagctccg

SEQ ID NO: 160 - DNA, 97 bp, Artificial
  Hairpin sequence Hsd_from_Mmd_190, human
ctggccgtgctggcggggctggctctgggcctcagacactctggaatcgccaaggtctgagctcagggcctggcccccttcccaggctaacagccgg

SEQ ID NO: 161 - DNA, 59 bp, Artificial
  Hairpin sequence Hsd_from_Mmd_193, human
ggaggagcagcagggtgaaactgacacagttctggtgagtttcactttgctgctcctcc

SEQ ID NO: 162 - DNA, 99 bp, Artificial
  Hairpin sequence Hsd_from_Mmd_195, human
ctgtaaagcctttattgccacttgttaaggaagacctgtatagctcactcgtgagtaataaggcggtcaacccaaactaaggcactaaaaattttatag

SEQ ID NO: 163 - DNA, 96 bp, Artificial
  Hairpin sequence Hsd_from_Mmd_196, human
agaaacatctcaaatcatgctgacagcattttcactattagcggcaaacaaatcaactataattaaaatgctgtcaaagtgatttgagatttttct

SEQ ID NO: 164 - DNA, 85 bp, Artificial
  Hairpin sequence Hsd_from_Mmd_197, human
aatctaggaggcaggtgctcacttgtcctcctccatgcttggaaaatgcagggaggaggccatagtggcaactgttaccatgatt

SEQ ID NO: 165 - DNA, 85 bp, Artificial
  Hairpin sequence Hsd_from_Mmd_198, human
gcgggggattcctttctggcctcattcctgtaccatttgtttgcaggcttgtagggggagaggaggacattttggaatcctttgt

SEQ ID NO: 166 - DNA, 79 bp, Artificial
  Hairpin sequence Hsd_from_Mmd_20, human
tcctcctcaggtgctcatgtgggagagattagcttgtgtttataagccgatctgttcattaagcgcctgctggtgtgga

SEQ ID NO: 167 - DNA, 100 bp, Artificial
  Hairpin sequence Hsd_from_Mmd_203, human
gcagaaataatcatgtaatcatcttgtaattatatggtacttactatgcaattacatagtaaatacattgtaaattcaaaataattgcatggttatttgc

SEQ ID NO: 168 - DNA, 98 bp, Artificial
  Hairpin sequence Hsd_from_Mmd_204, human
ccctggcagcgggctctgcttcggaaactgttgactcagagggtggccgggcggccagcgtctgatgtcagcctggagctgggccagggagtgcaggg

SEQ ID NO: 169 - DNA, 94 bp, Artificial
  Hairpin sequence Hsd_from_Mmd_208, human
agatgatcccttaccctacctgtctttctatcagtgtagctgaggctaattcagtgcattgatgtaagattattatggggttgagcatttatct

SEQ ID NO: 170 - DNA, 89 bp, Artificial
  Hairpin sequence Hsd_from_Mmd_211, human
gcatcaaacggcttgttttgggcctcaatccgctccttttctgattttcgaaggtagggagcagcttcgccaaaaacagccatctcagc

SEQ ID NO: 171 - DNA, 85 bp, Artificial
  Hairpin sequence Hsd_from_Mmd_212, human
ggtagaggagatggcgcaggggacacgggcaaagacttgggggttcctgggaccctcagacgtgtgtcctcttctccctcctccc

SEQ ID NO: 172 - DNA, 99 bp, Artificial
  Hairpin sequence Hsd_from_Mmd_215, human
ctggagtccagccctccaggggttaagggggcgggaccagctagttgccatggtgccagactgtttgggtctgctctctgacccttgggggctccccag

SEQ ID NO: 173 - DNA, 95 bp, Artificial
  Hairpin sequence Hsd_from_Mmd_217, human
ttgagctgtaattccattgagggtttctggtgactccagcttcgtacttgtggttatagtattcccagaacccctcaatggagtgatttcctgaa

SEQ ID NO: 174 - DNA, 83 bp, Artificial
  Hairpin sequence Hsd_from_Mmd_219, human
catgagtggggtctcctgaacatagtgttcaggtggacttttgggtgtctgagcaccacttttggagggagatttcgctcctg

SEQ ID NO: 175 - DNA, 99 bp, Artificial
  Hairpin sequence Hsd_from_Mmd_222, human
tgggctgcagaggcaccagccctgatggtgtgtcagccaagacatggaagtgagaggtaggcggaggccccattggggttggtcgactctcagcatcca

SEQ ID NO: 176 - DNA, 95 bp, Artificial
  Hairpin sequence Hsd_from_Mmd_223, human
tgtaattccatcttggtgttatggtgacatgaaaatccactcaagcttttctgtcagggtttatgaagttatcaaagccccttgatggaattaca

SEQ ID NO: 177 - DNA, 92 bp, Artificial
  Hairpin sequence Hsd_from_Mmd_225, human; Mmd_225, mouse
tgcatttcagagaatatgcattttacctttgggaatatgttaatttcaggcagcattccctatgggaaaggtgataccagctctgatatgca

SEQ ID NO: 178 - DNA, 91 bp, Artificial
  Hairpin sequence Hsd_from_Mmd_226, human
ttaatgtatccatttttctcagttagtgtcaggtttcattaggaaacatgagaggcctgacattaatcgtatgaaaaatgggtctcaggga

SEQ ID NO: 179 - DNA, 96 bp, Artificial
  Hairpin sequence Hsd_from_Mmd_227, human
cagcgagaggcactttgtacttctgccaggagaccatatgatatctctcagtgactctcctgcatgccaggaacacggacccatgcctcttagctg

SEQ ID NO: 180 - DNA, 99 bp, Artificial
  Hairpin sequence Hsd_from_Mmd_228, human; Mmd_228, mouse
gcctcctcactgcactcttgtctcagttcttgtttcgttagcaggattgactcagtcttgcagcgaggctcggagcagcccagggtcgcaggtagaggt

SEQ ID NO: 181 - DNA, 98 bp, Artificial
  Hairpin sequence Hsd_from_Mmd_229, human
ttgcagcccagtgaagtggggtccggtcattccagtctacatctttgtagtttgggtcacagagacctttcttcaaaatcttcttcactaagctgtag

SEQ ID NO: 182 - DNA, 94 bp, Artificial
  Hairpin sequence Hsd_from_Mmd_23, human
atttttcattccttcagtgttgaaacaatctctactgaaccagcttcaaacaagttcactggagtttgtttcaatattgcaagaatgataagat

SEQ ID NO: 183 - DNA, 93 bp, Artificial
  Hairpin sequence Hsd_from_Mmd_231, human
tagccagtaggtactgatttatgaaaagctgtaaaagatcaggtggagctctgtaggacatcgtttacagctgcatggattgaaacctatcta

SEQ ID NO: 184 - DNA, 98 bp, Artificial
  Hairpin sequence Hsd_from_Mmd_232, human
tgttttcttcacttctgtttatttgcagtcactcaaactgacacgtgctgtcaatatctcctcactgtaagtgtaagcagaagtatttaaagaaagcg

SEQ ID NO: 185 - DNA, 99 bp, Artificial
  Hairpin sequence Hsd_from_Mmd_235, human
gtgtgcttgttgtcgaagatgagggcctcctggatgagctggtgctgctgctccagcaggtccaggttgggcttgtagtccacgatgctgcgttcatac

SEQ ID NO: 186 - DNA, 91 bp, Artificial
  Hairpin sequence Hsd_from_Mmd_236, human
tttctggagattaatagtggactgaagctaatagcctttggctgactctccagccatcagcttttcccagctggtcattaattcccagaaa

SEQ ID NO: 187 - DNA, 77 bp, Artificial
  Hairpin sequence Hsd_from_Mmd_237, human
cgctggcggaggagcagacggaggtggcggtcaagctagagcctgagggaccgccaacgctgctacctccgcaggcg

SEQ ID NO: 188 - DNA, 100 bp, Artificial
  Hairpin sequence Hsd_from_Mmd_243, human
gaaaagtgaaaagttcagtcagttgcccagatgtatttattgccaaataacacagggtacttggatacatctggacagccgaatgaactcttaactcctc

SEQ ID NO: 189 - DNA, 100 bp, Artificial
  Hairpin sequence Hsd_from_Mmd_245, human
caggagcagctggagtcggggattaccccctgctgctgacgtgaggacggtgaacaatcgggaacgttcggtggaagggggaattccccgccgctccctg

SEQ ID NO: 190 - DNA, 98 bp, Artificial
  Hairpin sequence Hsd_from_Mmd_246, human; Hsd_from_Mmd_266, human
tgaccccaagaaaccaaagggcaagatgtctgcttatgccttctatgtgcagacgtgcagagaagaacataggaagaaaaacccagaggtccctgtca

SEQ ID NO: 191 - DNA, 96 bp, Artificial
  Hairpin sequence Hsd_from_Mmd_247, human
ccactttcagctttcagtttttatttaaaagacttaattggaagtttttattactcccaattaggctttttaattaaaaggaaaagttgaaagagg

SEQ ID NO: 192 - DNA, 92 bp, Artificial
  Hairpin sequence Hsd_from_Mmd_249, human
taactctttgattgccatggcaagaaccatgctgatgattctagcttgtgacatttgtgtggttaaaggttgccgcagcagtcaaagggtta

SEQ ID NO: 193 - DNA, 99 bp, Artificial
  Hairpin sequence Hsd_from_Mmd_250, human
tggaccaaaggaacttttctggtctattgggtaaatatgtattaaagtaatttttaaaatacttacatacttaataggctggaagtggtcaatggttta

SEQ ID NO: 194 - DNA, 79 bp, Artificial
  Hairpin sequence Hsd_from_Mmd_253, human; Hsd_from_Mmd_319, human; Mmd_253, mouse
ccttgatttcaatgtttcccactttggtggttgatctgataataggtcttccaaccaaagctgggaagatgtgttctgg

SEQ ID NO: 195 - DNA, 93 bp, Artificial
  Hairpin sequence Hsd_from_Mmd_255, human
tggtgctaaagttggtatggcagcctgcaccattccagttcccaggaatgggcttaggatcaaaggttgctatcactccaaagtcttcacaca

SEQ ID NO: 196 - DNA, 99 bp, Artificial
  Hairpin sequence Hsd_from_Mmd_256, human
gaaaggcctcagtctgcgggccccgaggagggttgtgggcccttttttgtgaatgaagcgccacggaacagccctcctggggtccccacgagccgcgtc

SEQ ID NO: 197 - DNA, 98 bp, Artificial
  Hairpin sequence Hsd_from_Mmd_258, human
ggggtgtttgtttctttctcggtttgctggttggaagacgaagatgaggaggagctggtgctggccctcgaatcgtcatccgacatagcgaacccccc

SEQ ID NO: 198 - DNA, 99 bp, Artificial
  Hairpin sequence Hsd_from_Mmd_259, human
tcccctgctgcactaaattgacacttgggcaagcaatggctctcgtcagtcactccgaagctgctacttccagaagtgtcgatttagtgcagcggggga

SEQ ID NO: 199 - DNA, 96 bp, Artificial
  Hairpin sequence Hsd_from_Mmd_26, human; Mmd_26, mouse
ctctgcttcacctttcttttagcaaagatgaggatttctaccttcaacatacattgttggtcttgtcttctgtttttgttaggagggacagcagtg

SEQ ID NO: 200 - DNA, 96 bp, Artificial
  Hairpin sequence Hsd_from_Mmd_260, human
tatctcttttctgattagagaggtggcatggagcctggctcattaggcagaagtaatgagccagtctatacgccatctctaattagagaaaagata

SEQ ID NO: 201 - DNA, 94 bp, Artificial
  Hairpin sequence Hsd_from_Mmd_261, human
agaatcttctgacaatgaaggtaggcggacaacgaggagattgctgtcacgcatagcttctagcatgtcatctacttttttttcacgaagatct

SEQ ID NO: 202 - DNA, 98 bp, Artificial
  Hairpin sequence Hsd_from_Mmd_262, human
ttacacctgaaacttctcacttgggggtacaattagcctctggcgcctttagaatgagttgctggtgactaattatgccctcaaggaggcatttgtaa

SEQ ID NO: 203 - DNA, 98 bp, Artificial
  Hairpin sequence Hsd_from_Mmd_263, human
gagtacagctggcagaaagtgttacagatataatccttattttccttgtttttgttggtattgtaggagggatctgtaggcctttctgtccagcgctc

SEQ ID NO: 204 - DNA, 97 bp, Artificial
  Hairpin sequence Hsd_from_Mmd_264, human
caaatgctgtgactcgaactcggggaaattgttcctgtaatggagttctcaatttattggtcaatttcaccttgattttgtgtcactgttagctttg

SEQ ID NO: 205 - DNA, 93 bp, Artificial
  Hairpin sequence Hsd_from_Mmd_270, human
tggttgggtgtggggatgggggcacttctgttcctgacaacctcattatgtggttatcaggagcagacactgcccaggttgtcacgacaacca

SEQ ID NO: 206 - DNA, 92 bp, Artificial
  Hairpin sequence Hsd_from_Mmd_271, human
cttggaggctttgcctcatccacaggcatttggcatccgagatggaaaatttcacttgtcaggtcgccatggaaaccagcagagccactgag

SEQ ID NO: 207 - DNA, 98 bp, Artificial
  Hairpin sequence Hsd_from_Mmd_272, human
tattagcatgttaataggtctttgtgcccagaggctttggattataaattatgaagactgcattagccagatgggcaggattaattagcatgctagta

SEQ ID NO: 208 - DNA, 99 bp, Artificial
  Hairpin sequence Hsd_from_Mmd_274, human
caggatggctggggtcgtacatctgtgggtaaggataagcatgcaagtactgtatgtatgactgatgctgactcatgggtgaggagacagccactcttg

SEQ ID NO: 209 - DNA, 98 bp, Artificial
  Hairpin sequence Hsd_from_Mmd_275, human; Hsd_from_Mmd_389, human
ggcaccagctcctccagctccagccccaggtcctgcgcgatgcggcccacgaaggtgccgtgtttggcctcctcggggacggagtagcggagctggcc

SEQ ID NO: 210 - DNA, 78 bp, Artificial
  Hairpin sequence Hsd_from_Mmd_277, human
tagctaattgcaggtgcaattggccacttgcaccatcagttgaagggcaagtggttaattgagcccacaagtgaccta

SEQ ID NO: 211 - DNA, 99 bp, Artificial
  Hairpin sequence Hsd_from_Mmd_279, human
tctaggcttgttttgagttcattgttcagcagatgagcttgttcaagatttcactttcagcagttcatttgattgaacttgggaccaataaaagcgaga

SEQ ID NO: 212 - DNA, 96 bp, Artificial
  Hairpin sequence Hsd_from_Mmd_28, human
tggctttgctccttttctgcatcacttccattaatgcacccacaattcctgaagtgggtgcaggtgttggtggtgtagactcttggccatcagcca

SEQ ID NO: 213 - DNA, 93 bp, Artificial
  Hairpin sequence Hsd_from_Mmd_280, human
ggctacagtaggcttgctgcccagtccaaggccagcagtgttgtgtctggcctgtaagaggcaggtagcaagccatgaatatgtccaaaggcc

SEQ ID NO: 214 - DNA, 80 bp, Artificial
  Hairpin sequence Hsd_from_Mmd_284, human
acgttagtccatttgctcagcggcccttccatgatggacgccatcttgggagccgccaatgacaacaaacggcctgacgt

SEQ ID NO: 215 - DNA, 98 bp, Artificial
  Hairpin sequence Hsd_from_Mmd_286, human
agaaactaatctggattcactccctctggttgatacccactcaaaaaggacacttctgattaagacggttgaaactagagatggacaggttggtatct

SEQ ID NO: 216 - DNA, 100 bp, Artificial
  Hairpin sequence Hsd_from_Mmd_291, human
cccagcgcgtggccgaccgcctgggcctggagctgggcaaggtggtcacgaagaagttcagcaaccaggagaccaggtgggggccgcgccggcggccggg

SEQ ID NO: 217 - DNA, 100 bp, Artificial
  Hairpin sequence Hsd_from_Mmd_293, human
gcttgagctaggggggtaacctcaagctatggaaaaaattagggttagacatgaagtattttttcatagcctgaggaaggccccatgggcagcagcaggc

SEQ ID NO: 218 - DNA, 91 bp, Artificial
  Hairpin sequence Hsd_from_Mmd_294, human
attttcatcacctagggatcttgttaaaaagcagattctgattcagggaccaagattctgcatttttagcaagttctcaagtgatgctaat

SEQ ID NO: 219 - DNA, 99 bp, Artificial
  Hairpin sequence Hsd_from_Mmd_295, human
ggtcagagtgttttgttgtcaggattcttagttgcttgcattggcttatgaaaaggtcattatgagagaagggatctgaatagcaacgagattccagct

SEQ ID NO: 220 - DNA, 87 bp, Artificial
  Hairpin sequence Hsd_from_Mmd_296, human
gtatatttttctcttgcagggttacattttgccatctgcctttccagagtaagtggctctatgtgggcactgaacgaggtaatatac

SEQ ID NO: 221 - DNA, 96 bp, Artificial
  Hairpin sequence Hsd_from_Mmd_297, human
agactaattaatgtttcagagtgtttaaacacaatgcctctacagaagcaatggcattataatgtgttgggacactctagtgttgtaattagtact

SEQ ID NO: 222 - DNA, 98 bp, Artificial
  Hairpin sequence Hsd_from_Mmd_298, human
cttcagcaaccttacagccccatcattcatttgcataatggatgcctttttatccattatgcaaatggtatgagaggaaaattaggcaataagggaag

SEQ ID NO: 223 - DNA, 91 bp, Artificial
  Hairpin sequence Hsd_from_Mmd_299, human
gtgatgaatgtatattggtaaggagggtgaggttgaaggggcagggacctctcaaatgaagtgactttctttaccagcacattcagaacac

SEQ ID NO: 224 - DNA, 95 bp, Artificial
  Hairpin sequence Hsd_from_Mmd_300, human
cagccagaactaccctggcgggtggaaacagcttttaccgcgtgtggctgtcgcatgtggttttggaattttccaacgccccctacgattggctg

SEQ ID NO: 225 - DNA, 99 bp, Artificial
  Hairpin sequence Hsd_from_Mmd_301, human
aggctataattccactgaggggtgctggcggtgacatgtaccatgaagtcagaatctgagtggtttgtcaccagaacccccagggtagaattataggct

SEQ ID NO: 226 - DNA, 96 bp, Artificial
  Hairpin sequence Hsd_from_Mmd_302, human
ggcagtgcctaaggaattaatggcccgctgaggttaatgagtccctcctctgggccatcaactctcccagctggccattaatcccctagaaatgtc

SEQ ID NO: 227 - DNA, 92 bp, Artificial
  Hairpin sequence Hsd_from_Mmd_303, human
gtaacacaggtggtacaccctttcctctctgccccatagggtgtagctctaactaccctctagggaagagaaggttgggtgaacagccttac

SEQ ID NO: 228 - DNA, 94 bp, Artificial
  Hairpin sequence Hsd_from_Mmd_305, human
gcgatgcgttgcatttgggtgacaggcagttgttcgtgcttgaataactcaggatttgaattctacagtttgtggcatccgtgtaatgcttagc

SEQ ID NO: 229 - DNA, 97 bp, Artificial
  Hairpin sequence Hsd_from_Mmd_306, human
tcaacattttccttgccacagaatgattcctctgagaacaaagtaattgttgacttcaaagaactctgaggaagttcagtggatggaaagaatttgg

SEQ ID NO: 230 - DNA, 97 bp, Artificial
  Hairpin sequence Hsd_from_Mmd_31, human
gcggtcccatcagcggaagctcagggcctgcgggaactggagggtgcctctgaccccttgctctcactctttggctctacttctgacaacgacttgc

SEQ ID NO: 231 - DNA, 96 bp, Artificial
  Hairpin sequence Hsd_from_Mmd_311, human
ggattaattggtcaggaaagacactttttatattgtcaagtggcacttaagccattaattcttgactgtgaaactgcttttcctgggcaatgctct

SEQ ID NO: 232 - DNA, 97 bp, Artificial
  Hairpin sequence Hsd_from_Mmd_314, human
aaattaatgaccaaaatgtcagatgtgtccacagctaattattcattagatgcttaattagtgtgggatgatcatgacattttaatgttattaattt

SEQ ID NO: 233 - DNA, 92 bp, Artificial
  Hairpin sequence Hsd_from_Mmd_316, human; Mmd_316, mouse
tcctctttgcaaaatcatatttttgtgggaatgggccctgctttttgtggcaaggcctgttctgattaataaaggatcgtgaaaaagtaggg

SEQ ID NO: 234 - DNA, 82 bp, Artificial
  Hairpin sequence Hsd_from_Mmd_318, human
gatctctaatacccattagtgttagggcctgttacctcaatcatgagtgacagagccctaattattaaggtaattagaagtt

SEQ ID NO: 235 - DNA, 99 bp, Artificial
  Hairpin sequence Hsd_from_Mmd_321, human
agtatatgagcctataactggcttttacagatgattaaatgctcaggttgaagccgaggcttttgataactgctagagccatttatgacctcatatact

SEQ ID NO: 236 - DNA, 99 bp, Artificial
  Hairpin sequence Hsd_from_Mmd_324, human
ggccgcatggaccacgtggaccgctgcttcgacgtgctggctgtggagtactatgtgccggagacggaccagtggaccagcgtgagccccatgcgggcc

SEQ ID NO: 237 - DNA, 82 bp, Artificial
  Hairpin sequence Hsd_from_Mmd_325, human
ggcgtgagggtatgtgcctttggactacatcgtggaagccagcaccatgcagtccatgggcatatacacttgcctcaaggcc

SEQ ID NO: 238 - DNA, 81 bp, Artificial
  Hairpin sequence Hsd_from_Mmd_326, human
tttcctaagtgatgtcagcccctgtgagcttccaataggaaccaggcataaatcagggagctgaccttatccaataggaaa

SEQ ID NO: 239 - DNA, 91 bp, Artificial
  Hairpin sequence Hsd_from_Mmd_328, human
ccaagcagggacttcttgccagcccttggcagcatgaggcctcccatcatcatccaccgagctggcaagaagtatggcttcaccctgcggg

SEQ ID NO: 240 - DNA, 90 bp, Artificial
  Hairpin sequence Hsd_from_Mmd_33, human
ggtcagaatcctgtgcttacgacacctcggtctgttgccatggaaacaggggcggattaaggctggagcgtggagcgcagggatcaggcc

SEQ ID NO: 241 - DNA, 95 bp, Artificial
  Hairpin sequence Hsd_from_Mmd_330, human
gtgccccgcggagtggctgtgatgagcgggatgcggaaggtgtccactgagccgatctgtctcccgctcacccacagcagttgctccatggtcac

SEQ ID NO: 242 - DNA, 100 bp, Artificial
  Hairpin sequence Hsd_from_Mmd_333, human
gggctgatgagcagttcaagttccctgcatagaaatagcctcagaatagttccagtgttgtttctaattgcaatggatgagcagactgtctcattaatcc

SEQ ID NO: 243 - DNA, 99 bp, Artificial
  Hairpin sequence Hsd_from_Mmd_334, human
ctttcacaaagagcaaagggtttcagaatcaagtttgtcttcaagcagcagcaaacgcttgctgacaagatattttggaacaactcgctattaggaagg

SEQ ID NO: 244 - DNA, 95 bp, Artificial
  Hairpin sequence Hsd_from_Mmd_335, human
gaggcgagtgtggatctaatcttcagctgattaaatgtccctcattaatgagtttctttaattaatgaagtttttgggtctgctccacttgcttt

SEQ ID NO: 245 - DNA, 88 bp, Artificial
  Hairpin sequence Hsd_from_Mmd_336, human
gtgggaattacaggctggagagaccttccttctgcaggagaagaaattcttgaagtagaatctgaggtgtatcaagcttaattcctat

SEQ ID NO: 246 - DNA, 77 bp, Artificial
  Hairpin sequence Hsd_from_Mmd_338, human
tccaagttcatgatgaagagtttatcagtgggggtcagttccacaggctgtctggtgaactctttgtcgaagttgga

SEQ ID NO: 247 - DNA, 76 bp, Artificial
  Hairpin sequence Hsd_from_Mmd_34, human
gtcgagaattgattttatattcctggtcaagttgctgaaatgtagcaattgggtcaggaagatcggttccttggac

SEQ ID NO: 248 - DNA, 98 bp, Artificial
  Hairpin sequence Hsd_from_Mmd_340, human
ggcccagccacagtgacattcatcccccggtgggtctggcctcagtcctcacaacccaccgacaacaatgaatgttgattgtgacctcggctgtggcc

SEQ ID NO: 249 - DNA, 100 bp, Artificial
  Hairpin sequence Hsd_from_Mmd_343, human
aatatgcagggtgatggttggggatttggcagcatggccccatgaacattagtgggagttagtctgctaaatcccagacactgaacagaatcctcatgtt

SEQ ID NO: 250 - DNA, 100 bp, Artificial
  Hairpin sequence Hsd_from_Mmd_344, human
gttctcggtagctatggaaatcccagggtttccctagcaacagctccagatgggtcttgttgctagggaacgctgggatttcccaggctgccagatgagc

SEQ ID NO: 251 - DNA, 91 bp, Artificial
  Hairpin sequence Hsd_from_Mmd_346, human
ctcaggcgcgggttggggaggatgttttggatgccgctctgctgacgctggtgccctctgttcttacatcctccttaatttactgcctgag

SEQ ID NO: 252 - DNA, 98 bp, Artificial
  Hairpin sequence Hsd_from_Mmd_347, human
gcggcgggctgagttttgaaaacttaggattctaaatgtataaattgtttggaacatttaacatctagtcattaagcagtcacccccttgccctccgt

SEQ ID NO: 253 - DNA, 83 bp, Artificial
  Hairpin sequence Hsd_from_Mmd_35, human
gggcttggcctggctctgctgggacacttcgcacttttgccatttttggccagaaggcgctccctgctagcccggctctgttc

SEQ ID NO: 254 - DNA, 99 bp, Artificial
  Hairpin sequence Hsd_from_Mmd_353, human
gcattttctgaggattgatgaccagctaggaggagttgatggtccttggctgaaacttgggccattaactctagccagtcattaattgcctggaaatgt

SEQ ID NO: 255 - DNA, 92 bp, Artificial
  Hairpin sequence Hsd_from_Mmd_354, human
ggcctctgtatttaatttggctcagccgggaagatttttggctctgtgcgtgtgtatattctgaaaaatctttccgagtgagcccaggggtt

SEQ ID NO: 256 - DNA, 94 bp, Artificial
  Hairpin sequence Hsd_from_Mmd_355, human
gttgtagcatgtggttgtattaatgaacgttacaggagagctttataatcatttataaatctgtaacattcaataaagaaacacatgttgcaat

SEQ ID NO: 257 - DNA, 98 bp, Artificial
  Hairpin sequence Hsd_from_Mmd_356, human
ttggtgttgtcaatttgcgagaccagtctggaattctcggccttggtacacaagatctagaattaagagattgtacacacaaatgaagcaaacaccaa

SEQ ID NO: 258 - DNA, 88 bp, Artificial
  Hairpin sequence Hsd_from_Mmd_358, human
ggtcggtgcagcagagaaacagaggataatggcgtctgcagtgctgtcgcctggagcgccctcctcctttctcgttcgcgcactcact

SEQ ID NO: 259 - DNA, 93 bp, Artificial
  Hairpin sequence Hsd_from_Mmd_361, human
agaaagatgctgaaaccaatgaagcaatctattgtacaaaggagcctttcattaaggctcgtgttattgtcattcgttggctggtttctttct

SEQ ID NO: 260 - DNA, 97 bp, Artificial
  Hairpin sequence Hsd_from_Mmd_363, human
agacaaaccctaaaaatgtagcagaagcatttccgcacactggtgtccagaatctagtttgtgcagaaatgtttccactagatttatagagtactct

SEQ ID NO: 261 - DNA, 99 bp, Artificial
  Hairpin sequence Hsd_from_Mmd_367, human
gcacggcttggcattggaagttttatttgaatcaggggagaatattatttgagatattttcctaaatgacaaatgaatgatttacctgcagcaatgtgt

SEQ ID NO: 262 - DNA, 98 bp, Artificial
  Hairpin sequence Hsd_from_Mmd_37, human
gagtccgtgaccgggatttgcttgtgcagttgtttattaactacctgggcattttgctgatggtgcaatttgcagagctgttaatggtaatgaaactc

SEQ ID NO: 263 - DNA, 100 bp, Artificial
  Hairpin sequence Hsd_from_Mmd_370, human
atgccatgcaaattggcacagaggcaatcagcctgactctaaaagctgccccactggccgcaggctggctcattgtcttttctgtcaatttgcatctcat

SEQ ID NO: 264 - DNA, 99 bp, Artificial
  Hairpin sequence Hsd_from_Mmd_371, human
gcagctaggagcctgccaagtgctggtggaagtagaggccgaaaaggctggcgagcagctggcaggcagccgtccaccagatgaggtaggccaggacgc

SEQ ID NO: 265 - DNA, 88 bp, Artificial
  Hairpin sequence Hsd_from_Mmd_372, human
cttggcgtccttgtctctctctcccctgcccagtggcctccttgtctggctcactgggcaggagccctaatcggattcgacagctgag

SEQ ID NO: 266 - DNA, 88 bp, Artificial
  Hairpin sequence Hsd_from_Mmd_373, human
tattttctgtttcagaaaattcttccaggaggaaatacatcatttgatgtagtttttcttgcaagagtagtaggaaatgtagaaaata

SEQ ID NO: 267 - DNA, 96 bp, Artificial
  Hairpin sequence Hsd_from_Mmd_376, human
gttatcataaaataatcacagccctcaggtgctgtgaggcactgggtgcagctaagtgtctctaattccccaagggggtgattagctgatgataac

SEQ ID NO: 268 - DNA, 83 bp, Artificial
  Hairpin sequence Hsd_from_Mmd_378, human
cgaacacccaaaataatgtgagatcaggcaccatgcattatgcatgaggtctgatttaacatgaacattatttcttgtgtacg

SEQ ID NO: 269 - DNA, 81 bp, Artificial
  Hairpin sequence Hsd_from_Mmd_382, human
aggactcgatgacgttgaagttgcacagggggctgacctcaaagaaggtcatgcagttcttctctgcgtacgcgcgggcct

SEQ ID NO: 270 - DNA, 93 bp, Artificial
  Hairpin sequence Hsd_from_Mmd_383, human
cttcacctggcacactgggctggaagactttattcagatccaaggaggaggctctggaatgggttttctgtggccgaggtggcggggtgggag

SEQ ID NO: 271 - DNA, 84 bp, Artificial
  Hairpin sequence Hsd_from_Mmd_387, human
tagggaaacccagttgcttgggtggatccagacaaaatggattttcatccttggattttgtgcccacgcctctgggtcaccttg

SEQ ID NO: 272 - DNA, 100 bp, Artificial
  Hairpin sequence Hsd_from_Mmd_388, human
agggtgtgtattatagacgagcaatgatgtgccttggcagttaatggcactcagtccaaactaccagggcatgtcattattaggtcataatacccaccct

SEQ ID NO: 273 - DNA, 94 bp, Artificial
  Hairpin sequence Hsd_from_Mmd_39, human; Mmd_39, mouse
cagctcagaatgtggtaggagctatcagaacttagtgatcaagtgaagtcgtagttactaatttctgatgctcttcccctgcagaagagagctg

SEQ ID NO: 274 - DNA, 82 bp, Artificial
  Hairpin sequence Hsd_from_Mmd_391, human
gcaaagctggcatttcggagcacgtcagaagcgctggctcccagccctggaagtcagcgtctggcctctgagccagcactgc

SEQ ID NO: 275 - DNA, 79 bp, Artificial
  Hairpin sequence Hsd_from_Mmd_396, human
tacaggacgtctgtgcaattcgatggagctcatcacttttcggtctatgagcaattaaattgcaccaggaagccctgta

SEQ ID NO: 276 - DNA, 91 bp, Artificial
  Hairpin sequence Hsd_from_Mmd_398, human
tgcttgattagtcagattgatggaagaggccatatgtggccatgtcaaaacttggctacaaggctctttccctctctatgaaggacaggca

SEQ ID NO: 277 - DNA, 87 bp, Artificial
  Hairpin sequence Hsd_from_Mmd_399, human
gctcaccctggaggctacagatgctgatggaagccgcagccatgccgctgtggactacagcatcatcagtggcaactggggccgagt

SEQ ID NO: 278 - DNA, 100 bp, Artificial
  Hairpin sequence Hsd_from_Mmd_40, human
ctgtcggctcagaagtccatggagctgtgggccaggtagtccttgcgaccgatgttgctgacctgcttggtctgcatagcctcgagtttggggcagtcag

SEQ ID NO: 279 - DNA, 95 bp, Artificial
  Hairpin sequence Hsd_from_Mmd_405, human
ctgccctctgcagcctgccccgagcctgggccctcttcccacccaggtcaggagcgggggagggtagggtcctggggagggaagaggaggggcag

SEQ ID NO: 280 - DNA, 92 bp, Artificial
  Hairpin sequence Hsd_from_Mmd_408, human
gaaaaatcagctttaattaatttgagtgccagctctgtgtataattacacagcatgagagtttgcatgcaaatgcagaaatgctgattgttc

SEQ ID NO: 281 - DNA, 88 bp, Artificial
  Hairpin sequence Hsd_from_Mmd_409, human
ccatcagtcaggaaattgtatgataaataggaggtagccaggtttcgtggcacttccttctgcttcagcagttttcgcctgactttgg

SEQ ID NO: 282 - DNA, 83 bp, Artificial
  Hairpin sequence Hsd_from_Mmd_41, human
gtttgtgtgcatttgcaggaacttgtgagtctcctattgaaaatgaacaggagactgatgagttcccgggaacacccacaaat

SEQ ID NO: 283 - DNA, 91 bp, Artificial
  Hairpin sequence Hsd_from_Mmd_410, human
gtcgttgctgacccaagccgtcaggtagatgtagaaagcgctgggattaatgatgccatctgcatccaccagacgctgtttagtcaactac

SEQ ID NO: 284 - DNA, 88 bp, Artificial
  Hairpin sequence Hsd_from_Mmd_411, human
cttcttgtataagcactgtgctaaaattgcagacactaggaccatgtcttggtttttgcaataatgctagcagagtacacacaagaag

SEQ ID NO: 285 - DNA, 96 bp, Artificial
  Hairpin sequence Hsd_from_Mmd_412, human
ccattagcagtaggctatggattaggagtggtagaaaggatatctttaaatagatttctttgtttgtttgtttggtttgaggcctagtgattgagg

SEQ ID NO: 286 - DNA, 98 bp, Artificial
  Hairpin sequence Hsd_from_Mmd_413, human
gcaggcatttcctgaggattaatgaccagctgggaggaaccagtggcccttggctctgcctcccagccagccattaattctaaggaaatgtcttttgc

SEQ ID NO: 287 - DNA, 100 bp, Artificial
  Hairpin sequence Hsd_from_Mmd_416, human
ggctcggaggtgggggaggcggtttgtgctggtgcctggtgtataatcgggttaatccagtagacaaagaataaaccaatagccctcccacctcacttcc

SEQ ID NO: 288 - DNA, 98 bp, Artificial
  Hairpin sequence Hsd_from_Mmd_418, human
tcactggttctcctcccctcccccaatccaaacttccctactccgtctaccggcagcaacaaccacgtgggggaggggtaagagagtagaaccggtga

SEQ ID NO: 289 - DNA, 96 bp, Artificial
  Hairpin sequence Hsd_from_Mmd_42, human
gaccacaagaaaccaaagggcaagatgtctgcttatgccttctttgcgcagacatgcagagaagaacataagaagaaaaacccagaggtccctgtc

SEQ ID NO: 290 - DNA, 100 bp, Artificial
  Hairpin sequence Hsd_from_Mmd_422, human
tcctcatttgagtcataatcctccatttgtgacatcacaattagccacttgtggtgatgattataatgtcatgaacaaaggattatgactgggagttgga

SEQ ID NO: 291 - DNA, 99 bp, Artificial
  Hairpin sequence Hsd_from_Mmd_424, human
atcccaagagtcactgacacaagctctacaactattgaactagaatgggaacccccagctttcaatggtggtggggaaattgttggctattttgttgat

SEQ ID NO: 292 - DNA, 94 bp, Artificial
  Hairpin sequence Hsd_from_Mmd_426, human
gcctgttgacatgttcagacgcaactccagtagaagtgctgggcctggcagggggccaggcctgagtcacagctgctgggcgtatcaacgtggc

SEQ ID NO: 293 - DNA, 87 bp, Artificial
  Hairpin sequence Hsd_from_Mmd_428, human
tcgatgtgaagatcctgcagcagctggtgaccttgaatgagggcatcgaggcagtgcgctggctgttggaggagcgggggacgttga

SEQ ID NO: 294 - DNA, 86 bp, Artificial
  Hairpin sequence Hsd_from_Mmd_429, human
gttttacagctcagaggggattaggacaaaagatgtatttaaaatatggtatgtgtctctctctgtccctctgcagctgatggagc

SEQ ID NO: 295 - DNA, 78 bp, Artificial
  Hairpin sequence Hsd_from_Mmd_430, human
ccatcgtgcaggattacatttgttctcctcatgctgaaagtatgaggaagagaaaccagattgtgttcaccatggtgg

SEQ ID NO: 296 - DNA, 87 bp, Artificial
  Hairpin sequence Hsd_from_Mmd_431, human
gctggttttggcacttctctcactctagtgagttgcaaaaaaacaagcaggtgctagcaatctgagagaccacatgccagctacagc

SEQ ID NO: 297 - DNA, 98 bp, Artificial
  Hairpin sequence Hsd_from_Mmd_433, human
gttggtgccctgataaagccgagccctggcagataaatgctgaggtgcagccaagccatttatttgaggagcagcagggctcctatcagggcaccaac

SEQ ID NO: 298 - DNA, 88 bp, Artificial
  Hairpin sequence Hsd_from_Mmd_435, human
agcatttgtgtgcataaaatgggtaattgcacacacaaatgggcaattttgtatgcaattatccattttgcatacgcaattatatgct

SEQ ID NO: 299 - DNA, 97 bp, Artificial
  Hairpin sequence Hsd_from_Mmd_436, human
tccaggtgtccaccaaggacgtgccgctggcgctgatggcctgtgccctgcggaagaaggccacagtgttccggcagccgctggtggagcagccgga

SEQ ID NO: 300 - DNA, 91 bp, Artificial
  Hairpin sequence Hsd_from_Mmd_437, human
gcctttcctgggcatacagaaccccctggcagccagtcttgaggcaacacctgccttccgcctggctgacagcaggactaacccagcaggc

SEQ ID NO: 301 - DNA, 97 bp, Artificial
  Hairpin sequence Hsd_from_Mmd_438, human
gttgttattaaatcaccttgaagtgtctcttgtaaaagataactccctgcattgtagaaatgtctttgacaagagaggattagggtgaaactgcaat

SEQ ID NO: 302 - DNA, 89 bp, Artificial
  Hairpin sequence Hsd_from_Mmd_439, human; Mmd_439, mouse
tctagggagccaccagtggtgtaagtgctttggctaagtgatggagacaactgaggaggagtgtgattaccactgggttcctgaatgga

SEQ ID NO: 303 - DNA, 99 bp, Artificial
  Hairpin sequence Hsd_from_Mmd_44, human
ggtgaggagcaggttagctgggtgaaaagttcacagtgaggggagctgtctgttccctcgcttaatttatccactatttggctaaccttgctctgaacc

SEQ ID NO: 304 - DNA, 93 bp, Artificial
  Hairpin sequence Hsd_from_Mmd_443, human
cagagggggaatcacatgagctacagctgagttcacaggaatgatttgtgagcctcagtatttgcacatgtgtggtcatgggggacctctctg

SEQ ID NO: 305 - DNA, 73 bp, Artificial
  Hairpin sequence Hsd_from_Mmd_448, human
ccttctcagccccagctcccgctcacccctgccacgtcaaaggaggcagaaggggagttgggagcagagaggg

SEQ ID NO: 306 - DNA, 83 bp, Artificial
  Hairpin sequence Hsd_from_Mmd_45, human
gggccctgctgattgttaaactcaacggagatagaattttttttcttcctctgtgtgtgtttattgtaatatctggagggctt

SEQ ID NO: 307 - DNA, 90 bp, Artificial
  Hairpin sequence Hsd_from_Mmd_450, human
gcagctggaaagggcttagccctttaatgccggcagctgtatcttcacagtgcggctgctctgctgaggggctggactctgtccagaagc

SEQ ID NO: 308 - DNA, 91 bp, Artificial
  Hairpin sequence Hsd_from_Mmd_452, human; Hsd_from_Mmd_473, human
taataaattaaatgcctaaactggcagagtgcaaacaattttgactcagatctaaatgtttgcactggctgtttaaacatttaatttgtta

SEQ ID NO: 309 - DNA, 97 bp, Artificial
  Hairpin sequence Hsd_from_Mmd_455, human
tctttgtcatggtgtcagaagattaattatgctcgtgtgagaacagctttctcattgggtaaaaagagacattatccttctgacttgtgacagaaga

SEQ ID NO: 310 - DNA, 87 bp, Artificial
  Hairpin sequence Hsd_from_Mmd_456, human
taggcacgcagctttggagacgccgaggggaaaatggatttaattgattcgttacctctggtattgtaatgcctgctgcgatgttta

SEQ ID NO: 311 - DNA, 82 bp, Artificial
  Hairpin sequence Hsd_from_Mmd_459, human
gaccagctcacaggaagtggccttcaatagtccgatagcttcctgtatcctgacattgtgaaggcccacttcctgtgctgtc

SEQ ID NO: 312 - DNA, 98 bp, Artificial
  Hairpin sequence Hsd_from_Mmd_461, human
gccggagggggcggcgcgcgagagcctggtggccctggtcagcacctcggacagggactcgggcgccaacgggcaagtgcgctgcgccctctatgggc

SEQ ID NO: 313 - DNA, 100 bp, Artificial
  Hairpin sequence Hsd_from_Mmd_464, human
ttaggcagcaggagaaaacaatgggccaggttctcattctgtgtaatctcataggatggttccattgtatagcccattgtttcttccatgtactgcctga

SEQ ID NO: 314 - DNA, 87 bp, Artificial
  Hairpin sequence Hsd_from_Mmd_465, human
ccgtgtgagtttgtactgcaaagctccttggcatccttgcctgagttgggtgttgggaagctcaaattgcagctacaaactggctgg

SEQ ID NO: 315 - DNA, 91 bp, Artificial
  Hairpin sequence Hsd_from_Mmd_466, human
gtgtttatttgaatgtgtgatggggaggtcatcaaaatgaacacactcgttgtgtttatttgaatctcacatcgctcataagaatacacgc

SEQ ID NO: 316 - DNA, 79 bp, Artificial
  Hairpin sequence Hsd_from_Mmd_468, human
gtccgcggagtctctaactggcgacagatgggccactttcttctggccacaaaggggccggaatggagcgctccgcggc

SEQ ID NO: 317 - DNA, 85 bp, Artificial
  Hairpin sequence Hsd_from_Mmd_47, human
gcctgccccagaaccagccctttgtcttctcccttggcacaggccaggtcatcaagggctgggaccaggggctgctggggtgagt

SEQ ID NO: 318 - DNA, 92 bp, Artificial
  Hairpin sequence Hsd_from_Mmd_470, human
ttggtcctatttcctcctgtggcccggagttggatgtgtagggcaatgatacccagctccttgcacctctgggccacatcctgggtggtcaa

SEQ ID NO: 319 - DNA, 94 bp, Artificial
  Hairpin sequence Hsd_from_Mmd_471, human
aaaatttttgtaggtggactgggagagcagcagattgcagatgcgtttaacagcagggtattttctgctgccatgaccagttaaggaaaatttt

SEQ ID NO: 320 - DNA, 90 bp, Artificial
  Hairpin sequence Hsd_from_Mmd_472, human
ggcccctctgtgtggctgctgctggctcagacccctgcccaccttgggcgggtgggtctgggtcttggctggcacgcacacccaggggcc

SEQ ID NO: 321 - DNA, 95 bp, Artificial
  Hairpin sequence Hsd_from_Mmd_476, human
ccgggtctcagggaaatcaggcttctggagagtgagtttgtttgtaataataatacgaattattctctcagcctgaggtcaccgggaggtgtagg

SEQ ID NO: 322 - DNA, 98 bp, Artificial
  Hairpin sequence Hsd_from_Mmd_477, human
gtccagcaatattttaagctcccagccagacagcttttatgaagggagggatgtttgggaaacaatgggagtgagagaatgggagagctgtgttgggc

SEQ ID NO: 323 - DNA, 95 bp, Artificial
  Hairpin sequence Hsd_from_Mmd_478, human
tcggtccagtatatggttggttggtcctgagcatgttggaagagtttctgttcaacatgacatgctctgaggccacttggccagaaatgagctga

SEQ ID NO: 324 - DNA, 93 bp, Artificial
  Hairpin sequence Hsd_from_Mmd_48, human
cctttggttcacattaaaatataaattccctgtgggagagaccctattaagccttgcagggaattgctaatttacatcttaatgtgaatgagg

SEQ ID NO: 325 - DNA, 99 bp, Artificial
  Hairpin sequence Hsd_from_Mmd_480, human
gatcacgtcaccatggccaaccgggagttggcatttaaagctggcgacgtcatcaaagtcttggatgcttccaacaaggattggtggtggggccagatc

SEQ ID NO: 326 - DNA, 96 bp, Artificial
  Hairpin sequence Hsd_from_Mmd_481, human
aagtggtttggagggctgcgttcattttgagtgctgttgtaatcaattttagatacagcattccacaatggatcagtttgcatccaaacctgcctt

SEQ ID NO: 327 - DNA, 99 bp, Artificial
  Hairpin sequence Hsd_from_Mmd_482, human
cctcggctccctggagccgctccaccgatggcaccatcttggcgcagaaactcgccgaggaggtgcccatggacgtggcctcttacctctacaccgggg

SEQ ID NO: 328 - DNA, 91 bp, Artificial
  Hairpin sequence Hsd_from_Mmd_483, human
ccagctgcccgggaagcttggcagccaggctgagggaaggaagcatcggctctctttgaaggtcggctgccagtgaatctcaggcagctgg

SEQ ID NO: 329 - DNA, 77 bp, Artificial
  Hairpin sequence Hsd_from_Mmd_485, human
ttatttcctccactgcctgactttattgaatgccatggggcatattaatcagtaaagccaagtagtgcatgaaataa

SEQ ID NO: 330 - DNA, 99 bp, Artificial
  Hairpin sequence Hsd_from_Mmd_486, human
gtcggagctgttacatttggcagcattccttgttagcatttgataaacaattattgccaaatgttagcaaggaaacctgccaaatgttacagctcagat

SEQ ID NO: 331 - DNA, 100 bp, Artificial
  Hairpin sequence Hsd_from_Mmd_487, human; Hsd_from_Mmd_535, human; Hsd_from_Mmd_78, human
tgctgttgtccttggagaagtctgggcctgggacagaggagggatgtaatctgaacactcctttgtcacaggtcaccagggtgtgcttgaggggacggta

SEQ ID NO: 332 - DNA, 91 bp, Artificial
  Hairpin sequence Hsd_from_Mmd_488, human
cagctagctccgttcgtgatccgggagcctggtgccagcgagacctggaatttccggtctggttggtctggggccccgcggagccaggttg

SEQ ID NO: 333 - DNA, 98 bp, Artificial
  Hairpin sequence Hsd_from_Mmd_489, human
gggaaagaggactattatttaaaaggcttttaaatgatgtcactatatattcttttaacaacatcctctaaaagcctttgaaaaaatagtcccttcct

SEQ ID NO: 334 - DNA, 98 bp, Artificial
  Hairpin sequence Hsd_from_Mmd_49, human
gcgagagccatccccgaacaccttgcggtaggaggaggaggagcacaggtagtgctccgagccgaagctcatggtgccgggatcggggccggacgtgc

SEQ ID NO: 335 - DNA, 89 bp, Artificial
  Hairpin sequence Hsd_from_Mmd_490, human
agtcaggtactcgaatggaggttgtccatggtgtgttcattttatttatgatgagtattacatggccaatctcctttcggtactcaatt

SEQ ID NO: 336 - DNA, 93 bp, Artificial
  Hairpin sequence Hsd_from_Mmd_491, human
gaactgcttttcttttctcctttttgcacaaagagtctcatgtctgatatttagacatgatgagctttgtgcaaaaggggagctggctacttc

SEQ ID NO: 337 - DNA, 99 bp, Artificial
  Hairpin sequence Hsd_from_Mmd_492, human
cgtcaaggatttggcatttcaatcgatgggaaatgatgtgtgatcattctaatttattatacatcatttcccatcaatcgacgaactaaagccttgacg

SEQ ID NO: 338 - DNA, 91 bp, Artificial
  Hairpin sequence Hsd_from_Mmd_494, human
gctctgtggccatttcggtttttccagtccgatgcccctgagggggagggtcgggccccttggaaaatccgttttcatggcaacacggagc

SEQ ID NO: 339 - DNA, 95 bp, Artificial
  Hairpin sequence Hsd_from_Mmd_499, human
ttcgagaggtcacacatgtgatgaattgtgggtgcttgcctggcttcccaggcgagaaccataagcaattattaaatgccattgtgcgtcaggaa

SEQ ID NO: 340 - DNA, 81 bp, Artificial
  Hairpin sequence Hsd_from_Mmd_500, human
gattttcccaacattttatggcaatttgtttcatttgccgcaggcccgtaacgatgcaaattgccataaagtgggataatc

SEQ ID NO: 341 - DNA, 96 bp, Artificial
  Hairpin sequence Hsd_from_Mmd_501, human
tctaatggccagataatggaccacaataaaagttatgggtccccagctggggtgaagctcataatggttggcaagatccattatttgaccattagg

SEQ ID NO: 342 - DNA, 89 bp, Artificial
  Hairpin sequence Hsd_from_Mmd_503, human
ggccaaaatctgccctcagttatgcatgcacagcttgcattgacgtcagtaagaactgtgctcatgtaacaggaggcagaaatttggct

SEQ ID NO: 343 - DNA, 98 bp, Artificial
  Hairpin sequence Hsd_from_Mmd_505, human
tcccatgtgcctttaaggaatcattcttgatctcagccataaaattggaaagctgcataactgacaagatgatccctgaaggcagctgaaacatgggg

SEQ ID NO: 344 - DNA, 91 bp, Artificial
  Hairpin sequence Hsd_from_Mmd_506, human
gtcttttaactctatattgctggtggctctgatttcatgatgcattgtgcttatgaaactctagctttcagcactaaaatgagttaaagat

SEQ ID NO: 345 - DNA, 100 bp, Artificial
  Hairpin sequence Hsd_from_Mmd_507, human
gcggcgcggggcgcgtcgcccccctcagtccaccagagcccggatacctcagaaattcggctctgggtctgtggggagcgaaatgcaacccaaaccccgt

SEQ ID NO: 346 - DNA, 80 bp, Artificial
  Hairpin sequence Hsd_from_Mmd_509, human
ggctcactggaggctgcagagaagtgaactgaagaattacagtcggtttcacttccctgccttatgtgccttcaggtgcc

SEQ ID NO: 347 - DNA, 92 bp, Artificial
  Hairpin sequence Hsd_from_Mmd_51, human
cacttttttgaagtgtgaattgcctgctgtcagcctggagttctcacctccgcaatcctggctgcaggcatatttgcatattggatgctgtg

SEQ ID NO: 348 - DNA, 98 bp, Artificial
  Hairpin sequence Hsd_from_Mmd_510, human
catggtcttggtttggtagcgccccaggatggagtaggcagggccaaggtccttgccagtcctcagtatcttggggtttacattgtaacggggccctg

SEQ ID NO: 349 - DNA, 74 bp, Artificial
  Hairpin sequence Hsd_from_Mmd_511, human
cagaaggtactctgtgggagggaggagataatagccaatgattatattcctccttcatacttgcagtacctctg

SEQ ID NO: 350 - DNA, 97 bp, Artificial
  Hairpin sequence Hsd_from_Mmd_515, human; Mmd_515, mouse
gggcatagttggacgagagggcgtcttggcaggtctctgtgtttaaagagcacaggtgtgagacactgggacgcacgctttcggctcaacattgcct

SEQ ID NO: 351 - DNA, 89 bp, Artificial
  Hairpin sequence Hsd_from_Mmd_516, human
aaaacacttgcagctgattggccgaggtcgatatggagcagtatataaaggctccttggatgagcgtccagttgctgtaaaagtgtttt

SEQ ID NO: 352 - DNA, 94 bp, Artificial
  Hairpin sequence Hsd_from_Mmd_517, human
ttgaggcaaacagcacagaagtcctcattctctattggggctggggggcccttcttggctcctggggttcgaggaatgagtctgtgttcttcag

SEQ ID NO: 353 - DNA, 81 bp, Artificial
  Hairpin sequence Hsd_from_Mmd_518, human
gtcacacagccggattgtccctttgctgctgctgtacacgaaggtgttgcaatgatgggggtggaactcggctgctgtgat

SEQ ID NO: 354 - DNA, 71 bp, Artificial
  Hairpin sequence Hsd_from_Mmd_519, human
gaggtgcccaggtcagtgcgctggttcatagaggcggacgtgtctatgaggaacagcaggatgggcatctt

SEQ ID NO: 355 - DNA, 92 bp, Artificial
  Hairpin sequence Hsd_from_Mmd_52, human; Mmd_52, mouse
ccagcagcagcttcaggccgacagcttcaaagctaagcagatggaaaaccaccagcttattaaggaggctgtagaaatgaagtctgtcatgg

SEQ ID NO: 356 - DNA, 98 bp, Artificial
  Hairpin sequence Hsd_from_Mmd_523, human
gagttgtatcgctcaaataaaagattgaaggatgctgtggcccgctgccatgaggcagagaggaacatagctttgcgttcaagtttagagtggaattc

SEQ ID NO: 357 - DNA, 67 bp, Artificial
  Hairpin sequence Hsd_from_Mmd_524, human; Mmd_524, mouse
gggtgtgataggtatacagctggttgttaccatggtgatggccagtgtcatgcagaagattatacct

SEQ ID NO: 358 - DNA, 88 bp, Artificial
  Hairpin sequence Hsd_from_Mmd_526, human
tcctcctgcttggcgttgatgtctgctttcatctccatggcaacatgacggggaaggacagacagcaggagccgttcctgcagaggga

SEQ ID NO: 359 - DNA, 95 bp, Artificial
  Hairpin sequence Hsd_from_Mmd_527, human
cgggtttgtgctgtagacccctcatttactcctttgtggagttaggagcagcttcccattaaaggagatcaggggtaattagcagcattattttg

SEQ ID NO: 360 - DNA, 99 bp, Artificial
  Hairpin sequence Hsd_from_Mmd_529, human
ggtaaatttcctaagcagtgtgtgagaggtgtacgcagaaatcctgttgacaaaatattttgtgcaagtgcctcccacacacagctttaaaatgttacc

SEQ ID NO: 361 - DNA, 99 bp, Artificial
  Hairpin sequence Hsd_from_Mmd_530, human
cccagtgggtgtccagatgcctgacaacattctccaggccaagatacataagagtcctgtggtctggggatgcgaggacagctggacaaacagcttggg

SEQ ID NO: 362 - DNA, 90 bp, Artificial
  Hairpin sequence Hsd_from_Mmd_532, human
agcggcaggggatttgaggggtggttgtgtgatttgtacagctgtcattagggtaattgcatgatattttcccaaatttctcctgcagct

SEQ ID NO: 363 - DNA, 98 bp, Artificial
  Hairpin sequence Hsd_from_Mmd_533, human
agtcacttaagctgagtgcattgtgatttccaataattgaggcagtggttctaaaagctgtctacattaatgaaaagagcaatgtggccagcttgact

SEQ ID NO: 364 - DNA, 92 bp, Artificial
  Hairpin sequence Hsd_from_Mmd_534, human
tctatataccctcagagctgatatgagtgtggagattccattcacttcaaaggaagcttcacgcttggatcttctccacaggggtgcttaga

SEQ ID NO: 365 - DNA, 93 bp, Artificial
  Hairpin sequence Hsd_from_Mmd_536, human; Mmd_536, mouse
ggctggggctgaaccgaatgctggcacccctccaaacccaggggatcccccaaaagtaggagggctgccaaacactggagcagcaccgaagcc

SEQ ID NO: 366 - DNA, 96 bp, Artificial
  Hairpin sequence Hsd_from_Mmd_54, human
gaggagggtctcctcgaggggtctctgcctctacccaggactctttcatgaccaggaggctgaggcccctcacaggcggcttcttactctctcctt

SEQ ID NO: 367 - DNA, 97 bp, Artificial
  Hairpin sequence Hsd_from_Mmd_56, human
gaccaaggtctttggtcttggaggaaggtgtgctactggaagaggccaccgaggcagggctggtgggggcatcttttttcaggctacgggccttgtc

SEQ ID NO: 368 - DNA, 99 bp, Artificial
  Hairpin sequence Hsd_from_Mmd_58, human
ctcttctgcacccaacgaagggttgaccaaagcggccatgatggcaatgtctgagtatgaagatcggttgtcatctggtctggtcagcccggccccgag

SEQ ID NO: 369 - DNA, 100 bp, Artificial
  Hairpin sequence Hsd_from_Mmd_59, human
gccaccgcgtcctgggccaggcgcccgcccggccggcgggaagaggcgcggacacgcgcacccggcccgccgcgggggcgcgcctggctctgggcggggc

SEQ ID NO: 370 - DNA, 83 bp, Artificial
  Hairpin sequence Hsd_from_Mmd_60, human
gccttggcttcctgctcctcctcatactgttcccgcagcaggtcacagtcgtggcgggaggactgcagggcgtgcgccatggc

SEQ ID NO: 371 - DNA, 98 bp, Artificial
  Hairpin sequence Hsd_from_Mmd_67, human
cttcttccagtcatcctgaggtagatatcatacaggaatgctggggccttatggcttacagcaatccagtaatgatataaaagatgattggaggttag

SEQ ID NO: 372 - DNA, 93 bp, Artificial
  Hairpin sequence Hsd_from_Mmd_68, human
tcgtcctgtctaaaggaagaagtttgttctactgtaaacagttatgggaactgtttgctttggatgggcttggtcctcattggctgaggagga

SEQ ID NO: 373 - DNA, 98 bp, Artificial
  Hairpin sequence Hsd_from_Mmd_69, human
tgggtatttctttcaggtagaagccaggtgaaactcaaagggtccaaactgggttttgctttgagtttccttttggttctgcttgaacttgacactca

SEQ ID NO: 374 - DNA, 95 bp, Artificial
  Hairpin sequence Hsd_from_Mmd_70, human
gattaattctacatgcagctaattatacccacaattggctaattgtcggtgcaattagccaattgcaggcccaattggccacttgtcccataatt

SEQ ID NO: 375 - DNA, 94 bp, Artificial
  Hairpin sequence Hsd_from_Mmd_71, human
cactgtaacaacattttactcctgactgattacattacatattgatattagtgagcatcagtatgtagtgcaatcagtcaggagaaaatgagtg

SEQ ID NO: 376 - DNA, 97 bp, Artificial
  Hairpin sequence Hsd_from_Mmd_74, human
catgccctgatatttgtgtagggataattactatctctcaggcctcacttggtggcaagatgagatgaaaacccataaaacaccactcagggctgtg

SEQ ID NO: 377 - DNA, 99 bp, Artificial
  Hairpin sequence Hsd_from_Mmd_75, human
ggggaaaaaaaaggcagacactgtgtttgatgccaataatggttgccagtggcaccgaggttggcatcagaccctctttgtctagttgctgaatgcctt

SEQ ID NO: 378 - DNA, 88 bp, Artificial
  Hairpin sequence Hsd_from_Mmd_76, human
agggcagcaatttgtgtcagatttcaatctattttgagtggaaaccaatgtaagcctggttgaaaaatggtgagtaaattgctgtcct

SEQ ID NO: 379 - DNA, 92 bp, Artificial
  Hairpin sequence Hsd_from_Mmd_80, human
cggacagtgtgttgatgcttattggtgtctcttttctcttctaggaccagcagagagaagagattccatcttccagaggttgccactgtctg

SEQ ID NO: 380 - DNA, 95 bp, Artificial
  Hairpin sequence Hsd_from_Mmd_81, human
ttcctttaactctcagcttctatttaaaaagctaatttgggagcttgtcgatgctcccaattcagacattttaaataggaactgaaagtcaggag

SEQ ID NO: 381 - DNA, 82 bp, Artificial
  Hairpin sequence Hsd_from_Mmd_82, human
ggtccatctttgggccaagatatgtagtcgccaacagtgagttggcgactatattttttgagtcctggcgcaaagtaagatc

SEQ ID NO: 382 - DNA, 93 bp, Artificial
  Hairpin sequence Hsd_from_Mmd_85, human
acaggccactccatctgttcaaacataatgctccaaaccaaggaatatgttccaaaccaaagagcatgatatttgacagatggagaggtctgt

SEQ ID NO: 383 - DNA, 88 bp, Artificial
  Hairpin sequence Hsd_from_Mmd_90, human
gcctccatttaggtgtcaattgtgtaatttccagctgttcctcagttcaacagctggagttcaatatgctcagggcttatttggaggc

SEQ ID NO: 384 - DNA, 99 bp, Artificial
  Hairpin sequence Hsd_from_Mmd_91, human
cgcacaggaagcagcaggtagttctgtctgctgtctctttagataaaatgtatgtctggcaccaagggaacagctgagaactacctgttgttatgtatg

SEQ ID NO: 385 - DNA, 100 bp, Artificial
  Hairpin sequence Hsd_from_Mmd_92, human
caccttgggtgagggcatgacgctgaaggtgttcatgatgcggtctgggtactcttcccggatcttgctgatgagcagggtgcccatcccggaccccgtg

SEQ ID NO: 386 - DNA, 92 bp, Artificial
  Hairpin sequence Hsd_from_Mmd_93, human
ttgtagttgactaaacagcgtctggtggatgcagatggcatcattaatcccagcgctttctacatctacctgacggcttgggtcagcaacga

SEQ ID NO: 387 - DNA, 93 bp, Artificial
  Hairpin sequence Hsd_from_Mmd_94, human
tgacattttctgtagattgtggacaaagccctagaagagccaaagtatagctcactgtatgctcagctatgtctgcgattggcagaagatgca

SEQ ID NO: 388 - DNA, 83 bp, Artificial
  Hairpin sequence Hsd_from_Mmd_95, human
gacactatcaaagttaaggcaggagagcctgtccacatccctgcagatgtgacaggccttccaatgcctaagattgaatggtc

SEQ ID NO: 389 - DNA, 92 bp, Artificial
  Hairpin sequence Hsd_from_Mmd_97, human
agctttctccaactgttacaatctccacttcactgtcagttgaggtaacattaatttcttcattggcagtaacctggggagtggaggaagct

SEQ ID NO: 390 - DNA, 83 bp, Artificial
  Hairpin sequence Hsd_from_Mmd_98, human
ggcccggctccgggtctcggcccgtacagtccggccggccatgctggcggggctggggccggggccgagcccgcggcggggcc

SEQ ID NO: 391 - DNA, 100 bp, Artificial
  Hairpin sequence Mmd_1, mouse
ggctgggcaaggtgcggggctagggctaacagcagtcttactgacggtttcctggaaaccacacacatgctgttgccactaacctcaaccttactcggtc

SEQ ID NO: 392 - DNA, 86 bp, Artificial
  Hairpin sequence Mmd_10, mouse
cctggcatatagcaggtcctcaataagtatttgttgaaaaaataaatgaagcaacaaatcttatttgagcacctgttatgtggagg

SEQ ID NO: 393 - DNA, 95 bp, Artificial
  Hairpin sequence Mmd_100, mouse
tgagtcatggagaagggagggcaagtcaggtgaccaggtgagactcagaactcctgaggtagcctggttaccttgacattcctgtgattatgcca

SEQ ID NO: 394 - DNA, 99 bp, Artificial
  Hairpin sequence Mmd_101, mouse
tggtgcagcactgagaaattttgtctccaagcaaaggtcattggatcggagtcttggatttagtgacggtggaggctataatttttcttgctggcagca

SEQ ID NO: 395 - DNA, 99 bp, Artificial
  Hairpin sequence Mmd_102, mouse
gagatggaggaagccgagtccaggcctccatgcagcggggagatggagaagtcggcctggggctgtggaggcacggcactcgggttgctaaggatgctc

SEQ ID NO: 396 - DNA, 87 bp, Artificial
  Hairpin sequence Mmd_103, mouse
tgctctgctccccaaatcatgtacccccacagagggtccagatggttcttagttcttctggaggcacatggtttgaagagcagagca

SEQ ID NO: 397 - DNA, 95 bp, Artificial
  Hairpin sequence Mmd_104, mouse
ggcagaggaatgtggctgcttttaaaaggggtctcaggtaaggctgtgtgtgccagccttcctgaccatcagtgatagcagcttgggtgtctgct

SEQ ID NO: 398 - DNA, 87 bp, Artificial
  Hairpin sequence Mmd_105, mouse
aggttgatgcaaaagaaaggaaaacatctttgaagttctgaaaaacaagacttcaaaagatgttttcctttcttctttctcgaatct

SEQ ID NO: 399 - DNA, 90 bp, Artificial
  Hairpin sequence Mmd_106, mouse; Mmd_168, mouse
gccgcgggtgcgcgtctctcggggtcgggggtgcgtggcgggggcccgtcccccgcctcccctccgcgcgccgggtttcgcccccgcggc

SEQ ID NO: 400 - DNA, 89 bp, Artificial
  Hairpin sequence Mmd_107, mouse
atgcccgtaatgtacagtaaatgaggcccataactcattggagcctccaatgagttatgtgctaaattcatatttcacaacatggccat

SEQ ID NO: 401 - DNA, 99 bp, Artificial
  Hairpin sequence Mmd_108, mouse
ccttttcttttcttgaagcctgactccccgcgggacttccaaggcagcataacttcgggtccagactgggctgtcaggcttttccaggaaggatccagg

SEQ ID NO: 402 - DNA, 97 bp, Artificial
  Hairpin sequence Mmd_109, mouse
gggggtgtgagcccctttttctgctttccagcatctttggcatttgcgcaaagttgctcagattgcaatgctggggtgcagtgggcgcgcgactctt

SEQ ID NO: 403 - DNA, 98 bp, Artificial
  Hairpin sequence Mmd_11, mouse
gtgctcttgtggcccatgaaatcaagcttgggtgagacctggtgcagaacaggaaggcgacccatacttggtttcagtggctgcaagaatgactgcat

SEQ ID NO: 404 - DNA, 94 bp, Artificial
  Hairpin sequence Mmd_110, mouse
gtggccagggtggggctgggtggtgcaggcaggagagccattgatctattgtgggctctactccctgccccagccagagcaccccattggctac

SEQ ID NO: 405 - DNA, 81 bp, Artificial
  Hairpin sequence Mmd_111, mouse
agatttcatcagtcaggctagtggttatactccaggacttatctggtcctggatataaccactgccagactgaatggtgct

SEQ ID NO: 406 - DNA, 93 bp, Artificial
  Hairpin sequence Mmd_112, mouse
tgtacctgtttcctcctgtggcccggagtttgatgtgcagggcagtgatgcccaactccttgcacctctgggccacatcctgggcagccaaca

SEQ ID NO: 407 - DNA, 97 bp, Artificial
  Hairpin sequence Mmd_113, mouse
ccaaatgagagggagtgtcagctcagaccctggccatctgttgtgtgtgaggagctggcccctcaggtgtttggtgtggatattcccttctattagg

SEQ ID NO: 408 - DNA, 95 bp, Artificial
  Hairpin sequence Mmd_114, mouse
ggccagggcactttaggctaccccagtgtgtcagtgtagagcaatgttgacaagctctgcctaactgagctgtgggtgttctagagggtatgacc

SEQ ID NO: 409 - DNA, 96 bp, Artificial
  Hairpin sequence Mmd_115, mouse
ggacatttctgtcccaggccagcagctgtcaccttagaaagattaagattctcccaccaggcgacaaggcttgttgtgcccgagacagatacggct

SEQ ID NO: 410 - DNA, 87 bp, Artificial
  Hairpin sequence Mmd_116, mouse
agactttattatgttcgccaaacatctggccttcccaagtatgtcattagacattgggccaggtgtgaggcatcagagtggattgct

SEQ ID NO: 411 - DNA, 97 bp, Artificial
  Hairpin sequence Mmd_117, mouse
aggtcctaggtgaggccatgactggcatctcccaaaatgccaagaatggaaatctgccggagtttggagatgccattgccacagcctccaaggctct

SEQ ID NO: 412 - DNA, 95 bp, Artificial
  Hairpin sequence Mmd_118, mouse
acctttgctactggcatttgagagatggggaaataggcacttggagaggtcgggaatcttgttcaaggtcatcagcaaaggtcagttgtgaaggt

SEQ ID NO: 413 - DNA, 98 bp, Artificial
  Hairpin sequence Mmd_119, mouse
ggcttgtcagaatgaattctagggtgccaagagacattttgcatatttaagggtatgcaaagtgtctcatggcacattagaattcattctgacaggcc

SEQ ID NO: 414 - DNA, 98 bp, Artificial
  Hairpin sequence Mmd_12, mouse
cgattcttgtttgcgtggggaggagggaggggatgggccaagttccctatgcctggaacgcccttcccccccttcttcacctggcgaactcctactcg

SEQ ID NO: 415 - DNA, 92 bp, Artificial
  Hairpin sequence Mmd_120, mouse
gtggccacaggggggtgggactggtcatgtagccgtgtgtcaggagtaatgattgtagaggggcggggcatgaagagtgccattctggaaac

SEQ ID NO: 416 - DNA, 95 bp, Artificial
  Hairpin sequence Mmd_121, mouse
gcttaggccagccgcgtcgccgcttcatgaatggaacccacgtgaccaaacatcatgtgacgtctgaggagcggcggcggcggcggattctgagc

SEQ ID NO: 417 - DNA, 95 bp, Artificial
  Hairpin sequence Mmd_122, mouse
cagtgagaaattaggagggatgtaaagtaagctggctttttgcctgagggcttaatttaaaagaatcctttaggtgcctctgtgatttcttactg

SEQ ID NO: 418 - DNA, 91 bp, Artificial
  Hairpin sequence Mmd_123, mouse
ttcctggggattaatgaatggctgggtggagttaattgcctaaagtatagtctcaggccattaacctcagttggtcactaatctcaaggaa

SEQ ID NO: 419 - DNA, 82 bp, Artificial
  Hairpin sequence Mmd_124, mouse
aggcaggatacagagctctttaaataatgcccagcatttcctggaccagcatgatatttaaagatttttgttccacctgcct

SEQ ID NO: 420 - DNA, 94 bp, Artificial
  Hairpin sequence Mmd_125, mouse
gtttttctattcttgaagcctgactccccgcgggacttccaaggcagcataacttcgggtccagactgggctgtcaggcttttccaggaaggat

SEQ ID NO: 421 - DNA, 91 bp, Artificial
  Hairpin sequence Mmd_126, mouse
gaagcaaggaattagctctctaaatgccccacgatgactggctgacttgctggtcctctgagggcgatttgaatatctaactcctctcttc

SEQ ID NO: 422 - DNA, 100 bp, Artificial
  Hairpin sequence Mmd_127, mouse
gggaatggaggaggcattaggggaagaggggactctgtctgatggattttcattctttttaggaattacccttgtgtccctggtggttcctgtggcttct

SEQ ID NO: 423 - DNA, 99 bp, Artificial
  Hairpin sequence Mmd_128, mouse
agctttttttaaaaattactggtgcccaggctccaccctggaccaattaaatgagctctcttggggaggggcctggacatcagtaattttttaaaagct

SEQ ID NO: 424 - DNA, 96 bp, Artificial
  Hairpin sequence Mmd_129, mouse
ccctgacctctacctccactgactccctcttctccccctccatcagccaatgctgaggccttgaaggagatgctaggggacagtgaaggagaaggg

SEQ ID NO: 425 - DNA, 98 bp, Artificial
  Hairpin sequence Mmd_13, mouse
tggcaggccaggaagaggaggaagccctggaggggctggaggtgatggatgttttcctccggttctcagggctccacctctttcgagccgtagagcca

SEQ ID NO: 426 - DNA, 100 bp, Artificial
  Hairpin sequence Mmd_130, mouse
ctccccagagagatctttcagtaactgatcttctagctggcatttttatagattaggaagcaggccagctggaggtcatactaaattaaactctgctgag

SEQ ID NO: 427 - DNA, 60 bp, Artificial
  Hairpin sequence Mmd_131, mouse
aagtcaggttgtgtggttttgtggttagttttctaagcacaaagccaaagatcttgattt

SEQ ID NO: 428 - DNA, 90 bp, Artificial
  Hairpin sequence Mmd_132, mouse
gaaggagaaaagcaagcagggtgtgaggggactcgtcccacacctgtgtaaacaatgtcaccttacaccccgtcaagcaccctcgccttc

SEQ ID NO: 429 - DNA, 98 bp, Artificial
  Hairpin sequence Mmd_133, mouse
gtgaaggctattaattacactgagtgacaaagactctccgtgttgtatgattgacacaaggatgaatctttgttactgattgcaaataataggaccgc

SEQ ID NO: 430 - DNA, 99 bp, Artificial
  Hairpin sequence Mmd_134, mouse
aggagaaaggacatgtggtgtttactgtgtgagtggtatttggtcaaacagtggcgatctaccagttcataaggatttaccacttagcctaaggtccct

SEQ ID NO: 431 - DNA, 98 bp, Artificial
  Hairpin sequence Mmd_135, mouse
gacagtgattgttgctatgggagacagtgtgggtttgtgacacaagaaaaattctcttgctgttgcaaaagtggatccagactgtcccaatggatgtc

SEQ ID NO: 432 - DNA, 83 bp, Artificial
  Hairpin sequence Mmd_136, mouse
gcagttaatgattggtttgttagttaatggcccaaggcaaagctgagggcggttaagactctaacaaacgatttgtgaattgt

SEQ ID NO: 433 - DNA, 97 bp, Artificial
  Hairpin sequence Mmd_137, mouse
tgtcttttggatcatcatattcttaccaaaacatttgctctgattggtggcccggtcaacaaagactttggctgagatgacatgaccaaaagggaca

SEQ ID NO: 434 - DNA, 96 bp, Artificial
  Hairpin sequence Mmd_138, mouse
tcttattgtgtttggctgaggcctagtaattttcaataaagcccttaatccaagtacttcactgaaaattaccaggcttctctgtggaggatgaga

SEQ ID NO: 435 - DNA, 88 bp, Artificial
  Hairpin sequence Mmd_139, mouse
gtatttcctgaggattaatgatcaactggaagagcctgtggtcttagggccattaactccgggtggtcattaattctgttggaaatat

SEQ ID NO: 436 - DNA, 85 bp, Artificial
  Hairpin sequence Mmd_14, mouse
ggatctcagacgtctcggggatcatcatgtcacgagataccactgtgcccttgtgacagattgataactgaaaggtctgggagcc

SEQ ID NO: 437 - DNA, 99 bp, Artificial
  Hairpin sequence Mmd_140, mouse
gtcttgccagcagaattctcagaggcaaaaggagtgaaatattttgctggaggggatactttcctttcaagaagcattcctttgcctcctgaacaagat

SEQ ID NO: 438 - DNA, 93 bp, Artificial
  Hairpin sequence Mmd_141, mouse
gggctgcccaagacaagggcttattttgacttaggatgctgctgaagctgtggcagccttgtcaaaatacatctgcctcttcttacgctgccc

SEQ ID NO: 439 - DNA, 100 bp, Artificial
  Hairpin sequence Mmd_142, mouse
gatggtgatctagccctttagttttgaggttggtgtactgtgtgtgagtatacatatttatcacacacagtcactatcttcgaaagtgagggtgcacatc

SEQ ID NO: 440 - DNA, 97 bp, Artificial
  Hairpin sequence Mmd_143, mouse
gtggccttgaggctggaccatgtgacacccaagcacagtggttccaatatggttgtctggttgtgggtggagttgcagaactctggctgtgagccat

SEQ ID NO: 441 - DNA, 97 bp, Artificial
  Hairpin sequence Mmd_144, mouse
gtgaagggctggggtggggtgtaggagattctgtactgagattgcagtctctgcctccagctcttctccacagtttcctcatccccatgcctgaaat

SEQ ID NO: 442 - DNA, 79 bp, Artificial
  Hairpin sequence Mmd_145, mouse
gtccactccatcaaagggtctaatggtcagcagaggaggctaaatgtctcccctgtgacctgacattaaccgagtggac

SEQ ID NO: 443 - DNA, 78 bp, Artificial
  Hairpin sequence Mmd_146, mouse
ggagaggtgggggaaagaattaatgtgtgctctctgattcctttcactgaggacttacagattaactcccacttctcc

SEQ ID NO: 444 - DNA, 81 bp, Artificial
  Hairpin sequence Mmd_147, mouse
ggaaagacacagacaagagaaaataagcctgcctagcaattacgtctgggctgcttggagggctctctctgttctctttcc

SEQ ID NO: 445 - DNA, 97 bp, Artificial
  Hairpin sequence Mmd_148, mouse
agagcccttctggcagctaatgacctgctggagtcgtgtgtgcccaaggcaaagcttaaggccattagtccaacaggtcattaactgacaaatgcct

SEQ ID NO: 446 - DNA, 96 bp, Artificial
  Hairpin sequence Mmd_149, mouse
ttgatttccgtgcataaacagtggcctagattcttgccctgtggaaatccacggaattaagaactctaggttcctggagtgataagaggtaagcaa

SEQ ID NO: 447 - DNA, 97 bp, Artificial
  Hairpin sequence Mmd_15, mouse
tggggactgccctcaaggagcttacaatctagctgggggtagatgacttgcacttgaacacaactagactgtgagcttctagagggcaggggcctta

SEQ ID NO: 448 - DNA, 99 bp, Artificial
  Hairpin sequence Mmd_150, mouse
gtgtgccagatacaagtgaatttaagcccacatggattgaagctgcaagcttactttgcaatttatgtgcaagtggttttggatttattgatctggacc

SEQ ID NO: 449 - DNA, 100 bp, Artificial
  Hairpin sequence Mmd_151, mouse
ggggtccctgagttcctgtcagttgttgtatctgcatgtctctttcctgtggcctcagggaagtggcatgcggtccagcttgtcttggtttactttctct

SEQ ID NO: 450 - DNA, 100 bp, Artificial
  Hairpin sequence Mmd_152, mouse
ggaaaaggctgtaattccatcttggggtatctggtgaaccaagctgtgggtctgtggtttatgatgtcaccagaacccccagctggaattacagccttcc

SEQ ID NO: 451 - DNA, 98 bp, Artificial
  Hairpin sequence Mmd_153, mouse
gctttgcttggccttctgggagttgtagttctagaggcacccgggttgcctggctggccccggaactgtggactacagctcccaggccttctctaagc

SEQ ID NO: 452 - DNA, 95 bp, Artificial
  Hairpin sequence Mmd_154, mouse
ggtcatcgttgttcaaagtgttgtgttcggggcccttccaggtgattgaggccttggggcggccacagacacgacatctaaaaacaacggtctcc

SEQ ID NO: 453 - DNA, 71 bp, Artificial
  Hairpin sequence Mmd_155, mouse
tgtggtgtgcctgcccccttccgtcattgctgtgaatgggctggacggaggaggggctggcgaaaatgacg

SEQ ID NO: 454 - DNA, 99 bp, Artificial
  Hairpin sequence Mmd_156, mouse
gcttattttcctcctaggtaatttaattccaagacaccaggagctattttataaaaatcctgtgtttgctggagtaaggttgcctgaggtcaaagatgc

SEQ ID NO: 455 - DNA, 91 bp, Artificial
  Hairpin sequence Mmd_157, mouse
ggccacagctgctgcgagcagcaggatgagggttgacctatatctgtcctctgtaggtcaacccccgaatttgtttgtagaagcttcagtc

SEQ ID NO: 456 - DNA, 85 bp, Artificial
  Hairpin sequence Mmd_158, mouse
gtcatttagaatgatgtgcacagggtaaattcattgggcatatgggcagcatgtgttcaaggactccctgtagcattgagatgac

SEQ ID NO: 457 - DNA, 100 bp, Artificial
  Hairpin sequence Mmd_159, mouse
ctgttggaaggtggtcagagagcaggaaatggcttctaattagtagtgtcctcacaggatgcaactgcagaagacaatttcctgtccccttattggatgg

SEQ ID NO: 458 - DNA, 97 bp, Artificial
  Hairpin sequence Mmd_16, mouse
gctactgtttcatacttgaggagaaattatccttggtgtgttggctcttttggatgaatcatacaaggataatttctttttgagtatcaaatactgc

SEQ ID NO: 459 - DNA, 88 bp, Artificial
  Hairpin sequence Mmd_160, mouse; Mmd_240, mouse
tcttttcttgaagcctgactccccgcgggacttccaaggcagcataacttcgggtccagactgggctgtcaggcttttccaggaagga

SEQ ID NO: 460 - DNA, 98 bp, Artificial
  Hairpin sequence Mmd_161, mouse
gatgctgctgatgctggcggtgatgccgatggtgcgagctgaaaatgggctgctacgtcatcgtcgtcatcgttatcatcatcatcagcacagccatc

SEQ ID NO: 461 - DNA, 81 bp, Artificial
  Hairpin sequence Mmd_162, mouse
gtaagaaatgagaaatttttagggccattgaacaccacgtatttgcagtgttcagtagccctgaaaatttctcatttaagc

SEQ ID NO: 462 - DNA, 90 bp, Artificial
  Hairpin sequence Mmd_163, mouse
gctaaatcattgccagtagtttccaagacattccgctaggctaagcaaattgccctaagtggtagtcagaaacgactggcatggtactgt

SEQ ID NO: 463 - DNA, 99 bp, Artificial
  Hairpin sequence Mmd_164, mouse
gggatttaatggatccccatcctgtcttttgctacacattcacaaattattatttactgagtgcagagcaaaaggcatggtgggtatctatttggttac

SEQ ID NO: 464 - DNA, 95 bp, Artificial
  Hairpin sequence Mmd_165, mouse
acctaggagattggctgtaggggcttctgagtctgatgcccttatatcttaagggacatgaggatagtcagtagtccaatgtccctcttgatggt

SEQ ID NO: 465 - DNA, 100 bp, Artificial
  Hairpin sequence Mmd_166, mouse
gaaaagtgttaaaataaatggctcatgacttatgaagtgttaaaataaacgtttatttcaacactactcatgtcataagccatttatttcgacacttttt

SEQ ID NO: 466 - DNA, 93 bp, Artificial
  Hairpin sequence Mmd_167, mouse
ggcggtagcccaaggtttgcaggcctggccgaatgaccagggcaatggaaggaagtcgtggtcgtcgcgggcgtggggaatgggcttaccggc

SEQ ID NO: 467 - DNA, 99 bp, Artificial
  Hairpin sequence Mmd_169, mouse
gttgatgtccgtgcctcactgtttgttaaatattctgacccggtcaccctgggtcagggtgactgacctgaagggtgagcaggaggaaatgataagagc

SEQ ID NO: 468 - DNA, 66 bp, Artificial
  Hairpin sequence Mmd_17, mouse
ggtaagtgtgcctcgggtgagcatgcacttaatgtaggtgtatgtcactcggctcggcccactacc

SEQ ID NO: 469 - DNA, 94 bp, Artificial
  Hairpin sequence Mmd_170, mouse
tttgctgtgaaaattgcaaatgtttgcctcaagcaaatatgtgaaaatttgcaatttgttgtaggtgtggaattttgctatttttcacagtgga

SEQ ID NO: 470 - DNA, 97 bp, Artificial
  Hairpin sequence Mmd_171, mouse
gggacattccctggggctgggccaagggtcaccctctgactctgtggccaagggtagacaggtcagaggtcgatcctgggcctactctggggctcct

SEQ ID NO: 471 - DNA, 94 bp, Artificial
  Hairpin sequence Mmd_172, mouse
tttcaagtagtcaaattctggctcatggctctggaaggtgctgtaaacattgtattctcctctgctatgagactggattttgttctcactgggg

SEQ ID NO: 472 - DNA, 85 bp, Artificial
  Hairpin sequence Mmd_173, mouse
tatggattttctttctcaattgctacggagtcaccctgaggctattaatttgggctattagctgagggtgatttcaaaatccata

SEQ ID NO: 473 - DNA, 83 bp, Artificial
  Hairpin sequence Mmd_174, mouse
ggagaacagctttaaagtttagtcactctgatggaatgtaaaagcttctatcagtgacaggttgacagagaaagctgttttcc

SEQ ID NO: 474 - DNA, 65 bp, Artificial
  Hairpin sequence Mmd_175, mouse
tcagttaggctgctggctatactccaggacttaccttgtcctggatataaccactgccagactga

SEQ ID NO: 475 - DNA, 80 bp, Artificial
  Hairpin sequence Mmd_176, mouse
agtctccaaagacaattgtgaagggattgtgtttgactgatcaatcaaaggcagcccccccttgcttgtcttccgagact

SEQ ID NO: 476 - DNA, 82 bp, Artificial
  Hairpin sequence Mmd_177, mouse
tagaaaaggcaattaaaatccacaactgacttccttcccgtgtccaaggcgagggacagtgcgtgggtgtgtgcccttttta

SEQ ID NO: 477 - DNA, 91 bp, Artificial
  Hairpin sequence Mmd_178, mouse
gtctgccctggaattaggttttatcttaagtccacactggatcctctggatgggtccactgaggattttgaaggaagcataattccttgac

SEQ ID NO: 478 - DNA, 94 bp, Artificial
  Hairpin sequence Mmd_179, mouse
ggtcttggctctgtgtggaccagggcaggtgagggagcctggagatgttctctaggttatcctctgttgctgtgaactgggaggatccaaggac

SEQ ID NO: 479 - DNA, 98 bp, Artificial
  Hairpin sequence Mmd_18, mouse
tcacttgatgggggtattcccagctgtctgcctgaggaggagaggcagctgccctggcaggcagctggggtgtgctggccatgcctgatctgatgtgg

SEQ ID NO: 480 - DNA, 94 bp, Artificial
  Hairpin sequence Mmd_180, mouse
gaggaagggagcggcagcagtgaaggatttgagccccctgccgcagatgggcagttctctggggccaggaatcagctgcgccgcccccagtatc

SEQ ID NO: 481 - DNA, 98 bp, Artificial
  Hairpin sequence Mmd_181, mouse
ccgagactttgaaaacgaacgagaccgagatctggatgcagatcttgagcgagaagagcgagacccagacttggatttgtttgtttttgacatcttgg

SEQ ID NO: 482 - DNA, 100 bp, Artificial
  Hairpin sequence Mmd_182, mouse
ggtttggaggtgggcctgacatccctgagtgtatgtggtgaacctgaacttgccctgggtttcctcatatccattcaggagtgtcagctgcctcttcgct

SEQ ID NO: 483 - DNA, 95 bp, Artificial
  Hairpin sequence Mmd_183, mouse
gggattccacttcagagtctgaatacaggaaataagcttaggaaccacctaggtttgttgattcctgggcattcttaggcctggagagcatttct

SEQ ID NO: 484 - DNA, 85 bp, Artificial
  Hairpin sequence Mmd_184, mouse
gaatgactaaacagccctgcatatatttctggaatacttggaaatgcctgttatttctggaaatgtgtgcttgttcaggttattc

SEQ ID NO: 485 - DNA, 62 bp, Artificial
  Hairpin sequence Mmd_185, mouse
ccaccagacagacagaacggacgctgcagcctctgcagggactaatctgtctgtggggatgg

SEQ ID NO: 486 - DNA, 99 bp, Artificial
  Hairpin sequence Mmd_186, mouse
ctgcctactcctcaaaacttccgaggctacttttgattgggataaaagtgcacatactgattttttaaaatgtggctttaattaatggtgggtgggcag

SEQ ID NO: 487 - DNA, 98 bp, Artificial
  Hairpin sequence Mmd_187, mouse; Mmd_525, mouse
gaggggttaagagttcattcggctgtccagatgtacccaagtaccctgttatttggcaatacatacatctgggcaactgattgaacttttcgcttctc

SEQ ID NO: 488 - DNA, 65 bp, Artificial
  Hairpin sequence Mmd_188, mouse
tcagtcaggctgctggtgattctccaggacttatctggtcctggatataaccactgccagactga

SEQ ID NO: 489 - DNA, 99 bp, Artificial
  Hairpin sequence Mmd_189, mouse
aggtactttcaaagcaatgtttgacaggcacagggacaaatcttgttaacaagtaagaggatttgtgcttggctctgtcacatgccactttgaaaacct

SEQ ID NO: 490 - DNA, 98 bp, Artificial
  Hairpin sequence Mmd_19, mouse
gggcccccgcaactgctgctaccgccggccccccgagctttgaggtttccacccatggccgggcctcctccgggccggcagcagccgccgaacagctc

SEQ ID NO: 491 - DNA, 88 bp, Artificial
  Hairpin sequence Mmd_190, mouse
tggcctggctggcggcgctggctctgggcctcagacactctggaatcgccaaggtctgagctcagggcctggcccccttcccaggcta

SEQ ID NO: 492 - DNA, 92 bp, Artificial
  Hairpin sequence Mmd_191, mouse
ggatggggaggtggatagaattgtgggaggtaggctctgtccctcagaacccctttcctcagacagcttgttatccctgtgtcccttgagcc

SEQ ID NO: 493 - DNA, 86 bp, Artificial
  Hairpin sequence Mmd_192, mouse
gccaggaagaggcacatgaaactgaacacagtgtctgggctagcgccttgaattcagaatcaggaagtcatggttctattcctggc

SEQ ID NO: 494 - DNA, 76 bp, Artificial
  Hairpin sequence Mmd_193, mouse
tggcaagtggaggagcagcagggtgaaactgacacagtgctggtgagtttcactttgctgctcctcctgactccca

SEQ ID NO: 495 - DNA, 91 bp, Artificial
  Hairpin sequence Mmd_194, mouse
tctgcccttttcctgtccgtttcaccccgggtagcaaatggcccccacagccaagaggctacccctccctctgaagcccagactgggctga

SEQ ID NO: 496 - DNA, 99 bp, Artificial
  Hairpin sequence Mmd_195, mouse
ctgtaaagcctttactgccacttgttaaggaagacctgtatagctcactcgtgagtaataaggcggtcaacccaaactcaggcactaaaaattttatag

SEQ ID NO: 497 - DNA, 96 bp, Artificial
  Hairpin sequence Mmd_196, mouse
agaaacatctcaaaacctgctgacagcattttcactattagcggcaaacaaatcaactataattaaaatgctgtcaaagtgattggagatttttct

SEQ ID NO: 498 - DNA, 94 bp, Artificial
  Hairpin sequence Mmd_197, mouse
aatctgaatcttggaggcaggtgctcacatgtcctcctccatgcttataaatacatggaggaggccatagtggcaactgtcaccatgattgatt

SEQ ID NO: 499 - DNA, 97 bp, Artificial
  Hairpin sequence Mmd_198, mouse
ggtgggcgggggttcctggctgacctcactcctgtactgtttgtttgcgggcttgtagggggagaggaggacattttggaatcctttgtgtcaaatc

SEQ ID NO: 500 - DNA, 93 bp, Artificial
  Hairpin sequence Mmd_199, mouse
aagcacttaattgtgggtgcagttagtcgaggcgggcactctctgcagatttcaggggtgaagaaacctaattatacctgcaattgagtgctt

SEQ ID NO: 501 - DNA, 95 bp, Artificial
  Hairpin sequence Mmd_2, mouse
gaagaaatcctactcgggtggatataatacaacctgctaagtgttctagcacttagcaggttgtattatcattgtccgaggttatggctctcgtc

SEQ ID NO: 502 - DNA, 87 bp, Artificial
  Hairpin sequence Mmd_20, mouse
ggtgagtctcctcaggtgctcatgtgggagagattagcctgtgtttataagctggtctgttcattaagcgcctgctggagtggaacc

SEQ ID NO: 503 - DNA, 99 bp, Artificial
  Hairpin sequence Mmd_200, mouse
ttcgggattcttcagtcatgtagcacggggagtgtcttagcttggttgtctacagtgactcaggcaatacaccgtcctaggtgcctgaagagacttgga

SEQ ID NO: 504 - DNA, 98 bp, Artificial
  Hairpin sequence Mmd_201, mouse
ctgggctgtgctgttttgtagagaattgtccagatcaaaaccctcgtctcaggaactgggatccaggacaagattctgcgaagcacattgttatcaag

SEQ ID NO: 505 - DNA, 96 bp, Artificial
  Hairpin sequence Mmd_202, mouse
gtgggaattcgactttgcatctctacatctgtaaactgaggaacactttcagtgctctcagtgatgggtgagatgacatgtttgagccgaagaagc

SEQ ID NO: 506 - DNA, 100 bp, Artificial
  Hairpin sequence Mmd_203, mouse
gcagaaataatcatgtaatcatcttgtaattatatggtacttactatgcaattacatagtaaacacattgtaaattcaaaataattacatggttatttgc

SEQ ID NO: 507 - DNA, 94 bp, Artificial
  Hairpin sequence Mmd_204, mouse
ccctggcagcaagctgcgcttcggaaactgttgactcagagggtggcctggcggccagcgtctgatgtcagcctggagcccggccgcgccgggg

SEQ ID NO: 508 - DNA, 97 bp, Artificial
  Hairpin sequence Mmd_205, mouse
agtggaaggagaggagatagcgcggatcgctggtggggaatgttaatgggcgggagcccaggccgctggccaccgagacgtgggtatctcctccatt

SEQ ID NO: 509 - DNA, 74 bp, Artificial
  Hairpin sequence Mmd_206, mouse
ctggcaaccatgaggcccagatgctaagcactggaagatatttcttccaatagcagcatctggcatgctggcag

SEQ ID NO: 510 - DNA, 97 bp, Artificial
  Hairpin sequence Mmd_207, mouse
tccgctaccagaagcagctgcagcacaactatatccagatgtaccggcgtaaccggcagctggagcaggaactgcagcaactgagcctggagctgga

SEQ ID NO: 511 - DNA, 94 bp, Artificial
  Hairpin sequence Mmd_208, mouse
agatgatccttccccttacctgtctttctatcagtgtagctgaagctaattcagtgcactgatataagattattatcaggttgagcacttatct

SEQ ID NO: 512 - DNA, 84 bp, Artificial
  Hairpin sequence Mmd_209, mouse
atttgggcagaaattcttgactcagctcccaaggaatgtaaaccagaccctgggagtggaggagagttaagaaaaatctcagat

SEQ ID NO: 513 - DNA, 98 bp, Artificial
  Hairpin sequence Mmd_21, mouse
gtgtgtctcatttctgagcctttatataccctcccatattgagaattgagcaatgctgtggtgggaggttaaggatgaaggcctcaggaggctaaagc

SEQ ID NO: 514 - DNA, 94 bp, Artificial
  Hairpin sequence Mmd_210, mouse
ggtgagacagtcaacagcccagtgtccctcttgatggcactttggagatggctggagtgctctgtaaggcctgggctcaatgaccctcctcatc

SEQ ID NO: 515 - DNA, 89 bp, Artificial
  Hairpin sequence Mmd_211, mouse
gcgtcaaaaggcttattttgggcctcaatcctctccttctccgattttcggaggtaaggagcagcttcgccaaaaatagccatctccgc

SEQ ID NO: 516 - DNA, 84 bp, Artificial
  Hairpin sequence Mmd_212, mouse
ggtagaggagatggcgcaggggacacaaggtaggccttgcgggtctgtggacccttggacatgtgtcctcttctccctcctccc

SEQ ID NO: 517 - DNA, 99 bp, Artificial
  Hairpin sequence Mmd_213, mouse
gtcttcctgtagcaacagtggcagcagctctctggtttcctgtggtgtaaacaggaagccagactgtgtcaaaacggtagtctacagctgtgagaaggc

SEQ ID NO: 518 - DNA, 99 bp, Artificial
  Hairpin sequence Mmd_214, mouse
ctaggagataagttggagggttatctaggagtgatgtccccctgttttgtgtaacatgggggcaatcaacagcctaatgtccctcttgatggcacctag

SEQ ID NO: 519 - DNA, 99 bp, Artificial
  Hairpin sequence Mmd_215, mouse
ctggagtccagccctccaggggttaagggggcgggaccagttggttgctatggtgccagactgtttgggtctgctctctgacccttgggggctccctag

SEQ ID NO: 520 - DNA, 87 bp, Artificial
  Hairpin sequence Mmd_216, mouse
tcagcatggaatgaactgttagactatagccagggcctctggattctattagaggctcctggaatttctgaaccactcctaagttga

SEQ ID NO: 521 - DNA, 95 bp, Artificial
  Hairpin sequence Mmd_217, mouse
ttgagctgtaattccactgagggtttctagtgactccagcttcacacttgtggttatagtattcccagaacccctcggtggagtgatttcctgaa

SEQ ID NO: 522 - DNA, 98 bp, Artificial
  Hairpin sequence Mmd_218, mouse
cggattcttctctgttttagggttcttgtggtgcctgctgggctttcagtgctgtgggggcccttgaagggcagctgaagctgaaaacggggaagctg

SEQ ID NO: 523 - DNA, 77 bp, Artificial
  Hairpin sequence Mmd_219, mouse
gagcggagtctcctggacatagtgttctgggggacttttgggtgtctgagcaccacttttggagggagacttggctc

SEQ ID NO: 524 - DNA, 89 bp, Artificial
  Hairpin sequence Mmd_22, mouse
gtatttgaggtttaggaaggcgtgataatgaggctgtgaagattcatggcctcttttctatggcttaatttaggctctatatcaaatat

SEQ ID NO: 525 - DNA, 98 bp, Artificial
  Hairpin sequence Mmd_220, mouse
ggtaaaacctacttgaaaggagtgtttgtaggttctagtaaagctttgtgacggagtattgcagggcctgcagacacattctcctcagaagtgtgact

SEQ ID NO: 526 - DNA, 96 bp, Artificial
  Hairpin sequence Mmd_221, mouse
ctctgcccctgctttgtctttcagaataactgccatggaaggatgctcctcctgccaattggcacttatcaatgacatcgagggagagggacagag

SEQ ID NO: 527 - DNA, 91 bp, Artificial
  Hairpin sequence Mmd_222, mouse
gctgaagaggaaccagccctgatggtgtgtccgccaagacatggaagtgagaggtgggtggaggccccattggggttggtcggctctcagc

SEQ ID NO: 528 - DNA, 99 bp, Artificial
  Hairpin sequence Mmd_223, mouse
gctgtaattccatcttggtgttatggtgacatgaaaatccactcaagctgggttgtcagggtttatgaagttatcaaagccccttgatggaattatagc

SEQ ID NO: 529 - DNA, 97 bp, Artificial
  Hairpin sequence Mmd_224, mouse
tcattgtcatcgtcttggagggacatcattgtgtcactagtctgccaggttgttcagacagtccgacctgatgtcaagcaccaggatgatgacatgg

SEQ ID NO: 530 - DNA, 91 bp, Artificial
  Hairpin sequence Mmd_226, mouse
ttaatgtatccatttttctcagttagtgtcaggtttcattaggaaacacgggaggcctgacattaatcgcatgaaaaatgtgtctcaggga

SEQ ID NO: 531 - DNA, 96 bp, Artificial
  Hairpin sequence Mmd_227, mouse
cagcaagaggcactttgtacttctgccaggagaccatatgatatctctcagcgactctcctgcatgccaggaatacggaaccatgcctctcagctg

SEQ ID NO: 532 - DNA, 94 bp, Artificial
  Hairpin sequence Mmd_229, mouse
gcagcccagtgaagtggagttctgtcgttccagtctgcatctttgtagtttgggtcacagagacctttctttaaaatcttcttcactgaattgc

SEQ ID NO: 533 - DNA, 83 bp, Artificial
  Hairpin sequence Mmd_23, mouse
cattctttcagtgttgaaacaatctctactgaaccaagctccaaagcgagttcactggagtttgtttcagtattgcaggagtg

SEQ ID NO: 534 - DNA, 93 bp, Artificial
  Hairpin sequence Mmd_230, mouse
tattctcatcttgatgtgtggggctgtacagacagaaatgccattagcattaatggtaattatgcgcgtgagtccccgtgctccatgagaata

SEQ ID NO: 535 - DNA, 84 bp, Artificial
  Hairpin sequence Mmd_231, mouse
gtaggtactgatttatgaaaagctgtaaaagatcaggtggaactccgtaggacatcgtttacagctgcatggattgaaacctat

SEQ ID NO: 536 - DNA, 96 bp, Artificial
  Hairpin sequence Mmd_232, mouse
gctttcctcacttctgtttattttcagtcactcaaactgacgtgtgctgtcagtatctcctcactgtaagtgtaagcaggagtatttaaagaaagc

SEQ ID NO: 537 - DNA, 97 bp, Artificial
  Hairpin sequence Mmd_233, mouse
gctgcagtggcagcttggttgtcatatgtgtgatgacactttctaaagtcttccagaatgacaccacatatatggcagctaaactgttacatggaac

SEQ ID NO: 538 - DNA, 92 bp, Artificial
  Hairpin sequence Mmd_234, mouse
tcctggaaatgccctttaggtcagagtctgggatgcagcttctgactaacaatgaagtccactcccacttcctccagacctggcaaccaggg

SEQ ID NO: 539 - DNA, 95 bp, Artificial
  Hairpin sequence Mmd_235, mouse
gtgtgcttgttgtcgaagatgagggcctcctggatgagctggtgctgctgctccagcaggtccaggctgggcttgtagtccacgatgctgcgctc

SEQ ID NO: 540 - DNA, 98 bp, Artificial
  Hairpin sequence Mmd_236, mouse
gcatttcaggagattaatggtagaccgaagctaatagcctttggctgactctccagccatcagcttttcccagctgctcattaattcccagaaaatgt

SEQ ID NO: 541 - DNA, 98 bp, Artificial
  Hairpin sequence Mmd_237, mouse
gcaagatggcggcgctggcggaggagcagacggaggtggcggtcaagctagagcctgagggaccgccgacgctgctacctccgcaggctggcgacggc

SEQ ID NO: 542 - DNA, 94 bp, Artificial
  Hairpin sequence Mmd_238, mouse
cccgccttgcccgctggtagggcctactaggccgccgggacatcccgggtctcaagtaggcctagtctgccagcaagggcgtcccaaaggcggg

SEQ ID NO: 543 - DNA, 85 bp, Artificial
  Hairpin sequence Mmd_239, mouse
gcctgaatgcatgactctacaaccttaggacttgcagaattaaaggaatgccgtcctgaggttgttgagctgtgcgtttctgggc

SEQ ID NO: 544 - DNA, 95 bp, Artificial
  Hairpin sequence Mmd_24, mouse
ttctcaacagtgatgtgatatgtgatttccccttccaagccatggtgcagtttcatcggcaccatggccaagagggctccatcttggtaagagaa

SEQ ID NO: 545 - DNA, 97 bp, Artificial
  Hairpin sequence Mmd_241, mouse
gggagaatgattggaaagattatctaaatctcttctctgggctctcaggagtacgtgagctggtggtttgggtggtttgggttttacaggttctccc

SEQ ID NO: 546 - DNA, 97 bp, Artificial
  Hairpin sequence Mmd_242, mouse
ttctgcaatgttttgcagccaggcacacacactacaggtgctctcagagattgagctgatggccctgctgtgtgcactgtaaacaattattatagaa

SEQ ID NO: 547 - DNA, 98 bp, Artificial
  Hairpin sequence Mmd_243, mouse
gagaagcgaaaagttcaatcagttgcccagatgtatgtattgccaaataacagggtacttgggtacatctggacagccgaatgaactcttaacccctc

SEQ ID NO: 548 - DNA, 69 bp, Artificial
  Hairpin sequence Mmd_244, mouse
gtgaaacatagcctcagtattttcaggtgattttaatgaacacctgataaaactgaggtatagtaccac

SEQ ID NO: 549 - DNA, 100 bp, Artificial
  Hairpin sequence Mmd_245, mouse
caggagcagctggagccggggattaccccctgctgctgacgtgaggacggtgaacaatccggaacgttcggtggaagggggaattcccgtccgttccctg

SEQ ID NO: 550 - DNA, 98 bp, Artificial
  Hairpin sequence Mmd_246, mouse; Mmd_266, mouse
tgaccccaagaaaccaaagggcaagatgtctgcttatgccttctttgtgcagacatgcagggaagaacataagaagaaaaacccagaggttcccgtca

SEQ ID NO: 551 - DNA, 99 bp, Artificial
  Hairpin sequence Mmd_247, mouse
gccactttgagagcatcggtttttatttaaaaggcttaattggaagtttttattactcccaattaggctttttaattaaaaggaaaagttgagagaggc

SEQ ID NO: 552 - DNA, 99 bp, Artificial
  Hairpin sequence Mmd_248, mouse
ccattttcaagtgcggtggatttacacttcaaaaagtcaggcgcgacttcataattgaattgcacctgatcttttcaagtgccaggcaccggagccggg

SEQ ID NO: 553 - DNA, 91 bp, Artificial
  Hairpin sequence Mmd_249, mouse
taactctttgactgccatggcacaaaccatgctgatgattctagattgtgaccgttgtatggttaaggttgccacagcagtcaaagggtta

SEQ ID NO: 554 - DNA, 86 bp, Artificial
  Hairpin sequence Mmd_25, mouse
gggaggtggtaatggtaggagattggcctagtaggactgtcaccggtggtgtgtccttgtggctgtgtcttagctggactcttcct

SEQ ID NO: 555 - DNA, 93 bp, Artificial
  Hairpin sequence Mmd_250, mouse
accaaaggagcttttctggtctattgggtaaatatgtattaaagtaatttttaaaatacttatgtactcaataggctggaagtggtcaatggt

SEQ ID NO: 556 - DNA, 88 bp, Artificial
  Hairpin sequence Mmd_251, mouse
tcttttcttgaagcctgactccccgcgggacttccaaggcagcataacttcgggtccagactgggctgtcaggcgtttccaggaagga

SEQ ID NO: 557 - DNA, 93 bp, Artificial
  Hairpin sequence Mmd_252, mouse
gggtgatccgggtctgatgtccccatgccatgagggacatggtgagtccagtgtccctcttgatggcacttttggacatggccagggtggcct

SEQ ID NO: 558 - DNA, 84 bp, Artificial
  Hairpin sequence Mmd_254, mouse
gcaatgagccatgggccaacaatgtgagtaatggctagttttgttattttgaacttgggtagttggctgatgggtgtttattgc

SEQ ID NO: 559 - DNA, 90 bp, Artificial
  Hairpin sequence Mmd_255, mouse
gtgctgaagttggtatggcagcctgcaccatcccagttccctggaatgggcttggggtcaaaggttgctatcaccccaaagtcttcgcat

SEQ ID NO: 560 - DNA, 97 bp, Artificial
  Hairpin sequence Mmd_256, mouse
gcggcccgagccggtaggccccgaggagggttgtgggcccttctttttgtgaatgaagctccacggaacatccctcctgggggtccccgggagccgc

SEQ ID NO: 561 - DNA, 86 bp, Artificial
  Hairpin sequence Mmd_257, mouse
gtgtgctcagctggagtaattagaggaaaaacctgagggaagtctaccccagaagactcactcagccttctccagctgagtctcac

SEQ ID NO: 562 - DNA, 98 bp, Artificial
  Hairpin sequence Mmd_258, mouse
ggggtgctgccttctttctcggtctgctggttggaggacgaagatgacgaggagctggtgctggccctcgaatcgtcatccgacatagcgaacccccc

SEQ ID NO: 563 - DNA, 99 bp, Artificial
  Hairpin sequence Mmd_259, mouse
tcccctgctgcactaaattgacacttgtgcaagcaatggctctcgtcagtcactctgaagctgctgcctccagaagtgtcgatttagtgcagcgggaga

SEQ ID NO: 564 - DNA, 96 bp, Artificial
  Hairpin sequence Mmd_260, mouse
tatctcttttttgattagagaggtggcagggagcctggctcattaggcagaagtaatgagccaggctacatgccatctctaattagagaaaagatg

SEQ ID NO: 565 - DNA, 94 bp, Artificial
  Hairpin sequence Mmd_261, mouse
agaatcttctgacaatgaaggtaggcgtacaactaggagattgctgtcacggatagcttctagcatgtcatctacttttttctcacgaagatct

SEQ ID NO: 566 - DNA, 98 bp, Artificial
  Hairpin sequence Mmd_262, mouse
ttacacctgaaacttctcacttgggggtacaattagcctctggcgcctttagaatgagttgccagtgactaatggtgccctcaaggaagcatttgtaa

SEQ ID NO: 567 - DNA, 98 bp, Artificial
  Hairpin sequence Mmd_263, mouse
gaggacagctggcagaaagtgttacaggtataaccctaattctccttgtttctgttggtgttgtaggagagatctgtaggcctttctgtccagcgctc

SEQ ID NO: 568 - DNA, 94 bp, Artificial
  Hairpin sequence Mmd_264, mouse
aaacgctgtgactcaaactcggggaaattgttcctgtaatggagttctcaatttattggtcaatttcaccttgattttgtgtcactgttggttt

SEQ ID NO: 569 - DNA, 99 bp, Artificial
  Hairpin sequence Mmd_265, mouse; Mmd_463, mouse; Mmd_504, mouse
ctttttcttttcttgaagcctgactccccgcgggacttccaaggcagcataacttcgggtccagactgggctgtcaggcttttccaggaaggatccagg

SEQ ID NO: 570 - DNA, 96 bp, Artificial
  Hairpin sequence Mmd_267, mouse
ggacctgaaagatggtgaactatgactgggcagggcaaagccagaggaaactctggtggaagtctgtagcagtcctgacctgcaaatcggtggtcc

SEQ ID NO: 571 - DNA, 54 bp, Artificial
  Hairpin sequence Mmd_268, mouse; Mmd_307, mouse; Mmd_467, mouse
gcctctcggcgccccctcgatgctcttagctgagtgtcccgcggggcccgaagc

SEQ ID NO: 572 - DNA, 82 bp, Artificial
  Hairpin sequence Mmd_269, mouse
tctcgggctctgggggactatgactacaagtgtgtggatggcaagggccctacagagcagcttgtttctccagagcctgagg

SEQ ID NO: 573 - DNA, 92 bp, Artificial
  Hairpin sequence Mmd_27, mouse
ggggaatttctggccacaatttgtaacactaaaaggctccccaaagggagggggtgcaaaatgatacaaattgggtacaaaggatagccact

SEQ ID NO: 574 - DNA, 91 bp, Artificial
  Hairpin sequence Mmd_270, mouse
ttgggtgtggggataggggcacttctgttcctgataaccttattatgtgtttatcaggagcagacactgcccaggttgtcacgacaaccag

SEQ ID NO: 575 - DNA, 92 bp, Artificial
  Hairpin sequence Mmd_271, mouse
cttggaggctttgcctcatccacaggcatttggcatcggagatggaaaatttcacttgtcaggtcaccatggaaacaagcagagccactgag

SEQ ID NO: 576 - DNA, 94 bp, Artificial
  Hairpin sequence Mmd_272, mouse
ttagcatgttaataggtctttgtgcccaaaggctttggattataaattatcaagactgcattagccagatgggcaggattaattagcatgctag

SEQ ID NO: 577 - DNA, 85 bp, Artificial
  Hairpin sequence Mmd_273, mouse
ctggacacctgcgtccctctcttgtttcctctcctcttcttatgccccctcctggggaggaggctactggatgtaagctgtgcag

SEQ ID NO: 578 - DNA, 94 bp, Artificial
  Hairpin sequence Mmd_274, mouse
gggtggctggggtcatacatctgtgggtaaggataagcatgcaagtattgtatgtaggactggtgctgactcatgggtgaggacacggccactc

SEQ ID NO: 579 - DNA, 98 bp, Artificial
  Hairpin sequence Mmd_275, mouse
ggcaccagctccgtcagctccagccccaggtcctgcgcgatgcggcccacaaaggtgccgtgtttggcctcctctgggacggagtagcggagctggcc

SEQ ID NO: 580 - DNA, 97 bp, Artificial
  Hairpin sequence Mmd_276, mouse
ccgagactttgaaagcaaacgagaccgagatctggatgcagatcttgagcgagaagagcgagacccagacttggtttgtttgtttttgacatcttgg

SEQ ID NO: 581 - DNA, 82 bp, Artificial
  Hairpin sequence Mmd_277, mouse
tagttagctaattgcaggtgcaattggccacttgctccatcagatgaagggtaagtggttaattgaactcatgagtgaccta

SEQ ID NO: 582 - DNA, 98 bp, Artificial
  Hairpin sequence Mmd_278, mouse
cgccttgcctagtcgggccgccaacaccagatccttctccttctggcggatcaccgacagcagctcgggatcctgggtaggcggcggcggcagcggcg

SEQ ID NO: 583 - DNA, 99 bp, Artificial
  Hairpin sequence Mmd_279, mouse
ggcttgttttgagttcattgttcagcagatgagctagttcaggttttagctttcagcagttcatttgattgaacttgggaccaataaaagtgagaggcc

SEQ ID NO: 584 - DNA, 96 bp, Artificial
  Hairpin sequence Mmd_28, mouse
tgaatggctttgctccttttctgcatcacttccatcagcgcacccacaattcctgaagtgggtgcgggtgttggtggtgtggactcttggccatca

SEQ ID NO: 585 - DNA, 94 bp, Artificial
  Hairpin sequence Mmd_280, mouse
cctggctgcaagaggcttgctgcctagtccgaggccagcagtgttgtgtctggcctgtaagaggcaggtagcaagccgagactatgtccaaagg

SEQ ID NO: 586 - DNA, 91 bp, Artificial
  Hairpin sequence Mmd_281, mouse
tctgaaggccacgcccattcgggactggagggatgggcttcctaacggaagcgcacccttcaagtcctggaacaccgactctatcttctga

SEQ ID NO: 587 - DNA, 88 bp, Artificial
  Hairpin sequence Mmd_282, mouse
ctgttctgctaagacctgcgctgtggtgtaggaccaagggaatgtgcccctggcttttgtgtcagcatgcttggttactacagaacag

SEQ ID NO: 588 - DNA, 99 bp, Artificial
  Hairpin sequence Mmd_283, mouse
gttagcgcagagcttcaagctaagcaaggcatctcagcacgaggtgtcaaacataagacagctaatgctggaagccagagcaagaaggctcttcttgac

SEQ ID NO: 589 - DNA, 80 bp, Artificial
  Hairpin sequence Mmd_284, mouse
acgttagtccatttgctcagcggcccttccacgatggacgccatcttgggagccgccaatgacaacaaacggcctgacgt

SEQ ID NO: 590 - DNA, 94 bp, Artificial
  Hairpin sequence Mmd_285, mouse
attaattgagccaagccaagctcaaccttgaagatgctactttggtgtgttcccgaaatagggctgagcttatggctggttcttacttgttagt

SEQ ID NO: 591 - DNA, 90 bp, Artificial
  Hairpin sequence Mmd_286, mouse
actaacctggagtcacttcctctggttgacacccactcaaaaagaacactcctgattaagacggttgagaccagagatggacaggtcagt

SEQ ID NO: 592 - DNA, 99 bp, Artificial
  Hairpin sequence Mmd_287, mouse
ttcctttatcagcttccctgcaggactgcagggcaatggcagagtgtaagctgccatgggtagagcttcggggatggcagggcagaggtgaggagggag

SEQ ID NO: 593 - DNA, 98 bp, Artificial
  Hairpin sequence Mmd_288, mouse
ttggctgttttcctattagcatatgaggaacctaggactgtcccttgttgtcaaggtaacagctattccttgggtagctgcaatagaaaagaagccaa

SEQ ID NO: 594 - DNA, 99 bp, Artificial
  Hairpin sequence Mmd_289, mouse
ggcctgtttttcaacctggctatttctttgatattagtctcaatagtagatgggatacagtgccagaaaagtagcactggacttggagtcagaaaagcc

SEQ ID NO: 595 - DNA, 99 bp, Artificial
  Hairpin sequence Mmd_29, mouse
ccttttcttttcttgaagcctgactccccgcgggacttccaaggcagcataacttcaggtccagactgggctgtcaggcttttccaggaaggatccagg

SEQ ID NO: 596 - DNA, 96 bp, Artificial
  Hairpin sequence Mmd_290, mouse
gctggcctcactgacccaggaattcatagcaggaaattaggcaggattaaggaaggctagttttcttgtgtgagaagggtaaaggtggaggaaagc

SEQ ID NO: 597 - DNA, 97 bp, Artificial
  Hairpin sequence Mmd_291, mouse
gtcgcagcgcgtggccgatcgcctgggcctggagctgggcaaggtggtcaccaagaagtttagcaaccaggagaccaggtgggagcctcgctggggc

SEQ ID NO: 598 - DNA, 88 bp, Artificial
  Hairpin sequence Mmd_292, mouse
agcttcttttcccgggcgagctgcctacgggtccgctgctggcacacagccagctgggtcttggcggctttgttgctgggatagagct

SEQ ID NO: 599 - DNA, 94 bp, Artificial
  Hairpin sequence Mmd_293, mouse
gcttgagctgaggggcctacctcaagctatggaaaaaattagggttagacaagaagcatttttttatagcctgaggaaggcccatggcaagagc

SEQ ID NO: 600 - DNA, 81 bp, Artificial
  Hairpin sequence Mmd_294, mouse
cgtcacctagggatcttgttaaaaagcagagtctgattgaggggccaagattctgcatttttagcaagctctcaagtgatg

SEQ ID NO: 601 - DNA, 99 bp, Artificial
  Hairpin sequence Mmd_295, mouse
ggtcaggatgctttgttgtctggattctcagttgcttgtattggcttttgaaaaggtcattatgagaaaagggatctgaatagcaaaaggattccagct

SEQ ID NO: 602 - DNA, 92 bp, Artificial
  Hairpin sequence Mmd_296, mouse
tgtctgtgtttcctcttgcagggttacattttgccatctgcctttccagagtaagtggctctatgtgggcactgagcgaggaaacatacaca

SEQ ID NO: 603 - DNA, 96 bp, Artificial
  Hairpin sequence Mmd_297, mouse
tagactaattaatgtttgagtgtttaaacacaatgcctttacagaagcaatggcattataatgtgttgggacactctagcattgtaattagcacta

SEQ ID NO: 604 - DNA, 98 bp, Artificial
  Hairpin sequence Mmd_298, mouse
cttcagcaaccttgcagccccatcgctcatttgcataatggatgcctttttatccattatgcaaatggtatgagaggaaaattaggcaataagggaag

SEQ ID NO: 605 - DNA, 94 bp, Artificial
  Hairpin sequence Mmd_299, mouse
ggtgatgaatgtatattggtaaggagggtgaagttgaaggggcagagacctctcaaatgaattgacttttctttaccaacatattcagaacacc

SEQ ID NO: 606 - DNA, 86 bp, Artificial
  Hairpin sequence Mmd_3, mouse
ttggcagactgggaaatctctgcaggcaaatgtgatgtcactgaagaaaccacacacttacctgtagagattcttcagtctgacaa

SEQ ID NO: 607 - DNA, 97 bp, Artificial
  Hairpin sequence Mmd_30, mouse
attggggtgcaccagtgagagaaccttccggaaagactcttgggcttggaacagggcccttgagtcttggtgctctcttccctttctgggcctcagt

SEQ ID NO: 608 - DNA, 90 bp, Artificial
  Hairpin sequence Mmd_300, mouse
cagctagaactcccctggcgagtggaaacagcttttaccgcggctgtagctgtggttttggaattttccaacgccccctgtgattggctg

SEQ ID NO: 609 - DNA, 95 bp, Artificial
  Hairpin sequence Mmd_301, mouse
ggctatgattccactgaggggtgctggcggtgacatgtgccatgaagtcaatctgagtggtttatcaccagaactcccagggtggaattataacc

SEQ ID NO: 610 - DNA, 99 bp, Artificial
  Hairpin sequence Mmd_302, mouse
gcagtgcctaaggaattaatgaccagctgaggttaatgagtccccactcagctccgggccatcaactctcccagctggccattaatcccctggaaatgc

SEQ ID NO: 611 - DNA, 82 bp, Artificial
  Hairpin sequence Mmd_303, mouse
aggtggtacgccctttcctctctgccccatagggtgtagctctaactaccctctagggaagagaaggttgggtgaacagcct

SEQ ID NO: 612 - DNA, 83 bp, Artificial
  Hairpin sequence Mmd_304, mouse
ttccagccaggccacctctcctttatctgcacagtctattttaagagtactctactgcaaggagaatggggcctaggcaggaa

SEQ ID NO: 613 - DNA, 94 bp, Artificial
  Hairpin sequence Mmd_305, mouse
gcgaagcattgcatttgggtgacaggcagttgttcgtgcttgaataactcaggatttgaattctacagtttgtggcacccgtgtaatgcttagc

SEQ ID NO: 614 - DNA, 96 bp, Artificial
  Hairpin sequence Mmd_306, mouse
ccacattttcttcgccacagaatgactcctctgagaacaaagtcattgttgacttcaaagaactctgaggaagttcagtggatggaaagaatttgg

SEQ ID NO: 615 - DNA, 97 bp, Artificial
  Hairpin sequence Mmd_308, mouse
gaggttgaggtctcctattcctggctcccagcttcttgcctccaggttcctccaccatccttgagctgtgaccttgacttggtgacctatgaacctc

SEQ ID NO: 616 - DNA, 64 bp, Artificial
  Hairpin sequence Mmd_309, mouse
ggccttttccatgttgggtaactgctgtgcatgctacccagttacccaagccaggaagcaggcc

SEQ ID NO: 617 - DNA, 99 bp, Artificial
  Hairpin sequence Mmd_31, mouse
agctgtgtcatcaatagaagctcagggccttagggaactggagggcacttctgacccactgctctcactctttggctctacttctgacaatgacttgct

SEQ ID NO: 618 - DNA, 98 bp, Artificial
  Hairpin sequence Mmd_310, mouse
ttctccagcgttggagtcagccacggcttacctggaagattgaatgtctacttggctttcttcctgtcagccgtgggtgcctcttgctactggaagag

SEQ ID NO: 619 - DNA, 85 bp, Artificial
  Hairpin sequence Mmd_311, mouse
attggtcaggaaagacactttttatattgtcaagtggcacttaagccactaattcttgactgtgaaactgcttttcctgggcaat

SEQ ID NO: 620 - DNA, 71 bp, Artificial
  Hairpin sequence Mmd_312, mouse
gggaggaggcggaaagccgacattgtttacttaattaaaagtaaacaacaatttgccgctgccagcctccc

SEQ ID NO: 621 - DNA, 89 bp, Artificial
  Hairpin sequence Mmd_313, mouse
gtacatctaggaagcagctgaaagggtttctctagtctgatatctcagagagtggactgagaaatccctctctttacctgaagacgtac

SEQ ID NO: 622 - DNA, 98 bp, Artificial
  Hairpin sequence Mmd_314, mouse
aaattaatgaccaaaaatgtcagatgtgtccacagctaattattcattagatgcttaattagtgtgggatgatcatgacattttaatgttattaattt

SEQ ID NO: 623 - DNA, 98 bp, Artificial
  Hairpin sequence Mmd_315, mouse
tcattgagcaggtggggctcaggaggtcctggggccgccctgaaggcagaacatgagaattctgggccctccagacctcatgcttcctgcctgtgtgg

SEQ ID NO: 624 - DNA, 88 bp, Artificial
  Hairpin sequence Mmd_317, mouse
aggaaggatctgggccaattttctggttgcttcttggcactgagttcttgtgtttttacagcagtcacacaggccctacatccttcct

SEQ ID NO: 625 - DNA, 82 bp, Artificial
  Hairpin sequence Mmd_318, mouse
gacggctaatgcccattagtgttggggactgttacctcgatcaggagtgacagagccctaattattaaggtaattagaagtt

SEQ ID NO: 626 - DNA, 96 bp, Artificial
  Hairpin sequence Mmd_319, mouse
aggtccttgatttcaatgtttcccactttggtggttgatctgataataggtcttccaaccaaagctgggaagatgtgttctggaaaattagagcct

SEQ ID NO: 627 - DNA, 95 bp, Artificial
  Hairpin sequence Mmd_32, mouse
aagctgacgctacccatcccctccacgtgccccgagccctttgcccgcctactggagggtgagccagggccctgtggagagggtaggctcagctt

SEQ ID NO: 628 - DNA, 89 bp, Artificial
  Hairpin sequence Mmd_320, mouse
aggtgcctgtgactcatctggtacctattgtgctctctgcaaaggcgcggaggcttgcttgtgtgatgggtgccatttgagagccactt

SEQ ID NO: 629 - DNA, 97 bp, Artificial
  Hairpin sequence Mmd_321, mouse
agtatatgacgctataacttgtttttacagatgattaaatgctcggttgaagctgaggctttgatgactgttggagccatttatgacctcatatact

SEQ ID NO: 630 - DNA, 88 bp, Artificial
  Hairpin sequence Mmd_322, mouse
tcttttcttgaagcctgactccccgcgggacttccaaggcagcataacctcgggtacagactgggctgtcaggcttttccaggaagga

SEQ ID NO: 631 - DNA, 99 bp, Artificial
  Hairpin sequence Mmd_323, mouse
ccttttcttttcttgaagcctgactccccgcgggacttccaaggcaccataacttcaggtccagactgggctgtcaggcttttccaggaaggatccagg

SEQ ID NO: 632 - DNA, 99 bp, Artificial
  Hairpin sequence Mmd_324, mouse
ggccgcatggaccacgtggaccgctgcttcgatgtgctggctgtggagtactacgtgccggatgccgaccagtggaccagtgtgacacccatgcgagct

SEQ ID NO: 633 - DNA, 83 bp, Artificial
  Hairpin sequence Mmd_325, mouse
ccctggtgtgagcgtatgtgcctttggactacatcgtgaacgcagcaccatgcagtccacgggcatatacacttgcctcaagg

SEQ ID NO: 634 - DNA, 99 bp, Artificial
  Hairpin sequence Mmd_326, mouse
cctagctttcctaagtgatgtcagcccctgcgagcttccaataggaaccaggcataaatcagggagctgaccttatccaataggaaactttattatagg

SEQ ID NO: 635 - DNA, 98 bp, Artificial
  Hairpin sequence Mmd_327, mouse
aggaattagggtcaggacccagaaactttgctctatcagctggtgtttgtttcagctcaggtggggtgggtttcccctttgatgggtcatttcctcct

SEQ ID NO: 636 - DNA, 91 bp, Artificial
  Hairpin sequence Mmd_328, mouse
ccaagcagggacttcttgccagcccttggcagcttgaggcctcccatcatcatccaccgagctggcaagaagtatggcttcaccctgcggg

SEQ ID NO: 637 - DNA, 94 bp, Artificial
  Hairpin sequence Mmd_329, mouse
tccttgatcttcaagccaggcgtctggaagtcgccgtaaagagggaacacgtcctctttggggtcgccttccagagggtaggtgcagtctggga

SEQ ID NO: 638 - DNA, 97 bp, Artificial
  Hairpin sequence Mmd_33, mouse
gctgtgaggtcagaatcctgtgcttacgacacctcggtctgttgccatggaaacaggggcggattaaggctggagcgcagggatcaggcccctccgc

SEQ ID NO: 639 - DNA, 95 bp, Artificial
  Hairpin sequence Mmd_330, mouse
gtgccccgaggggtggctgtgatgagcgggatgcggaaagtgtctacagagccgatctgcttcccgctcacccacagcagctgctccatggtcac

SEQ ID NO: 640 - DNA, 97 bp, Artificial
  Hairpin sequence Mmd_331, mouse
ggaaagctgtcacatttggaaaggagcaaccaggcagggagaaactaaattgtttttctttgtctgcctgctgttccaagtcgttgcaggcactgcc

SEQ ID NO: 641 - DNA, 95 bp, Artificial
  Hairpin sequence Mmd_332, mouse
tactccacgggtagcatgttggagatggtcaggtggaataataaggagagtccacagaccaggagcttctccgtaactgctgcctggaacgggtg

SEQ ID NO: 642 - DNA, 100 bp, Artificial
  Hairpin sequence Mmd_333, mouse
gggctgatgagcagttcaagctccctgcatagaaatagcctcagaatagttgtggtgttgtttctaattgcaatgggtgagcagactggctcattaatcc

SEQ ID NO: 643 - DNA, 99 bp, Artificial
  Hairpin sequence Mmd_334, mouse
tccttcacaaagtacaaagggtttcagaatcaagtgtattccagcagcagcccaggcttgctgacaagatattttgaaacaacttgctattaggaagga

SEQ ID NO: 644 - DNA, 95 bp, Artificial
  Hairpin sequence Mmd_335, mouse
gaggcgagtgtggatctaatcttcagctgattaaatgtccctcattaatgagtttctttaattaatgaagttttggggcctgctccacttgcttt

SEQ ID NO: 645 - DNA, 99 bp, Artificial
  Hairpin sequence Mmd_336, mouse
gcatgccagtgggaatcataggctggagagaccttccttctgcaggagatgaaattcttgaagtagaatctgaggtattcaagcctaattccctaatgt

SEQ ID NO: 646 - DNA, 97 bp, Artificial
  Hairpin sequence Mmd_337, mouse
aatttattttcgctaggagaggaatgacccataactcacgaacggtgatgcttaaagtgagttatggaggttactctcctgtgagaggaaatggatt

SEQ ID NO: 647 - DNA, 77 bp, Artificial
  Hairpin sequence Mmd_338, mouse
tccaagttcatgatgaagagtttgtcagtgggagtcagttccacaggctgcctggtgaactctttgtcgaagttgga

SEQ ID NO: 648 - DNA, 100 bp, Artificial
  Hairpin sequence Mmd_339, mouse
ggcccccatctgggaggatgatgtcatctatctccccaaagaaaaggccacactttcctttgtggaagtccatggtgacatcacctcctgatcacatgcc

SEQ ID NO: 649 - DNA, 96 bp, Artificial
  Hairpin sequence Mmd_34, mouse
gagcaatctagaattgattttatattcctggtcaagttgctgaaatgtagcaattgggtcaggaagatcagttccttggacatgtatcttgtgctt

SEQ ID NO: 650 - DNA, 97 bp, Artificial
  Hairpin sequence Mmd_340, mouse
ggcccagccacagtgacattcatcccccggtgggtctggctgcctcctcacaacccaccgacaacaatgaatgttaattgtgacctttgctgtggcc

SEQ ID NO: 651 - DNA, 95 bp, Artificial
  Hairpin sequence Mmd_341, mouse
gcaatgtggagaagcctagggcttgccctggctctctgtctcctcccctatggaggagcagagagccaaggccaaagctctgcttgttacaaagc

SEQ ID NO: 652 - DNA, 89 bp, Artificial
  Hairpin sequence Mmd_342, mouse
ttattcacctggaaactgctgaggagcacaaatgtcacaagataaatcaaacctgtgagattggcatctctcagcagcaggatgggtag

SEQ ID NO: 653 - DNA, 89 bp, Artificial
  Hairpin sequence Mmd_343, mouse
cagggtgatggttagggatttggcagcatggccccattaacattagtgggagttagtcagctaaatcccagacatggaacagaatcctg

SEQ ID NO: 654 - DNA, 95 bp, Artificial
  Hairpin sequence Mmd_344, mouse
tctcagtaactatggaaatcccagggtttccctagcaacagctccaaatgggtcttgttgctagggaacacagggatttcccaggctaccaaaga

SEQ ID NO: 655 - DNA, 95 bp, Artificial
  Hairpin sequence Mmd_345, mouse
aagctgcggagtcaaccatgcagacaaatgagaagctgtcttttgtctgcagaaggcagcaatcctacatcaacatggaggtctctgtctgactt

SEQ ID NO: 656 - DNA, 90 bp, Artificial
  Hairpin sequence Mmd_346, mouse
ctcaggcggggtgggggaggatgttttggatgccgctctgctgacgttggtgccctctgttcttacatcctccttaatttactgcctgag

SEQ ID NO: 657 - DNA, 98 bp, Artificial
  Hairpin sequence Mmd_347, mouse
gcggcgggctgagttttgaaaacttaggattctaaatgtataaattgtttggaacatttaacatctagtcattaagcagtcaccctcttgccctccgc

SEQ ID NO: 658 - DNA, 94 bp, Artificial
  Hairpin sequence Mmd_348, mouse
ggccttcttagctgctctaattaggatccccttagtccctcccggtttctccggagaggacagggggctttttaattgaggctattaggagttc

SEQ ID NO: 659 - DNA, 96 bp, Artificial
  Hairpin sequence Mmd_349, mouse
agccattaacatgtcacccctgcttgaaacaatgactcagcttggttctgcataataggacaagtgagggagacaagcagaggtgacaggaaggtt

SEQ ID NO: 660 - DNA, 83 bp, Artificial
  Hairpin sequence Mmd_35, mouse
gggcttggcctggctctgctgggacacttcacacttttgccatttttggccagaaggctctccctgctagccgggctctgttc

SEQ ID NO: 661 - DNA, 97 bp, Artificial
  Hairpin sequence Mmd_350, mouse
ttccaaattttatgggccaaattctgccctcaattatgcacatgcaactaattgcacacatataacagagggcagaatttcgcttttggaactggaa

SEQ ID NO: 662 - DNA, 98 bp, Artificial
  Hairpin sequence Mmd_351, mouse
caaaagcagatattttcccaagcagacaccagccacagccttcttggctgaaaggctaaatggctggctactcatgtactgttgaatgtctgagtatg

SEQ ID NO: 663 - DNA, 99 bp, Artificial
  Hairpin sequence Mmd_352, mouse
gtttaagtacctgtgggcagcatcagggtctgccttgcggtgggaccttttgggtttcagcgcagggtctctggtgtttcctgacaggcgatctgaagc

SEQ ID NO: 664 - DNA, 99 bp, Artificial
  Hairpin sequence Mmd_353, mouse
gcattttctgcagattaataattagctagaaggagttgatggtccttggctaaaacgtgggtcattaactccagccagtcattaattgcctggaaatgt

SEQ ID NO: 665 - DNA, 94 bp, Artificial
  Hairpin sequence Mmd_354, mouse
gactctgtatttaatttggctcagccgggaagattttttggctctgtgtgtgtatgtgtattctgaaaaatctttccgagcaagccccagggtc

SEQ ID NO: 666 - DNA, 92 bp, Artificial
  Hairpin sequence Mmd_355, mouse
ttgtagcatgtggttgtattaatgaacgttacaggacagctttataatcatttataaatctgtaacattcaataaagaagcacatgtggcaa

SEQ ID NO: 667 - DNA, 98 bp, Artificial
  Hairpin sequence Mmd_356, mouse
ttggtgttgtcaatttgtgagaccagtctggaattttcagccttggtacacaagatctagaattaagagattgcacacacaaatgagacaaacaccag

SEQ ID NO: 668 - DNA, 90 bp, Artificial
  Hairpin sequence Mmd_357, mouse
ttcaggtattatgggctatctagctgtggtgaaattgggaaggatgatatcttagaaatctttcctgactgcagagacttgtaacctgaa

SEQ ID NO: 669 - DNA, 95 bp, Artificial
  Hairpin sequence Mmd_358, mouse
gcgacgtccgtgcagcggagaagcagaggataatggcgtctgcagcgctgtcgcctgtagcgccctcctcctttctcgttcgcgcactctgtggt

SEQ ID NO: 670 - DNA, 90 bp, Artificial
  Hairpin sequence Mmd_359, mouse
ttggggtaccgagttgtgggtgagtctttttccccagttcccacggttctcccttgctggggtcctggcttctccgctctttgtccccga

SEQ ID NO: 671 - DNA, 99 bp, Artificial
  Hairpin sequence Mmd_36, mouse
gctgatatacagcatttggcaggattccttgctagcatttggtaataattccataccaaatgctagggagaaacccacccaaatggaaccgcttcaagc

SEQ ID NO: 672 - DNA, 88 bp, Artificial
  Hairpin sequence Mmd_360, mouse
ggcactgggggcagaaggccatttgaaaattttccacattgaaattttgattaattaaatttgtctcaagtggctggctttcagtgtc

SEQ ID NO: 673 - DNA, 93 bp, Artificial
  Hairpin sequence Mmd_361, mouse
agaaggatgctgaaaccaatgaaacaatatattgtacaaaagagcctttcatccaggctcgggttattgtcattcgttggctggtttctttct

SEQ ID NO: 674 - DNA, 99 bp, Artificial
  Hairpin sequence Mmd_362, mouse; Mmd_386, mouse
ctttttcttttcttgaagcctgactccccgcgggacttccaaggcagcataacttcaggtccagactgggctgtcaggcttttccaggaaggatccagg

SEQ ID NO: 675 - DNA, 97 bp, Artificial
  Hairpin sequence Mmd_363, mouse
aggcaaaccctacaaatgtagcagaagcatttccgcacactggcatcaacatctagtttgtgcagaaatgtttccactagattcatagagtgttctt

SEQ ID NO: 676 - DNA, 91 bp, Artificial
  Hairpin sequence Mmd_364, mouse
ccatggctgctgctgtagcagaagggttgagccagtccaggctggaaggatctgtcacccgatcccaggtctgtgctacagccagtcttgg

SEQ ID NO: 677 - DNA, 95 bp, Artificial
  Hairpin sequence Mmd_365, mouse
ggaaggatatctgaggactggatgtgttcatgttttacaccaaatgctttcaacatgagaatccgcccagtcgtatctaataaaaatatccttcc

SEQ ID NO: 678 - DNA, 79 bp, Artificial
  Hairpin sequence Mmd_366, mouse
gtcacctcttcaaggtgtttgggattcgctttgatatccttgtggatggcaaggtaagtgtcctatgtgaagggatggc

SEQ ID NO: 679 - DNA, 97 bp, Artificial
  Hairpin sequence Mmd_367, mouse
cacagcttggcactggaaattttatttgaatcaggggagaatattatttgcgatattttcctaaatgacaaatgaatgatttaccggcagcaatgtg

SEQ ID NO: 680 - DNA, 82 bp, Artificial
  Hairpin sequence Mmd_368, mouse
ccgcatttgctccagtggacactggtgcgcacccacttcaagatacactgggctagtgtcagtctccaaggagcgcgtgcgg

SEQ ID NO: 681 - DNA, 93 bp, Artificial
  Hairpin sequence Mmd_369, mouse
tgagacctttctgctctcgctgtggttatgtgtctcactgtttctctacaagggtgagacaaagcaatttcacagttatcagaagggttatca

SEQ ID NO: 682 - DNA, 98 bp, Artificial
  Hairpin sequence Mmd_37, mouse
ccttctggaatttgcttgtggcgctgtttattacctaccaggcattttgctgaaggtgcaatttgcagagccattaatggcaatgaagttccagcggg

SEQ ID NO: 683 - DNA, 100 bp, Artificial
  Hairpin sequence Mmd_370, mouse
atgccatgcaaattggcacgaaggcaatcagtctgactctgaaggctgccccaccggccgcaggctggctcattgtcttttctgtcaatttgcatctcat

SEQ ID NO: 684 - DNA, 96 bp, Artificial
  Hairpin sequence Mmd_371, mouse
agaggctgccaggtgctggtggaaatagaggccgaagaggctggagagcagctggcaggcagctgtccaccagatgatgtaagccagcatgcctct

SEQ ID NO: 685 - DNA, 99 bp, Artificial
  Hairpin sequence Mmd_372, mouse
gtccccgttgtctgcgtccttgcctgtctcttccctgcccagtggcctccttgtccggctcactgggcaggagccctaatcggattggacagctgagat

SEQ ID NO: 686 - DNA, 84 bp, Artificial
  Hairpin sequence Mmd_373, mouse
ttttctttttcagaaaattcttccaggaggaaacacatcatttgatgtagtttttcttgcaagagtagtaggaaatgtagaaaa

SEQ ID NO: 687 - DNA, 99 bp, Artificial
  Hairpin sequence Mmd_374, mouse
ggcagtcgtcacctttcttccgggcactggccaagccaaagtcagtgatgatgatcttggagtcagtgcctgggtggtagtaaaggagattctcaggct

SEQ ID NO: 688 - DNA, 85 bp, Artificial
  Hairpin sequence Mmd_375, mouse
aaaagcttggcgtaattatctctgaacaggttgagcgcaaggtctctgcaaaatctgctcagggtgattattttgctggggtttt

SEQ ID NO: 689 - DNA, 96 bp, Artificial
  Hairpin sequence Mmd_376, mouse
gttatcaggaaataatcatagccctcgggtgctgggagacactgggtgtagctaagtgtctctaattccccaagggtatgattagctcacgttaac

SEQ ID NO: 690 - DNA, 98 bp, Artificial
  Hairpin sequence Mmd_377, mouse
actcgggaagcagcattcaggtctctgggtcctggatgtccttggtgcacactccaaggactcctcgtccttaagttcatagtctgtattccctgagt

SEQ ID NO: 691 - DNA, 82 bp, Artificial
  Hairpin sequence Mmd_378, mouse
cgaacacccaaaataatgtgagatcaggctcatgcgttatgcatgaggtctgatttaacatgaacattatttcttgtgtacg

SEQ ID NO: 692 - DNA, 82 bp, Artificial
  Hairpin sequence Mmd_379, mouse
cattccaagccactctctgatttgctgtgagtggcagaatcattcaccgtggtgaatcacagagagcgagccatgtggagtg

SEQ ID NO: 693 - DNA, 96 bp, Artificial
  Hairpin sequence Mmd_38, mouse
aggcagcggtcctacatgaatatggaggtctctgtctgacttagaatagctggctgagtctgatcgttcacctccatacaaccttagactctcact

SEQ ID NO: 694 - DNA, 98 bp, Artificial
  Hairpin sequence Mmd_380, mouse
gctgaacgatcgatccccatcccagcttccttccagcccttgatgttttagtacgcacataggctagagagaggttggggatggggaaagatgagagc

SEQ ID NO: 695 - DNA, 87 bp, Artificial
  Hairpin sequence Mmd_381, mouse
cagggaagcacaggtggctcatttagaagcagccatacactcagagagtggctgcctatacatgggctttcctgtgctcctctcctg

SEQ ID NO: 696 - DNA, 98 bp, Artificial
  Hairpin sequence Mmd_382, mouse
cgggagagctcagtgaaggactcaatgacgttgaagttgcacagggggctgacttcaaagaaggtcatgcagttcttctctgcataggctctggcctg

SEQ ID NO: 697 - DNA, 90 bp, Artificial
  Hairpin sequence Mmd_383, mouse
ttcacctggcgcactgggcaggaagactttattcagatccaaggaggaggctctggaatgggttttctgtggccgtggtggtggggtggg

SEQ ID NO: 698 - DNA, 87 bp, Artificial
  Hairpin sequence Mmd_384, mouse
catctggaatttctattgctcaatgggaggctgatgggggagctgatctggaaagagcctccaaaaagaaataatgagttccagatg

SEQ ID NO: 699 - DNA, 89 bp, Artificial
  Hairpin sequence Mmd_385, mouse
ttaacctcaatggtcctgatatggcaggcctccttgggctgtatggttccagattagtaggtctgtatggttcaggatttacaggttgg

SEQ ID NO: 700 - DNA, 98 bp, Artificial
  Hairpin sequence Mmd_387, mouse
caactagagagacccggttgcttgggtggatccagacaaaggtggatttccatccctggattttgtgcccacgcctctgggtcaccctgtctcccttg

SEQ ID NO: 701 - DNA, 99 bp, Artificial
  Hairpin sequence Mmd_388, mouse
agggtgcgtattacagacgaacaatgatatgccttgccagtaatggcactcagtcaaaactaccagggcatgtcattattaggtcataatacccaccct

SEQ ID NO: 702 - DNA, 98 bp, Artificial
  Hairpin sequence Mmd_389, mouse
ggcaccagctccgtcagctccagccccaggtcctgcgcgatgcggcccacgaaggtgccgtgtttggcctcctctgggacggagtagcggagctggcc

SEQ ID NO: 703 - DNA, 91 bp, Artificial
  Hairpin sequence Mmd_390, mouse
tctactaggaatgggatacattcacaggtgtggttgttggagacatgctgcgcaaagctgtgagttaaaatctgatttctctcctagggga

SEQ ID NO: 704 - DNA, 96 bp, Artificial
  Hairpin sequence Mmd_391, mouse
ccattaagcagagctggcattttagagcacgtcagaggcgctggcttcctgccctggaagtcagcgtctggcctctgagccagcattgcctgccgg

SEQ ID NO: 705 - DNA, 94 bp, Artificial
  Hairpin sequence Mmd_392, mouse
ctgggcaaaggctctcctaaggcaggcagacttcagtgttgcccatttctcagttctctgaagcttgcttacctccaaagggcctttgccatag

SEQ ID NO: 706 - DNA, 89 bp, Artificial
  Hairpin sequence Mmd_393, mouse
ctctccatatgctgtggcatctgtaactggcatgtaagggactcattttcctcacatatctcattaaagatgcaaagcaaaatggaggg

SEQ ID NO: 707 - DNA, 84 bp, Artificial
  Hairpin sequence Mmd_394, mouse
atttactattttagtgctggatccagttgcagctgaaacatttcaaccaggctgcggagttgggccagctctgtgatggtcagt

SEQ ID NO: 708 - DNA, 96 bp, Artificial
  Hairpin sequence Mmd_395, mouse
gagtgttgtgtgcaatgctttatctagttggatgtcaagacacgtgaaacttaagtgcatgacaccacactgggtagaggagggctcacagtgttc

SEQ ID NO: 709 - DNA, 79 bp, Artificial
  Hairpin sequence Mmd_396, mouse
tacaggacgtctgtgcaattcgatggagctcatcactttccggtctatgagcaattaaattgcaccaggaagccctgta

SEQ ID NO: 710 - DNA, 57 bp, Artificial
  Hairpin sequence Mmd_397, mouse
tctctgcctgaggttgtgtgagggcagactagcccaggaccaggccttggggagaga

SEQ ID NO: 711 - DNA, 91 bp, Artificial
  Hairpin sequence Mmd_398, mouse
tgcttgattagtcagattgatggaggaggccatatgtggccgtgtcaaaacttggctaccaggctcctttcctctctctgaaggacaggca

SEQ ID NO: 712 - DNA, 87 bp, Artificial
  Hairpin sequence Mmd_399, mouse
gctcaccctggaggccacagatgctgatggaagccgcacccatgctactgtggactacagcatcatcagtggcaatcggggccgagt

SEQ ID NO: 713 - DNA, 96 bp, Artificial
  Hairpin sequence Mmd_4, mouse
tgatattatgccatgacattgtgtcaatatgcgatgatgtgttgtgatggcacagcgtcatcacgtggtgacgcaacatcatgacgtaagacatca

SEQ ID NO: 714 - DNA, 96 bp, Artificial
  Hairpin sequence Mmd_40, mouse
gacggctcagaagtccatggagctgtgggccaggtagtccttgcggccaatgttgctgacctgcttggtctgcatagcttcaagtttggggcagtc

SEQ ID NO: 715 - DNA, 96 bp, Artificial
  Hairpin sequence Mmd_400, mouse
tcatgccgagcgaaaaagcccctgacgtcacctgcagccaatcagagtgagccgctcgggggcaggtgacgtcagcggagcgggcgctgggtgcgg

SEQ ID NO: 716 - DNA, 98 bp, Artificial
  Hairpin sequence Mmd_401, mouse
gagcgattcatgccgccacctcacccactgcgaggcacctgggtaatgcgtcccttgcttgtggtgcgtgagctctgtggctccgttttgttttgctc

SEQ ID NO: 717 - DNA, 92 bp, Artificial
  Hairpin sequence Mmd_402, mouse
cttcttcagaagctctgctcaccatgcttcctggtccttgcagagtcctggcctgggctgctctgggtgctgcagagtcttcttgggaggag

SEQ ID NO: 718 - DNA, 94 bp, Artificial
  Hairpin sequence Mmd_403, mouse
aagggagggtatggtgaggatggtggtcttggaggcggacatttatccaacagaatgctactattagacaggccgtttttacctagattccttt

SEQ ID NO: 719 - DNA, 68 bp, Artificial
  Hairpin sequence Mmd_404, mouse
cttgacatgtccctttaacgttagaggcatttgctgatgccactaacttatgggtcaatgtggtcaag

SEQ ID NO: 720 - DNA, 97 bp, Artificial
  Hairpin sequence Mmd_405, mouse
ctgtgcagcctgccccgcgcctgggccctcttcccacccaggtcagcaggggagagagggcaggctccccagggaggggacaggaggcagtacccag

SEQ ID NO: 721 - DNA, 99 bp, Artificial
  Hairpin sequence Mmd_406, mouse
ccttatcatagagtttactgaagtggggccagttccccgcctcttccagctttgctgccaaagttggagaggggtggagtggcctggaagactgttggg

SEQ ID NO: 722 - DNA, 97 bp, Artificial
  Hairpin sequence Mmd_407, mouse
gatgatgagctgtcctttcccgagggagcaattattcgcatcttgaacaaagaaaaccaagatgatgatggcttctgggaaggggagttcagtggtc

SEQ ID NO: 723 - DNA, 91 bp, Artificial
  Hairpin sequence Mmd_408, mouse
gagaaatcagctttaattaatttgagtgccagctctgtgtataattacccagcatgagagtttgcatgcaaatgcggaaatgctgattctt

SEQ ID NO: 724 - DNA, 88 bp, Artificial
  Hairpin sequence Mmd_409, mouse
ccatcagtcaggaaattgtatgataaataggaggtagccaggtttagtggcacttccttctgcttcagcagtttttgcctgactttgg

SEQ ID NO: 725 - DNA, 99 bp, Artificial
  Hairpin sequence Mmd_41, mouse
atcagtttgtgtgcatttgcaggaacttgtgagtctcctattgaaaatagacaggagactgacaagttcccgggaacacccacaaatcttcctactggt

SEQ ID NO: 726 - DNA, 91 bp, Artificial
  Hairpin sequence Mmd_410, mouse
gtcgttgctgacccaagcggtcaggtagatgtagaaagcgctcggattaatgatgccatctgcgtctaccagacgctgtttagtcaactac

SEQ ID NO: 727 - DNA, 88 bp, Artificial
  Hairpin sequence Mmd_411, mouse
cttcttgtataagcactgtgctaaaattgcaggaactaagattctatcttggtttttgtaataatgctagcagagtacacacaagaag

SEQ ID NO: 728 - DNA, 100 bp, Artificial
  Hairpin sequence Mmd_412, mouse
ccaccagttagcagcaggctgtggattaggagtggcagaaaggatgtctttaaataggtttccgtttctgtttgtttggtttgaggcttggtgatggagg

SEQ ID NO: 729 - DNA, 98 bp, Artificial
  Hairpin sequence Mmd_413, mouse
gcaggcgtttcctggggattaatgaccagctgggaagaaccagtggccctcggctctgcctcccagccagccattaactccaaggaaatgtcttttgc

SEQ ID NO: 730 - DNA, 86 bp, Artificial
  Hairpin sequence Mmd_414, mouse
ggtggtgcatggcagcagcacactgtgagtccaaacagcagatggcagcgctgttgagtaggctggcaagctgatgtctagccacc

SEQ ID NO: 731 - DNA, 99 bp, Artificial
  Hairpin sequence Mmd_415, mouse
ctttttcttttcttgaagcctgactccccgcgggacttccaaggcagcataatttcgggtccagactgggctgtcaggcttttccaggaaggatccagg

SEQ ID NO: 732 - DNA, 80 bp, Artificial
  Hairpin sequence Mmd_416, mouse
tgggggaggcgggctgtgctggtgcccggtgtataatcgggttaatccagtagacaaagaataaaccaatagccctccca

SEQ ID NO: 733 - DNA, 97 bp, Artificial
  Hairpin sequence Mmd_417, mouse
ctatcgaatttgtggcttttgctagctttgcagaaagggacttttaaaaatacttctcttgatagtgtaaaactagcgaaagccacaaatggaatgg

SEQ ID NO: 734 - DNA, 98 bp, Artificial
  Hairpin sequence Mmd_418, mouse
cactagttctcctcccatccccctaccccaaacttctctactctggtttaccagcaccaacaaccacgtgggggaggggtaagagagtagaaccggtg

SEQ ID NO: 735 - DNA, 95 bp, Artificial
  Hairpin sequence Mmd_419, mouse
cagccttttctttggtgtgcgaatgtgagtgtgtgtaatgatgttatctatatgccgtcggggcacctgcacatttgcatattggggaagaactg

SEQ ID NO: 736 - DNA, 80 bp, Artificial
  Hairpin sequence Mmd_42, mouse
aaccaaagggcaagatgtctgcttatgctttcttcatgcagacatgcagggaagaacataagaagaaaaacccagaggtt

SEQ ID NO: 737 - DNA, 97 bp, Artificial
  Hairpin sequence Mmd_420, mouse; Mmd_513, mouse
tgtatgtgcatgtgtgtatagttgtgtgtgcatgttcatgtctatatttgaatatacataacatacacacacacgtataaacgcaagcacacataca

SEQ ID NO: 738 - DNA, 65 bp, Artificial
  Hairpin sequence Mmd_421, mouse
tcagtcaggctgctggctatacaccaggacttatctggtcctggatataaccactgccagactga

SEQ ID NO: 739 - DNA, 97 bp, Artificial
  Hairpin sequence Mmd_422, mouse
cccatttcgagtcataatccccttttgtgacatcacaattagccacttgtggtgatgattataatgtcacaaacgcaggattaggacaaggaatggg

SEQ ID NO: 740 - DNA, 100 bp, Artificial
  Hairpin sequence Mmd_423, mouse
cagtgtaacccatgctggctgcagcaatgagggcctgctggatggcgtggctcttcttaaacactccttgctgctggccagccattgtccagtcacactg

SEQ ID NO: 741 - DNA, 99 bp, Artificial
  Hairpin sequence Mmd_424, mouse
gtcccgagagttgctgatacaagctctacaaccattgagctggagtgggaacccccagctttcaatggtggtggggaaattatgggctactttgttgat

SEQ ID NO: 742 - DNA, 93 bp, Artificial
  Hairpin sequence Mmd_425, mouse
tgctctccctggctgggggtaacctctgcccctggagccttcccttgttcctacaatgccaacctctcaggttagacccagccctggagctca

SEQ ID NO: 743 - DNA, 94 bp, Artificial
  Hairpin sequence Mmd_426, mouse
gcctgttgacatgtccagacactactccagcagaggcactgggcctggcaagaggccaggcctgagtcacagctgctggatatatcaacgtggc

SEQ ID NO: 744 - DNA, 99 bp, Artificial
  Hairpin sequence Mmd_427, mouse
ctggacgtgttagtggaggccttaaggcctgtgggcacctttaagaaaatcggaaaggtgttccgcaaagaagaggactccacggtggggatgctgcag

SEQ ID NO: 745 - DNA, 96 bp, Artificial
  Hairpin sequence Mmd_428, mouse
gctatcgatgtgaagatcctgcagcagctggtgaccttgaacgagggtattgaggcagtgcgctggctgctggaggagcggggtacactgacgagc

SEQ ID NO: 746 - DNA, 82 bp, Artificial
  Hairpin sequence Mmd_429, mouse
gttttacagctcagaggggattaggacaagagatgtgtttaaaatacgatgtgtctctctgtctctctgcagctgatggagc

SEQ ID NO: 747 - DNA, 82 bp, Artificial
  Hairpin sequence Mmd_43, mouse
tagaaaaggcaattaaaatccacaactgacttccttcccgtgtccaagatgagggacagtgcgtgggtgtgtgcccttttta

SEQ ID NO: 748 - DNA, 91 bp, Artificial
  Hairpin sequence Mmd_430, mouse
tggaagaccatcgtgcaggactacatttgttctccccatgcagagagcatgaggaagagaaaccagattgtgttcacgatggtggaggccg

SEQ ID NO: 749 - DNA, 87 bp, Artificial
  Hairpin sequence Mmd_431, mouse
gctggttttggcacttctctcactctagtgagttgcaaaaaaacaagcaggtgctagcaatctgagagaccacatgccagctccagc

SEQ ID NO: 750 - DNA, 93 bp, Artificial
  Hairpin sequence Mmd_432, mouse
ctgaggcagctgaggccatgctgtctggctcaatgaggccctcaggaacagaggagccaaagccacgggacagggcctcagatgcgatttcag

SEQ ID NO: 751 - DNA, 99 bp, Artificial
  Hairpin sequence Mmd_433, mouse
gttggtgccctgataaagccggagccctggcagataaatgctgaggtggagccaagccatttatttgaggagcagcagggctcctatcagggcgccggc

SEQ ID NO: 752 - DNA, 96 bp, Artificial
  Hairpin sequence Mmd_434, mouse
gacaggatagggtccttaaaataaactctctggtttccttcctttctttatctaaggggaggctaaagtgggtttgcacaaagggctcttcgtgtt

SEQ ID NO: 753 - DNA, 74 bp, Artificial
  Hairpin sequence Mmd_435, mouse
tttgtgtgtataaaatgggtaattgcacacacaaatgaacaattttgtatgcaattatccattttgcatacaga

SEQ ID NO: 754 - DNA, 94 bp, Artificial
  Hairpin sequence Mmd_436, mouse
caggtatccaccaaggacatgcccctggcactgatggcctgtgccctccgaaaaaaggccacagtgttccggcagcctctggtggagcagcctg

SEQ ID NO: 755 - DNA, 79 bp, Artificial
  Hairpin sequence Mmd_437, mouse
ctgggcatacagaaccccctggcagccagccttgaggtggcccctgccttccgtctggctgagagcaggactaacccag

SEQ ID NO: 756 - DNA, 97 bp, Artificial
  Hairpin sequence Mmd_438, mouse
gttgttcttaaatcaccttgaagtgtctcttgtcaaagataactccctgcattgtagaaacgtctttgacaagagaggattagggtgaaattgcaat

SEQ ID NO: 757 - DNA, 98 bp, Artificial
  Hairpin sequence Mmd_44, mouse
gtgaggagcaggttagctgggtgaaaagttcgcagcgaggggagctgtctgtttcctttgcttaatttatccactatttggctaacctcactctgaac

SEQ ID NO: 758 - DNA, 93 bp, Artificial
  Hairpin sequence Mmd_440, mouse
tgacaatccaccaagaacccttcgtgtatgtcaagcccacaatgagtgatggcacatgcaaagaggagttcacagtcaatggtgaccctgtca

SEQ ID NO: 759 - DNA, 90 bp, Artificial
  Hairpin sequence Mmd_441, mouse
gccaaaatcagagaagggattctgatgttggtcacactccaagagttttaaaatgagtggcgaacacagaatccatactctgcttatggc

SEQ ID NO: 760 - DNA, 92 bp, Artificial
  Hairpin sequence Mmd_442, mouse
cagcagaggtaagcctgtgagactaacagctttagcgcaggattcatctttccttcttgactgtggtttacagagtgctttacctccagctg

SEQ ID NO: 761 - DNA, 94 bp, Artificial
  Hairpin sequence Mmd_443, mouse
cagagatgggattcacatgaaccacagctgagttcacagagatgatttgtgagcctcagtatttgcacatatgtggtcatgcgggacctctctg

SEQ ID NO: 762 - DNA, 75 bp, Artificial
  Hairpin sequence Mmd_444, mouse
ggtatatctgcagcctctcctctcctggggaaactgaattattggagtcctcaggagtatagctgttgatatgct

SEQ ID NO: 763 - DNA, 95 bp, Artificial
  Hairpin sequence Mmd_445, mouse
gaacccagggcttcttaagggaactacaactcccagtgtacatgcaaagcagctgtgatgcacactgggagttgtagtccttgagctctcagttt

SEQ ID NO: 764 - DNA, 99 bp, Artificial
  Hairpin sequence Mmd_446, mouse
tcccacctgaagcctaatccctgctttgctacaacacaattggttgcggtggaaatgattatgttgtcacaaacagaggattagaacttcgggtggaga

SEQ ID NO: 765 - DNA, 99 bp, Artificial
  Hairpin sequence Mmd_447, mouse
tcaaaataatgctgctaattacctctgatctcctttaatgggaagctgctcccaactccacaaaggagtaaatgagaggtccacagcacagacccagga

SEQ ID NO: 766 - DNA, 63 bp, Artificial
  Hairpin sequence Mmd_448, mouse
cccagctcccgctcacccctgccacgtcaaaggaggcagaaggggagtcgggagcggagaggg

SEQ ID NO: 767 - DNA, 95 bp, Artificial
  Hairpin sequence Mmd_449, mouse
ggcttctgagtctgatgccctcataccttgagggacatgatcatcagtagcccaatgtccctcttgatggcaacttagacatagtcagaatagct

SEQ ID NO: 768 - DNA, 99 bp, Artificial
  Hairpin sequence Mmd_45, mouse
gaggtaattttggccctcctgattgttaagctcaatggagatagattttttcttcctctgtgtgtgtgtttattgtaatatctggagggctttttcttc

SEQ ID NO: 769 - DNA, 88 bp, Artificial
  Hairpin sequence Mmd_450, mouse
gcagctggaaagggcttagccctttaatgccagcagctgtatctccaatgtggctgctctgctgaggggctggatgctatccagaagc

SEQ ID NO: 770 - DNA, 99 bp, Artificial
  Hairpin sequence Mmd_451, mouse
ctgattctgcctgcgtggagcgggcacagctgtgagagccccctaggtacagcggggctgcagcgtgatcgcctgctcacgcacaggaagtgacgacag

SEQ ID NO: 771 - DNA, 98 bp, Artificial
  Hairpin sequence Mmd_452, mouse; Mmd_473, mouse
ggattataataaattaaatgcctaaactggcagagtgcaaacaattttgactcagatctaaatgtttgcactggctgtttaaacatttaatttgttcc

SEQ ID NO: 772 - DNA, 100 bp, Artificial
  Hairpin sequence Mmd_453, mouse
ggtggaggtgggtgggctgcctcccaatcctggctcaggcagggtggcctctgatctgggctccggagttgggaaagggagctgacccatggaagacacc

SEQ ID NO: 773 - DNA, 68 bp, Artificial
  Hairpin sequence Mmd_454, mouse
gatatatacattctattgtccctagaaggtgtattccttctagggacaatgtgttggctgtgtgagtc

SEQ ID NO: 774 - DNA, 99 bp, Artificial
  Hairpin sequence Mmd_455, mouse
gtctttgtcgtggtgtcagaagattaattacactcatgtgagaacaactttctcattgggtgaaaagagacattatccttctgacttgtgatagacgac

SEQ ID NO: 775 - DNA, 81 bp, Artificial
  Hairpin sequence Mmd_456, mouse
gcatgcagctttggagacgccaaggggaaaatggatttaattgattcgttacctttggtattgtaatgcctgctgcgatgt

SEQ ID NO: 776 - DNA, 87 bp, Artificial
  Hairpin sequence Mmd_457, mouse
tgccttagctagttaaaccggaagcctatggtaatcagagagaggcacttcttgccttctcctatggtttcttcattagcagaggta

SEQ ID NO: 777 - DNA, 83 bp, Artificial
  Hairpin sequence Mmd_458, mouse
acctggaaaaggcagtgatgtttccaagcacatatctgacttatatgtgtggatggtaataatgctgagtcttttccgaaggt

SEQ ID NO: 778 - DNA, 82 bp, Artificial
  Hairpin sequence Mmd_459, mouse
gaccagctcacgggaagtggccttcaatagtccgatagcttcctgtatcctgacattgtgaaggcccacttcctgctctgtc

SEQ ID NO: 779 - DNA, 99 bp, Artificial
  Hairpin sequence Mmd_46, mouse
ctggagtatcctgctttgggatttgggtcagtcaatcagcaggtatttatcctgctttctttggacccagaatactgttaactcagcaggataccacag

SEQ ID NO: 780 - DNA, 98 bp, Artificial
  Hairpin sequence Mmd_460, mouse
cccaggaggttcaaacattgtctgctgagtttggacaagagagaaattaactccaaactgaagataatgtctaagaatctccatttcaaccagttggg

SEQ ID NO: 781 - DNA, 98 bp, Artificial
  Hairpin sequence Mmd_461, mouse
gccagagggggcggcgcgcgagagtctagtggcgctggtcagcacctcggacagggactcgggcgccaacgggcaggtgcgctgcgccctctacgggc

SEQ ID NO: 782 - DNA, 79 bp, Artificial
  Hairpin sequence Mmd_462, mouse
agaggcttggagctcgaggctaattgtgaattaggagcccaattatgccctgcacaattggctccacgctaccttctct

SEQ ID NO: 783 - DNA, 100 bp, Artificial
  Hairpin sequence Mmd_464, mouse
ttaggcagctggagaaaacaatgggccagattctcactctgtgtaatcacagaggacgactccattgtatagcccattgtttctcccatgtactgcctga

SEQ ID NO: 784 - DNA, 86 bp, Artificial
  Hairpin sequence Mmd_465, mouse
ccgtgtgagtttgcgctgcaaagctccttggcatccttgcatgggttgggtgttggggagctcaaattgcagctacaactggctgg

SEQ ID NO: 785 - DNA, 93 bp, Artificial
  Hairpin sequence Mmd_466, mouse
gtgtttatttgaatgtgtgatgaggaggtcatcaaaatgaacacgctcgttgtgtttatttgaatctcacatcgctcatgagagaatacacgc

SEQ ID NO: 786 - DNA, 76 bp, Artificial
  Hairpin sequence Mmd_468, mouse
ccgcggagtctctaactggcgacagatgggccactttcttctggccacaaaggggccggaatggagcgctccgcgg

SEQ ID NO: 787 - DNA, 98 bp, Artificial
  Hairpin sequence Mmd_469, mouse
atgtctaagcttttcaagttaactcctggctcatggctctggaaggtgctgtaaacattgtcccctctgccatgagtctggattttgttcttttacat

SEQ ID NO: 788 - DNA, 99 bp, Artificial
  Hairpin sequence Mmd_47, mouse
gagtttgacagcagcctaccacagaaccagccctttgttttctcccttggcactggccaggttatcaagggctgggaccaggggctgctggggtaagtc

SEQ ID NO: 789 - DNA, 92 bp, Artificial
  Hairpin sequence Mmd_470, mouse
ttggtcctgtttcctcctgtggcccggagtttgatgtgcagggcggtgatgcccagcttcttgcacctctgggccacatcctgggcagccaa

SEQ ID NO: 790 - DNA, 94 bp, Artificial
  Hairpin sequence Mmd_471, mouse
aaaatttttgtaggtggactgggaaagcagcggattgcagatgcgtttaacagcagggtattttccgctgccatgaccagttaagggagatttt

SEQ ID NO: 791 - DNA, 89 bp, Artificial
  Hairpin sequence Mmd_472, mouse
ggcccctctgtgtggctgctgctggctcagaccccagcccaccttgggcggtgggtttgggttttggctggcacattcaccaaggggcc

SEQ ID NO: 792 - DNA, 83 bp, Artificial
  Hairpin sequence Mmd_474, mouse
gaagtcagacttgcctccgcaactgcatcacagctacatctttggagctgttgaaatccagctgacggaggaatcggtccttt

SEQ ID NO: 793 - DNA, 79 bp, Artificial
  Hairpin sequence Mmd_475, mouse
gagtttgctggctctgaatggggtatgagacttgttcttacccaaagccctgatgcactctttcagggctagcagactt

SEQ ID NO: 794 - DNA, 89 bp, Artificial
  Hairpin sequence Mmd_476, mouse
cgggtctcagaaatcaggcttccggagagtgtagtttgtttgtaataataatacgaattattctctcagcctgaggtcactagggcgtg

SEQ ID NO: 795 - DNA, 98 bp, Artificial
  Hairpin sequence Mmd_477, mouse
gtccagcaatattttaagctcccagccagacagcttttatgaagggagggatgtttggaaaacaatgggagagagagaatgggagagctgtgctgggc

SEQ ID NO: 796 - DNA, 98 bp, Artificial
  Hairpin sequence Mmd_478, mouse
ctgtccggaatatggttggttggtcctgagcatgttagaggaattcctgttcagcatgacatgctcagaggccacttggccagagatgagctgggagg

SEQ ID NO: 797 - DNA, 85 bp, Artificial
  Hairpin sequence Mmd_479, mouse
gcctccttccagcgcagcagctgccggatctcggcctcacgctcgcgctgcacctcctcctgcagctgccgcagctcccggaggc

SEQ ID NO: 798 - DNA, 93 bp, Artificial
  Hairpin sequence Mmd_48, mouse
cctttggttcacattaaaatataaattccccgtgggagagaccctattaagccttgcagggaattactaatttacattttaatgtgaatgagg

SEQ ID NO: 799 - DNA, 99 bp, Artificial
  Hairpin sequence Mmd_480, mouse
gatcacgtcaccatggccaaccgggagttggcatttaaggctggcgacgtcatcaaagtcttggatgcttccaacaaggattggtggtggggccagatc

SEQ ID NO: 800 - DNA, 91 bp, Artificial
  Hairpin sequence Mmd_481, mouse
gcggtttggagggctgcattcattttgagtgctgttgtaatcaattttagatacagtattccacaatggatcagtttgcatccaaacctgc

SEQ ID NO: 801 - DNA, 93 bp, Artificial
  Hairpin sequence Mmd_482, mouse
tccctggagccgctccactgacggcaccatcttggcacaaaaactagccgaggaggtgcccgtggacgtggcctcttacctctacactgggga

SEQ ID NO: 802 - DNA, 91 bp, Artificial
  Hairpin sequence Mmd_483, mouse
ccagctgcccgggaagcttggcggccaggctgagggaaggaagcgtcggctctctttgaaggtcggctgccagtgaatctcaggcagctgg

SEQ ID NO: 803 - DNA, 97 bp, Artificial
  Hairpin sequence Mmd_484, mouse
gtgtagatggtaacttgttagaaggttacttgttagttcaggacctcattactttctgcctgaactattgcagtagcctcctaactggttatcccac

SEQ ID NO: 804 - DNA, 85 bp, Artificial
  Hairpin sequence Mmd_485, mouse
actcttatttcctccactgcctgactttattgaatgccgtggggcatattaatcagtaaagccaagtagtgcatgaaataaaagt

SEQ ID NO: 805 - DNA, 91 bp, Artificial
  Hairpin sequence Mmd_486, mouse
gagcggttacatttggcagcattccttgttagcatttgataaacaattattgccaaatgttagcaaggaaacctgccaaatgttacagctc

SEQ ID NO: 806 - DNA, 101 bp, Artificial
  Hairpin sequence Mmd_487, mouse
tgctgttgtccttggagaaatctgggcctgagacagaggagggatgtaatttgagtgctcctttgtcacaggttaccagggtgtgcttgaggggacggtag

SEQ ID NO: 807 - DNA, 100 bp, Artificial
  Hairpin sequence Mmd_488, mouse
ggagcagccggcttcatttgtgatccgggagcctggtgccagcaagacctggaatttccggtctggttggtcttgggccccgtggagccaggttgatacc

SEQ ID NO: 808 - DNA, 100 bp, Artificial
  Hairpin sequence Mmd_489, mouse
ggtggaggaggactgttatttaaaaggcttttaaatgatgtcactatatattcttttaacatcctctaaaagcctttgaaaaaacagtctctacctccct

SEQ ID NO: 809 - DNA, 98 bp, Artificial
  Hairpin sequence Mmd_49, mouse
gcgcgagctgtccccgaacaccttgcggtaggaggaggcggagcacaaatagtgctccgatccgaagctcatggtgccggggtcggggccgggtgcgc

SEQ ID NO: 810 - DNA, 79 bp, Artificial
  Hairpin sequence Mmd_490, mouse
agtgttcgaatggaggttgcccatggtgtgttcattttatttatgatgagtattacatggccaatctcctttcggcact

SEQ ID NO: 811 - DNA, 99 bp, Artificial
  Hairpin sequence Mmd_491, mouse
tgagctgcttcttcctctctcctcttttgcacaaagagtctcatgtctgatatttagacatgatgagctttgtgcaaagtggaacctggtttcttctca

SEQ ID NO: 812 - DNA, 90 bp, Artificial
  Hairpin sequence Mmd_492, mouse
aaggatttggcatttcaatcgatgggaaatgatgtgtgatcattctaatttattatacatcattcccatcaatcgacgggttgaagcctt

SEQ ID NO: 813 - DNA, 100 bp, Artificial
  Hairpin sequence Mmd_493, mouse
cctaggtgccatcaggagggacatcaggctgtcgattgccctcgagtagcacagaacagagggacatcacccccaagtgacctccagctgacctcctagg

SEQ ID NO: 814 - DNA, 94 bp, Artificial
  Hairpin sequence Mmd_494, mouse
ctctgctgtctggccatttcgggttttccagtccgatgctcctgagggggagggtcgggccccttggaaaatccgttttcatggcaacacggag

SEQ ID NO: 815 - DNA, 98 bp, Artificial
  Hairpin sequence Mmd_495, mouse
tcattcattgtctttcttatgtttcccaacagacactgagcacattgaagagctgcagtgggtgtggagaacatacttgaacaatcagaaatgaatga

SEQ ID NO: 816 - DNA, 93 bp, Artificial
  Hairpin sequence Mmd_496, mouse
gctcatttttgccatgtggagtcagtcattctggagtggctggggacagcaggaaagccagcagagtggctgacccgggatggtttcaagggc

SEQ ID NO: 817 - DNA, 92 bp, Artificial
  Hairpin sequence Mmd_497, mouse
ctagactagcctagactgggaagcctgggctaagatgcagtaaactattttcagtttataaacaagtcctgacatcccagtttgggtgttgg

SEQ ID NO: 818 - DNA, 99 bp, Artificial
  Hairpin sequence Mmd_498, mouse
agagtgttccagccctgagccaccctcccaggagccccacagatccagtcttgactgtcccaatggggcagggaggaaaggtggccgctgggatttttt

SEQ ID NO: 819 - DNA, 98 bp, Artificial
  Hairpin sequence Mmd_499, mouse
ctcgaaaggtcacacatgtaatgaattgtgggtgcttgcctggcttcccaggcgagaaccgtaagcaattattaaatgccattgtgtgtcaggaaggg

SEQ ID NO: 820 - DNA, 99 bp, Artificial
  Hairpin sequence Mmd_5, mouse
gacgtacggtgcttaatgagaagttgcccgcgtgtttttcgctttatatgtgacgaaacattcgcggtgcacttctttttcagcatcctattctacgtt

SEQ ID NO: 821 - DNA, 91 bp, Artificial
  Hairpin sequence Mmd_50, mouse
tcgtgtggttagtgacgtgtgcttggtgtgtcttagcttggttgtgtgttttagagtggagtccatactgagtgctgtaactgccatggga

SEQ ID NO: 822 - DNA, 81 bp, Artificial
  Hairpin sequence Mmd_500, mouse
gacattcccaacattttatggcaatttgtttcatttgccgcaggcccataacgatgcaaattgccataaagtgggataatc

SEQ ID NO: 823 - DNA, 92 bp, Artificial
  Hairpin sequence Mmd_501, mouse
taatggtcagataatggatgacaataaaagttatgggtccctagctggggtgtagctcataatggttggcaagatccattattagaccatta

SEQ ID NO: 824 - DNA, 91 bp, Artificial
  Hairpin sequence Mmd_502, mouse
tggagcctgaggggctcacagctctggtccttggagctccagagaaaatgttgctccggggctgagttctgtgcaccccccttgccctcca

SEQ ID NO: 825 - DNA, 89 bp, Artificial
  Hairpin sequence Mmd_503, mouse
ggccaaaagctgccctcagctatgcatgcacagcttccattgacgtcagtaagaactgtgctcatgtaacaggaggcagaaatttggct

SEQ ID NO: 826 - DNA, 99 bp, Artificial
  Hairpin sequence Mmd_505, mouse
tcccatgtgcctttaaggaatcactcttgatctcagtcataaaattggaaagccacacaactgacaagatgatccccccaaggcagctgaaatatgggg

SEQ ID NO: 827 - DNA, 91 bp, Artificial
  Hairpin sequence Mmd_506, mouse
gtcttttaactctctattgctggtggctctgatttcatgatgcattttgcttatgaaactctagctttcagcactaaattgagttaaagat

SEQ ID NO: 828 - DNA, 94 bp, Artificial
  Hairpin sequence Mmd_507, mouse
ggtgcggggcgcgtcgcccccctcaggccaccagagcccggatacctcagaaattcggctctgggtctgtggggagcgaaatgcaacccaaacc

SEQ ID NO: 829 - DNA, 96 bp, Artificial
  Hairpin sequence Mmd_508, mouse
agcttgaagtagaaaaacaaaaatgggaaacagatgggtaatacccagaaagaaaattttctcggtattgcccatctgcttctctgcctgaaagct

SEQ ID NO: 830 - DNA, 87 bp, Artificial
  Hairpin sequence Mmd_509, mouse
ggagcctggctcactggaggctgcagagaagtgaactgaagaattacagtcggtttcacttccctgccttatgtctcttcaggtgcc

SEQ ID NO: 831 - DNA, 92 bp, Artificial
  Hairpin sequence Mmd_51, mouse
cacttttctgaagtgtgaattgcctgctgtcagcctggagttctcacctccgcaatcctggctgcaggcatatttgcatattggatgctgtg

SEQ ID NO: 832 - DNA, 98 bp, Artificial
  Hairpin sequence Mmd_510, mouse
caaggtcttggtatggtagcgccccaggatggagtaggcagggccaaggtccttgccagtcttcaggatcttggggttcacactgtagcggggccctg

SEQ ID NO: 833 - DNA, 72 bp, Artificial
  Hairpin sequence Mmd_511, mouse
ggaaggtactctgtgggagggaggagatcagagccaaggatgacattcctccttcacacttgcagtacctcc

SEQ ID NO: 834 - DNA, 86 bp, Artificial
  Hairpin sequence Mmd_512, mouse
ggctgctccttgcctttgatgtgaggcaagctggggcagtgcagcccctgttctggttgccttttgtcagataggagttgacagcc

SEQ ID NO: 835 - DNA, 100 bp, Artificial
  Hairpin sequence Mmd_514, mouse
ggcctagtcatcaccctgagccttgcactgagatgggagtggtgtaaggctcaggtatgcacagctcccatctcagaacaaggctcgggtgtgctcagct

SEQ ID NO: 836 - DNA, 73 bp, Artificial
  Hairpin sequence Mmd_516, mouse
ttacagctgattggacggggtcgatacggagcagtatataaaggttccttggatgagcgtccagttgctgtaa

SEQ ID NO: 837 - DNA, 95 bp, Artificial
  Hairpin sequence Mmd_517, mouse
gcacaccgcacagaagtcctcattctctatgggggccggggtgttcttcttggctcctggagctcgggggatgagtctgtgttcctcagatgtgc

SEQ ID NO: 838 - DNA, 96 bp, Artificial
  Hairpin sequence Mmd_518, mouse
cgcatgtcacacagccggattgtccccttgctgctgctgtatacgaaggtgttgcagtggtgggggtggaactcagctgcagtgatcacctctgtg

SEQ ID NO: 839 - DNA, 73 bp, Artificial
  Hairpin sequence Mmd_519, mouse
ggaggtgcccaggtcagtgcgctggttcatggaggcggacgtatctatgaggaacagcaggatgggcatcttc

SEQ ID NO: 840 - DNA, 90 bp, Artificial
  Hairpin sequence Mmd_520, mouse
tgcaccagggagaacagctgatggatcacaaatctctgcatttcaccaacagaaatgaatttgaatccatcaattttattcccttatgca

SEQ ID NO: 841 - DNA, 88 bp, Artificial
  Hairpin sequence Mmd_521, mouse
gggtctgcttacacattagcaactgactgtctccttcaaccaaacatgatcccacagacagtcaggagctgtggaagcaaagaaaacc

SEQ ID NO: 842 - DNA, 81 bp, Artificial
  Hairpin sequence Mmd_522, mouse
agatttcattagtctggttgctggctatattccaggacttatctggtcctggatataaccactgccagactgaatggtgct

SEQ ID NO: 843 - DNA, 85 bp, Artificial
  Hairpin sequence Mmd_523, mouse
ccgttcaaataaaagattgaaggatgctgtggcccactgccatgaggcagacaggaacacagctttacgttcaagtttagaatgg

SEQ ID NO: 844 - DNA, 88 bp, Artificial
  Hairpin sequence Mmd_526, mouse
tcctcctgcttggcgttgatgtctgctttcatctccatggcaacatgacggggaaggacagacagcaggagacgctcctgcagaggga

SEQ ID NO: 845 - DNA, 94 bp, Artificial
  Hairpin sequence Mmd_527, mouse
gtctgtgctgtggacctctcatttactcctttgtggagttgggagcagcttcccattaaaggagatcagaggtaattagcagcattattttgac

SEQ ID NO: 846 - DNA, 95 bp, Artificial
  Hairpin sequence Mmd_528, mouse
tgagcagctgttccatagaggctactatagaaacagctacaacagcataaccagcgcgagtagcgatgaggagctcctagatggagcaggtgcca

SEQ ID NO: 847 - DNA, 99 bp, Artificial
  Hairpin sequence Mmd_529, mouse
gtataaaatttctaagcagtgtgtgagaggtgtacgcagaaatcatgttggcaaaatattttgtgtaagtgcctcccacacacagctttaaaatgttac

SEQ ID NO: 848 - DNA, 87 bp, Artificial
  Hairpin sequence Mmd_53, mouse
atgacgtaaactctagttcatatttgagtgtcaaaagttggagtttgacatattccaaaatgtcactcaagatggagtttgggttat

SEQ ID NO: 849 - DNA, 99 bp, Artificial
  Hairpin sequence Mmd_530, mouse
tgggctccatgggtgtccagatgcctgatacattctccaggccaaggtatataagaacctgtggcctggggaggcgaggacagctggacaaacagctta

SEQ ID NO: 850 - DNA, 89 bp, Artificial
  Hairpin sequence Mmd_531, mouse
gccgcgtagtgaaagagctagcgtgggcagttcttttgtactccagctggagtaaaatgaacgcaggctcgcgtgttttcatcgctggt

SEQ ID NO: 851 - DNA, 93 bp, Artificial
  Hairpin sequence Mmd_532, mouse
gctcgcaggcaggggatttgaggagcggttgtgtgatttgtacagctgtcattagggtaattgcacgatattttcccaaatttctcctgcagc

SEQ ID NO: 852 - DNA, 90 bp, Artificial
  Hairpin sequence Mmd_533, mouse
ttaagctgagtgcattgtgatttccaataattgaggcagtggttctaaaagctgtctacattaatgaaaagagcaatgtggccagcttga

SEQ ID NO: 853 - DNA, 80 bp, Artificial
  Hairpin sequence Mmd_534, mouse
taccctcagagctgatctgagtgtggagattccattgacttcaaaggaagcttcatgcttggatcttctccacaggggtg

SEQ ID NO: 854 - DNA, 101 bp, Artificial
  Hairpin sequence Mmd_535, mouse
tgctgttgtccttggagaaatctgggcctgagacagaggagggatgtaatttgaatgctcctttgtcacaggttaccagggtgtgcttgaggggacggtag

SEQ ID NO: 855 - DNA, 94 bp, Artificial
  Hairpin sequence Mmd_54, mouse
agaacagggtctccttgaggggcctctgcctctatccaggattatgtttttatgaccaggaggctgaggtcccttacaggcggcctcttactct

SEQ ID NO: 856 - DNA, 84 bp, Artificial
  Hairpin sequence Mmd_55, mouse
gccagttgtggggcggagcaggctgagtttacagcgggccgcagacatctgttgagcccagcctgccctgcacccaggctgtgc

SEQ ID NO: 857 - DNA, 97 bp, Artificial
  Hairpin sequence Mmd_56, mouse
gaccaaggtctttggtcttggaggaaggtgtgctgctggaggaagccacggaggctgggctggtgggggcatctttcttcagaccacgggctttgtc

SEQ ID NO: 858 - DNA, 97 bp, Artificial
  Hairpin sequence Mmd_57, mouse
tgggaagggcattgcttattttgtatgcttctgggttgattttggaagtgatctgtgacccagaaacgcaaaggacagtgtgggctgcctttcatca

SEQ ID NO: 859 - DNA, 93 bp, Artificial
  Hairpin sequence Mmd_58, mouse
gcaccgaacgaggggttgaccaaagcagccatgatggcaatgtccgagtatgaagaccggttgtcatctggtctggtcagcccagccccgagc

SEQ ID NO: 860 - DNA, 95 bp, Artificial
  Hairpin sequence Mmd_59, mouse
ccgccgcctgggccaggcgcccgccaggtcggcgggaagaggcgcggacacgcgcaccagtcccgccgcgggggcgcgcctggctctgggcgggg

SEQ ID NO: 861 - DNA, 94 bp, Artificial
  Hairpin sequence Mmd_6, mouse
agatttgctttttctcttccatgccttgagtgtaggaccgttgacatcttaattaccctcccacacccaaggcttgcaggagagcaagccttct

SEQ ID NO: 862 - DNA, 83 bp, Artificial
  Hairpin sequence Mmd_60, mouse
gccttggcttcctgttcttcttcatactgttcccgcagcaggtcacagtcatggcgggaggactgaagagcatgagctaaggc

SEQ ID NO: 863 - DNA, 94 bp, Artificial
  Hairpin sequence Mmd_61, mouse
ggggagcaattgtactgactcagcacaagttgcttggctgtgtttacatgtggcttgaagttgcttgagtttcagtatctctgtcctgctctct

SEQ ID NO: 864 - DNA, 97 bp, Artificial
  Hairpin sequence Mmd_62, mouse
ggagtgacaggcgccgaggtgatgatggaggcttctttcctcgaaccctggaaatccattggttgtccatcatcaactccatggtgcttgtgttttt

SEQ ID NO: 865 - DNA, 92 bp, Artificial
  Hairpin sequence Mmd_63, mouse
tggtgtgctgggaaggaggccagtgtggtttctgtcctctgccttttctagcaacttccctccacactgccctctctgcccgggcaacacca

SEQ ID NO: 866 - DNA, 87 bp, Artificial
  Hairpin sequence Mmd_64, mouse
gtatttctatcttggggttctaatgactaaccacttgagctctgcttttgtggtttataatgtcaccagaactctccatggaattat

SEQ ID NO: 867 - DNA, 88 bp, Artificial
  Hairpin sequence Mmd_65, mouse
gtcagttgtttctgggttgtactgggttgtagcaggttgtgtggttttcctccctgtcatgcccagagctctgcccagtgtggcttgc

SEQ ID NO: 868 - DNA, 95 bp, Artificial
  Hairpin sequence Mmd_66, mouse
ctcactttctcagccatttcatgagagtgatgcagggaatgttccctttctgagaacatcctcctttgctcatagctggctagacgacaagtgag

SEQ ID NO: 869 - DNA, 98 bp, Artificial
  Hairpin sequence Mmd_67, mouse
cttcttccagtcatcctgaggtagatatcatacaggaatgctggggccttatggcttacagcaatccagtaatgatataaaaggtgattggaggttag

SEQ ID NO: 870 - DNA, 92 bp, Artificial
  Hairpin sequence Mmd_68, mouse
cgccctgtttaaaggaagaagtttgttctgttgtaaacagtgatgggaactgtttgctttggatgggcttggtccttatgagccaaagagcg

SEQ ID NO: 871 - DNA, 100 bp, Artificial
  Hairpin sequence Mmd_69, mouse
gaggggggagttctctcaggaagaagccaggtgaaactcaaagggtccaaagaaggcttcgctttgagtttctttctggttctgtttgaacctgacactc

SEQ ID NO: 872 - DNA, 85 bp, Artificial
  Hairpin sequence Mmd_7, mouse
gctatgtactgcacaaccctaggagggggtgccattcacatagagtataattgaatggcgccactagggttgtgcagtgtacagc

SEQ ID NO: 873 - DNA, 95 bp, Artificial
  Hairpin sequence Mmd_70, mouse
gattaattctacatgcgcctaattagacccacaattggctaattgcatccacaattagccaattgcaggcccaattggccacttgtcccataatt

SEQ ID NO: 874 - DNA, 94 bp, Artificial
  Hairpin sequence Mmd_71, mouse
cactgtaacaacgttttccttctgactgattacattacatattgctattagtgagcatcagagtgtagtgcaatcagtcaggggaaaatgagtg

SEQ ID NO: 875 - DNA, 97 bp, Artificial
  Hairpin sequence Mmd_72, mouse
ttgcagcttgtgggtcatggcgaggaagaaacaaggagggcatgttcctttcttgtcatgttcttccaagccctgggcatacaaacccactctacag

SEQ ID NO: 876 - DNA, 61 bp, Artificial
  Hairpin sequence Mmd_73, mouse
gggctatggagccgccacatcttgcagcagacactgatggatgaggggctgcggctcgccc

SEQ ID NO: 877 - DNA, 97 bp, Artificial
  Hairpin sequence Mmd_74, mouse
catgccctgatatttgtgttgggataattaccatctctcaggcctcactcggtggcaagatgagatgaaaacccataaaacaccactcagggctgtg

SEQ ID NO: 878 - DNA, 98 bp, Artificial
  Hairpin sequence Mmd_75, mouse
gggaaaaaaaaaggcagacactgtgtttgatgccaataatggttgccagtggcaccgaggttggcatcagaccctctttgtctagctgctgaatgcct

SEQ ID NO: 879 - DNA, 84 bp, Artificial
  Hairpin sequence Mmd_76, mouse
aggcagcaatttgtgtcagatttcaatctatttaagggaaaaccaatgaagtctggttgaaaaatggagagtaaattgctgtct

SEQ ID NO: 880 - DNA, 88 bp, Artificial
  Hairpin sequence Mmd_77, mouse
tctccaaactgttatttaaagcagggtttggcaaggctcagcgagcctgcaccaattttaattgtgtttttaaaactcaggatggaga

SEQ ID NO: 881 - DNA, 99 bp, Artificial
  Hairpin sequence Mmd_78, mouse
ctcttgtccttggagaaatctgggcctgagacagaggagggatgtaatgtgaatgctcctttgtcacaggttaccagggtgtgcttgaggggacggtag

SEQ ID NO: 882 - DNA, 92 bp, Artificial
  Hairpin sequence Mmd_79, mouse
gtgggtactggcctcggtgctggtggagcagtgagcacgccatacattatatctgtgacacctgccacccagcccaaggcccctaggcccac

SEQ ID NO: 883 - DNA, 81 bp, Artificial
  Hairpin sequence Mmd_8, mouse
tgggtgcgtgaggtggttgaccagagagcacacgctatatttgtgccgtttgtgacctggtccactaaccctcagtatcta

SEQ ID NO: 884 - DNA, 90 bp, Artificial
  Hairpin sequence Mmd_80, mouse
ggacagtgtgttgatgtttattggtgtctcttttctcttctagggccagcagagagaagagactccatcttccagaggttgccactgtct

SEQ ID NO: 885 - DNA, 95 bp, Artificial
  Hairpin sequence Mmd_81, mouse
ttcctttaactctcagcttctatttaaaaagctaatttgggagcctgtcgatgctcccaattcagacattttaaataggaactgaaagtcaggaa

SEQ ID NO: 886 - DNA, 82 bp, Artificial
  Hairpin sequence Mmd_82, mouse
ggtccatctttgggccaagatacgtagtcgccaacagtgagttggcgactgtatttttcgagtcctggcgcaaagcaagatc

SEQ ID NO: 887 - DNA, 91 bp, Artificial
  Hairpin sequence Mmd_83, mouse
ggccacactggcagtctggaggcttctcactgtaggagggctgacagcatgggacctcctgtctactagcctgcagtgaccttccatggcc

SEQ ID NO: 888 - DNA, 91 bp, Artificial
  Hairpin sequence Mmd_84, mouse
ggtgtgaaagggtaggagagatgctgggggtgggggtgcttgtgttttagacccccaatattatcccagtgtcccctgccttccttcttcc

SEQ ID NO: 889 - DNA, 99 bp, Artificial
  Hairpin sequence Mmd_85, mouse
caggccactccatctgttcaaacataatgctccaaagcaaggaatatgttccaaaccaaagagcatgatatttgacagatggagatgcccatacgcctg

SEQ ID NO: 890 - DNA, 98 bp, Artificial
  Hairpin sequence Mmd_86, mouse
gtcagaagccaccttctgtgcccccagcaccacgtgtctgggccacgtgagcaacgccacgtgggcctgacgtggagctggggccgcaggggtctgat

SEQ ID NO: 891 - DNA, 99 bp, Artificial
  Hairpin sequence Mmd_87, mouse
ggcagtctgggagtgatgtccctgtgtcattagtgatatgatggcaatcaacagtccaatgtccctcttgatggcactttggacatgaccctagtggct

SEQ ID NO: 892 - DNA, 93 bp, Artificial
  Hairpin sequence Mmd_88, mouse
agcctaacactccgcgggagtttccatggcgaccgaagccgggaccgcgcggcctggcagcgttgccatggagacaactccggagctggggct

SEQ ID NO: 893 - DNA, 93 bp, Artificial
  Hairpin sequence Mmd_89, mouse
gagtctagtctgccaactcctctacagccttctccacgatctctctcacctgggctggaggcccttggagttcttggcagtatctctatactt

SEQ ID NO: 894 - DNA, 95 bp, Artificial
  Hairpin sequence Mmd_9, mouse
gagctttggtacttggagagtggttatccctgtcctcttcgcttcactcatgccgaatcgtacagggtcatccactttttcagtatcaagtgcgc

SEQ ID NO: 895 - DNA, 100 bp, Artificial
  Hairpin sequence Mmd_90, mouse
gggatcaccgcctccatttaggtgtcaattgtgtaatttccagctgttgctcatctcaacagctggagttcaatatgctcagggcgtatctggaggcccc

SEQ ID NO: 896 - DNA, 81 bp, Artificial
  Hairpin sequence Mmd_91, mouse
gcagcaggtagctctgtctgctgtctctttagataaaatgtatgtctggcacggagggaacagctgagaactacctgttgt

SEQ ID NO: 897 - DNA, 92 bp, Artificial
  Hairpin sequence Mmd_92, mouse
ctttgagtgagggtaccatgctgaaggtattcatgatgcggtcaggatattcttctctgatcttgctgatgagcagggtgcccatgccagag

SEQ ID NO: 898 - DNA, 92 bp, Artificial
  Hairpin sequence Mmd_93, mouse
ttgtagttgactaaacagcgtctggtagacgcagatggcatcattaatccgagcgctttctacatctacctgaccgcttgggtcagcaacga

SEQ ID NO: 899 - DNA, 82 bp, Artificial
  Hairpin sequence Mmd_94, mouse
cttctgtagattgtggacaaagccttagaagagccaaagtatagctcgctgtatgctcagctatgtctgcgattggcagaag

SEQ ID NO: 900 - DNA, 99 bp, Artificial
  Hairpin sequence Mmd_95, mouse
gttcgaggagacactatcaaagttaaggcaggggagccagttaacatccctgcagacgtgaccggcctccccatgcctaagattgagtggtccaagaat

SEQ ID NO: 901 - DNA, 98 bp, Artificial
  Hairpin sequence Mmd_96, mouse
ttttcaagtagtcaaattctggctcatggctctggaaggtgctgtaaacattgtattctcctctgctatgagactggattttgttctacaacagaaaa

SEQ ID NO: 902 - DNA, 92 bp, Artificial
  Hairpin sequence Mmd_97, mouse
agctttctccaactgtaacaatctccacttcactgtcagttgaggtaacattaatttcttcattggcagtgacctggggagtgaaggaggct

SEQ ID NO: 903 - DNA, 99 bp, Artificial
  Hairpin sequence Mmd_98, mouse
tcatctttggcccggctccgggtctcggcccgcacggtccggccggccatgctggcggggctggggccgggacagagcccgtggcggggcggcctgtgg

SEQ ID NO: 904 - DNA, 90 bp, Artificial
  Hairpin sequence Mmd_99, mouse
ggcctctgttttgggagaacatgatgtatttattttgttctcatgagaagttcatttcatgagtgcatcatcttctttaaggcaatggcc

SEQ ID NO: 905 - DNA, 82 bp, Artificial
  Hairpin sequence Mmd_from_Hsd_20, mouse
aggtttttactcatgcaccatggttgtctgagcacataacatgcttgtctgctcataccctatggttcctgaagaggaatct

SEQ ID NO: 906 - DNA, 96 bp, Artificial
  Hairpin sequence Mmd_from_Hsd_21, mouse
tgcctctggtgaggactggggaggtggagggtagcatcattagagccagagctctgtctcagctccctctccccccacctcttctctcctcaggta

SEQ ID NO: 907 - DNA, 90 bp, Artificial
  Hairpin sequence Mmd_from_Hsd_39, mouse
cagcttgttatttggtggattgtggcagtaaatcggggcgagtgggggaacccggcgcaggaactgccgctgcggccgggagcggtgctg

SEQ ID NO: 908 - DNA, 85 bp, Artificial
  Hairpin sequence Mmd_from_Hsd_73, mouse
ggccgccgggcgcacccgtcccgttcgtccccggacgttgctctctgccccgggaacgtcgagactggagcgcccgaactgagcc

SEQ ID NO: 909 - DNA, 100 bp, Artificial
  Hairpin sequence Mmd_from_Hsd_75, mouse
agcctgatacccagcacccaggtgagtgcttggcacctggtaagcactcagtaagtatttgatgagtgcctactgtgtgccaagacattgtgctgaggct

SEQ ID NO: 910 - DNA, 97 bp, Artificial
  Hairpin sequence Mmd_from_Hsd_94, mouse
tttcctgctggctgcgggtgctctgactaggttgcactactgtgctgtgagaagcagtgcaatggtattgtcaaagcatctgggaccagcctcgaag

SEQ ID NO: 911 - DNA, 84 bp, Artificial
  Hairpin sequence Mmd_from_Hsd_97, mouse
tgcggcccagggactggtgcggaaagggcccacagtggacttggtacactgtatgccctaaccgctcagtccctgggtctggca

SEQ ID NO: 912 - DNA, 20 bp, Artificial
  Hsd_1, Mmd_1; human brain 25_K23 sequence
ctgttgccactaacctcaac

SEQ ID NO: 913 - DNA, 21 bp, Artificial
  Hsd_1, Mmd_1; human lung 1_J05, mouse brain 49_M17 sequence
tgcggggctagggctaacagc

SEQ ID NO: 914 - DNA, 20 bp, Artificial
  Hsd_1, Mmd_1; mouse brain 13_N23 sequence
tgcggggctagggctaacag

SEQ ID NO: 915 - DNA, 18 bp, Artificial
  Hsd_1, Mmd_1; mouse brain 64_E12np sequence
ggggctagggctaacagc

SEQ ID NO: 916 - DNA, 23 bp, Artificial
  Hsd_10, Mmd_10; human liver 12_H07 sequence
acaagtcttatttgagcacctgt

SEQ ID NO: 917 - DNA, 22 bp, Artificial
  Hsd_10, Mmd_10; mouse brain 104_J08 sequence
aggtcctcaataagtatttgtt

SEQ ID NO: 918 - DNA, 22 bp, Artificial
  Hsd_10, Mmd_10; mouse brain 39_C01 sequence
caaatcttatttgagcacctgt

SEQ ID NO: 919 - DNA, 21 bp, Artificial
  Hsd_100; human brain 18_N21 sequence
actccagccccacagcctcag

SEQ ID NO: 920 - DNA, 19 bp, Artificial
  Hsd_101; human skin 3_L08np sequence
tcctgtgctgtgctgcccc

SEQ ID NO: 921 - DNA, 18 bp, Artificial
  Hsd_102; human heart 5_O18 sequence
atggttcctatcctgctg

SEQ ID NO: 922 - DNA, 18 bp, Artificial
  Hsd_103, Hsd_34, Hsd_36, Hsd_64; human lung 1_N21 sequence
aaaagctgggttgagagg

SEQ ID NO: 923 - DNA, 19 bp, Artificial
  Hsd_103, Hsd_34, Hsd_36; human brain 13_G14 sequence
aaaagctgggttgagaggg

SEQ ID NO: 924 - DNA, 20 bp, Artificial
  Hsd_103, Hsd_34, Hsd_36; human brain 1_E06np sequence
gaaaagctgggttgagaggg

SEQ ID NO: 925 - DNA, 18 bp, Artificial
  Hsd_103, Hsd_34, Hsd_36; human brain 20_E16 sequence
aaagctgggttgagaggg

SEQ ID NO: 926 - DNA, 19 bp, Artificial
  Hsd_103, Hsd_34; human brain 16_E04 sequence
aaagctgggttgagagggc

SEQ ID NO: 927 - DNA, 20 bp, Artificial
  Hsd_103, Hsd_34; human brain 26_J05np sequence
aaaagctgggttgagagggc

SEQ ID NO: 928 - DNA, 21 bp, Artificial
  Hsd_103, Hsd_34; human skin 11_N18np sequence
aaaagctgggttgagagggca

SEQ ID NO: 929 - DNA, 20 bp, Artificial
  Hsd_104; human heart 13_O20np sequence
actggacttggagtcagaaa

SEQ ID NO: 930 - DNA, 25 bp, Artificial
  Hsd_105; human liver 3_A14 sequence
catatctgggctgctgtctcagaat

SEQ ID NO: 931 - DNA, 20 bp, Artificial
  Hsd_106; human lung 14_P16 sequence
taatccttgctacctgggtg

SEQ ID NO: 932 - DNA, 22 bp, Artificial
  Hsd_106; human skin 12_J23 sequence
taatccttgctacctgggtgag

SEQ ID NO: 933 - DNA, 22 bp, Artificial
  Hsd_107; human brain 10_A01np sequence
actgcccaggtgtctgctggtt

SEQ ID NO: 934 - DNA, 22 bp, Artificial
  Hsd_108, Hsd_83; human brain 7_B18np sequence
agaggataccctttgtatgttc

SEQ ID NO: 935 - DNA, 19 bp, Artificial
  Hsd_108, Hsd_83; human lung 16_G04np sequence
ggataccctttgtatgttc

SEQ ID NO: 936 - DNA, 20 bp, Artificial
  Hsd_109, Hsd_56, Hsd_68; human lung 2_D01 sequence
gtaagtgagtcaagagaagg

SEQ ID NO: 937 - DNA, 19 bp, Artificial
  Hsd_11, Mmd_11; human heart 12_F17, mouse brain 11_I07 sequence
gcgacccatacttggtttc

SEQ ID NO: 938 - DNA, 21 bp, Artificial
  Hsd_11, Mmd_11; human lung 5_D01, mouse brain 11_K11 sequence
gcgacccatacttggtttcag

SEQ ID NO: 939 - DNA, 22 bp, Artificial
  Hsd_11, Mmd_11; mouse cand254_probe17 sequence
gcgacccatacttggtttcagt

SEQ ID NO: 940 - DNA, 22 bp, Artificial
  Hsd_110; human skin 11_H21 sequence
tacccattgcatatcggagttg

SEQ ID NO: 941 - DNA, 21 bp, Artificial
  Hsd_110; human skin 13_H14 sequence
tacccattgcatatcggagtt

SEQ ID NO: 942 - DNA, 23 bp, Artificial
  Hsd_110; human skin 1_F09 sequence
tacccattgcatatcggagttgt

SEQ ID NO: 943 - DNA, 18 bp, Artificial
  Hsd_111; human lung 9_P12np sequence
gagtagtgtagtgggtga

SEQ ID NO: 944 - DNA, 20 bp, Artificial
  Hsd_12, Mmd_12; human liver 21_J09 sequence
acgcccttcccccccttctt

SEQ ID NO: 945 - DNA, 20 bp, Artificial
  Hsd_12, Mmd_12; human skin 13_J16np sequence
cgcccttcccccccttcttc

SEQ ID NO: 946 - DNA, 21 bp, Artificial
  Hsd_12, Mmd_12; mouse brain 30_L18 sequence
acgcccttcccccccttcttc

SEQ ID NO: 947 - DNA, 23 bp, Artificial
  Hsd_13, Mmd_13; human heart 13_K23np sequence
aggaagccctggaggggctggag

SEQ ID NO: 948 - DNA, 24 bp, Artificial
  Hsd_13, Mmd_13; human heart 7_H19np, mouse brain 86_F02np sequence
aggaagccctggaggggctggagg

SEQ ID NO: 949 - DNA, 22 bp, Artificial
  Hsd_13, Mmd_13; mouse cand43_probe5 sequence
aggaagccctggaggggctgga

SEQ ID NO: 950 - DNA, 21 bp, Artificial
  Hsd_14, Mmd_14; human lung 1_D04np sequence
ttgtgacagattgataactga

SEQ ID NO: 951 - DNA, 20 bp, Artificial
  Hsd_14, Mmd_14; human skin 12_D07np sequence
tgtgacagattgataactga

SEQ ID NO: 952 - DNA, 19 bp, Artificial
  Hsd_14, Mmd_14; human skin 7_A03 sequence
tgtgacagattgataactg

SEQ ID NO: 953 - DNA, 22 bp, Artificial
  Hsd_14, Mmd_14; mouse cand972_probe5 sequence
tctcggggatcatcatgtcacg

SEQ ID NO: 954 - DNA, 22 bp, Artificial
  Hsd_15, Mmd_15; human brain 11_L21, mouse brain 62_B19 sequence
aaggagcttacaatctagctgg

SEQ ID NO: 955 - DNA, 24 bp, Artificial
  Hsd_15, Mmd_15; human brain 16_I19 sequence
aaggagcttacaatctagctgggg

SEQ ID NO: 956 - DNA, 23 bp, Artificial
  Hsd_15, Mmd_15; human brain 18_J09, mouse brain 101_D04 sequence
aaggagcttacaatctagctggg

SEQ ID NO: 957 - DNA, 22 bp, Artificial
  Hsd_15, Mmd_15; human brain 26_D24np, mouse cand371_probe3 sequence
aggagcttacaatctagctggg

SEQ ID NO: 958 - DNA, 21 bp, Artificial
  Hsd_15, Mmd_15; human brain 26_N24 sequence
aactagactgtgagcttctag

SEQ ID NO: 959 - DNA, 18 bp, Artificial
  Hsd_15, Mmd_15; human lung 16_L10np, mouse brain 52_C24np sequence
aaggagcttacaatctag

SEQ ID NO: 960 - DNA, 20 bp, Artificial
  Hsd_15, Mmd_15; human skin 1_O20np, mouse brain 113_E07 sequence
aaggagcttacaatctagct

SEQ ID NO: 961 - DNA, 19 bp, Artificial
  Hsd_15, Mmd_15; mouse brain 111_A23 sequence
aaggagcttacaatctagc

SEQ ID NO: 962 - DNA, 20 bp, Artificial
  Hsd_15, Mmd_15; mouse brain 13_K21 sequence
caactagactgtgagcttct

SEQ ID NO: 963 - DNA, 22 bp, Artificial
  Hsd_15, Mmd_15; mouse brain 66_J02 sequence
caactagactgtgagcttctag

SEQ ID NO: 964 - DNA, 20 bp, Artificial
  Hsd_15, Mmd_15; mouse brain 77_J13 sequence
actagactgtgagcttctag

SEQ ID NO: 965 - DNA, 21 bp, Artificial
  Hsd_15, Mmd_15; mouse brain 80_K04 sequence
aaggagcttacaatctagctg

SEQ ID NO: 966 - DNA, 21 bp, Artificial
  Hsd_15, Mmd_15; mouse brain 88_H04np sequence
aggagcttacaatctagctgg

SEQ ID NO: 967 - DNA, 23 bp, Artificial
  Hsd_16, Mmd_16; human skin 13_I22, mouse brain 86_C23np sequence
ggagaaattatccttggtgtgtt

SEQ ID NO: 968 - DNA, 22 bp, Artificial
  Hsd_16, Mmd_16; mouse brain 21_N14 sequence
ggagaaattatccttggtgtgt

SEQ ID NO: 969 - DNA, 22 bp, Artificial
  Hsd_16, Mmd_16; mouse cand213_probe4 sequence
aggagaaattatccttggtgtg

SEQ ID NO: 970 - DNA, 21 bp, Artificial
  Hsd_17, Mmd_17; human brain 19_J01, mouse brain 39_C04np sequence
tgtcactcggctcggcccact

SEQ ID NO: 971 - DNA, 24 bp, Artificial
  Hsd_17, Mmd_17; mouse brain 103_B18 sequence
tgtcactcggctcggcccactacc

SEQ ID NO: 972 - DNA, 23 bp, Artificial
  Hsd_17, Mmd_17; mouse brain 87_H14 sequence
tgtcactcggctcggcccactac

SEQ ID NO: 973 - DNA, 22 bp, Artificial
  Hsd_17, Mmd_17; mouse cand216_probe21 sequence
gtcactcggctcggcccactac

SEQ ID NO: 974 - DNA, 22 bp, Artificial
  Hsd_18, Hsd_70, Hsd_82; human brain 14_E16np sequence
tgtcttactccctcaggcacat

SEQ ID NO: 975 - DNA, 18 bp, Artificial
  Hsd_18, Hsd_70, Hsd_82; human brain 29_E04np sequence
tgtcttactccctcaggc

SEQ ID NO: 976 - DNA, 22 bp, Artificial
  Hsd_18, Hsd_70, Hsd_82; human heart 2_F23 sequence
gtcttactccctcaggcacatc

SEQ ID NO: 977 - DNA, 20 bp, Artificial
  Hsd_19; human brain 2_N23 sequence
tatgtctgctgaccatcacc

SEQ ID NO: 978 - DNA, 19 bp, Artificial
  Hsd_19; human lung 15_E21 sequence
tatgtctgctgaccatcac

SEQ ID NO: 979 - DNA, 21 bp, Artificial
  Hsd_19; human skin 4_G20 sequence
tatgtctgctgaccatcacct

SEQ ID NO: 980 - DNA, 20 bp, Artificial
  Hsd_19; human skin 7_A06np sequence
tggtgggccgcagaacatgt

SEQ ID NO: 981 - DNA, 21 bp, Artificial
  Hsd_2, Mmd_2; human lung 2_C01, mouse brain 42_K24 sequence
atataatacaacctgctaagt

SEQ ID NO: 982 - DNA, 22 bp, Artificial
  Hsd_2, Mmd_2; human skin 10_F19, mouse brain 15_N06 sequence
atataatacaacctgctaagtg

SEQ ID NO: 983 - DNA, 22 bp, Artificial
  Hsd_2, Mmd_2; mouse cand350_probe20 sequence
ggttgtattatcattgtccgag

SEQ ID NO: 984 - DNA, 23 bp, Artificial
  Hsd_20, Mmd_from_Hsd_20; human brain 12_B10 sequence
tctgctcataccccatggtttct

SEQ ID NO: 985 - DNA, 20 bp, Artificial
  Hsd_20, Mmd_from_Hsd_20; human brain 8_O15np sequence
accatggttgtctgagcatg

SEQ ID NO: 986 - DNA, 22 bp, Artificial
  Hsd_21, Mmd_from_Hsd_21; human brain 27_B10 sequence
gtgaggactcgggaggtggagg

SEQ ID NO: 987 - DNA, 18 bp, Artificial
  Hsd_22, Hsd_53; human lung 14_O08np sequence
ccaggttcaagtcctggc

SEQ ID NO: 988 - DNA, 22 bp, Artificial
  Hsd_23; human lung 9_B23 sequence
taattttatgtataagctagtc

SEQ ID NO: 989 - DNA, 21 bp, Artificial
  Hsd_24, Hsd_43; human mix 3_E16np sequence
agtggtcggttcctggagctg

SEQ ID NO: 990 - DNA, 22 bp, Artificial
  Hsd_25; human brain 30_J18 sequence
tgtggcttgtccaagaacgttc

SEQ ID NO: 991 - DNA, 18 bp, Artificial
  Hsd_26; human liver 21_N13np sequence
tacactgacggagccagc

SEQ ID NO: 992 - DNA, 19 bp, Artificial
  Hsd_27; human skin 3_J11 sequence
tccctgtcctccaggagct

SEQ ID NO: 993 - DNA, 22 bp, Artificial
  Hsd_28; human liver 14_J22 sequence
tgtctactactggagacactgg

SEQ ID NO: 994 - DNA, 19 bp, Artificial
  Hsd_28; human skin 11_M12np sequence
ctactactggagacactgg

SEQ ID NO: 995 - DNA, 23 bp, Artificial
  Hsd_29; human skin 11_B02 sequence
cgtcccaccccccactcctgttt

SEQ ID NO: 996 - DNA, 21 bp, Artificial
  Hsd_3, Mmd_3; human brain 1_N14np sequence
aatctctgcaggcaaatgtga

SEQ ID NO: 997 - DNA, 21 bp, Artificial
  Hsd_3, Mmd_3; human brain 2_M12, mouse brain 108_B12 sequence
aaatctctgcaggcaaatgtg

SEQ ID NO: 998 - DNA, 22 bp, Artificial
  Hsd_3, Mmd_3; mouse cand234_probe26 sequence
gggaaatctctgcaggcaaatg

SEQ ID NO: 999 - DNA, 18 bp, Artificial
  Hsd_30, Hsd_61; human brain 26_G01np sequence
tcgaggagctcacagtct

SEQ ID NO: 1000 - DNA, 22 bp, Artificial
  Hsd_31; human lung 14_C06np sequence
ccctgggcttaattcccagctc

SEQ ID NO: 1001 - DNA, 24 bp, Artificial
  Hsd_32; human brain 16_L06 sequence
ttgcgggggttagagctgtgggtg

SEQ ID NO: 1002 - DNA, 20 bp, Artificial
  Hsd_33; human brain 19_I17 sequence
aaggagctcacagtctattg

SEQ ID NO: 1003 - DNA, 18 bp, Artificial
  Hsd_33; human heart 9_I07np sequence
aaggagctcacagtctat

SEQ ID NO: 1004 - DNA, 21 bp, Artificial
  Hsd_33; human lung 16_H24 sequence
caaggagctcacagtctattg

SEQ ID NO: 1005 - DNA, 19 bp, Artificial
  Hsd_35; human heart 12_F12np sequence
cgtccgcgccttgcccctg

SEQ ID NO: 1006 - DNA, 22 bp, Artificial
  Hsd_37; human heart 3_P15 sequence
gctaggagttagcttgggagcc

SEQ ID NO: 1007 - DNA, 25 bp, Artificial
  Hsd_38; human brain 30_P22np sequence
ttagggccctggctccatctccttt

SEQ ID NO: 1008 - DNA, 22 bp, Artificial
  Hsd_38; human brain 5_B05 sequence
ttagggccctggctccatctcc

SEQ ID NO: 1009 - DNA, 21 bp, Artificial
  Hsd_38; human lung 3_J17 sequence
ttagggccctggctccatctc

SEQ ID NO: 1010 - DNA, 20 bp, Artificial
  Hsd_39, Mmd_from_Hsd_39; human brain 17_K03 sequence
gaacccggcgcaggaactgc

SEQ ID NO: 1011 - DNA, 22 bp, Artificial
  Hsd_4, Mmd_4; human brain 17_D14np, mouse brain 103_B14 sequence
ttgtgtcaatatgcgatgatgt

SEQ ID NO: 1012 - DNA, 21 bp, Artificial
  Hsd_4, Mmd_4; mouse brain 112_O10 sequence
attgtgtcaatatgcgatgat

SEQ ID NO: 1013 - DNA, 22 bp, Artificial
  Hsd_4, Mmd_4; mouse brain 15_K12 sequence
tcatcacgtggtgacgcaacat

SEQ ID NO: 1014 - DNA, 21 bp, Artificial
  Hsd_40; human heart 2_E14 sequence
ctccgtttgcctgtttcgctg

SEQ ID NO: 1015 - DNA, 18 bp, Artificial
  Hsd_41, Hsd_88; human brain 20_I03np sequence
gccctgggaccctgtctg

SEQ ID NO: 1016 - DNA, 22 bp, Artificial
  Hsd_42; human lung 2_L06np sequence
ttagtggctccctctgcctgca

SEQ ID NO: 1017 - DNA, 22 bp, Artificial
  Hsd_44; human lung 2_C09 sequence
tcaaaactgaggggcattttct

SEQ ID NO: 1018 - DNA, 20 bp, Artificial
  Hsd_44; human skin 5_B02 sequence
tcaaaactgaggggcatttt

SEQ ID NO: 1019 - DNA, 22 bp, Artificial
  Hsd_45; human heart 13_O13 sequence
acgacctcgatgttggatcagg

SEQ ID NO: 1020 - DNA, 18 bp, Artificial
  Hsd_46; human lung 2_D18 sequence
aggttgggagtggaaggt

SEQ ID NO: 1021 - DNA, 19 bp, Artificial
  Hsd_47; human brain 15_G06np sequence
tctttggttatctcagctg

SEQ ID NO: 1022 - DNA, 18 bp, Artificial
  Hsd_48; human lung 9_B11np sequence
tggctcagttcagccggg

SEQ ID NO: 1023 - DNA, 22 bp, Artificial
  Hsd_49; human brain 17_F03 sequence
tccattacactaccctgcctct

SEQ ID NO: 1024 - DNA, 22 bp, Artificial
  Hsd_5, Mmd_5; human skin 4_K16, mouse cand210_probe14 sequence
aaacattcgcggtgcacttctt

SEQ ID NO: 1025 - DNA, 23 bp, Artificial
  Hsd_5, Mmd_5; human skin 8_E07np, mouse brain 8_O13np sequence
aaacattcgcggtgcacttcttt

SEQ ID NO: 1026 - DNA, 19 bp, Artificial
  Hsd_5, Mmd_5; mouse brain 12_A15np sequence
aaacattcgcggtgcactt

SEQ ID NO: 1027 - DNA, 20 bp, Artificial
  Hsd_5, Mmd_5; mouse brain 16_C05 sequence
aagttgcccgcgtgtttttc

SEQ ID NO: 1028 - DNA, 22 bp, Artificial
  Hsd_5, Mmd_5; mouse brain 20_L19 sequence
gaagttgcccgcgtgtttttcg

SEQ ID NO: 1029 - DNA, 20 bp, Artificial
  Hsd_5, Mmd_5; mouse brain 35_F23np sequence
gaagttgcccgcgtgttttt

SEQ ID NO: 1030 - DNA, 21 bp, Artificial
  Hsd_5, Mmd_5; mouse brain 94_J19 sequence
aaacattcgcggtgcacttct

SEQ ID NO: 1031 - DNA, 21 bp, Artificial
  Hsd_5, Mmd_5; mouse brain 95_O20 sequence
aagttgcccgcgtgtttttcg

SEQ ID NO: 1032 - DNA, 19 bp, Artificial
  Hsd_50; human heart 5_I01np sequence
ccgttccttgtccgtcctt

SEQ ID NO: 1033 - DNA, 18 bp, Artificial
  Hsd_51; human lung 16_D10np sequence
gcctccttggtattccag

SEQ ID NO: 1034 - DNA, 23 bp, Artificial
  Hsd_52; human brain 20_K10 sequence
ccagttaccgcttccgctaccgc

SEQ ID NO: 1035 - DNA, 21 bp, Artificial
  Hsd_54; human heart 8_E13np sequence
aggggcgctctgtctctgttg

SEQ ID NO: 1036 - DNA, 21 bp, Artificial
  Hsd_55; human skin 8_N12 sequence
acccctggggtcctgcccacc

SEQ ID NO: 1037 - DNA, 18 bp, Artificial
  Hsd_57; human lung 7_G22np sequence
aagaagtccttgttactt

SEQ ID NO: 1038 - DNA, 22 bp, Artificial
  Hsd_58; human heart 15_I13np sequence
tctgtgcttcacccctacccag

SEQ ID NO: 1039 - DNA, 20 bp, Artificial
  Hsd_59; human brain 4_K23np sequence
cgttgcccgcatcccccacc

SEQ ID NO: 1040 - DNA, 22 bp, Artificial
  Hsd_6, Mmd_6; human brain 1_K18, mouse cand347_probe29 sequence
catgccttgagtgtaggaccgt

SEQ ID NO: 1041 - DNA, 22 bp, Artificial
  Hsd_6, Mmd_6; human heart 2_P03 sequence
atgccttgagtgtaggaccgtt

SEQ ID NO: 1042 - DNA, 21 bp, Artificial
  Hsd_6, Mmd_6; human lung 10_I24, mouse brain 106_A21 sequence
cctcccacacccaaggcttgc

SEQ ID NO: 1043 - DNA, 23 bp, Artificial
  Hsd_6, Mmd_6; mouse brain 107_C17np sequence
catgccttgagtgtaggaccgtt

SEQ ID NO: 1044 - DNA, 22 bp, Artificial
  Hsd_6, Mmd_6; mouse brain 55_L20np sequence
cctcccacacccaaggcttgca

SEQ ID NO: 1045 - DNA, 24 bp, Artificial
  Hsd_60; human brain 11_C14 sequence
gtgaacgggcgccatcccgaggct

SEQ ID NO: 1046 - DNA, 25 bp, Artificial
  Hsd_60; human heart 10_C06 sequence
gtgaacgggcgccatcccgaggctt

SEQ ID NO: 1047 - DNA, 26 bp, Artificial
  Hsd_60; human heart 13_M22 sequence
gtgaacgggcgccatcccgaggcttt

SEQ ID NO: 1048 - DNA, 22 bp, Artificial
  Hsd_60; human heart 4_B18np sequence
gtgaacgggcgccatcccgagg

SEQ ID NO: 1049 - DNA, 23 bp, Artificial
  Hsd_60; human heart 6_A01 sequence
tgaacgggcgccatcccgaggct

SEQ ID NO: 1050 - DNA, 21 bp, Artificial
  Hsd_61; human brain 14_G18 sequence
tcgaggagctcacagtctagt

SEQ ID NO: 1051 - DNA, 18 bp, Artificial
  Hsd_62; human lung 14_M21np sequence
gggttcaaaccccacctc

SEQ ID NO: 1052 - DNA, 19 bp, Artificial
  Hsd_63; human brain 26_P14np sequence
cccacgcctcctcccctcc

SEQ ID NO: 1053 - DNA, 18 bp, Artificial
  Hsd_65; human heart 13_B21np sequence
gagctgggatcactcccg

SEQ ID NO: 1054 - DNA, 20 bp, Artificial
  Hsd_66; human brain 30_N24np sequence
gcaatgttcgggggaggcag

SEQ ID NO: 1055 - DNA, 25 bp, Artificial
  Hsd_67; human lung 11_L11 sequence
aggcagtgtattgttagctggctgc

SEQ ID NO: 1056 - DNA, 27 bp, Artificial
  Hsd_67; human lung 12_A04np sequence
aggcagtgtattgttagctggctgctt

SEQ ID NO: 1057 - DNA, 24 bp, Artificial
  Hsd_67; human lung 5_M21np sequence
aggcagtgtattgttagctggctg

SEQ ID NO: 1058 - DNA, 18 bp, Artificial
  Hsd_69; human liver 19_P17np sequence
gtgaaggcccggcggaga

SEQ ID NO: 1059 - DNA, 21 bp, Artificial
  Hsd_7, Mmd_7; human heart 3_E21, mouse brain 106_F19 sequence
aatggcgccactagggttgtg

SEQ ID NO: 1060 - DNA, 20 bp, Artificial
  Hsd_7, Mmd_7; mouse brain 95_D10 sequence
aatggcgccactagggttgt

SEQ ID NO: 1061 - DNA, 22 bp, Artificial
  Hsd_7, Mmd_7; mouse cand355_probe41 sequence
gaatggcgccactagggttgtg

SEQ ID NO: 1062 - DNA, 20 bp, Artificial
  Hsd_71; human brain 20_F05np sequence
cgcccctcctgcccccacag

SEQ ID NO: 1063 - DNA, 22 bp, Artificial
  Hsd_72; human heart 3_N22np sequence
ctgctgccttgtgggtgggggg

SEQ ID NO: 1064 - DNA, 21 bp, Artificial
  Hsd_73, Mmd_from_Hsd_73; human brain 18_D19 sequence
acccgtcccgttcgtccccgg

SEQ ID NO: 1065 - DNA, 19 bp, Artificial
  Hsd_74; human heart 10_B02 sequence
attgcctctgttctaacac

SEQ ID NO: 1066 - DNA, 21 bp, Artificial
  Hsd_75, Mmd_from_Hsd_75; human brain 28_N20 sequence
cttggcacctagcaagcactc

SEQ ID NO: 1067 - DNA, 24 bp, Artificial
  Hsd_76; human brain 6_J16np sequence
ttgcagctgcctgggagtgacttc

SEQ ID NO: 1068 - DNA, 23 bp, Artificial
  Hsd_77; human skin 4_C19 sequence
ctctgctcctcctgttcgacagt

SEQ ID NO: 1069 - DNA, 18 bp, Artificial
  Hsd_78; human heart 11_J17np sequence
agaggcgcacgggggtcg

SEQ ID NO: 1070 - DNA, 20 bp, Artificial
  Hsd_79; human lung 15_E03np sequence
gcaggcgtctgcggaactgg

SEQ ID NO: 1071 - DNA, 21 bp, Artificial
  Hsd_8, Mmd_8; human brain 20_O07 sequence
tttgtgacctggtccactaac

SEQ ID NO: 1072 - DNA, 18 bp, Artificial
  Hsd_8, Mmd_8; human brain 2_A23 sequence
tttgtgacctggtccact

SEQ ID NO: 1073 - DNA, 19 bp, Artificial
  Hsd_8, Mmd_8; mouse brain 98_F03np sequence
tttgtgacctggtccacta

SEQ ID NO: 1074 - DNA, 23 bp, Artificial
  Hsd_80; human lung 2_B06np sequence
tgtcactcttgtgtgttgcagat

SEQ ID NO: 1075 - DNA, 22 bp, Artificial
  Hsd_81; human brain 25_H01 sequence
accctatcaatattgtctctgc

SEQ ID NO: 1076 - DNA, 22 bp, Artificial
  Hsd_81; human lung 12_J23np sequence
tagtgcaatattgcttataggg

SEQ ID NO: 1077 - DNA, 23 bp, Artificial
  Hsd_81; human skin 12_D12 sequence
tagtgcaatattgcttatagggt

SEQ ID NO: 1078 - DNA, 25 bp, Artificial
  Hsd_81; human skin 12_N11 sequence
tagtgcaatattgcttatagggttt

SEQ ID NO: 1079 - DNA, 22 bp, Artificial
  Hsd_84; human heart 13_E01np sequence
ttatggtttgcctgggactgag

SEQ ID NO: 1080 - DNA, 19 bp, Artificial
  Hsd_85; human mix 4_M20np sequence
ggtggtcaaaggagcccca

SEQ ID NO: 1081 - DNA, 23 bp, Artificial
  Hsd_86; human lung 10_F10np sequence
aggcagtgtattgctagcggctg

SEQ ID NO: 1082 - DNA, 25 bp, Artificial
  Hsd_86; human lung 11_O08 sequence
aggcagtgtattgctagcggctgtt

SEQ ID NO: 1083 - DNA, 24 bp, Artificial
  Hsd_86; human lung 13_P02 sequence
aggcagtgtattgctagcggctgt

SEQ ID NO: 1084 - DNA, 18 bp, Artificial
  Hsd_87; human lung 6_D19np sequence
gggccccctacagggctc

SEQ ID NO: 1085 - DNA, 22 bp, Artificial
  Hsd_89; human lung 7_O04np sequence
ttctctgttttggccatgtgtg

SEQ ID NO: 1086 - DNA, 21 bp, Artificial
  Hsd_9, Mmd_9; human brain 10_O20, mouse brain 18_B04 sequence
aatcgtacagggtcatccact

SEQ ID NO: 1087 - DNA, 21 bp, Artificial
  Hsd_9, Mmd_9; human brain 7_A24 sequence
tcgtacagggtcatccacttt

SEQ ID NO: 1088 - DNA, 20 bp, Artificial
  Hsd_9, Mmd_9; human skin 2_A11np sequence
aatcgtacagggtcatccac

SEQ ID NO: 1089 - DNA, 23 bp, Artificial
  Hsd_9, Mmd_9; mouse brain 100_A13np sequence
aatcgtacagggtcatccacttt

SEQ ID NO: 1090 - DNA, 20 bp, Artificial
  Hsd_9, Mmd_9; mouse brain 18_F01np sequence
atcgtacagggtcatccact

SEQ ID NO: 1091 - DNA, 19 bp, Artificial
  Hsd_9, Mmd_9; mouse brain 44_G16np sequence
aatcgtacagggtcatcca

SEQ ID NO: 1092 - DNA, 23 bp, Artificial
  Hsd_9, Mmd_9; mouse brain 64_L05np sequence
tcgtacagggtcatccacttttt

SEQ ID NO: 1093 - DNA, 22 bp, Artificial
  Hsd_9, Mmd_9; mouse cand212_probe16 sequence
aatcgtacagggtcatccactt

SEQ ID NO: 1094 - DNA, 20 bp, Artificial
  Hsd_90; human heart 4_P23np sequence
ccagggggagaaggtgtaag

SEQ ID NO: 1095 - DNA, 18 bp, Artificial
  Hsd_91; human heart 6_G01np sequence
agttttttgggaatgcag

SEQ ID NO: 1096 - DNA, 18 bp, Artificial
  Hsd_92; human heart 2_M05np sequence
gcgcgcgggctcttgggt

SEQ ID NO: 1097 - DNA, 20 bp, Artificial
  Hsd_93; human heart 4_B07np sequence
gtcagtgacgaagccagacc

SEQ ID NO: 1098 - DNA, 23 bp, Artificial
  Hsd_94, Mmd_from_Hsd_94; human lung 16_G20 sequence
cagtgcaatgatattgtcaaagc

SEQ ID NO: 1099 - DNA, 21 bp, Artificial
  Hsd_95; human heart 4_M23 sequence
ataagacgaacaaaaggtttg

SEQ ID NO: 1100 - DNA, 18 bp, Artificial
  Hsd_96; human skin 5_M20np sequence
gaaagcgcttcccttttg

SEQ ID NO: 1101 - DNA, 22 bp, Artificial
  Hsd_97, Mmd_from_Hsd_97; human heart 10_G17 sequence
ctgtatgccctcaccgctcagc

SEQ ID NO: 1102 - DNA, 22 bp, Artificial
  Hsd_97, Mmd_from_Hsd_97; human heart 2_F09 sequence
tggtgcggagagggcccacagt

SEQ ID NO: 1103 - DNA, 21 bp, Artificial
  Hsd_97, Mmd_from_Hsd_97; human skin 8_O20np sequence
ctgtatgccctcaccgctcag

SEQ ID NO: 1104 - DNA, 23 bp, Artificial
  Hsd_98; human brain 18_L10 sequence
ctgggatctccggggtcttggtt

SEQ ID NO: 1105 - DNA, 22 bp, Artificial
  Hsd_98; human brain 3_A01 sequence
tgagacctctgggttctgagct

SEQ ID NO: 1106 - DNA, 22 bp, Artificial
  Hsd_98; human brain 3_C09 sequence
tgggatctccggggtcttggtt

SEQ ID NO: 1107 - DNA, 21 bp, Artificial
  Hsd_98; human heart 14_G20 sequence
tgagacctctgggttctgagc

SEQ ID NO: 1108 - DNA, 21 bp, Artificial
  Hsd_98; human skin 3_M18np sequence
ctgagacctctgggttctgag

SEQ ID NO: 1109 - DNA, 22 bp, Artificial
  Hsd_99; human brain 18_M20np sequence
tttcctctctgccccatagggt

SEQ ID NO: 1110 - DNA, 22 bp, Artificial
  Hsd_from_Mmd_100, Mmd_100; mouse cand424_probe2 sequence
agggagggcaagtcaggtgacc

SEQ ID NO: 1111 - DNA, 22 bp, Artificial
  Hsd_from_Mmd_101, Mmd_101; mouse cand659_probe2 sequence
ttttgtctccaagcaaaggtca

SEQ ID NO: 1112 - DNA, 22 bp, Artificial
  Hsd_from_Mmd_105, Mmd_105; mouse cand310_probe9 sequence
aaggaaaacatctttgaagttc

SEQ ID NO: 1113 - DNA, 22 bp, Artificial
  Hsd_from_Mmd_107, Mmd_107; mouse cand906_probe13 sequence
gagttatgtgctaaattcatat

SEQ ID NO: 1114 - DNA, 22 bp, Artificial
  Hsd_from_Mmd_112, Hsd_from_Mmd_470, Mmd_112, Mmd_470; mouse cand513_probe6 sequence
gcccggagtttgatgtgcaggg

SEQ ID NO: 1115 - DNA, 22 bp, Artificial
  Hsd_from_Mmd_115, Mmd_115; mouse cand456_probe40 sequence
gacaaggcttgttgtgcccgag

SEQ ID NO: 1116 - DNA, 22 bp, Artificial
  Hsd_from_Mmd_117, Mmd_117; mouse cand100_probe35 sequence
ccggagtttggagatgccattg

SEQ ID NO: 1117 - DNA, 22 bp, Artificial
  Hsd_from_Mmd_119, Mmd_119; mouse cand469_probe10 sequence
tgccaagagacattttgcatat

SEQ ID NO: 1118 - DNA, 22 bp, Artificial
  Hsd_from_Mmd_120, Mmd_120; mouse cand578_probe13 sequence
gtagaggggcggggcatgaaga

SEQ ID NO: 1119 - DNA, 22 bp, Artificial
  Hsd_from_Mmd_123, Mmd_123; mouse cand447_probe19 sequence
ggccattaacctcagttggtca

SEQ ID NO: 1120 - DNA, 22 bp, Artificial
  Hsd_from_Mmd_126, Mmd_126; mouse cand496_probe28 sequence
tctctaaatgccccacgatgac

SEQ ID NO: 1121 - DNA, 22 bp, Artificial
  Hsd_from_Mmd_126, Mmd_126; mouse cand496_probe36 sequence
gtcctctgagggcgatttgaat

SEQ ID NO: 1122 - DNA, 22 bp, Artificial
  Hsd_from_Mmd_128, Mmd_128; mouse cand556_probe6 sequence
ggtgcccaggctccaccctgga

SEQ ID NO: 1123 - DNA, 22 bp, Artificial
  Hsd_from_Mmd_129, Mmd_129; mouse cand617_probe41 sequence
aggagatgctaggggacagtga

SEQ ID NO: 1124 - DNA, 22 bp, Artificial
  Hsd_from_Mmd_133, Mmd_133; mouse cand50_probe34 sequence
acaaggatgaatctttgttact

SEQ ID NO: 1125 - DNA, 22 bp, Artificial
  Hsd_from_Mmd_136, Mmd_136; mouse cand605_probe7 sequence
ttggtttgttagttaatggccc

SEQ ID NO: 1126 - DNA, 22 bp, Artificial
  Hsd_from_Mmd_137, Mmd_137; mouse mmHP3254020_probe13 sequence
ggtcaacaaagactttggctga

SEQ ID NO: 1127 - DNA, 22 bp, Artificial
  Hsd_from_Mmd_138, Mmd_138; mouse cand139_probe2 sequence
ctgaggcctagtaattttcaat

SEQ ID NO: 1128 - DNA, 22 bp, Artificial
  Hsd_from_Mmd_141, Mmd_141; mouse cand620_probe22 sequence
aaaatacatctgcctcttctta

SEQ ID NO: 1129 - DNA, 22 bp, Artificial
  Hsd_from_Mmd_145, Mmd_145; mouse cand534_probe28 sequence
aagggtctaatggtcagcagag

SEQ ID NO: 1130 - DNA, 22 bp, Artificial
  Hsd_from_Mmd_147, Mmd_147; mouse cand356_probe16 sequence
ggctgcttggagggctctctct

SEQ ID NO: 1131 - DNA, 22 bp, Artificial
  Hsd_from_Mmd_148, Mmd_148; mouse cand582_probe38 sequence
aaggccattagtccaacaggtc

SEQ ID NO: 1132 - DNA, 22 bp, Artificial
  Hsd_from_Mmd_149, Mmd_149; mouse cand236_probe19 sequence
agaactctaggttcctggagtg

SEQ ID NO: 1133 - DNA, 22 bp, Artificial
  Hsd_from_Mmd_150, Mmd_150; mouse cand267_probe12 sequence
tgcaatttatgtgcaagtggtt

SEQ ID NO: 1134 - DNA, 22 bp, Artificial
  Hsd_from_Mmd_154, Mmd_154; mouse cand914_probe16 sequence
gcggccacagacacgacatcta

SEQ ID NO: 1135 - DNA, 22 bp, Artificial
  Hsd_from_Mmd_155, Mmd_155; mouse cand674_probe14 sequence
cggaggaggggctggcgaaaat

SEQ ID NO: 1136 - DNA, 22 bp, Artificial
  Hsd_from_Mmd_156, Mmd_156; mouse cand907_probe14 sequence
tcctgtgtttgctggagtaagg

SEQ ID NO: 1137 - DNA, 22 bp, Artificial
  Hsd_from_Mmd_157, Mmd_157; mouse cand670_probe9 sequence
gcaggatgagggttgacctata

SEQ ID NO: 1138 - DNA, 22 bp, Artificial
  Hsd_from_Mmd_159, Mmd_159; mouse cand625_probe19 sequence
ctgcagaagacaatttcctgtc

SEQ ID NO: 1139 - DNA, 22 bp, Artificial
  Hsd_from_Mmd_159, Mmd_159; mouse cand625_probe3 sequence
gcaggaaatggcttctaattag

SEQ ID NO: 1140 - DNA, 22 bp, Artificial
  Hsd_from_Mmd_161, Mmd_161; mouse brain 51_F13np sequence
gcggtgatgccgatggtgcgag

SEQ ID NO: 1141 - DNA, 20 bp, Artificial
  Hsd_from_Mmd_161, Mmd_161; mouse brain 83_H16 sequence
gcggtgatgccgatggtgcg

SEQ ID NO: 1142 - DNA, 22 bp, Artificial
  Hsd_from_Mmd_162, Mmd_162; mouse cand339_probe12 sequence
cagtgttcagtagccctgaaaa

SEQ ID NO: 1143 - DNA, 22 bp, Artificial
  Hsd_from_Mmd_163, Mmd_163; mouse cand378_probe17 sequence
ctaagtggtagtcagaaacgac

SEQ ID NO: 1144 - DNA, 22 bp, Artificial
  Hsd_from_Mmd_163, Mmd_163; mouse cand378_probe7 sequence
gtttccaagacattccgctagg

SEQ ID NO: 1145 - DNA, 22 bp, Artificial
  Hsd_from_Mmd_166, Mmd_166; mouse cand301_probe27 sequence
gctcatgacttatgaagtgtta

SEQ ID NO: 1146 - DNA, 22 bp, Artificial
  Hsd_from_Mmd_167, Mmd_167; mouse cand711_probe18 sequence
cgtggtcgtcgcgggcgtgggg

SEQ ID NO: 1147 - DNA, 22 bp, Artificial
  Hsd_from_Mmd_169, Mmd_169; mouse cand636_probe14 sequence
cagggtgactgacctgaagggt

SEQ ID NO: 1148 - DNA, 22 bp, Artificial
  Hsd_from_Mmd_170, Mmd_170; mouse cand51_probe4 sequence
tgcaaatgtttgcctcaagcaa

SEQ ID NO: 1149 - DNA, 22 bp, Artificial
  Hsd_from_Mmd_172, Hsd_from_Mmd_96, Mmd_172, Mmd_469, Mmd_96; mouse cand650_probe9 sequence
gctcatggctctggaaggtgct

SEQ ID NO: 1150 - DNA, 22 bp, Artificial
  Hsd_from_Mmd_173, Mmd_173; mouse cand687_probe19 sequence
ctgagggtgatttcaaaatcca

SEQ ID NO: 1151 - DNA, 22 bp, Artificial
  Hsd_from_Mmd_174, Mmd_174; mouse mmHP2021933_probe2 sequence
agctttaaagtttagtcactct

SEQ ID NO: 1152 - DNA, 22 bp, Artificial
  Hsd_from_Mmd_176, Mmd_176; mouse cand651_probe26 sequence
agacaattgtgaagggattgtg

SEQ ID NO: 1153 - DNA, 22 bp, Artificial
  Hsd_from_Mmd_178, Mmd_178; mouse cand102_probe21 sequence
aggattttgaaggaagcataat

SEQ ID NO: 1154 - DNA, 22 bp, Artificial
  Hsd_from_Mmd_180, Mmd_180; mouse cand859_probe42 sequence
ggccaggaatcagctgcgccgc

SEQ ID NO: 1155 - DNA, 22 bp, Artificial
  Hsd_from_Mmd_181, Hsd_from_Mmd_276, Mmd_181, Mmd_276; mouse cand723a_probe8 sequence
cgagaccgagatctggatgcag

SEQ ID NO: 1156 - DNA, 22 bp, Artificial
  Hsd_from_Mmd_181, Mmd_181; mouse cand723_probe14 sequence
cgagacccagacttggatttgt

SEQ ID NO: 1157 - DNA, 20 bp, Artificial
  Hsd_from_Mmd_182, Mmd_182; mouse brain 67_M09np sequence
atccctgagtgtatgtggtg

SEQ ID NO: 1158 - DNA, 22 bp, Artificial
  Hsd_from_Mmd_182, Mmd_182; mouse cand520_probe21 sequence
catatccattcaggagtgtcag

SEQ ID NO: 1159 - DNA, 22 bp, Artificial
  Hsd_from_Mmd_183, Mmd_183; mouse cand633_probe11 sequence
gaatacaggaaataagcttagg

SEQ ID NO: 1160 - DNA, 22 bp, Artificial
  Hsd_from_Mmd_184, Mmd_184; mouse cand405_probe12 sequence
gttatttctggaaatgtgtgct

SEQ ID NO: 1161 - DNA, 22 bp, Artificial
  Hsd_from_Mmd_185, Mmd_185; mouse cand439_probe12 sequence
gggactaatctgtctgtgggga

SEQ ID NO: 1162 - DNA, 22 bp, Artificial
  Hsd_from_Mmd_186, Mmd_186; mouse cand944_probe6 sequence
cgaggctacttttgattgggat

SEQ ID NO: 1163 - DNA, 21 bp, Artificial
  Hsd_from_Mmd_187, Mmd_187; mouse brain 52_F18 sequence
catctgggcaactgattgaac

SEQ ID NO: 1164 - DNA, 22 bp, Artificial
  Hsd_from_Mmd_189, Mmd_189; mouse cand579_probe3 sequence
gtttgacaggcacagggacaaa

SEQ ID NO: 1165 - DNA, 22 bp, Artificial
  Hsd_from_Mmd_19, Mmd_19; mouse cand623_probe27 sequence
gccggcagcagccgccgaacag

SEQ ID NO: 1166 - DNA, 22 bp, Artificial
  Hsd_from_Mmd_190, Mmd_190; mouse cand147_probe17 sequence
gtctgagctcagggcctggccc

SEQ ID NO: 1167 - DNA, 22 bp, Artificial
  Hsd_from_Mmd_193, Mmd_193; mouse cand372_probe7 sequence
gcagcagggtgaaactgacaca

SEQ ID NO: 1168 - DNA, 22 bp, Artificial
  Hsd_from_Mmd_195, Mmd_195; mouse cand450_probe11 sequence
ttaaggaagacctgtatagctc

SEQ ID NO: 1169 - DNA, 22 bp, Artificial
  Hsd_from_Mmd_196, Mmd_196; mouse cand743_probe27 sequence
gctgacagcattttcactatta

SEQ ID NO: 1170 - DNA, 22 bp, Artificial
  Hsd_from_Mmd_197, Mmd_197; mouse cand127_probe18 sequence
aggaggccatagtggcaactgt

SEQ ID NO: 1171 - DNA, 22 bp, Artificial
  Hsd_from_Mmd_197, Mmd_197; mouse cand127_probe3 sequence
gcaggtgctcacatgtcctcct

SEQ ID NO: 1172 - DNA, 22 bp, Artificial
  Hsd_from_Mmd_198, Mmd_198; mouse cand595_probe11 sequence
agggggagaggaggacattttg

SEQ ID NO: 1173 - DNA, 22 bp, Artificial
  Hsd_from_Mmd_20, Mmd_20; mouse cand601_probe3 sequence
caggtgctcatgtgggagagat

SEQ ID NO: 1174 - DNA, 22 bp, Artificial
  Hsd_from_Mmd_203, Mmd_203; mouse cand394_probe43 sequence
acattgtaaattcaaaataatt

SEQ ID NO: 1175 - DNA, 22 bp, Artificial
  Hsd_from_Mmd_204, Mmd_204; mouse cand480_probe13 sequence
ggccagcgtctgatgtcagcct

SEQ ID NO: 1176 - DNA, 22 bp, Artificial
  Hsd_from_Mmd_208, Mmd_208; mouse cand640_probe13 sequence
cagtgcactgatataagattat

SEQ ID NO: 1177 - DNA, 22 bp, Artificial
  Hsd_from_Mmd_211, Mmd_211; mouse cand881_probe38 sequence
taaggagcagcttcgccaaaaa

SEQ ID NO: 1178 - DNA, 20 bp, Artificial
  Hsd_from_Mmd_212, Mmd_212; mouse brain 43_A14 sequence
gtagaggagatggcgcaggg

SEQ ID NO: 1179 - DNA, 22 bp, Artificial
  Hsd_from_Mmd_215, Mmd_215; mouse cand225_probe19 sequence
gtttgggtctgctctctgaccc

SEQ ID NO: 1180 - DNA, 22 bp, Artificial
  Hsd_from_Mmd_215, Mmd_215; mouse cand225_probe2 sequence
gggttaagggggcgggaccagt

SEQ ID NO: 1181 - DNA, 22 bp, Artificial
  Hsd_from_Mmd_217, Mmd_217; mouse cand448_probe8 sequence
agggtttctagtgactccagct

SEQ ID NO: 1182 - DNA, 22 bp, Artificial
  Hsd_from_Mmd_219, Mmd_219; mouse cand478_probe21 sequence
ccacttttggagggagacttgg

SEQ ID NO: 1183 - DNA, 22 bp, Artificial
  Hsd_from_Mmd_222, Mmd_222; mouse cand156_probe4 sequence
accagccctgatggtgtgtccg

SEQ ID NO: 1184 - DNA, 22 bp, Artificial
  Hsd_from_Mmd_223, Mmd_223; mouse cand642_probe13 sequence
agggtttatgaagttatcaaag

SEQ ID NO: 1185 - DNA, 22 bp, Artificial
  Hsd_from_Mmd_225, Mmd_225; mouse cand458_probe12 sequence
gcattccctatgggaaaggtga

SEQ ID NO: 1186 - DNA, 22 bp, Artificial
  Hsd_from_Mmd_226, Mmd_226; mouse cand320_probe1 sequence
catttttctcagttagtgtcag

SEQ ID NO: 1187 - DNA, 22 bp, Artificial
  Hsd_from_Mmd_227, Mmd_227; mouse cand869_probe21 sequence
aggaatacggaaccatgcctct

SEQ ID NO: 1188 - DNA, 22 bp, Artificial
  Hsd_from_Mmd_227, Mmd_227; mouse cand869_probe3 sequence
ggcactttgtacttctgccagg

SEQ ID NO: 1189 - DNA, 22 bp, Artificial
  Hsd_from_Mmd_228, Mmd_228; mouse cand541_probe22 sequence
cgaggctcggagcagcccaggg

SEQ ID NO: 1190 - DNA, 22 bp, Artificial
  Hsd_from_Mmd_229, Mmd_229; mouse cand281_probe12 sequence
agagacctttctttaaaatctt

SEQ ID NO: 1191 - DNA, 22 bp, Artificial
  Hsd_from_Mmd_23, Mmd_23; mouse brain 69_B01np sequence
ttgaaacaatctctactgaacc

SEQ ID NO: 1192 - DNA, 22 bp, Artificial
  Hsd_from_Mmd_23, Mmd_23; mouse cand644_probe15 sequence
gttcactggagtttgtttcagt

SEQ ID NO: 1193 - DNA, 22 bp, Artificial
  Hsd_from_Mmd_231, Mmd_231; mouse cand589_probe13 sequence
aggacatcgtttacagctgcat

SEQ ID NO: 1194 - DNA, 22 bp, Artificial
  Hsd_from_Mmd_232, Mmd_232; mouse cand549_probe9 sequence
tattttcagtcactcaaactga

SEQ ID NO: 1195 - DNA, 22 bp, Artificial
  Hsd_from_Mmd_235, Mmd_235; mouse cand466_probe13 sequence
gcaggtccaggctgggcttgta

SEQ ID NO: 1196 - DNA, 22 bp, Artificial
  Hsd_from_Mmd_236, Mmd_236; mouse cand113_probe16 sequence
agccatcagcttttcccagctg

SEQ ID NO: 1197 - DNA, 22 bp, Artificial
  Hsd_from_Mmd_236, Mmd_236; mouse cand113_probe9 sequence
ccgaagctaatagcctttggct

SEQ ID NO: 1198 - DNA, 22 bp, Artificial
  Hsd_from_Mmd_237, Mmd_237; mouse cand515_probe14 sequence
agggaccgccgacgctgctacc

SEQ ID NO: 1199 - DNA, 22 bp, Artificial
  Hsd_from_Mmd_237, Mmd_237; mouse cand733_probe35 sequence
gagggaccgccgacgctgctac

SEQ ID NO: 1200 - DNA, 22 bp, Artificial
  Hsd_from_Mmd_243, Mmd_243; mouse cand129_probe40 sequence
gggtacatctggacagccgaat

SEQ ID NO: 1201 - DNA, 22 bp, Artificial
  Hsd_from_Mmd_245, Mmd_245; mouse cand87_probe1 sequence
gggattaccccctgctgctgac

SEQ ID NO: 1202 - DNA, 22 bp, Artificial
  Hsd_from_Mmd_246, Hsd_from_Mmd_266, Hsd_from_Mmd_42, Mmd_246, Mmd_266, Mmd_42; mouse cand410_probe35 sequence
agggaagaacataagaagaaaa

SEQ ID NO: 1203 - DNA, 22 bp, Artificial
  Hsd_from_Mmd_246, Hsd_from_Mmd_266, Hsd_from_Mmd_42, Mmd_246, Mmd_266, Mmd_42; mouse cand598_probe34 sequence
cagggaagaacataagaagaaa

SEQ ID NO: 1204 - DNA, 22 bp, Artificial
  Hsd_from_Mmd_247, Mmd_247; mouse cand309_probe17 sequence
aattaggctttttaattaaaag

SEQ ID NO: 1205 - DNA, 22 bp, Artificial
  Hsd_from_Mmd_249, Mmd_249; mouse cand816_probe3 sequence
tgccatggcacaaaccatgctg

SEQ ID NO: 1206 - DNA, 22 bp, Artificial
  Hsd_from_Mmd_250, Mmd_250; mouse cand82_probe8 sequence
tctattgggtaaatatgtatta

SEQ ID NO: 1207 - DNA, 22 bp, Artificial
  Hsd_from_Mmd_253, Hsd_from_Mmd_319, Mmd_253, Mmd_319; mouse cand48_probe12 sequence
tcttccaaccaaagctgggaag

SEQ ID NO: 1208 - DNA, 22 bp, Artificial
  Hsd_from_Mmd_255, Mmd_255; mouse cand538_probe14 sequence
gggtcaaaggttgctatcaccc

SEQ ID NO: 1209 - DNA, 22 bp, Artificial
  Hsd_from_Mmd_256, Mmd_256; mouse cand960_probe1 sequence
aggccccgaggagggttgtggg

SEQ ID NO: 1210 - DNA, 22 bp, Artificial
  Hsd_from_Mmd_256, Mmd_256; mouse cand960_probe22 sequence
ggaacatccctcctgggggtcc

SEQ ID NO: 1211 - DNA, 22 bp, Artificial
  Hsd_from_Mmd_258, Mmd_258; mouse cand713_probe11 sequence
aggacgaagatgacgaggagct

SEQ ID NO: 1212 - DNA, 22 bp, Artificial
  Hsd_from_Mmd_259, Mmd_259; mouse cand376_probe15 sequence
agctgctgcctccagaagtgtc

SEQ ID NO: 1213 - DNA, 22 bp, Artificial
  Hsd_from_Mmd_26, Mmd_26; mouse cand65_probe6 sequence
caaagatgaggatttctacctt

SEQ ID NO: 1214 - DNA, 22 bp, Artificial
  Hsd_from_Mmd_260, Mmd_260; mouse cand468_probe33 sequence
gcagggagcctggctcattagg

SEQ ID NO: 1215 - DNA, 22 bp, Artificial
  Hsd_from_Mmd_260, Mmd_260; mouse cand784a_probe32 sequence
ggcagggagcctggctcattag

SEQ ID NO: 1216 - DNA, 22 bp, Artificial
  Hsd_from_Mmd_261, Mmd_261; mouse cand873_probe8 sequence
aggtaggcgtacaactaggaga

SEQ ID NO: 1217 - DNA, 22 bp, Artificial
  Hsd_from_Mmd_262, Mmd_262; mouse cand360_probe7 sequence
gggtacaattagcctctggcgc

SEQ ID NO: 1218 - DNA, 22 bp, Artificial
  Hsd_from_Mmd_263, Mmd_263; mouse cand568_probe21 sequence
aggagagatctgtaggcctttc

SEQ ID NO: 1219 - DNA, 22 bp, Artificial
  Hsd_from_Mmd_264, Mmd_264; mouse cand393_probe14 sequence
tattggtcaatttcaccttgat

SEQ ID NO: 1220 - DNA, 22 bp, Artificial
  Hsd_from_Mmd_270, Mmd_270; mouse cand126_probe18 sequence
aggagcagacactgcccaggtt

SEQ ID NO: 1221 - DNA, 22 bp, Artificial
  Hsd_from_Mmd_271, Mmd_271; mouse cand377_probe20 sequence
gtcaccatggaaacaagcagag

SEQ ID NO: 1222 - DNA, 22 bp, Artificial
  Hsd_from_Mmd_272, Mmd_272; mouse cand19_probe18 sequence
gccagatgggcaggattaatta

SEQ ID NO: 1223 - DNA, 22 bp, Artificial
  Hsd_from_Mmd_274, Mmd_274; mouse cand275_probe10 sequence
ctgtgggtaaggataagcatgc

SEQ ID NO: 1224 - DNA, 22 bp, Artificial
  Hsd_from_Mmd_275, Hsd_from_Mmd_389, Mmd_275, Mmd_389; mouse cand927d_probe16 sequence
gtgtttggcctcctctgggacg

SEQ ID NO: 1225 - DNA, 22 bp, Artificial
  Hsd_from_Mmd_276, Mmd_276; mouse cand723a_probe15 sequence
cgagacccagacttggtttgtt

SEQ ID NO: 1226 - DNA, 22 bp, Artificial
  Hsd_from_Mmd_277, Mmd_277; mouse cand318_probe13 sequence
aagggtaagtggttaattgaac

SEQ ID NO: 1227 - DNA, 22 bp, Artificial
  Hsd_from_Mmd_279, Mmd_279; mouse cand666_probe18 sequence
agttcatttgattgaacttggg

SEQ ID NO: 1228 - DNA, 22 bp, Artificial
  Hsd_from_Mmd_28, Mmd_28; mouse cand386_probe17 sequence
gggtgcgggtgttggtggtgtg

SEQ ID NO: 1229 - DNA, 22 bp, Artificial
  Hsd_from_Mmd_280, Mmd_280; mouse cand860_probe10 sequence
gctgcctagtccgaggccagca

SEQ ID NO: 1230 - DNA, 22 bp, Artificial
  Hsd_from_Mmd_284, Mmd_284; mouse cand149_probe35 sequence
gggagccgccaatgacaacaaa

SEQ ID NO: 1231 - DNA, 21 bp, Artificial
  Hsd_from_Mmd_286, Mmd_286; mouse brain 15_J22 sequence
ttaagacggttgagaccagag

SEQ ID NO: 1232 - DNA, 22 bp, Artificial
  Hsd_from_Mmd_291, Mmd_291; mouse cand498_probe20 sequence
accaggagaccaggtgggagcc

SEQ ID NO: 1233 - DNA, 22 bp, Artificial
  Hsd_from_Mmd_293, Mmd_293; mouse cand138_probe15 sequence
catttttttatagcctgaggaa

SEQ ID NO: 1234 - DNA, 22 bp, Artificial
  Hsd_from_Mmd_294, Mmd_294; mouse cand214_probe3 sequence
agggatcttgttaaaaagcaga

SEQ ID NO: 1235 - DNA, 22 bp, Artificial
  Hsd_from_Mmd_295, Mmd_295; mouse mmHP2669067_probe14 sequence
ggtcattatgagaaaagggatc

SEQ ID NO: 1236 - DNA, 22 bp, Artificial
  Hsd_from_Mmd_296, Mmd_296; mouse cand609_probe9 sequence
gcagggttacattttgccatct

SEQ ID NO: 1237 - DNA, 22 bp, Artificial
  Hsd_from_Mmd_297, Mmd_297; mouse cand461_probe9 sequence
agtgtttaaacacaatgccttt

SEQ ID NO: 1238 - DNA, 22 bp, Artificial
  Hsd_from_Mmd_298, Mmd_298; mouse cand248_probe6 sequence
cccatcgctcatttgcataatg

SEQ ID NO: 1239 - DNA, 22 bp, Artificial
  Hsd_from_Mmd_299, Mmd_299; mouse cand686_probe10 sequence
taaggagggtgaagttgaaggg

SEQ ID NO: 1240 - DNA, 22 bp, Artificial
  Hsd_from_Mmd_300, Mmd_300; mouse cand420_probe12 sequence
ctgtggttttggaattttccaa

SEQ ID NO: 1241 - DNA, 22 bp, Artificial
  Hsd_from_Mmd_301, Mmd_301; mouse cand445_probe4 sequence
gggtgctggcggtgacatgtgc

SEQ ID NO: 1242 - DNA, 22 bp, Artificial
  Hsd_from_Mmd_302, Mmd_302; mouse cand615_probe30 sequence
cagctgaggttaatgagtcccc

SEQ ID NO: 1243 - DNA, 22 bp, Artificial
  Hsd_from_Mmd_302, Mmd_302; mouse cand615_probe36 sequence
ggccatcaactctcccagctgg

SEQ ID NO: 1244 - DNA, 21 bp, Artificial
  Hsd_from_Mmd_303, Mmd_303; mouse brain 35_A09 sequence
tttcctctctgccccataggg

SEQ ID NO: 1245 - DNA, 22 bp, Artificial
  Hsd_from_Mmd_305, Mmd_305; mouse cand657_probe8 sequence
gggtgacaggcagttgttcgtg

SEQ ID NO: 1246 - DNA, 22 bp, Artificial
  Hsd_from_Mmd_306, Mmd_306; mouse mmHP1541151_probe27 sequence
cagaatgactcctctgagaaca

SEQ ID NO: 1247 - DNA, 22 bp, Artificial
  Hsd_from_Mmd_31, Mmd_31; mouse mmHP2052196_probe5 sequence
agggccttagggaactggaggg

SEQ ID NO: 1248 - DNA, 22 bp, Artificial
  Hsd_from_Mmd_311, Mmd_311; mouse cand124_probe1 sequence
aggaaagacactttttatattg

SEQ ID NO: 1249 - DNA, 22 bp, Artificial
  Hsd_from_Mmd_314, Mmd_314; mouse cand148_probe7 sequence
cagatgtgtccacagctaatta

SEQ ID NO: 1250 - DNA, 22 bp, Artificial
  Hsd_from_Mmd_316, Mmd_316; mouse cand367_probe7 sequence
atatttttgtgggaatgggccc

SEQ ID NO: 1251 - DNA, 22 bp, Artificial
  Hsd_from_Mmd_318, Mmd_318; mouse cand543_probe12 sequence
gtgacagagccctaattattaa

SEQ ID NO: 1252 - DNA, 22 bp, Artificial
  Hsd_from_Mmd_321, Mmd_321; mouse cand597_probe9 sequence
tttacagatgattaaatgctcg

SEQ ID NO: 1253 - DNA, 22 bp, Artificial
  Hsd_from_Mmd_324, Mmd_324; mouse cand224_probe10 sequence
ctgcttcgatgtgctggctgtg

SEQ ID NO: 1254 - DNA, 21 bp, Artificial
  Hsd_from_Mmd_325, Mmd_325; mouse brain 102_H06 sequence
gcagtccacgggcatatacac

SEQ ID NO: 1255 - DNA, 22 bp, Artificial
  Hsd_from_Mmd_325, Mmd_325; mouse brain 111_J08 sequence
gcagtccacgggcatatacact

SEQ ID NO: 1256 - DNA, 23 bp, Artificial
  Hsd_from_Mmd_325, Mmd_325; mouse brain 19_C16 sequence
atgcagtccacgggcatatacac

SEQ ID NO: 1257 - DNA, 20 bp, Artificial
  Hsd_from_Mmd_325, Mmd_325; mouse brain 77_O10np sequence
cagtccacgggcatatacac

SEQ ID NO: 1258 - DNA, 22 bp, Artificial
  Hsd_from_Mmd_325, Mmd_325; mouse cand101_probe16 sequence
tgcagtccacgggcatatacac

SEQ ID NO: 1259 - DNA, 22 bp, Artificial
  Hsd_from_Mmd_326, Mmd_326; mouse cand522_probe43 sequence
agggagctgaccttatccaata

SEQ ID NO: 1260 - DNA, 22 bp, Artificial
  Hsd_from_Mmd_328, Mmd_328; mouse cand697_probe25 sequence
gcagggacttcttgccagccct

SEQ ID NO: 1261 - DNA, 22 bp, Artificial
  Hsd_from_Mmd_33, Mmd_33; mouse cand162_probe18 sequence
ggcggattaaggctggagcgca

SEQ ID NO: 1262 - DNA, 22 bp, Artificial
  Hsd_from_Mmd_330, Mmd_330; mouse cand545_probe17 sequence
gcttcccgctcacccacagcag

SEQ ID NO: 1263 - DNA, 22 bp, Artificial
  Hsd_from_Mmd_333, Mmd_333; mouse cand473_probe20 sequence
ttgcaatgggtgagcagactgg

SEQ ID NO: 1264 - DNA, 22 bp, Artificial
  Hsd_from_Mmd_333, Mmd_333; mouse mmHP1301606_probe19 sequence
attgcaatgggtgagcagactg

SEQ ID NO: 1265 - DNA, 22 bp, Artificial
  Hsd_from_Mmd_334, Mmd_334; mouse cand787_probe21 sequence
tgacaagatattttgaaacaac

SEQ ID NO: 1266 - DNA, 22 bp, Artificial
  Hsd_from_Mmd_335, Mmd_335; mouse cand781_probe9 sequence
atcttcagctgattaaatgtcc

SEQ ID NO: 1267 - DNA, 22 bp, Artificial
  Hsd_from_Mmd_336, Mmd_336; mouse cand430_probe8 sequence
tggagagaccttccttctgcag

SEQ ID NO: 1268 - DNA, 22 bp, Artificial
  Hsd_from_Mmd_338, Mmd_338; mouse cand307_probe2 sequence
tcatgatgaagagtttgtcagt

SEQ ID NO: 1269 - DNA, 22 bp, Artificial
  Hsd_from_Mmd_34, Mmd_34; mouse cand553_probe18 sequence
caattgggtcaggaagatcagt

SEQ ID NO: 1270 - DNA, 22 bp, Artificial
  Hsd_from_Mmd_340, Mmd_340; mouse cand853_probe27 sequence
gacattcatcccccggtgggtc

SEQ ID NO: 1271 - DNA, 22 bp, Artificial
  Hsd_from_Mmd_343, Mmd_343; mouse cand673_probe13 sequence
gggagttagtcagctaaatccc

SEQ ID NO: 1272 - DNA, 22 bp, Artificial
  Hsd_from_Mmd_343, Mmd_343; mouse cand673_probe6 sequence
tagggatttggcagcatggccc

SEQ ID NO: 1273 - DNA, 22 bp, Artificial
  Hsd_from_Mmd_344, Mmd_344; mouse cand120_probe19 sequence
tgctagggaacacagggatttc

SEQ ID NO: 1274 - DNA, 22 bp, Artificial
  Hsd_from_Mmd_346, Mmd_346; mouse cand365_probe11 sequence
aggatgttttggatgccgctct

SEQ ID NO: 1275 - DNA, 22 bp, Artificial
  Hsd_from_Mmd_347, Mmd_347; mouse cand492_probe32 sequence
aggattctaaatgtataaattg

SEQ ID NO: 1276 - DNA, 22 bp, Artificial
  Hsd_from_Mmd_35, Mmd_35; mouse cand684_probe15 sequence
ggccagaaggctctccctgcta

SEQ ID NO: 1277 - DNA, 22 bp, Artificial
  Hsd_from_Mmd_353, Mmd_353; mouse cand395_probe7 sequence
agctagaaggagttgatggtcc

SEQ ID NO: 1278 - DNA, 22 bp, Artificial
  Hsd_from_Mmd_354, Mmd_354; mouse cand704_probe5 sequence
gccgggaagattttttggctct

SEQ ID NO: 1279 - DNA, 22 bp, Artificial
  Hsd_from_Mmd_355, Mmd_355; mouse cand323_probe1 sequence
gtattaatgaacgttacaggac

SEQ ID NO: 1280 - DNA, 22 bp, Artificial
  Hsd_from_Mmd_356, Mmd_356; mouse cand182_probe10 sequence
ccagtctggaattttcagcctt

SEQ ID NO: 1281 - DNA, 22 bp, Artificial
  Hsd_from_Mmd_358, Mmd_358; mouse cand668_probe30 sequence
gcagaggataatggcgtctgca

SEQ ID NO: 1282 - DNA, 22 bp, Artificial
  Hsd_from_Mmd_361, Mmd_361; mouse cand18_probe11 sequence
atatattgtacaaaagagcctt

SEQ ID NO: 1283 - DNA, 22 bp, Artificial
  Hsd_from_Mmd_363, Mmd_363; mouse mmHP2216591_probe41 sequence
gcagaaatgtttccactagatt

SEQ ID NO: 1284 - DNA, 22 bp, Artificial
  Hsd_from_Mmd_367, Mmd_367; mouse cand558_probe1 sequence
ggaaattttatttgaatcaggg

SEQ ID NO: 1285 - DNA, 22 bp, Artificial
  Hsd_from_Mmd_37, Mmd_37; mouse mmHP200260_probe14 sequence
gcaatttgcagagccattaatg

SEQ ID NO: 1286 - DNA, 22 bp, Artificial
  Hsd_from_Mmd_370, Mmd_370; mouse cand546_probe16 sequence
gccgcaggctggctcattgtct

SEQ ID NO: 1287 - DNA, 22 bp, Artificial
  Hsd_from_Mmd_371, Mmd_371; mouse cand854_probe3 sequence
ccaggtgctggtggaaatagag

SEQ ID NO: 1288 - DNA, 22 bp, Artificial
  Hsd_from_Mmd_372, Mmd_372; mouse cand181_probe20 sequence
gcaggagccctaatcggattgg

SEQ ID NO: 1289 - DNA, 22 bp, Artificial
  Hsd_from_Mmd_373, Mmd_373; mouse cand767_probe3 sequence
tttcagaaaattcttccaggag

SEQ ID NO: 1290 - DNA, 22 bp, Artificial
  Hsd_from_Mmd_376, Mmd_376; mouse cand294_probe16 sequence
tgtctctaattccccaagggta

SEQ ID NO: 1291 - DNA, 22 bp, Artificial
  Hsd_from_Mmd_378, Mmd_378; mouse cand136_probe8 sequence
aaataatgtgagatcaggctca

SEQ ID NO: 1292 - DNA, 22 bp, Artificial
  Hsd_from_Mmd_382, Mmd_382; mouse mmHP1665736_probe7 sequence
aggactcaatgacgttgaagtt

SEQ ID NO: 1293 - DNA, 22 bp, Artificial
  Hsd_from_Mmd_383, Mmd_383; mouse cand675_probe1 sequence
gcactgggcaggaagactttat

SEQ ID NO: 1294 - DNA, 22 bp, Artificial
  Hsd_from_Mmd_387, Mmd_387; mouse cand265_probe18 sequence
tttgtgcccacgcctctgggtc

SEQ ID NO: 1295 - DNA, 22 bp, Artificial
  Hsd_from_Mmd_388, Mmd_388; mouse cand635_probe43 sequence
agggcatgtcattattaggtca

SEQ ID NO: 1296 - DNA, 22 bp, Artificial
  Hsd_from_Mmd_39, Mmd_39; mouse cand184_probe15 sequence
agttactaatttctgatgctct

SEQ ID NO: 1297 - DNA, 22 bp, Artificial
  Hsd_from_Mmd_39, Mmd_39; mouse cand184_probe5 sequence
aggagctatcagaacttagtga

SEQ ID NO: 1298 - DNA, 22 bp, Artificial
  Hsd_from_Mmd_391, Mmd_391; mouse cand698_probe22 sequence
cagcgtctggcctctgagccag

SEQ ID NO: 1299 - DNA, 22 bp, Artificial
  Hsd_from_Mmd_396, Mmd_396; mouse cand187_probe38 sequence
gagcaattaaattgcaccagga

SEQ ID NO: 1300 - DNA, 22 bp, Artificial
  Hsd_from_Mmd_398, Mmd_398; mouse cand361_probe11 sequence
aggaggccatatgtggccgtgt

SEQ ID NO: 1301 - DNA, 22 bp, Artificial
  Hsd_from_Mmd_399, Mmd_399; mouse cand694_probe2 sequence
gaggccacagatgctgatggaa

SEQ ID NO: 1302 - DNA, 22 bp, Artificial
  Hsd_from_Mmd_40, Mmd_40; mouse cand519_probe11 sequence
ggccaggtagtccttgcggcca

SEQ ID NO: 1303 - DNA, 21 bp, Artificial
  Hsd_from_Mmd_405, Mmd_405; mouse brain 58_M04np sequence
ctgggccctcttcccacccag

SEQ ID NO: 1304 - DNA, 22 bp, Artificial
  Hsd_from_Mmd_408, Mmd_408; mouse cand547_probe13 sequence
catgagagtttgcatgcaaatg

SEQ ID NO: 1305 - DNA, 22 bp, Artificial
  Hsd_from_Mmd_409, Mmd_409; mouse cand292_probe2 sequence
aggaaattgtatgataaatagg

SEQ ID NO: 1306 - DNA, 22 bp, Artificial
  Hsd_from_Mmd_41, Mmd_41; mouse cand98_probe29 sequence
tgcaggaacttgtgagtctcct

SEQ ID NO: 1307 - DNA, 22 bp, Artificial
  Hsd_from_Mmd_410, Mmd_410; mouse cand326_probe38 sequence
gccatctgcgtctaccagacgc

SEQ ID NO: 1308 - DNA, 22 bp, Artificial
  Hsd_from_Mmd_411, Mmd_411; mouse cand257_probe3 sequence
agcactgtgctaaaattgcagg

SEQ ID NO: 1309 - DNA, 22 bp, Artificial
  Hsd_from_Mmd_412, Mmd_412; mouse mmHP453167_probe8 sequence
attaggagtggcagaaaggatg

SEQ ID NO: 1310 - DNA, 22 bp, Artificial
  Hsd_from_Mmd_413, Mmd_413; mouse cand718_probe33 sequence
ccagctgggaagaaccagtggc

SEQ ID NO: 1311 - DNA, 22 bp, Artificial
  Hsd_from_Mmd_416, Mmd_416; mouse cand8_probe3 sequence
tgggggaggcgggctgtgctgg

SEQ ID NO: 1312 - DNA, 22 bp, Artificial
  Hsd_from_Mmd_418, Mmd_418; mouse cand425_probe43 sequence
aggggtaagagagtagaaccgg

SEQ ID NO: 1313 - DNA, 22 bp, Artificial
  Hsd_from_Mmd_422, Mmd_422; mouse cand196_probe33 sequence
ttgtgacatcacaattagccac

SEQ ID NO: 1314 - DNA, 22 bp, Artificial
  Hsd_from_Mmd_424, Mmd_424; mouse cand443_probe6 sequence
caagctctacaaccattgagct

SEQ ID NO: 1315 - DNA, 22 bp, Artificial
  Hsd_from_Mmd_426, Mmd_426; mouse cand427_probe13 sequence
caggcctgagtcacagctgctg

SEQ ID NO: 1316 - DNA, 22 bp, Artificial
  Hsd_from_Mmd_428, Mmd_428; mouse cand518_probe14 sequence
cagtgcgctggctgctggagga

SEQ ID NO: 1317 - DNA, 22 bp, Artificial
  Hsd_from_Mmd_428, Mmd_428; mouse cand518_probe8 sequence
cctgcagcagctggtgaccttg

SEQ ID NO: 1318 - DNA, 22 bp, Artificial
  Hsd_from_Mmd_429, Mmd_429; mouse cand685_probe7 sequence
aggggattaggacaagagatgt

SEQ ID NO: 1319 - DNA, 22 bp, Artificial
  Hsd_from_Mmd_430, Mmd_430; mouse cand607_probe13 sequence
aggaagagaaaccagattgtgt

SEQ ID NO: 1320 - DNA, 22 bp, Artificial
  Hsd_from_Mmd_430, Mmd_430; mouse cand607_probe6 sequence
gcaggactacatttgttctccc

SEQ ID NO: 1321 - DNA, 22 bp, Artificial
  Hsd_from_Mmd_431, Mmd_431; mouse mmHP2175366_probe12 sequence
gtgctagcaatctgagagacca

SEQ ID NO: 1322 - DNA, 22 bp, Artificial
  Hsd_from_Mmd_433, Mmd_433; mouse cand192_probe4 sequence
gccggagccctggcagataaat

SEQ ID NO: 1323 - DNA, 22 bp, Artificial
  Hsd_from_Mmd_435, Mmd_435; mouse cand125_probe11 sequence
atgggtaattgcacacacaaat

SEQ ID NO: 1324 - DNA, 22 bp, Artificial
  Hsd_from_Mmd_436, Mmd_436; mouse cand544_probe10 sequence
ccctggcactgatggcctgtgc

SEQ ID NO: 1325 - DNA, 23 bp, Artificial
  Hsd_from_Mmd_437, Mmd_437; mouse brain 87_F08 sequence
ctggctgagagcaggactaaccc

SEQ ID NO: 1326 - DNA, 22 bp, Artificial
  Hsd_from_Mmd_438, Mmd_438; mouse cand957_probe18 sequence
ctttgacaagagaggattaggg

SEQ ID NO: 1327 - DNA, 22 bp, Artificial
  Hsd_from_Mmd_438, Mmd_438; mouse cand957_probe5 sequence
ttgaagtgtctcttgtcaaaga

SEQ ID NO: 1328 - DNA, 22 bp, Artificial
  Hsd_from_Mmd_439, Mmd_439; mouse cand165_probe14 sequence
ctgaggaggagtgtgattacca

SEQ ID NO: 1329 - DNA, 22 bp, Artificial
  Hsd_from_Mmd_44, Mmd_44; mouse cand618_probe6 sequence
gggtgaaaagttcgcagcgagg

SEQ ID NO: 1330 - DNA, 22 bp, Artificial
  Hsd_from_Mmd_443, Mmd_443; mouse cand73_probe10 sequence
tgaaccacagctgagttcacag

SEQ ID NO: 1331 - DNA, 20 bp, Artificial
  Hsd_from_Mmd_448, Mmd_448; mouse brain 72_B19 sequence
cagaaggggagtcgggagcg

SEQ ID NO: 1332 - DNA, 22 bp, Artificial
  Hsd_from_Mmd_45, Mmd_45; mouse cand540_probe12 sequence
gtgtgtgtgtttattgtaatat

SEQ ID NO: 1333 - DNA, 22 bp, Artificial
  Hsd_from_Mmd_450, Mmd_450; mouse cand536_probe8 sequence
agccctttaatgccagcagctg

SEQ ID NO: 1334 - DNA, 22 bp, Artificial
  Hsd_from_Mmd_452, Hsd_from_Mmd_473, Mmd_452, Mmd_473; mouse cand167_probe11 sequence
gcagagtgcaaacaattttgac

SEQ ID NO: 1335 - DNA, 22 bp, Artificial
  Hsd_from_Mmd_455, Mmd_455; mouse cand190_probe12 sequence
gggtgaaaagagacattatcct

SEQ ID NO: 1336 - DNA, 22 bp, Artificial
  Hsd_from_Mmd_456, Mmd_456; mouse cand239_probe7 sequence
tggagacgccaaggggaaaatg

SEQ ID NO: 1337 - DNA, 22 bp, Artificial
  Hsd_from_Mmd_459, Mmd_459; mouse cand681_probe30 sequence
aagtggccttcaatagtccgat

SEQ ID NO: 1338 - DNA, 22 bp, Artificial
  Hsd_from_Mmd_461, Mmd_461; mouse cand392_probe21 sequence
ggcgccaacgggcaggtgcgct

SEQ ID NO: 1339 - DNA, 22 bp, Artificial
  Hsd_from_Mmd_464, Mmd_464; mouse cand688_probe8 sequence
caatgggccagattctcactct

SEQ ID NO: 1340 - DNA, 22 bp, Artificial
  Hsd_from_Mmd_465, Mmd_465; mouse cand449_probe19 sequence
gagctcaaattgcagctacaac

SEQ ID NO: 1341 - DNA, 22 bp, Artificial
  Hsd_from_Mmd_466, Mmd_466; mouse cand438_probe6 sequence
gatgaggaggtcatcaaaatga

SEQ ID NO: 1342 - DNA, 22 bp, Artificial
  Hsd_from_Mmd_468, Mmd_468; mouse cand58_probe19 sequence
aggggccggaatggagcgctcc

SEQ ID NO: 1343 - DNA, 22 bp, Artificial
  Hsd_from_Mmd_47, Mmd_47; mouse cand368_probe44 sequence
tatcaagggctgggaccagggg

SEQ ID NO: 1344 - DNA, 22 bp, Artificial
  Hsd_from_Mmd_471, Mmd_471; mouse cand428_probe21 sequence
gctgccatgaccagttaaggga

SEQ ID NO: 1345 - DNA, 22 bp, Artificial
  Hsd_from_Mmd_472, Mmd_472; mouse cand141_probe5 sequence
tgctgctggctcagaccccagc

SEQ ID NO: 1346 - DNA, 22 bp, Artificial
  Hsd_from_Mmd_476, Mmd_476; mouse cand416_probe11 sequence
ccggagagtgtagtttgtttgt

SEQ ID NO: 1347 - DNA, 22 bp, Artificial
  Hsd_from_Mmd_477, Mmd_477; mouse cand415_probe21 sequence
caatgggagagagagaatggga

SEQ ID NO: 1348 - DNA, 22 bp, Artificial
  Hsd_from_Mmd_478, Mmd_478; mouse cand622_probe21 sequence
gctcagaggccacttggccaga

SEQ ID NO: 1349 - DNA, 22 bp, Artificial
  Hsd_from_Mmd_48, Mmd_48; mouse cand452_probe35 sequence
agggaattactaatttacattt

SEQ ID NO: 1350 - DNA, 22 bp, Artificial
  Hsd_from_Mmd_480, Mmd_480; mouse cand963_probe9 sequence
aggattggtggtggggccagat

SEQ ID NO: 1351 - DNA, 22 bp, Artificial
  Hsd_from_Mmd_481, Mmd_481; mouse cand269_probe17 sequence
cagtattccacaatggatcagt

SEQ ID NO: 1352 - DNA, 22 bp, Artificial
  Hsd_from_Mmd_481, Mmd_481; mouse cand269_probe2 sequence
gggctgcattcattttgagtgc

SEQ ID NO: 1353 - DNA, 22 bp, Artificial
  Hsd_from_Mmd_482, Mmd_482; mouse cand486_probe16 sequence
ccgaggaggtgcccgtggacgt

SEQ ID NO: 1354 - DNA, 22 bp, Artificial
  Hsd_from_Mmd_483, Mmd_483; mouse cand271_probe10 sequence
cggccaggctgagggaaggaag

SEQ ID NO: 1355 - DNA, 22 bp, Artificial
  Hsd_from_Mmd_485, Mmd_485; mouse cand57_probe38 sequence
cagtaaagccaagtagtgcatg

SEQ ID NO: 1356 - DNA, 22 bp, Artificial
  Hsd_from_Mmd_486, Mmd_486; mouse cand38_probe12 sequence
tgccaaatgttagcaaggaaac

SEQ ID NO: 1357 - DNA, 22 bp, Artificial
  Hsd_from_Mmd_487, Hsd_from_Mmd_535, Hsd_from_Mmd_78, Mmd_487, Mmd_535, Mmd_78; mouse cand780_probe16 sequence
ctttgtcacaggttaccagggt

SEQ ID NO: 1358 - DNA, 22 bp, Artificial
  Hsd_from_Mmd_487, Hsd_from_Mmd_535, Hsd_from_Mmd_78, Mmd_487, Mmd_535, Mmd_78; mouse cand780_probe8 sequence
ctgggcctgagacagaggaggg

SEQ ID NO: 1359 - DNA, 22 bp, Artificial
  Hsd_from_Mmd_488, Mmd_488; mouse cand255_probe13 sequence
cggtctggttggtcttgggccc

SEQ ID NO: 1360 - DNA, 22 bp, Artificial
  Hsd_from_Mmd_489, Mmd_489; mouse cand604_probe27 sequence
tttaaaaggcttttaaatgatg

SEQ ID NO: 1361 - DNA, 22 bp, Artificial
  Hsd_from_Mmd_49, Mmd_49; mouse cand732_probe22 sequence
ctcatggtgccggggtcggggc

SEQ ID NO: 1362 - DNA, 20 bp, Artificial
  Hsd_from_Mmd_490, Mmd_490; mouse brain 42_N15 sequence
agtattacatggccaatctc

SEQ ID NO: 1363 - DNA, 22 bp, Artificial
  Hsd_from_Mmd_490, Mmd_490; mouse brain 51_A22 sequence
tgagtattacatggccaatctc

SEQ ID NO: 1364 - DNA, 22 bp, Artificial
  Hsd_from_Mmd_491, Mmd_491; mouse cand247_probe17 sequence
catgatgagctttgtgcaaagt

SEQ ID NO: 1365 - DNA, 22 bp, Artificial
  Hsd_from_Mmd_492, Mmd_492; mouse cand243_probe7 sequence
atcgatgggaaatgatgtgtga

SEQ ID NO: 1366 - DNA, 22 bp, Artificial
  Hsd_from_Mmd_494, Mmd_494; mouse cand115_probe6 sequence
atttcgggttttccagtccgat

SEQ ID NO: 1367 - DNA, 22 bp, Artificial
  Hsd_from_Mmd_499, Mmd_499; mouse cand835_probe15 sequence
ccgtaagcaattattaaatgcc

SEQ ID NO: 1368 - DNA, 22 bp, Artificial
  Hsd_from_Mmd_499, Mmd_499; mouse cand835_probe2 sequence
cacatgtaatgaattgtgggtg

SEQ ID NO: 1369 - DNA, 22 bp, Artificial
  Hsd_from_Mmd_500, Mmd_500; mouse cand322_probe32 sequence
atggcaatttgtttcatttgcc

SEQ ID NO: 1370 - DNA, 22 bp, Artificial
  Hsd_from_Mmd_501, Mmd_501; mouse cand7_probe8 sequence
tgacaataaaagttatgggtcc

SEQ ID NO: 1371 - DNA, 22 bp, Artificial
  Hsd_from_Mmd_503, Mmd_503; mouse cand887_probe4 sequence
cctcagctatgcatgcacagct

SEQ ID NO: 1372 - DNA, 22 bp, Artificial
  Hsd_from_Mmd_505, Mmd_505; mouse cand949_probe25 sequence
ttaaggaatcactcttgatctc

SEQ ID NO: 1373 - DNA, 22 bp, Artificial
  Hsd_from_Mmd_506, Mmd_506; mouse cand93_probe8 sequence
gctggtggctctgatttcatga

SEQ ID NO: 1374 - DNA, 21 bp, Artificial
  Hsd_from_Mmd_507, Mmd_507; mouse brain 57_I16np sequence
cggctctgggtctgtggggag

SEQ ID NO: 1375 - DNA, 21 bp, Artificial
  Hsd_from_Mmd_507, Mmd_507; mouse brain 7_G17np sequence
tcggctctgggtctgtgggga

SEQ ID NO: 1376 - DNA, 22 bp, Artificial
  Hsd_from_Mmd_507, Mmd_507; mouse cand244_probe12 sequence
gaaattcggctctgggtctgtg

SEQ ID NO: 1377 - DNA, 22 bp, Artificial
  Hsd_from_Mmd_509, Mmd_509; mouse cand952_probe11 sequence
ctgcagagaagtgaactgaaga

SEQ ID NO: 1378 - DNA, 22 bp, Artificial
  Hsd_from_Mmd_51, Mmd_51; mouse cand99_probe20 sequence
gctgcaggcatatttgcatatt

SEQ ID NO: 1379 - DNA, 22 bp, Artificial
  Hsd_from_Mmd_510, Mmd_510; mouse cand692_probe9 sequence
gccccaggatggagtaggcagg

SEQ ID NO: 1380 - DNA, 22 bp, Artificial
  Hsd_from_Mmd_511, Mmd_511; mouse cand683_probe8 sequence
ctctgtgggagggaggagatca

SEQ ID NO: 1381 - DNA, 22 bp, Artificial
  Hsd_from_Mmd_515, Mmd_515; mouse cand389_probe14 sequence
gtgagacactgggacgcacgct

SEQ ID NO: 1382 - DNA, 22 bp, Artificial
  Hsd_from_Mmd_516, Mmd_516; mouse cand722_probe18 sequence
cttggatgagcgtccagttgct

SEQ ID NO: 1383 - DNA, 22 bp, Artificial
  Hsd_from_Mmd_517, Mmd_517; mouse cand842_probe10 sequence
tcattctctatgggggccgggg

SEQ ID NO: 1384 - DNA, 22 bp, Artificial
  Hsd_from_Mmd_518, Mmd_518; mouse cand790_probe19 sequence
tggtgggggtggaactcagctg

SEQ ID NO: 1385 - DNA, 22 bp, Artificial
  Hsd_from_Mmd_518, Mmd_518; mouse cand790_probe5 sequence
ccggattgtccccttgctgctg

SEQ ID NO: 1386 - DNA, 22 bp, Artificial
  Hsd_from_Mmd_519, Mmd_519; mouse cand676_probe12 sequence
cgtatctatgaggaacagcagg

SEQ ID NO: 1387 - DNA, 22 bp, Artificial
  Hsd_from_Mmd_52, Mmd_52; mouse cand922_probe21 sequence
taaggaggctgtagaaatgaag

SEQ ID NO: 1388 - DNA, 22 bp, Artificial
  Hsd_from_Mmd_523, Mmd_523; mouse cand433_probe8 sequence
attgaaggatgctgtggcccac

SEQ ID NO: 1389 - DNA, 22 bp, Artificial
  Hsd_from_Mmd_523, Mmd_523; mouse cand435_probe12 sequence
aggaacacagctttacgttcaa

SEQ ID NO: 1390 - DNA, 22 bp, Artificial
  Hsd_from_Mmd_524, Mmd_524; mouse cand89_probe16 sequence
ggccagtgtcatgcagaagatt

SEQ ID NO: 1391 - DNA, 21 bp, Artificial
  Hsd_from_Mmd_525, Mmd_525; mouse brain 12_O15 sequence
ttcattcggctgtccagatgt

SEQ ID NO: 1392 - DNA, 22 bp, Artificial
  Hsd_from_Mmd_525, Mmd_525; mouse brain 88_L17np sequence
ttcattcggctgtccagatgta

SEQ ID NO: 1393 - DNA, 22 bp, Artificial
  Hsd_from_Mmd_526, Mmd_526; mouse cand593_probe15 sequence
aggacagacagcaggagacgct

SEQ ID NO: 1394 - DNA, 22 bp, Artificial
  Hsd_from_Mmd_526, Mmd_526; mouse cand593_probe6 sequence
ggcgttgatgtctgctttcatc

SEQ ID NO: 1395 - DNA, 22 bp, Artificial
  Hsd_from_Mmd_527, Mmd_527; mouse cand332_probe20 sequence
ttaaaggagatcagaggtaatt

SEQ ID NO: 1396 - DNA, 22 bp, Artificial
  Hsd_from_Mmd_529, Mmd_529; mouse cand741_probe25 sequence
gcagtgtgtgagaggtgtacgc

SEQ ID NO: 1397 - DNA, 22 bp, Artificial
  Hsd_from_Mmd_530, Mmd_530; mouse cand523_probe3 sequence
atgcctgatacattctccaggc

SEQ ID NO: 1398 - DNA, 22 bp, Artificial
  Hsd_from_Mmd_532, Mmd_532; mouse cand111_probe13 sequence
agggtaattgcacgatattttc

SEQ ID NO: 1399 - DNA, 22 bp, Artificial
  Hsd_from_Mmd_533, Mmd_533; mouse cand95_probe8 sequence
gatttccaataattgaggcagt

SEQ ID NO: 1400 - DNA, 22 bp, Artificial
  Hsd_from_Mmd_534, Mmd_534; mouse cand477_probe12 sequence
aaggaagcttcatgcttggatc

SEQ ID NO: 1401 - DNA, 22 bp, Artificial
  Hsd_from_Mmd_536, Mmd_536; mouse cand109_probe41 sequence
ggctgccaaacactggagcagc

SEQ ID NO: 1402 - DNA, 18 bp, Artificial
  Hsd_from_Mmd_54, Mmd_54; mouse brain 35_N12np sequence
accaggaggctgaggtcc

SEQ ID NO: 1403 - DNA, 21 bp, Artificial
  Hsd_from_Mmd_54, Mmd_54; mouse brain 74_K09 sequence
accaggaggctgaggtccctt

SEQ ID NO: 1404 - DNA, 22 bp, Artificial
  Hsd_from_Mmd_56, Mmd_56; mouse cand266_probe10 sequence
aggaaggtgtgctgctggagga

SEQ ID NO: 1405 - DNA, 22 bp, Artificial
  Hsd_from_Mmd_56, Mmd_56; mouse cand266_probe12 sequence
gggctggtgggggcatctttct

SEQ ID NO: 1406 - DNA, 22 bp, Artificial
  Hsd_from_Mmd_58, Mmd_58; mouse cand712_probe10 sequence
agccatgatggcaatgtccgag

SEQ ID NO: 1407 - DNA, 22 bp, Artificial
  Hsd_from_Mmd_59, Mmd_59; mouse cand552_probe8 sequence
cccgccaggtcggcgggaagag

SEQ ID NO: 1408 - DNA, 22 bp, Artificial
  Hsd_from_Mmd_60, Mmd_60; mouse cand838_probe12 sequence
cagtcatggcgggaggactgaa

SEQ ID NO: 1409 - DNA, 22 bp, Artificial
  Hsd_from_Mmd_67, Mmd_67; mouse cand11_probe5 sequence
gtagatatcatacaggaatgct

SEQ ID NO: 1410 - DNA, 22 bp, Artificial
  Hsd_from_Mmd_68, Mmd_68; mouse cand586_probe2 sequence
aaggaagaagtttgttctgttg

SEQ ID NO: 1411 - DNA, 22 bp, Artificial
  Hsd_from_Mmd_69, Mmd_69; mouse cand632_probe11 sequence
aggtgaaactcaaagggtccaa

SEQ ID NO: 1412 - DNA, 22 bp, Artificial
  Hsd_from_Mmd_70, Mmd_70; mouse cand200_probe39 sequence
gccaattgcaggcccaattggc

SEQ ID NO: 1413 - DNA, 22 bp, Artificial
  Hsd_from_Mmd_71, Mmd_71; mouse cand402_probe35 sequence
agagtgtagtgcaatcagtcag

SEQ ID NO: 1414 - DNA, 22 bp, Artificial
  Hsd_from_Mmd_74, Mmd_74; mouse cand734_probe31 sequence
gggataattaccatctctcagg

SEQ ID NO: 1415 - DNA, 22 bp, Artificial
  Hsd_from_Mmd_75, Mmd_75; mouse cand656_probe13 sequence
cgaggttggcatcagaccctct

SEQ ID NO: 1416 - DNA, 22 bp, Artificial
  Hsd_from_Mmd_76, Mmd_76; mouse cand645_probe3 sequence
atttgtgtcagatttcaatcta

SEQ ID NO: 1417 - DNA, 22 bp, Artificial
  Hsd_from_Mmd_80, Mmd_80; mouse cand261_probe12 sequence
gcagagagaagagactccatct

SEQ ID NO: 1418 - DNA, 22 bp, Artificial
  Hsd_from_Mmd_81, Mmd_81; mouse cand28_probe31 sequence
tttaaaaagctaatttgggagc

SEQ ID NO: 1419 - DNA, 22 bp, Artificial
  Hsd_from_Mmd_81, Mmd_81; mouse cand28_probe40 sequence
attcagacattttaaataggaa

SEQ ID NO: 1420 - DNA, 22 bp, Artificial
  Hsd_from_Mmd_82, Mmd_82; mouse cand896_probe6 sequence
ggccaagatacgtagtcgccaa

SEQ ID NO: 1421 - DNA, 22 bp, Artificial
  Hsd_from_Mmd_85, Mmd_85; mouse cand59_probe28 sequence
catctgttcaaacataatgctc

SEQ ID NO: 1422 - DNA, 22 bp, Artificial
  Hsd_from_Mmd_90, Mmd_90; mouse cand363_probe13 sequence
gctggagttcaatatgctcagg

SEQ ID NO: 1423 - DNA, 22 bp, Artificial
  Hsd_from_Mmd_90, Mmd_90; mouse cand363_probe7 sequence
tcaattgtgtaatttccagctg

SEQ ID NO: 1424 - DNA, 22 bp, Artificial
  Hsd_from_Mmd_91, Mmd_91; mouse cand629_probe16 sequence
cggagggaacagctgagaacta

SEQ ID NO: 1425 - DNA, 22 bp, Artificial
  Hsd_from_Mmd_92, Mmd_92; mouse mmHP2160056_probe22 sequence
tgatcttgctgatgagcagggt

SEQ ID NO: 1426 - DNA, 22 bp, Artificial
  Hsd_from_Mmd_93, Mmd_93; mouse cand331_probe6 sequence
gcgtctggtagacgcagatggc

SEQ ID NO: 1427 - DNA, 22 bp, Artificial
  Hsd_from_Mmd_94, Mmd_94; mouse cand696_probe8 sequence
aagccttagaagagccaaagta

SEQ ID NO: 1428 - DNA, 22 bp, Artificial
  Hsd_from_Mmd_95, Mmd_95; mouse cand584_probe24 sequence
caaagttaaggcaggggagcca

SEQ ID NO: 1429 - DNA, 22 bp, Artificial
  Hsd_from_Mmd_97, Mmd_97; mouse cand68_probe2 sequence
caatctccacttcactgtcagt

SEQ ID NO: 1430 - DNA, 22 bp, Artificial
  Hsd_from_Mmd_98, Mmd_98; mouse cand482_probe12 sequence
ggggctggggccgggacagagc

SEQ ID NO: 1431 - DNA, 22 bp, Artificial
  Mmd_102; mouse mmHP969107_probe21 sequence
tgtggaggcacggcactcgggt

SEQ ID NO: 1432 - DNA, 22 bp, Artificial
  Mmd_102; mouse mmHP969107_probe3 sequence
cgagtccaggcctccatgcagc

SEQ ID NO: 1433 - DNA, 20 bp, Artificial
  Mmd_103; mouse brain 65_C14np sequence
ttctggaggcacatggtttg

SEQ ID NO: 1434 - DNA, 22 bp, Artificial
  Mmd_104; mouse mmHP2682003_probe7 sequence
ttaaaaggggtctcaggtaagg

SEQ ID NO: 1435 - DNA, 21 bp, Artificial
  Mmd_106, Mmd_168; mouse brain 11_H05np sequence
ggtgcgcgtctctcggggtcg

SEQ ID NO: 1436 - DNA, 18 bp, Artificial
  Mmd_106, Mmd_168; mouse brain 82_M03np sequence
gcgtctctcggggtcggg

SEQ ID NO: 1437 - DNA, 22 bp, Artificial
  Mmd_108, Mmd_125, Mmd_160, Mmd_240, Mmd_251, Mmd_265, Mmd_29, Mmd_322, Mmd_323, Mmd_362, Mmd_386, Mmd_415, Mmd_463, Mmd_504; mouse brain 3_L19 sequence
tcttgaagcctgactccccgcg

SEQ ID NO: 1438 - DNA, 22 bp, Artificial
  Mmd_109; mouse mmHP121950_probe14 sequence
gctcagattgcaatgctggggt

SEQ ID NO: 1439 - DNA, 20 bp, Artificial
  Mmd_110; mouse brain 21_I02 sequence
ctctactccctgccccagcc

SEQ ID NO: 1440 - DNA, 21 bp, Artificial
  Mmd_110; mouse brain 61_E24np sequence
ggtggtgcaggcaggagagcc

SEQ ID NO: 1441 - DNA, 21 bp, Artificial
  Mmd_111, Mmd_175, Mmd_188, Mmd_421, Mmd_522; mouse brain 112_M18 sequence
gatataaccactgccagactg

SEQ ID NO: 1442 - DNA, 20 bp, Artificial
  Mmd_111, Mmd_175, Mmd_188, Mmd_421, Mmd_522; mouse brain 69_K07 sequence
gatataaccactgccagact

SEQ ID NO: 1443 - DNA, 18 bp, Artificial
  Mmd_113; mouse brain 53_K18np sequence
gtggatattcccttctat

SEQ ID NO: 1444 - DNA, 22 bp, Artificial
  Mmd_114; mouse mmHP1647321_probe8 sequence
ccccagtgtgtcagtgtagagc

SEQ ID NO: 1445 - DNA, 22 bp, Artificial
  Mmd_116; mouse mmHP1779096_probe17 sequence
ggccaggtgtgaggcatcagag

SEQ ID NO: 1446 - DNA, 24 bp, Artificial
  Mmd_118; mouse brain 63_D22 sequence
ttgagagatggggaaataggcact

SEQ ID NO: 1447 - DNA, 22 bp, Artificial
  Mmd_121; mouse cand913_probe22 sequence
acgtctgaggagcggcggcggc

SEQ ID NO: 1448 - DNA, 22 bp, Artificial
  Mmd_122; mouse mmHP2044575_probe10 sequence
agggatgtaaagtaagctggct

SEQ ID NO: 1449 - DNA, 22 bp, Artificial
  Mmd_124; mouse cand168_probe2 sequence
aggatacagagctctttaaata

SEQ ID NO: 1450 - DNA, 22 bp, Artificial
  Mmd_124; mouse cand168_probe22 sequence
ttaaagatttttgttccacctg

SEQ ID NO: 1451 - DNA, 22 bp, Artificial
  Mmd_127; mouse mmHP157519_probe4 sequence
aggggaagaggggactctgtct

SEQ ID NO: 1452 - DNA, 22 bp, Artificial
  Mmd_130; mouse mmHP115458_probe21 sequence
ccagctggaggtcatactaaat

SEQ ID NO: 1453 - DNA, 19 bp, Artificial
  Mmd_131; mouse brain 106_I09np sequence
agtcaggttgtgtggtttt

SEQ ID NO: 1454 - DNA, 22 bp, Artificial
  Mmd_132; mouse mmHP1181586_probe18 sequence
tgtcaccttacaccccgtcaag

SEQ ID NO: 1455 - DNA, 22 bp, Artificial
  Mmd_132; mouse mmHP1181586_probe7 sequence
gcagggtgtgaggggactcgtc

SEQ ID NO: 1456 - DNA, 22 bp, Artificial
  Mmd_134; mouse mmHP2549445_probe12 sequence
gcgatctaccagttcataagga

SEQ ID NO: 1457 - DNA, 22 bp, Artificial
  Mmd_135; mouse mmHP291564_probe22 sequence
ggatccagactgtcccaatgga

SEQ ID NO: 1458 - DNA, 22 bp, Artificial
  Mmd_139; mouse cand238_probe13 sequence
ggccattaactccgggtggtca

SEQ ID NO: 1459 - DNA, 22 bp, Artificial
  Mmd_140; mouse mmHP2148319_probe5 sequence
aaggagtgaaatattttgctgg

SEQ ID NO: 1460 - DNA, 19 bp, Artificial
  Mmd_142; mouse brain 108_H04np sequence
ggttggtgtactgtgtgtg

SEQ ID NO: 1461 - DNA, 21 bp, Artificial
  Mmd_142; mouse brain 52_E14 sequence
tgaggttggtgtactgtgtgt

SEQ ID NO: 1462 - DNA, 22 bp, Artificial
  Mmd_142; mouse brain 62_E07 sequence
tgaggttggtgtactgtgtgtg

SEQ ID NO: 1463 - DNA, 18 bp, Artificial
  Mmd_143; mouse brain 102_E05np sequence
tggttgtctggttgtggg

SEQ ID NO: 1464 - DNA, 19 bp, Artificial
  Mmd_144; mouse brain 7_L19np sequence
ccacagtttcctcatcccc

SEQ ID NO: 1465 - DNA, 22 bp, Artificial
  Mmd_146; mouse cand517_probe15 sequence
ctgaggacttacagattaactc

SEQ ID NO: 1466 - DNA, 22 bp, Artificial
  Mmd_146; mouse cand517_probe6 sequence
gggaaagaattaatgtgtgctc

SEQ ID NO: 1467 - DNA, 21 bp, Artificial
  Mmd_151; mouse brain 4_D20np sequence
tccctgagttcctgtcagttg

SEQ ID NO: 1468 - DNA, 22 bp, Artificial
  Mmd_152; mouse cand789_probe9 sequence
gggtatctggtgaaccaagctg

SEQ ID NO: 1469 - DNA, 22 bp, Artificial
  Mmd_153; mouse cand678_probe18 sequence
ccggaactgtggactacagctc

SEQ ID NO: 1470 - DNA, 22 bp, Artificial
  Mmd_153; mouse cand678_probe8 sequence
gtagttctagaggcacccgggt

SEQ ID NO: 1471 - DNA, 22 bp, Artificial
  Mmd_158; mouse mmHP2073048_probe4 sequence
gtgcacagggtaaattcattgg

SEQ ID NO: 1472 - DNA, 22 bp, Artificial
  Mmd_164; mouse cand658_probe20 sequence
gcagagcaaaaggcatggtggg

SEQ ID NO: 1473 - DNA, 22 bp, Artificial
  Mmd_165; mouse mmHP3434196_probe13 sequence
catgaggatagtcagtagtcca

SEQ ID NO: 1474 - DNA, 18 bp, Artificial
  Mmd_171; mouse brain 7_L13np sequence
aggtcagaggtcgatcct

SEQ ID NO: 1475 - DNA, 22 bp, Artificial
  Mmd_177, Mmd_43; mouse mmHP1442327_probe17 sequence
agggacagtgcgtgggtgtgtg

SEQ ID NO: 1476 - DNA, 18 bp, Artificial
  Mmd_179; mouse brain 22_I06np sequence
taggttatcctctgttgc

SEQ ID NO: 1477 - DNA, 22 bp, Artificial
  Mmd_18; mouse cand506_probe12 sequence
gcagctgccctggcaggcagct

SEQ ID NO: 1478 - DNA, 18 bp, Artificial
  Mmd_191; mouse brain 12_B04np sequence
tccctgtgtcccttgagc

SEQ ID NO: 1479 - DNA, 22 bp, Artificial
  Mmd_192; mouse mmHP1050998_probe13 sequence
gaattcagaatcaggaagtcat

SEQ ID NO: 1480 - DNA, 18 bp, Artificial
  Mmd_194; mouse brain 18_O06np sequence
tttcctgtccgtttcacc

SEQ ID NO: 1481 - DNA, 22 bp, Artificial
  Mmd_199; mouse mmHP909030_probe18 sequence
gggtgaagaaacctaattatac

SEQ ID NO: 1482 - DNA, 19 bp, Artificial
  Mmd_200; mouse brain 48_O10np sequence
agtgtcttagcttggttgt

SEQ ID NO: 1483 - DNA, 22 bp, Artificial
  Mmd_201; mouse mmHP2117009_probe13 sequence
ggatccaggacaagattctgcg

SEQ ID NO: 1484 - DNA, 22 bp, Artificial
  Mmd_202; mouse cand831_probe34 sequence
tcagtgctctcagtgatgggtg

SEQ ID NO: 1485 - DNA, 22 bp, Artificial
  Mmd_205; mouse mmHP1788264_probe19 sequence
cgctggccaccgagacgtgggt

SEQ ID NO: 1486 - DNA, 22 bp, Artificial
  Mmd_206; mouse cand274_probe30 sequence
ggcccagatgctaagcactgga

SEQ ID NO: 1487 - DNA, 22 bp, Artificial
  Mmd_207; mouse cand689_probe25 sequence
gctgcagcacaactatatccag

SEQ ID NO: 1488 - DNA, 22 bp, Artificial
  Mmd_209; mouse mmHP1378833_probe1 sequence
gcagaaattcttgactcagctc

SEQ ID NO: 1489 - DNA, 22 bp, Artificial
  Mmd_209; mouse mmHP1378833_probe21 sequence
aggagagttaagaaaaatctca

SEQ ID NO: 1490 - DNA, 22 bp, Artificial
  Mmd_210, Mmd_252; mouse mmHP2825016_probe18 sequence
cagtgtccctcttgatggcact

SEQ ID NO: 1491 - DNA, 22 bp, Artificial
  Mmd_213; mouse cand751_probe17 sequence
aggaagccagactgtgtcaaaa

SEQ ID NO: 1492 - DNA, 22 bp, Artificial
  Mmd_214; mouse mmHP432573_probe3 sequence
agggttatctaggagtgatgtc

SEQ ID NO: 1493 - DNA, 22 bp, Artificial
  Mmd_216; mouse mmHP855413_probe3 sequence
aactgttagactatagccaggg

SEQ ID NO: 1494 - DNA, 22 bp, Artificial
  Mmd_218; mouse cand418_probe16 sequence
ggcccttgaagggcagctgaag

SEQ ID NO: 1495 - DNA, 22 bp, Artificial
  Mmd_21; mouse mmHP533267_probe20 sequence
gggaggttaaggatgaaggcct

SEQ ID NO: 1496 - DNA, 22 bp, Artificial
  Mmd_220; mouse cand921_probe13 sequence
tgcagggcctgcagacacattc

SEQ ID NO: 1497 - DNA, 22 bp, Artificial
  Mmd_221; mouse mmHP1210358_probe10 sequence
tcagaataactgccatggaagg

SEQ ID NO: 1498 - DNA, 22 bp, Artificial
  Mmd_224; mouse cand446_probe26 sequence
agggacatcattgtgtcactag

SEQ ID NO: 1499 - DNA, 22 bp, Artificial
  Mmd_22; mouse cand472_probe7 sequence
aggaaggcgtgataatgaggct

SEQ ID NO: 1500 - DNA, 22 bp, Artificial
  Mmd_230; mouse cand330_probe21 sequence
atgcgcgtgagtccccgtgctc

SEQ ID NO: 1501 - DNA, 22 bp, Artificial
  Mmd_233; mouse brain 108_C20 sequence
aatgacaccacatatatggcag

SEQ ID NO: 1502 - DNA, 22 bp, Artificial
  Mmd_234; mouse mmHP1505538_probe23 sequence
ctttaggtcagagtctgggatg

SEQ ID NO: 1503 - DNA, 22 bp, Artificial
  Mmd_238; mouse mmHP1679825_probe38 sequence
taggcctagtctgccagcaagg

SEQ ID NO: 1504 - DNA, 21 bp, Artificial
  Mmd_239; mouse brain 107_M08 sequence
ccgtcctgaggttgttgagct

SEQ ID NO: 1505 - DNA, 20 bp, Artificial
  Mmd_239; mouse brain 116_A12 sequence
ccgtcctgaggttgttgagc

SEQ ID NO: 1506 - DNA, 22 bp, Artificial
  Mmd_239; mouse brain 18_I18 sequence
ccgtcctgaggttgttgagctg

SEQ ID NO: 1507 - DNA, 22 bp, Artificial
  Mmd_241; mouse brain 40_O20np sequence
tgagctggtggtttgggtggtt

SEQ ID NO: 1508 - DNA, 22 bp, Artificial
  Mmd_242; mouse mmHP1170304_probe1 sequence
gccaggcacacacactacaggt

SEQ ID NO: 1509 - DNA, 22 bp, Artificial
  Mmd_244; mouse cand311_probe25 sequence
gaaacatagcctcagtattttc

SEQ ID NO: 1510 - DNA, 22 bp, Artificial
  Mmd_248; mouse cand811_probe37 sequence
tgcacctgatcttttcaagtgc

SEQ ID NO: 1511 - DNA, 22 bp, Artificial
  Mmd_24; mouse cand174_probe40 sequence
catggccaagagggctccatct

SEQ ID NO: 1512 - DNA, 22 bp, Artificial
  Mmd_254; mouse mmHP2341379_probe21 sequence
gggtagttggctgatgggtgtt

SEQ ID NO: 1513 - DNA, 22 bp, Artificial
  Mmd_257; mouse cand511_probe9 sequence
aggaaaaacctgagggaagtct

SEQ ID NO: 1514 - DNA, 18 bp, Artificial
  Mmd_25; mouse brain 60_G19np sequence
tggctgtgtcttagctgg

SEQ ID NO: 1515 - DNA, 18 bp, Artificial
  Mmd_267; mouse brain 27_M18np sequence
gaaagatggtgaactatg

SEQ ID NO: 1516 - DNA, 22 bp, Artificial
  Mmd_268, Mmd_307, Mmd_467; mouse brain 69_H11 sequence
ctctcggcgccccctcgatgct

SEQ ID NO: 1517 - DNA, 22 bp, Artificial
  Mmd_269; mouse cand570_probe12 sequence
agggccctacagagcagcttgt

SEQ ID NO: 1518 - DNA, 18 bp, Artificial
  Mmd_273; mouse brain 35_C09np sequence
ctgcgtccctctcttgtt

SEQ ID NO: 1519 - DNA, 22 bp, Artificial
  Mmd_278; mouse cand384_probe17 sequence
agcagctcgggatcctgggtag

SEQ ID NO: 1520 - DNA, 22 bp, Artificial
  Mmd_27; mouse mmHP744986_probe7 sequence
atttgtaacactaaaaggctcc

SEQ ID NO: 1521 - DNA, 21 bp, Artificial
  Mmd_281; mouse brain 62_N19np sequence
cgcacccttcaagtcctggaa

SEQ ID NO: 1522 - DNA, 19 bp, Artificial
  Mmd_282; mouse brain 1_K03np sequence
tgtgcccctggcttttgtg

SEQ ID NO: 1523 - DNA, 22 bp, Artificial
  Mmd_283; mouse cand680_probe23 sequence
gctaagcaaggcatctcagcac

SEQ ID NO: 1524 - DNA, 22 bp, Artificial
  Mmd_285; mouse cand488_probe10 sequence
gccaagctcaaccttgaagatg

SEQ ID NO: 1525 - DNA, 18 bp, Artificial
  Mmd_287; mouse brain 43_E09 sequence
agggcagaggtgaggagg

SEQ ID NO: 1526 - DNA, 22 bp, Artificial
  Mmd_288; mouse mmHP1540701_probe28 sequence
catatgaggaacctaggactgt

SEQ ID NO: 1527 - DNA, 19 bp, Artificial
  Mmd_289; mouse brain 27_E23np sequence
actggacttggagtcagaa

SEQ ID NO: 1528 - DNA, 22 bp, Artificial
  Mmd_290; mouse mmHP1876696_probe21 sequence
ttcttgtgtgagaagggtaaag

SEQ ID NO: 1529 - DNA, 22 bp, Artificial
  Mmd_292; mouse cand710_probe3 sequence
gggcgagctgcctacgggtccg

SEQ ID NO: 1530 - DNA, 22 bp, Artificial
  Mmd_304; mouse cand467_probe44 sequence
tgcaaggagaatggggcctagg

SEQ ID NO: 1531 - DNA, 18 bp, Artificial
  Mmd_308; mouse brain 1_B02np sequence
ctgtgaccttgacttggt

SEQ ID NO: 1532 - DNA, 22 bp, Artificial
  Mmd_309; mouse mmHP874966_probe9 sequence
ccatgttgggtaactgctgtgc

SEQ ID NO: 1533 - DNA, 21 bp, Artificial
  Mmd_30; mouse brain 95_P09 sequence
cagggcccttgagtcttggtg

SEQ ID NO: 1534 - DNA, 22 bp, Artificial
  Mmd_310; mouse brain 64_B07 sequence
tcagccacggcttacctggaag

SEQ ID NO: 1535 - DNA, 22 bp, Artificial
  Mmd_312; mouse cand852_probe17 sequence
acaacaatttgccgctgccagc

SEQ ID NO: 1536 - DNA, 22 bp, Artificial
  Mmd_312; mouse cand852_probe3 sequence
aggaggcggaaagccgacattg

SEQ ID NO: 1537 - DNA, 22 bp, Artificial
  Mmd_313; mouse cand60_probe26 sequence
cagctgaaagggtttctctagt

SEQ ID NO: 1538 - DNA, 20 bp, Artificial
  Mmd_315; mouse brain 76_N24 sequence
tgggccctccagacctcatg

SEQ ID NO: 1539 - DNA, 22 bp, Artificial
  Mmd_317; mouse cand608_probe16 sequence
gtttttacagcagtcacacagg

SEQ ID NO: 1540 - DNA, 22 bp, Artificial
  Mmd_320; mouse mmHP325598_probe5 sequence
tcatctggtacctattgtgctc

SEQ ID NO: 1541 - DNA, 22 bp, Artificial
  Mmd_327; mouse mmHP527107_probe22 sequence
tgggtttcccctttgatgggtc

SEQ ID NO: 1542 - DNA, 23 bp, Artificial
  Mmd_329; mouse brain 1_O13 sequence
tttggggtcgccttccagagggt

SEQ ID NO: 1543 - DNA, 22 bp, Artificial
  Mmd_32; mouse cand756_probe40 sequence
gtgagccagggccctgtggaga

SEQ ID NO: 1544 - DNA, 22 bp, Artificial
  Mmd_331; mouse cand460_probe7 sequence
aaggagcaaccaggcagggaga

SEQ ID NO: 1545 - DNA, 22 bp, Artificial
  Mmd_332; mouse mmHP2109324_probe14 sequence
gaccaggagcttctccgtaact

SEQ ID NO: 1546 - DNA, 22 bp, Artificial
  Mmd_337; mouse cand246_probe3 sequence
aggagaggaatgacccataact

SEQ ID NO: 1547 - DNA, 22 bp, Artificial
  Mmd_339; mouse cand434_probe1 sequence
aggatgatgtcatctatctccc

SEQ ID NO: 1548 - DNA, 22 bp, Artificial
  Mmd_339; mouse cand434_probe18 sequence
ggaagtccatggtgacatcacc

SEQ ID NO: 1549 - DNA, 22 bp, Artificial
  Mmd_341; mouse cand86_probe20 sequence
gcagagagccaaggccaaagct

SEQ ID NO: 1550 - DNA, 22 bp, Artificial
  Mmd_342; mouse cand403_probe29 sequence
ctgaggagcacaaatgtcacaa

SEQ ID NO: 1551 - DNA, 19 bp, Artificial
  Mmd_345, Mmd_38; mouse brain 61_M12np sequence
ggaggtctctgtctgactt

SEQ ID NO: 1552 - DNA, 22 bp, Artificial
  Mmd_348; mouse cand596_probe10 sequence
aggatccccttagtccctcccg

SEQ ID NO: 1553 - DNA, 22 bp, Artificial
  Mmd_348; mouse cand596_probe12 sequence
ccggagaggacagggggctttt

SEQ ID NO: 1554 - DNA, 22 bp, Artificial
  Mmd_349; mouse cand690_probe14 sequence
ataggacaagtgagggagacaa

SEQ ID NO: 1555 - DNA, 22 bp, Artificial
  Mmd_350; mouse cand264_probe16 sequence
ataacagagggcagaatttcgc

SEQ ID NO: 1556 - DNA, 22 bp, Artificial
  Mmd_350; mouse cand264_probe4 sequence
ggccaaattctgccctcaatta

SEQ ID NO: 1557 - DNA, 22 bp, Artificial
  Mmd_351; mouse cand631_probe10 sequence
gcagacaccagccacagccttc

SEQ ID NO: 1558 - DNA, 22 bp, Artificial
  Mmd_352; mouse cand21_probe20 sequence
gcgcagggtctctggtgtttcc

SEQ ID NO: 1559 - DNA, 18 bp, Artificial
  Mmd_357; mouse brain 54_F07np sequence
ggctatctagctgtggtg

SEQ ID NO: 1560 - DNA, 22 bp, Artificial
  Mmd_359; mouse mmHP486329_probe19 sequence
ggggtcctggcttctccgctct

SEQ ID NO: 1561 - DNA, 22 bp, Artificial
  Mmd_360; mouse mmHP811508_probe6 sequence
gcagaaggccatttgaaaattt

SEQ ID NO: 1562 - DNA, 22 bp, Artificial
  Mmd_364; mouse mmHP1290061_probe10 sequence
cacccgatcccaggtctgtgct

SEQ ID NO: 1563 - DNA, 22 bp, Artificial
  Mmd_365; mouse cand682_probe29 sequence
aggactggatgtgttcatgttt

SEQ ID NO: 1564 - DNA, 22 bp, Artificial
  Mmd_365; mouse cand682_probe37 sequence
catgagaatccgcccagtcgta

SEQ ID NO: 1565 - DNA, 22 bp, Artificial
  Mmd_366; mouse cand390_probe17 sequence
gcaaggtaagtgtcctatgtga

SEQ ID NO: 1566 - DNA, 22 bp, Artificial
  Mmd_368; mouse mmHP2418251_probe5 sequence
ccagtggacactggtgcgcacc

SEQ ID NO: 1567 - DNA, 22 bp, Artificial
  Mmd_369; mouse cand399_probe17 sequence
acaaagcaatttcacagttatc

SEQ ID NO: 1568 - DNA, 22 bp, Artificial
  Mmd_369; mouse cand399_probe3 sequence
ctctcgctgtggttatgtgtct

SEQ ID NO: 1569 - DNA, 22 bp, Artificial
  Mmd_36; mouse cand566_probe27 sequence
gcaggattccttgctagcattt

SEQ ID NO: 1570 - DNA, 22 bp, Artificial
  Mmd_374; mouse cand273_probe11 sequence
ggcactggccaagccaaagtca

SEQ ID NO: 1571 - DNA, 22 bp, Artificial
  Mmd_375; mouse cand580_probe18 sequence
gctcagggtgattattttgctg

SEQ ID NO: 1572 - DNA, 22 bp, Artificial
  Mmd_377; mouse mmHP1218232_probe15 sequence
aaggactcctcgtccttaagtt

SEQ ID NO: 1573 - DNA, 22 bp, Artificial
  Mmd_379; mouse cand70_probe16 sequence
gtgaatcacagagagcgagcca

SEQ ID NO: 1574 - DNA, 21 bp, Artificial
  Mmd_380; mouse brain 77_B20 sequence
taggctagagagaggttgggg

SEQ ID NO: 1575 - DNA, 18 bp, Artificial
  Mmd_381; mouse brain 91_A17 sequence
tggctcatttagaagcag

SEQ ID NO: 1576 - DNA, 22 bp, Artificial
  Mmd_384; mouse mmHP2197503_probe16 sequence
agcctccaaaaagaaataatga

SEQ ID NO: 1577 - DNA, 18 bp, Artificial
  Mmd_385; mouse brain 105_C04np sequence
tagtaggtctgtatggtt

SEQ ID NO: 1578 - DNA, 21 bp, Artificial
  Mmd_38; mouse brain 14_I18 sequence
tctgatcgttcacctccatac

SEQ ID NO: 1579 - DNA, 19 bp, Artificial
  Mmd_38; mouse brain 75_N06 sequence
tctgatcgttcacctccat

SEQ ID NO: 1580 - DNA, 22 bp, Artificial
  Mmd_390; mouse mmHP3025219_probe1 sequence
aggaatgggatacattcacagg

SEQ ID NO: 1581 - DNA, 21 bp, Artificial
  Mmd_392; mouse brain 63_M16 sequence
ctaaggcaggcagacttcagt

SEQ ID NO: 1582 - DNA, 20 bp, Artificial
  Mmd_392; mouse brain 95_D02 sequence
tctgaagcttgcttacctcc

SEQ ID NO: 1583 - DNA, 22 bp, Artificial
  Mmd_393; mouse cand12_probe10 sequence
tctgtaactggcatgtaaggga

SEQ ID NO: 1584 - DNA, 22 bp, Artificial
  Mmd_394; mouse mmHP2549249_probe15 sequence
gctgcggagttgggccagctct

SEQ ID NO: 1585 - DNA, 22 bp, Artificial
  Mmd_394; mouse mmHP2549249_probe8 sequence
tgctggatccagttgcagctga

SEQ ID NO: 1586 - DNA, 20 bp, Artificial
  Mmd_395; mouse brain 8_M05np sequence
ctagttggatgtcaagacac

SEQ ID NO: 1587 - DNA, 18 bp, Artificial
  Mmd_397; mouse brain 72_K08np sequence
tgcctgaggttgtgtgag

SEQ ID NO: 1588 - DNA, 22 bp, Artificial
  Mmd_400; mouse cand516_probe21 sequence
gtgacgtcagcggagcgggcgc

SEQ ID NO: 1589 - DNA, 18 bp, Artificial
  Mmd_401; mouse brain 3_O07np sequence
tgcgtcccttgcttgtgg

SEQ ID NO: 1590 - DNA, 20 bp, Artificial
  Mmd_402; mouse brain 5_C21np sequence
tcctggcctgggctgctctg

SEQ ID NO: 1591 - DNA, 22 bp, Artificial
  Mmd_403; mouse cand978_probe16 sequence
tgctactattagacaggccgtt

SEQ ID NO: 1592 - DNA, 22 bp, Artificial
  Mmd_403; mouse cand978_probe3 sequence
aggatggtggtcttggaggcgg

SEQ ID NO: 1593 - DNA, 22 bp, Artificial
  Mmd_404; mouse mmHP1595839_probe41 sequence
cttatgggtcaatgtggtcaag

SEQ ID NO: 1594 - DNA, 22 bp, Artificial
  Mmd_406; mouse cand484_probe5 sequence
ggccagttccccgcctcttcca

SEQ ID NO: 1595 - DNA, 22 bp, Artificial
  Mmd_407; mouse cand703_probe4 sequence
cgagggagcaattattcgcatc

SEQ ID NO: 1596 - DNA, 18 bp, Artificial
  Mmd_414; mouse brain 10_O20np sequence
cagcagcacactgtgagt

SEQ ID NO: 1597 - DNA, 22 bp, Artificial
  Mmd_417; mouse cand193_probe30 sequence
gctagctttgcagaaagggact

SEQ ID NO: 1598 - DNA, 22 bp, Artificial
  Mmd_419; mouse mmHP683_probe18 sequence
tcggggcacctgcacatttgca

SEQ ID NO: 1599 - DNA, 22 bp, Artificial
  Mmd_420, Mmd_513; mouse brain 116_B14 sequence
agttgtgtgtgcatgttcatgt

SEQ ID NO: 1600 - DNA, 22 bp, Artificial
  Mmd_423; mouse cand408_probe2 sequence
ctggctgcagcaatgagggcct

SEQ ID NO: 1601 - DNA, 22 bp, Artificial
  Mmd_423; mouse cand408_probe22 sequence
acactccttgctgctggccagc

SEQ ID NO: 1602 - DNA, 20 bp, Artificial
  Mmd_425; mouse brain 67_J02 sequence
tgctctccctggctgggggt

SEQ ID NO: 1603 - DNA, 22 bp, Artificial
  Mmd_427; mouse mmHP1499491_probe4 sequence
aggccttaaggcctgtgggcac

SEQ ID NO: 1604 - DNA, 22 bp, Artificial
  Mmd_432; mouse cand134_probe27 sequence
catgctgtctggctcaatgagg

SEQ ID NO: 1605 - DNA, 22 bp, Artificial
  Mmd_432; mouse cand134_probe34 sequence
aggagccaaagccacgggacag

SEQ ID NO: 1606 - DNA, 22 bp, Artificial
  Mmd_434; mouse mmHP2810075_probe14 sequence
aggggaggctaaagtgggtttg

SEQ ID NO: 1607 - DNA, 18 bp, Artificial
  Mmd_440; mouse brain 51_A03 sequence
gaacccttcgtgtatgtc

SEQ ID NO: 1608 - DNA, 20 bp, Artificial
  Mmd_441; mouse brain 100_M10 sequence
aagggattctgatgttggtc

SEQ ID NO: 1609 - DNA, 22 bp, Artificial
  Mmd_441; mouse brain 103_I17 sequence
aagggattctgatgttggtcac

SEQ ID NO: 1610 - DNA, 26 bp, Artificial
  Mmd_441; mouse brain 109_H12 sequence
aagggattctgatgttggtcacactc

SEQ ID NO: 1611 - DNA, 25 bp, Artificial
  Mmd_441; mouse brain 109_J22 sequence
aagggattctgatgttggtcacact

SEQ ID NO: 1612 - DNA, 24 bp, Artificial
  Mmd_441; mouse brain 48_C24 sequence
aagggattctgatgttggtcacac

SEQ ID NO: 1613 - DNA, 19 bp, Artificial
  Mmd_441; mouse brain 52_L05 sequence
aagggattctgatgttggt

SEQ ID NO: 1614 - DNA, 23 bp, Artificial
  Mmd_441; mouse brain 66_P22np sequence
gggattctgatgttggtcacact

SEQ ID NO: 1615 - DNA, 24 bp, Artificial
  Mmd_441; mouse brain 86_C01 sequence
agggattctgatgttggtcacact

SEQ ID NO: 1616 - DNA, 22 bp, Artificial
  Mmd_442; mouse mmHP1626774_probe9 sequence
gactaacagctttagcgcagga

SEQ ID NO: 1617 - DNA, 22 bp, Artificial
  Mmd_444; mouse mmHP565280_probe15 sequence
gagtcctcaggagtatagctgt

SEQ ID NO: 1618 - DNA, 22 bp, Artificial
  Mmd_445; mouse cand567_probe2 sequence
agggaactacaactcccagtgt

SEQ ID NO: 1619 - DNA, 22 bp, Artificial
  Mmd_445; mouse cand761_probe23 sequence
aagggaactacaactcccagtg

SEQ ID NO: 1620 - DNA, 22 bp, Artificial
  Mmd_446; mouse cand560_probe44 sequence
ttgtcacaaacagaggattaga

SEQ ID NO: 1621 - DNA, 22 bp, Artificial
  Mmd_446; mouse cand843a_probe19 sequence
atgttgtcacaaacagaggatt

SEQ ID NO: 1622 - DNA, 22 bp, Artificial
  Mmd_447; mouse cand327_probe37 sequence
caaaggagtaaatgagaggtcc

SEQ ID NO: 1623 - DNA, 22 bp, Artificial
  Mmd_449; mouse mmHP693133_probe7 sequence
ccctcataccttgagggacatg

SEQ ID NO: 1624 - DNA, 18 bp, Artificial
  Mmd_451; mouse brain 72_M07 sequence
agcgggcacagctgtgag

SEQ ID NO: 1625 - DNA, 22 bp, Artificial
  Mmd_453; mouse mmHP1778980_probe15 sequence
ggctccggagttgggaaaggga

SEQ ID NO: 1626 - DNA, 22 bp, Artificial
  Mmd_453; mouse mmHP1778980_probe5 sequence
ctgcctcccaatcctggctcag

SEQ ID NO: 1627 - DNA, 22 bp, Artificial
  Mmd_454; mouse mmHP3397717_probe17 sequence
agggacaatgtgttggctgtgt

SEQ ID NO: 1628 - DNA, 22 bp, Artificial
  Mmd_457; mouse mmHP2347_probe4 sequence
ccggaagcctatggtaatcaga

SEQ ID NO: 1629 - DNA, 21 bp, Artificial
  Mmd_458; mouse brain 31_P17 sequence
tggatggtaataatgctgagt

SEQ ID NO: 1630 - DNA, 18 bp, Artificial
  Mmd_460; mouse brain 76_E12np sequence
acattgtctgctgagttt

SEQ ID NO: 1631 - DNA, 22 bp, Artificial
  Mmd_462; mouse mmHP1121223_probe5 sequence
gctcgaggctaattgtgaatta

SEQ ID NO: 1632 - DNA, 22 bp, Artificial
  Mmd_46; mouse mmHP3140720_probe6 sequence
gggatttgggtcagtcaatcag

SEQ ID NO: 1633 - DNA, 22 bp, Artificial
  Mmd_474; mouse cand55_probe43 sequence
ccagctgacggaggaatcggtc

SEQ ID NO: 1634 - DNA, 22 bp, Artificial
  Mmd_475; mouse cand411_probe13 sequence
gccctgatgcactctttcaggg

SEQ ID NO: 1635 - DNA, 22 bp, Artificial
  Mmd_479; mouse cand655_probe29 sequence
gcagcagctgccggatctcggc

SEQ ID NO: 1636 - DNA, 21 bp, Artificial
  Mmd_484; mouse brain 101_B22 sequence
aaggttacttgttagttcagg

SEQ ID NO: 1637 - DNA, 20 bp, Artificial
  Mmd_484; mouse brain 15_J05 sequence
aggttacttgttagttcagg

SEQ ID NO: 1638 - DNA, 18 bp, Artificial
  Mmd_484; mouse brain 30_J21 sequence
aaggttacttgttagttc

SEQ ID NO: 1639 - DNA, 20 bp, Artificial
  Mmd_484; mouse brain 88_K04 sequence
aaggttacttgttagttcag

SEQ ID NO: 1640 - DNA, 22 bp, Artificial
  Mmd_493; mouse mmHP3423784_probe36 sequence
cagagggacatcacccccaagt

SEQ ID NO: 1641 - DNA, 22 bp, Artificial
  Mmd_495; mouse mmHP200292_probe14 sequence
ctgcagtgggtgtggagaacat

SEQ ID NO: 1642 - DNA, 22 bp, Artificial
  Mmd_496; mouse mmHP2299700_probe14 sequence
gcagagtggctgacccgggatg

SEQ ID NO: 1643 - DNA, 22 bp, Artificial
  Mmd_497; mouse cand451_probe7 sequence
agcctgggctaagatgcagtaa

SEQ ID NO: 1644 - DNA, 22 bp, Artificial
  Mmd_498; mouse cand145_probe42 sequence
gcagggaggaaaggtggccgct

SEQ ID NO: 1645 - DNA, 22 bp, Artificial
  Mmd_502; mouse brain 13_F04 sequence
ctcacagctctggtccttggag

SEQ ID NO: 1646 - DNA, 20 bp, Artificial
  Mmd_502; mouse brain 69_K13 sequence
ctcacagctctggtccttgg

SEQ ID NO: 1647 - DNA, 22 bp, Artificial
  Mmd_508; mouse cand801_probe10 sequence
acagatgggtaatacccagaaa

SEQ ID NO: 1648 - DNA, 18 bp, Artificial
  Mmd_50; mouse brain 58_N11np sequence
tgtgtcttagcttggttg

SEQ ID NO: 1649 - DNA, 22 bp, Artificial
  Mmd_512; mouse mmHP668435_probe3 sequence
cttgcctttgatgtgaggcaag

SEQ ID NO: 1650 - DNA, 20 bp, Artificial
  Mmd_514; mouse brain 11_B21 sequence
gcactgagatgggagtggtg

SEQ ID NO: 1651 - DNA, 20 bp, Artificial
  Mmd_514; mouse brain 34_M13 sequence
cacagctcccatctcagaac

SEQ ID NO: 1652 - DNA, 21 bp, Artificial
  Mmd_514; mouse brain 78_H11np sequence
gcactgagatgggagtggtgt

SEQ ID NO: 1653 - DNA, 22 bp, Artificial
  Mmd_520; mouse cand627_probe2 sequence
cagctgatggatcacaaatctc

SEQ ID NO: 1654 - DNA, 22 bp, Artificial
  Mmd_521; mouse mmHP1528040_probe19 sequence
gacagtcaggagctgtggaagc

SEQ ID NO: 1655 - DNA, 22 bp, Artificial
  Mmd_528; mouse mmHP166179_probe15 sequence
cgcgagtagcgatgaggagctc

SEQ ID NO: 1656 - DNA, 22 bp, Artificial
  Mmd_531; mouse mmHP141642_probe4 sequence
agctagcgtgggcagttctttt

SEQ ID NO: 1657 - DNA, 22 bp, Artificial
  Mmd_53; mouse mmHP3172562_probe11 sequence
ttgagtgtcaaaagttggagtt

SEQ ID NO: 1658 - DNA, 22 bp, Artificial
  Mmd_55; mouse brain 105_K22 sequence
tgttgagcccagcctgccctgc

SEQ ID NO: 1659 - DNA, 22 bp, Artificial
  Mmd_57; mouse mmHP1485966_probe13 sequence
cccagaaacgcaaaggacagtg

SEQ ID NO: 1660 - DNA, 22 bp, Artificial
  Mmd_61; mouse mmHP2157333_probe14 sequence
tgaagttgcttgagtttcagta

SEQ ID NO: 1661 - DNA, 22 bp, Artificial
  Mmd_62; mouse cand398_probe5 sequence
cgaggtgatgatggaggcttct

SEQ ID NO: 1662 - DNA, 22 bp, Artificial
  Mmd_63; mouse cand457_probe32 sequence
ggccagtgtggtttctgtcctc

SEQ ID NO: 1663 - DNA, 22 bp, Artificial
  Mmd_64; mouse cand789a_probe20 sequence
atgtcaccagaactctccatgg

SEQ ID NO: 1664 - DNA, 20 bp, Artificial
  Mmd_65; mouse brain 13_L04np sequence
gtagcaggttgtgtggtttt

SEQ ID NO: 1665 - DNA, 22 bp, Artificial
  Mmd_66; mouse cand938_probe28 sequence
catgagagtgatgcagggaatg

SEQ ID NO: 1666 - DNA, 18 bp, Artificial
  Mmd_72; mouse brain 79_E14np sequence
ttcttgtcatgttcttcc

SEQ ID NO: 1667 - DNA, 22 bp, Artificial
  Mmd_73; mouse cand715_probe23 sequence
atggatgaggggctgcggctcg

SEQ ID NO: 1668 - DNA, 22 bp, Artificial
  Mmd_77; mouse cand483_probe2 sequence
aaactgttatttaaagcagggt

SEQ ID NO: 1669 - DNA, 22 bp, Artificial
  Mmd_77; mouse cand483_probe21 sequence
gtgtttttaaaactcaggatgg

SEQ ID NO: 1670 - DNA, 23 bp, Artificial
  Mmd_79; mouse brain 100_J16 sequence
tgacacctgccacccagcccaag

SEQ ID NO: 1671 - DNA, 21 bp, Artificial
  Mmd_79; mouse brain 105_A12np sequence
tgacacctgccacccagccca

SEQ ID NO: 1672 - DNA, 20 bp, Artificial
  Mmd_79; mouse brain 114_E09 sequence
tgacacctgccacccagccc

SEQ ID NO: 1673 - DNA, 22 bp, Artificial
  Mmd_79; mouse brain 70_D05 sequence
gacacctgccacccagcccaag

SEQ ID NO: 1674 - DNA, 22 bp, Artificial
  Mmd_83; mouse mmHP2052148_probe11 sequence
actgtaggagggctgacagcat

SEQ ID NO: 1675 - DNA, 22 bp, Artificial
  Mmd_84; mouse cand6_probe6 sequence
ggagagatgctgggggtggggg

SEQ ID NO: 1676 - DNA, 21 bp, Artificial
  Mmd_86; mouse brain 103_B05np sequence
gtgggcctgacgtggagctgg

SEQ ID NO: 1677 - DNA, 22 bp, Artificial
  Mmd_86; mouse brain 117_K04 sequence
cgtgggcctgacgtggagctgg

SEQ ID NO: 1678 - DNA, 20 bp, Artificial
  Mmd_86; mouse brain 30_D11 sequence
tgggcctgacgtggagctgg

SEQ ID NO: 1679 - DNA, 22 bp, Artificial
  Mmd_86; mouse brain 61_L02np sequence
agcaccacgtgtctgggccacg

SEQ ID NO: 1680 - DNA, 20 bp, Artificial
  Mmd_86; mouse brain 82_N13np sequence
gtgggcctgacgtggagctg

SEQ ID NO: 1681 - DNA, 23 bp, Artificial
  Mmd_86; mouse brain 86_J05np sequence
agcaccacgtgtctgggccacgt

SEQ ID NO: 1682 - DNA, 20 bp, Artificial
  Mmd_86; mouse brain 86_O04 sequence
cgtgggcctgacgtggagct

SEQ ID NO: 1683 - DNA, 22 bp, Artificial
  Mmd_87; mouse mmHP1815876_probe21 sequence
tgatggcactttggacatgacc

SEQ ID NO: 1684 - DNA, 22 bp, Artificial
  Mmd_88; mouse cand279_probe13 sequence
cctggcagcgttgccatggaga

SEQ ID NO: 1685 - DNA, 25 bp, Artificial
  Mmd_89; mouse brain 51_M21 sequence
gtctagtctgccaactcctctacag

SEQ ID NO: 1686 - DNA, 22 bp, Artificial
  Mmd_99; mouse mmHP1974380_probe11 sequence
atttattttgttctcatgagaa

SEQ ID NO: 1687 - DNA, 87 bp, Artificial
  Hairpin sequence HS_1, human
acaaaacaggcgaaagccctcgtgttgcagtgctaggccaagggggagccaggcctggccctgggatgctggggagccatgggctgt

SEQ ID NO: 1688 - DNA, 83 bp, Artificial
  Hairpin sequence HS_10, human; HSbrain_1174, human
gcacagagttatactggagatatggaagagctgtgttgggtataagtaacaggcttttctttatcttctatgtggctctttgc

SEQ ID NO: 1689 - DNA, 76 bp, Artificial
  Hairpin sequence HS_100, human
tcttgatcccaccgctgccaaaaggggtaaggattcaccccttgctaccttttcagaatgtggaccatgatggaga

SEQ ID NO: 1690 - DNA, 102 bp, Artificial
  Hairpin sequence HS_101, human; HS_102, human
gggacccgattcaggagtgagggagagcaggggtggaggtgtcagagcgaagtctgactgctgatcctgtctgttctccccaggttgctcttgttctctcct

SEQ ID NO: 1691 - DNA, 89 bp, Artificial
  Hairpin sequence HS_103, human
ccaggtctgatggcccagatggcaaccactgcagctggcgtggctgtgggctctgctgtggggcacatactgggtcatgccattactgg

SEQ ID NO: 1692 - DNA, 68 bp, Artificial
  Hairpin sequence HS_104, human
ggcttccgccccgcagccccgaggggtctgggcgcgctgaagaccccttcggctgctgggccaacgcc

SEQ ID NO: 1693 - DNA, 106 bp, Artificial
  Hairpin sequence HS_105, human
ggtcttttacgtcggccttcgcgagcgtctgggcgggtggtaggtgagtgggtattgcgggctagtatccgagcaaaagatggtggcgcaggccgagttaagagct

SEQ ID NO: 1694 - DNA, 106 bp, Artificial
  Hairpin sequence HS_106, human
ccaccaacctgtgggaaggcaggtggactccagcagtaggtaggtaacatccaaggtagccatacacagctggtgtttgtgaatctgcacttcccctgggcaatgg

SEQ ID NO: 1695 - DNA, 61 bp, Artificial
  Hairpin sequence HS_107, human; PT_from_HS_107, chimp
ctttcgcgctctggctgggtgagtggcagaaaaagccactgatctcggtcgagcaagacag

SEQ ID NO: 1696 - DNA, 118 bp, Artificial
  Hairpin sequence HS_108, human
ttctctcccaccgtcactgcaagatcagaactggctgaggggcacaggtggagaagccagagctccacctgagggctactcctgaggtagtaggtggtgtgcaggatgtggagcagag

SEQ ID NO: 1697 - DNA, 93 bp, Artificial
  Hairpin sequence HS_109, human
aggcggttaagccatgggacagggccgcagatggagactgctcaaggtcaaaggggtctccagctgggaccctgcacctggttcgtagcccct

SEQ ID NO: 1698 - DNA, 116 bp, Artificial
  Hairpin sequence HS_11, human
gtctgtctacactggctgggccagtgtgtggtgcaggcagtctgtctacactggtggggccagtgcatggggcaggcagtccgcctacactgacggagccagcacgtgggtcaggc

SEQ ID NO: 1699 - DNA, 109 bp, Artificial
  Hairpin sequence HS_110, human
ttgcgtcacaatgacctggcggacaggtgggagccacagcgtacaccccagggttccctctgtgctgtgcgtagtgcctactgcttgcttccaggttaaatttctgtag

SEQ ID NO: 1700 - DNA, 79 bp, Artificial
  Hairpin sequence HS_111, human
ctgtgacgtcacgaggctccacctcccgcgaggctttgtgtcggctgggcctggagcgagggtggaggttggcgggcgg

SEQ ID NO: 1701 - DNA, 84 bp, Artificial
  Hairpin sequence HS_112, human; PT_from_HS_112, chimp
gggccagaggcaggcaggggaactccaggagagctgcctcaggaagcactgcagtcctccggcccttcctcccctgcctggccc

SEQ ID NO: 1702 - DNA, 93 bp, Artificial
  Hairpin sequence HS_113, human; HS_from_PT_226, human; HSbrain_1413, human; PT_226, chimp; PT_from_HS_113, chimp; PT_from_HSbrain_1413, chimp
cagacggcagctgcggcctagcccccaggcttcacttggcgtggacaacttgctaagtaaagtggggggtgggccacggctggctcctacctg

SEQ ID NO: 1703 - DNA, 102 bp, Artificial
  Hairpin sequence HS_114, human; HS_118, human
gggcagaggtgggacagtgggctgggaggtggcgaggaggccctttattgaggggccagcttagatcccccagccccaaggtcctctgtcctccccctcccc

SEQ ID NO: 1704 - DNA, 79 bp, Artificial
  Hairpin sequence HS_115, human; MM_from_HS_115, mouse; MQ_from_HS_115, macaque; PT_from_HS_115, chimp
agctgaatagaaagaatgtggaagtggtctgaggcatatagagtatatgccaagaacactaccatatatggcatcagct

SEQ ID NO: 1705 - DNA, 69 bp, Artificial
  Hairpin sequence HS_116, human; PT_from_HS_116, chimp
gtctccagtgggcgtcttgggccccggctctattctgggctgcgggcctgggaagggctcgccgggtgc

SEQ ID NO: 1706 - DNA, 67 bp, Artificial
  Hairpin sequence HS_117, human
gtcgggcggagggggcggccccacggtgccaccgcaccaagaggccgcctctggggagctccgcggc

SEQ ID NO: 1707 - DNA, 92 bp, Artificial
  Hairpin sequence HS_119, human; PT_from_HS_119, chimp
atgcgggtgctagggctggggcttgggaggacaaaggactggctgaggggacagcagctctgtcaggcctgggttcccccagcacctcggat

SEQ ID NO: 1708 - DNA, 64 bp, Artificial
  Hairpin sequence HS_12, human
tggccggggagggacgctgctcagctgctgctctgctcctgtctcctgtcccctcccccggtca

SEQ ID NO: 1709 - DNA, 70 bp, Artificial
  Hairpin sequence HS_120, human
tgcgctcactgcccagccggggccccgggagcctccaggctcccgcccgccctgagctgcggcctccgca

SEQ ID NO: 1710 - DNA, 119 bp, Artificial
  Hairpin sequence HS_121, human
cctgcattttcacatccccatctccacacccctggtgattcttatgcatataataatgtgaaaagcattgcattgaagaattgctaaagggtgtcagaaaacggattaacaaaatcagg

SEQ ID NO: 1711 - DNA, 98 bp, Artificial
  Hairpin sequence HS_122, human; HSbrain_1262, human
acttctgctttttgtgtgtgaaattaggtagtggcagtggaacactatattaatcaggtttccactgccactacctaatttctcagatggaaatgagt

SEQ ID NO: 1712 - DNA, 96 bp, Artificial
  Hairpin sequence HS_123, human
tgccccggtgcggtgcagccgcggatggatgctgcgggaaggggctgccatttgctgcccctgccagcggcgcgcggacctgcccgcgctcctgca

SEQ ID NO: 1713 - DNA, 96 bp, Artificial
  Hairpin sequence HS_124, human
atggggtaacaaaaagaacatgggttgagccagacaggtctgggtctgtgggacctcagataaagcacataacccgttggggcttggttttcccat

SEQ ID NO: 1714 - DNA, 88 bp, Artificial
  Hairpin sequence HS_125, human; HSbrain_1431, human; PT_from_HS_125, chimp; PT_from_HSbrain_1431, chimp
ctgcacctctgccttgggggtggggggatagaggcatggaataggtgctctgacctctgaccctctagcccagggagaaggtgagcag

SEQ ID NO: 1715 - DNA, 67 bp, Artificial
  Hairpin sequence HS_126, human; HSbrain_1263, human
gccagcagtcgtccccgccctgcttcaaacatttgggtttcaggagccgggcggaggtgactgccgc

SEQ ID NO: 1716 - DNA, 118 bp, Artificial
  Hairpin sequence HS_127, human
gacttggatttctttggaagaaactgctgaagctgccatgtctaagaagaaaactttggagaaaaattttcttcttagacatggcaacgtcaacagtttctaagctcttgattccgtc

SEQ ID NO: 1717 - DNA, 70 bp, Artificial
  Hairpin sequence HS_128, human
tttccgccccctttccagctcccttcctcccgggtggacaggtcggaagaggagcggaaaggaaaggaag

SEQ ID NO: 1718 - DNA, 93 bp, Artificial
  Hairpin sequence HS_129, human
ggagtccaaaggagtgtttgcggggagggcccgaggtcgctgtgtccggggcagagcggccggttcgtcccgagtctgcgctctttcgggtcc

SEQ ID NO: 1719 - DNA, 94 bp, Artificial
  Hairpin sequence HS_13, human; HSbrain_1400, human
acgtggtgacgggtggcgaagatgacctggtcaccgtgtggtccttcaccgagggccgcgtggtggctcgaggccatggccacaagtcctgggt

SEQ ID NO: 1720 - DNA, 86 bp, Artificial
  Hairpin sequence HS_130, human
gtaacgccttttgactcatccggttcttggaccaggacgctgtcttgctctgtaagccagggagagattttattaggctattttac

SEQ ID NO: 1721 - DNA, 111 bp, Artificial
  Hairpin sequence HS_131, human
gcagctgcctgtgagcgcgagcctctttcggctttccagtttgtctcggtcctttggaacgtggcaaacgtggaagccgagagggctctcgcgagcgttggcagaccccgc

SEQ ID NO: 1722 - DNA, 93 bp, Artificial
  Hairpin sequence HS_132, human
tcttggaacatccactacaggctgtgtggagccttccctctgtgaagttgctggtctgtgagggtggccacgctgcgctggggtggggagggg

SEQ ID NO: 1723 - DNA, 107 bp, Artificial
  Hairpin sequence HS_133, human
ctgccgggagggagggtaagtgtgtgtcccagaggaggcgaggaggaagaggggctcttgtgttctttcgctcggattcccctggggcagccctaattatttggcgg

SEQ ID NO: 1724 - DNA, 109 bp, Artificial
  Hairpin sequence HS_134, human; HSbrain_1269, human; PT_from_HS_134, chimp; PT_from_HSbrain_1269, chimp
ggtgtgattgcggcagttccttcccgcatctgggccttgccatctctctctccgagtggacatggagaggacgggggcccagcagctggatggctgcagggatcaagtc

SEQ ID NO: 1725 - DNA, 101 bp, Artificial
  Hairpin sequence HS_135, human
gggccgtggtggcctgcccagaccagccaggagccaggctggggccaacttagcactcagcatggcttgtgatgggtgggtggtgggctgggctcaggcct

SEQ ID NO: 1726 - DNA, 117 bp, Artificial
  Hairpin sequence HS_136, human; HSbrain_1414, human; PT_314, chimp; PT_from_HSbrain_1414, chimp
ccagctgggttttctgggtatgtgggcagggccctggggagctgaggctctgggggtggccggggctgaccctgggcctctgctccccagtgtctgaccgcgaccgcaacctcatgg

SEQ ID NO: 1727 - DNA, 93 bp, Artificial
  Hairpin sequence HS_137, human
ttccatgttagtattcctggattcctaacctttcacacgtgcagccatcactgtgggaacactgaggacttcaggaatggctcttgacaggag

SEQ ID NO: 1728 - DNA, 105 bp, Artificial
  Hairpin sequence HS_138, human
gggaaacaagggcagcgggagaaacggcccggaaagggacgaagaggcttccagctttcgccaagtcgcggctcccagtttttccctgggcctccttcctttccc

SEQ ID NO: 1729 - DNA, 87 bp, Artificial
  Hairpin sequence HS_139, human
gaacgctcggtgagaggcggaggagcggtaactaccccggctgcgcacagctcggcgctccttcccgctccctcacacaccggcctc

SEQ ID NO: 1730 - DNA, 57 bp, Artificial
  Hairpin sequence HS_14, human
ccatggaggccctgggcggctcgagccagtcttcaggccgaatctcccgcctccagg

SEQ ID NO: 1731 - DNA, 56 bp, Artificial
  Hairpin sequence HS_140, human
gactgttcacatgtacaggcagcattagcatttcctgcctgtacatgtgaacgttc

SEQ ID NO: 1732 - DNA, 105 bp, Artificial
  Hairpin sequence HS_141, human; HSbrain_1419, human
ggttgccaaccctactctgggaaggtgccattctgagggccaggagtttgattatgtgtcactctggctgctatggccccctcccagggtctgggtatcacaccc

SEQ ID NO: 1733 - DNA, 87 bp, Artificial
  Hairpin sequence HS_142, human; HSbrain_1426, human
cactagcccagggcttggagtggggcaaggttgttggtgatatggcttcctctcccttcctgccctggctaggccctggagcgactg

SEQ ID NO: 1734 - DNA, 55 bp, Artificial
  Hairpin sequence HS_143, human; MQ_from_HS_143, macaque; PT_from_HS_143, chimp
gaggcgcgaggcggtctccgcggagggacctccgagggggagccattgctgcctc

SEQ ID NO: 1735 - DNA, 114 bp, Artificial
  Hairpin sequence HS_144, human; PT_from_HS_144, chimp
gactccagctcacattggctgctcagagatactggggatcccagtctcttcttatctgaatgagaccttctgggatttccatcagctaatctctggcaaatctgtggcttggtc

SEQ ID NO: 1736 - DNA, 90 bp, Artificial
  Hairpin sequence HS_145, human
agcggtggccaggaagacaggatgccagcacccaagggcactgacttccatccagcccaggtgtcttccattctgtccccctgcctccct

SEQ ID NO: 1737 - DNA, 89 bp, Artificial
  Hairpin sequence HS_146, human
tgcagcctgggcctgctgaacacttgagggtcgggggttctcaggaaatccctgagagctcaaaggatggcctgaggggcctggtggca

SEQ ID NO: 1738 - DNA, 108 bp, Artificial
  Hairpin sequence HS_147, human; PT_from_HS_147, chimp
gcgcgggcgagtgtgcctgcagcgcggtgctgggcggccggtgccgcgcgctcttctggtgggcgcgcaggccggccagctgcgagtaggcgctctggcacacctggc

SEQ ID NO: 1739 - DNA, 101 bp, Artificial
  Hairpin sequence HS_148, human; HSbrain_1247, human
ctgggcctccttagggccctggctccatcctgcagatgaggagctctggaaaagggcaaagtcccggaggctgaggagtggggcgggctccaagtgtccag

SEQ ID NO: 1740 - DNA, 69 bp, Artificial
  Hairpin sequence HS_149, human
tccgcgcctgccccgttgctttcctcaggctctaaggcccgcggtgtggagcgcggcgtaggcagcggg

SEQ ID NO: 1741 - DNA, 76 bp, Artificial
  Hairpin sequence HS_15, human
cgggaagcggatcgcgtggagtgaaagtcaccgcagcggtgagttttgctctgtgttgtgttatgtctgcgctccg

SEQ ID NO: 1742 - DNA, 94 bp, Artificial
  Hairpin sequence HS_150, human
cagcccctcctccacggtccgctctgtggagtggggtgcctgtcccctgccactgggtgacccacccctctccaccagcttctggaagcggctg

SEQ ID NO: 1743 - DNA, 61 bp, Artificial
  Hairpin sequence HS_151, human
gggttgtagtagcccgtaggggcctacaacgttggggcctttgcgtagttgtatatagcct

SEQ ID NO: 1744 - DNA, 90 bp, Artificial
  Hairpin sequence HS_152, human
gggtggggcccgcgcgtataaagggggcgcaggcgggctgggcgttccacaggccaagtgcgctgtgctcgaggggtgccggccaggcct

SEQ ID NO: 1745 - DNA, 68 bp, Artificial
  Hairpin sequence HS_153, human
cccctggctgccttgtgttgatctctggcctaggtaatgaccagaaatctcactggcaggcaggcagg

SEQ ID NO: 1746 - DNA, 85 bp, Artificial
  Hairpin sequence HS_154, human
ggggaggtagggaaaaggaagggggaggagaaggtgagaccaatgtcctgggtgccactcctgcccagtgcctcccttcctcgtt

SEQ ID NO: 1747 - DNA, 100 bp, Artificial
  Hairpin sequence HS_155, human
ccactggtgctgctccccgcaggggtggccgggctcgggaaccgcgaggccacgccacgccggggctcggccaccctccagccgcagcgggcgctcaggg

SEQ ID NO: 1748 - DNA, 117 bp, Artificial
  Hairpin sequence HS_156, human
ctaataaaccttaagagttccttttaagtgatcaattttcccatacatggcagaggcaaaagtttgcagctgccatgggaagaggatgatcagaagggactcctaaggttactgtag

SEQ ID NO: 1749 - DNA, 93 bp, Artificial
  Hairpin sequence HS_157, human; HSbrain_1416, human
gggcctttctggaggaagtggggcaagaaggaggatggagagctgggccagacatgctcttgcctgccctcttcctccaggtatcggtatacc

SEQ ID NO: 1750 - DNA, 84 bp, Artificial
  Hairpin sequence HS_159, human
ccaggcctttttgctcccccaccgccccccctccacccttgcttcttggcagggagaagggctgggagggagaagaaattctgg

SEQ ID NO: 1751 - DNA, 104 bp, Artificial
  Hairpin sequence HS_16, human; HSbrain_1401, human
gcaagaagatctcaagctgtgagtctacaaaggaaagcgctttctgttgtctgaaagaaaagaaatcgcttccctttggagtgttacggtttgagaaaagcagc

SEQ ID NO: 1752 - DNA, 119 bp, Artificial
  Hairpin sequence HS_160, human; HSbrain_1286, human
cttcatatcagattctcacctgaacgcatgactcttcaacctcaggacttgcagaattaatggaatgctgtcctaaggttgttgagttgtgcatttctgggcatttcatctctatgggg

SEQ ID NO: 1753 - DNA, 102 bp, Artificial
  Hairpin sequence HS_161, human; PT_from_HS_161, chimp
gtaggacttaatagggtgcatcacaacctgaaaaaagtatagcaactgtttctgtctgtataaaatgaaggtagtaggattgtagtagggattaagtcctat

SEQ ID NO: 1754 - DNA, 87 bp, Artificial
  Hairpin sequence HS_162, human
agtatgtggggaaaatgggtgggttgatgaggccaagctgacaagtcaggcatcaaatctagacccacaatatgttcccaaaacact

SEQ ID NO: 1755 - DNA, 86 bp, Artificial
  Hairpin sequence HS_163, human; HSbrain_1407, human; PT_323, chimp; PT_from_HSbrain_1407, chimp
cgtgaccttgcccgggagaaggaggtggcctggagagctgctgtctccagccgccgcctgtctccacagtatggcaagaagaaacg

SEQ ID NO: 1756 - DNA, 69 bp, Artificial
  Hairpin sequence HS_164, human
ggtggattcccagggactgtcggaggtgtggactctgcctgcctacctggtctgggaagatgttctacc

SEQ ID NO: 1757 - DNA, 119 bp, Artificial
  Hairpin sequence HS_165, human; PT_from_HS_165, chimp
gcggggccgcgcccaccgccgccacccccaggagcgctggcggctggagtacctcatggagttggacggcggccggcgcggcctggtgtgcggggtgtgcgggggcgcgctggcctcgc

SEQ ID NO: 1758 - DNA, 78 bp, Artificial
  Hairpin sequence HS_166, human
ctgacttctgcgcggggcgcggtggggttctgcggggtcggaaagactccccagatccccgcgcggccccagacccag

SEQ ID NO: 1759 - DNA, 118 bp, Artificial
  Hairpin sequence HS_167, human
tctctactccctcagcttgctctgctaccactttcctgtctctccctctcccaaagcagataaaagatgaggggacaaagacagtgtgtgtctgggaagctgggctgagaggaggagg

SEQ ID NO: 1760 - DNA, 108 bp, Artificial
  Hairpin sequence HS_168, human
ttctggcttccccagaccacagaactgtccttgagggccccctgccttggatgtggctttgaaggccagccgggggtgatttgagaaggtggatgggggaagagagaa

SEQ ID NO: 1761 - DNA, 88 bp, Artificial
  Hairpin sequence HS_169, human; PT_from_HS_169, chimp
ggggctgtagtggtgccagatgagtgagctaaggctctgggccacttggccctggccctctctcctccatctccacctgccctgccct

SEQ ID NO: 1762 - DNA, 74 bp, Artificial
  Hairpin sequence HS_17, human
ggttccattcggttctcccaccgaccccgctgtgggtctcagcagctcgggcggcgggaggagccgcagccgcc

SEQ ID NO: 1763 - DNA, 76 bp, Artificial
  Hairpin sequence HS_170, human; PT_from_HS_170, chimp
cgccccccaccggcccgaccctcactccgacccggccaccagtgttgtgggggaggaggaaggacctgtgcgagcg

SEQ ID NO: 1764 - DNA, 73 bp, Artificial
  Hairpin sequence HS_171, human; HSbrain_1298, human; PT_306, chimp; PT_from_HSbrain_1298, chimp
ggggaacaggggcaggatgggggtgggagtcctgatggcagacactcaggcccctgtctgccccaggtacttc

SEQ ID NO: 1765 - DNA, 114 bp, Artificial
  Hairpin sequence HS_172, human; HSbrain_1417, human; PT_281, chimp; PT_from_HSbrain_1417, chimp
gagagacgaggagttaagagttcattcggctgtccagatgtatccaagtaccctgtgttatttggcaataaatacatctgggcaactgactgaacttttcacttttcatgactc

SEQ ID NO: 1766 - DNA, 92 bp, Artificial
  Hairpin sequence HS_173, human
ctgcctggaccctgccctgcctccaccccgcctggcctgacccagccagggctctaggagggttgggtggaggcaaagtggggagaagggag

SEQ ID NO: 1767 - DNA, 90 bp, Artificial
  Hairpin sequence HS_174, human; PT_from_HS_174, chimp
gggcagggcagcttcacctggctctgcagctcctgagcctgggtgggctaacctgggccaggagtagggaggtgggtcctgccactgccc

SEQ ID NO: 1768 - DNA, 83 bp, Artificial
  Hairpin sequence HS_175, human
agacatcactccatcagccttctctggcctgtctcctgcagccccaccgctgcactgaagcccagggctgtggagcagcctct

SEQ ID NO: 1769 - DNA, 93 bp, Artificial
  Hairpin sequence HS_176, human; PT_from_HS_176, chimp
gagtcgctttttcctgcctcccaggctgcccagcggcgccggttgccggggaacgcaggcgccgtggggagggatggcgggaggatactgctt

SEQ ID NO: 1770 - DNA, 82 bp, Artificial
  Hairpin sequence HS_177, human; PT_from_HS_177, chimp
gtcacatctagccggcttagccaaagtacaggtgtatatagttcagggcacttgatttagatttggaggggctggggtgggc

SEQ ID NO: 1771 - DNA, 114 bp, Artificial
  Hairpin sequence HS_178, human
tgagaacgaacttgagaaataaggcttctgtctactactggagacactggtagtataaaacccagagtctccagtaatggacgggagccttatttctatcactcagtgttttca

SEQ ID NO: 1772 - DNA, 89 bp, Artificial
  Hairpin sequence HS_179, human
tgaggtagtagtttgaatgggatttggacgggaggcatagttgtctctccttccctccctccctcccctatatccatttctctgcctta

SEQ ID NO: 1773 - DNA, 63 bp, Artificial
  Hairpin sequence HS_18, human; PT_from_HS_18, chimp
aggggaggctgagggaggagtggggacttttgagacaagccctgactcctggggcgctcccct

SEQ ID NO: 1774 - DNA, 117 bp, Artificial
  Hairpin sequence HS_180, human
gagtctacaaatgttgtctccttaatccttgcaacgaacctgagccactgattcagtaaaatactcagtggcacatgtttgttgtgagggtcaaaagagataatctctacaggcctc

SEQ ID NO: 1775 - DNA, 78 bp, Artificial
  Hairpin sequence HS_181, human; PT_from_HS_181, chimp
gcctgtctgctgctgagtgattcagggagaacatgtgtgcacgtgcatgtgtgtttgcccacaccggtgacacggggc

SEQ ID NO: 1776 - DNA, 78 bp, Artificial
  Hairpin sequence HS_182, human
gtggacaaccctagggtggggctggaggtggggctgaggctgagtcttcctccccttcctccctgcccaggggtccac

SEQ ID NO: 1777 - DNA, 79 bp, Artificial
  Hairpin sequence HS_183, human
accccccggaggaaccgccaacagcgccccggcaccatcaagcatggatcggcgctggacgtgctcctctccatggggt

SEQ ID NO: 1778 - DNA, 115 bp, Artificial
  Hairpin sequence HS_184, human
tggggctggggatagagggcccagaagggggcgcagtcactgacgtgaagggaccacatcccgcttcatgtcagtgactcctgccccttggtcttcagtgtttttctcttcccca

SEQ ID NO: 1779 - DNA, 117 bp, Artificial
  Hairpin sequence HS_185, human
gaagagcgagcaggggagagcgagaccagttttaaggggaggaccggtgcgagtgaggcagccccgaggctctgctcgcccaccacccaatcctcgcctcccttctgctccaccttc

SEQ ID NO: 1780 - DNA, 93 bp, Artificial
  Hairpin sequence HS_186, human
ggggctcctgggaagggcctggctcctcccgcagctgttcctttgctcccttgggcagagaagctggcgttcggagccagcctttccagcctc

SEQ ID NO: 1781 - DNA, 118 bp, Artificial
  Hairpin sequence HS_187, human
gccctccctgccctcctgcccctcccaggcaaccccagcctgtctcaccaagggcctcccccacggcatgggcaacagtctggggccgcctgggggtggggaaggtgctgcagatggc

SEQ ID NO: 1782 - DNA, 96 bp, Artificial
  Hairpin sequence HS_188, human; MQ_from_HS_188, macaque; PT_from_HS_188, chimp
gctctggggcgtgccgccgccgtcgctgccacctcccctaccgctagtggaagaagatggcggaaggcggagcggcggatctggacacccagcggt

SEQ ID NO: 1783 - DNA, 93 bp, Artificial
  Hairpin sequence HS_189, human
catgctcaagagcaaaagcaaatgttgggtgaacggctgtttcctcttattcaagccatgcaccttactcttgctggtaaaatcactggcatg

SEQ ID NO: 1784 - DNA, 113 bp, Artificial
  Hairpin sequence HS_19, human
ccctcagagcctggcgagggggcgtggcccagccaggagggcgggagaggcagtgaagatcttccctcagagcctggcgagggggcgcggcccagccaggagagctggagagg

SEQ ID NO: 1785 - DNA, 84 bp, Artificial
  Hairpin sequence HS_190, human; PT_from_HS_190, chimp
ggtgacgggtggccgtgctgggggcgggagggcttctgtggtaggaagggaggtccgctcggccgggtgcgccgccccagtgct

SEQ ID NO: 1786 - DNA, 113 bp, Artificial
  Hairpin sequence HS_191, human; HSbrain_1422, human; MQbrain_2671, macaque; PT_from_HSbrain_1422, chimp
gagcgtccatgggtcagctatgtggactctagctgccaaaggcgcttctccttctgaacagagcgctttgctcagccagtgtagacatggcctgataaacaatggaacttctc

SEQ ID NO: 1787 - DNA, 119 bp, Artificial
  Hairpin sequence HS_192, human; HS_from_PT_7, human; PT_7, chimp; PT_from_HS_192, chimp
catgtaagagaaatatacctgcatgttagtctaacgttctgatagaaatgacatgcatttatgctgccatttgttactatcaggactcgactcgtgtgcggacatttctgttaataatg

SEQ ID NO: 1788 - DNA, 72 bp, Artificial
  Hairpin sequence HS_193, human
tggcgcccgcggcggccgtggcggcctgagcgtgatgctccgggttctcggcggcggctgtggccttggccg

SEQ ID NO: 1789 - DNA, 74 bp, Artificial
  Hairpin sequence HS_194, human
cgtttgtgggggcgggagctggggtctgcaggttcgcactgatgcctgctcgccctgtctcccgctagctgatg

SEQ ID NO: 1790 - DNA, 109 bp, Artificial
  Hairpin sequence HS_195, human
tgctctggttgctttgctttgagattctctcagcgattcaaaaacacaaaagcaaggcagtggttgtgtttgggaaggtgagggaagagagagaatggaacagtaagca

SEQ ID NO: 1791 - DNA, 89 bp, Artificial
  Hairpin sequence HS_196, human
ggaggacaaagaggaggaggaggaggatcaggcctccccggtaccatctccctctgcaaaggcccctccctcctgcccccaacccctct

SEQ ID NO: 1792 - DNA, 113 bp, Artificial
  Hairpin sequence HS_197, human
gtaactccggggtcgcggatctgcccgccccgctctcccgaagctgttcgggcagtgtccgaacggcttcggaggggcgagaagccagcatccgagccgcctctccggaatac

SEQ ID NO: 1793 - DNA, 87 bp, Artificial
  Hairpin sequence HS_198, human; PT_from_HS_198, chimp
gcctgaaacagtgcagggagaaggtggaagtgcagagtgggctcacctctcgcccacactgtccccttctccccagcgagctgaggc

SEQ ID NO: 1794 - DNA, 104 bp, Artificial
  Hairpin sequence HS_199, human; PT_from_HS_199, chimp
acatatttcataaacatatgttcatgcactccaaaaatgtcccatggttttgccttaccatgggacatttttggttggcagtagcgtgggtgggtgcggtgggt

SEQ ID NO: 1795 - DNA, 114 bp, Artificial
  Hairpin sequence HS_2, human; HSbrain_1168, human
ccagtggagaggagagccgggagggagagctgggaggcggtcggttctgagtcatcccagcctatgtcacttctcagaaacctccgccacccccccccccatcccggccactgg

SEQ ID NO: 1796 - DNA, 88 bp, Artificial
  Hairpin sequence HS_20, human
cgggtcgcctcccaacccgcgttgtcctcgcgccttcgccctgggtaggtgaggccgagaaggcaaccgcgaaaaggaggcggaaacg

SEQ ID NO: 1797 - DNA, 83 bp, Artificial
  Hairpin sequence HS_200, human; HSbrain_1325, human
ctaccgggttctcctggggagtggctggggagcagacagacccaacctcatgctccccggcctctgcccccagctcccggtgg

SEQ ID NO: 1798 - DNA, 100 bp, Artificial
  Hairpin sequence HS_201, human; PT_from_HS_201, chimp
tagggggctgtggtttgccagggcaggaggtggaagggagccccatttacagtggtaacttcctttccctttccatcctggcaggcttcagagaacttta

SEQ ID NO: 1799 - DNA, 118 bp, Artificial
  Hairpin sequence HS_202, human
tatttgagaaaggacattgttttgacagataaagtaggcatttgataaattgaaacaggttttgaattattttgagagaatgtgtgctacatctgtctgctgatattccactgaagta

SEQ ID NO: 1800 - DNA, 114 bp, Artificial
  Hairpin sequence HS_203, human
gcccggcggcggcggcacttcagctccaagcggcggcggcggccatgttggccctaatcacgtgatctgccgccgtcgcgcgctgggggtgaaagttcacaatgcggcgggggc

SEQ ID NO: 1801 - DNA, 113 bp, Artificial
  Hairpin sequence HS_204, human; PT_from_HS_204, chimp
cttcctgggtatccaagtaagaaagatatatagttctggaataacaggaaacttcacatttttcacatcctgttattctgggttttgtgacttgctgccttgccactatgaag

SEQ ID NO: 1802 - DNA, 74 bp, Artificial
  Hairpin sequence HS_205, human
tggctctaggccaccctggcagctgggccgcactctgccggcctggacgccggggtcggcctctgattggtcca

SEQ ID NO: 1803 - DNA, 79 bp, Artificial
  Hairpin sequence HS_206, human
ggtcccggaagctggcggagcaggagctgattgagaccagcgagcgggtgcagctgctgcattcccaggtgagggggtc

SEQ ID NO: 1804 - DNA, 92 bp, Artificial
  Hairpin sequence HS_208, human
ctatgccacctgctgagctcctgggtgtcactggagagcctcacactctcctacaatggtgagcaccctggagtggcagggattgggcttag

SEQ ID NO: 1805 - DNA, 119 bp, Artificial
  Hairpin sequence HS_209, human; PT_from_HS_209, chimp
ctgggaaccatggggagtccagctcatctacagagtcatttttattcctggccatggagcccttgaatgccagggtcagggatggctcagttcagccgggccccaaaagagtggaccag

SEQ ID NO: 1806 - DNA, 103 bp, Artificial
  Hairpin sequence HS_21, human
gtagaagttcagaagagggctaggcggagccgagcccacatccgggagaggagagcggaagtggcgttggtctggccggagcccttgggtgaaattgttaggc

SEQ ID NO: 1807 - DNA, 88 bp, Artificial
  Hairpin sequence HS_211, human
gcttccagaagtgcacgctctagcgaggattccaacattgggggaattggcccaatattggaatccccgctagagcgtgcacctaagc

SEQ ID NO: 1808 - DNA, 112 bp, Artificial
  Hairpin sequence HS_212, human; HSbrain_1336, human; PT_329, chimp; PT_from_HSbrain_1336, chimp
tctttgagccactctttggtacttgaagagaggataccctttgtatgttcacttgattaatggcgaatatacagggggagactcttatttgcgtatcaaactctgtcgagga

SEQ ID NO: 1809 - DNA, 113 bp, Artificial
  Hairpin sequence HS_213, human; HSbrain_1337, human
tctttgagccaccctttggtacttaaagagaggataccctttgtatgttcacttgattaatggcgaatatacagggggagactctcatttgcgtatcaaactgtcggagaaga

SEQ ID NO: 1810 - DNA, 118 bp, Artificial
  Hairpin sequence HS_214, human; HS_from_PT_32, human; HSbrain_1338, human; MQ_from_HS_214, macaque; MQ_from_PT_32, macaque; MQbrain_2642, macaque; PT_32, chimp; PT_from_HS_214, chimp; PT_from_HSbrain_1338, chimp
cttcttgatggcacagttctttggtgcttaaagaatggctgtccgtagtatggtctctatatttatgatgattaatatcggacaaccattgttttagtatccaaatttgcttcagaag

SEQ ID NO: 1811 - DNA, 105 bp, Artificial
  Hairpin sequence HS_216, human; HSbrain_917, human
gagctcatgccaacgtcagggaaaggattctgctgtcggtcccactccaaagttcacagaatgggtggtgggcacagaatctggactctgcttgtggcatccatc

SEQ ID NO: 1812 - DNA, 109 bp, Artificial
  Hairpin sequence HS_217, human
gatggctaccatcagggaagagatcagcatctgtgtcagtcttctgtacggctccatgggattaaaggaagcaatgacatcctgatctgttccttgatctttgggcatt

SEQ ID NO: 1813 - DNA, 85 bp, Artificial
  Hairpin sequence HS_218, human
atgctcctttctggcctcccacccacagggcgagtccaagggaagtatggactcgccctatgggtgggagcccaggaaggtgcat

SEQ ID NO: 1814 - DNA, 115 bp, Artificial
  Hairpin sequence HS_219, human
aggcaggggtgggggtgtgtggcagcacggctgatggagggctgtcttgccttgctttacaggttggttttgaccctcaccccccgatgcgggccacaggcctcccctcaagcct

SEQ ID NO: 1815 - DNA, 89 bp, Artificial
  Hairpin sequence HS_22, human
ttcccacacgtgctcaggcccctcaaccaaggaaggcagcaggcccactggcctccttattcagaggggctgcactgcaccctagggag

SEQ ID NO: 1816 - DNA, 73 bp, Artificial
  Hairpin sequence HS_220, human; HS_223, human; HS_225, human; HS_229, human; HS_235, human; HS_237, human
catgggcaccagctccagcatcaccggcagcagacactcccaggcctgccatggtccaggacctggtgtcctg

SEQ ID NO: 1817 - DNA, 105 bp, Artificial
  Hairpin sequence HS_221, human; HS_224, human; HS_226, human; HS_227, human; HS_230, human; HS_236, human; HS_238, human
ggactcgcagacgttactgccctcttgcgtgccccggccacccccgggcggcttgtagccggtgcgcggggtggctggggctacgtgcagagctgtcgcggagcc

SEQ ID NO: 1818 - DNA, 105 bp, Artificial
  Hairpin sequence HS_222, human; HS_233, human; HS_234, human
ggactcgcagacgttactgccttcttgcgtgccccggccacccccgggcggcttgtagccggtgcgcggggtggctggggctacgtgcagagctgtcgcggagcc

SEQ ID NO: 1819 - DNA, 73 bp, Artificial
  Hairpin sequence HS_228, human; PT_from_HS_228, chimp
agtgtgctttgctggccaaggttgggatcctagggttctctgtgatcctagcttgcctgaatgtaaacatcct

SEQ ID NO: 1820 - DNA, 87 bp, Artificial
  Hairpin sequence HS_23, human; PT_from_HS_23, chimp
cagccagagccctatgctgaaaactcacctccagctgtccttcttcagtgcaggcatgcagtttaaagtgcgtgatgctgatggctg

SEQ ID NO: 1821 - DNA, 105 bp, Artificial
  Hairpin sequence HS_231, human; MQ_from_HS_231, macaque; PT_from_HS_231, chimp
gtggggtaaatgtagagagtgtcaatcaaaggcagagctctcagagctgggaaggaggctctagatggcggctgtgccttagagagagcgcgctctgctccctgc

SEQ ID NO: 1822 - DNA, 90 bp, Artificial
  Hairpin sequence HS_232, human
agaacaggaactggagccaggctgaagggtccttaaccattcaaagtgtcagaagtggggaaggtagtcagtttgggtttatcctgcttt

SEQ ID NO: 1823 - DNA, 89 bp, Artificial
  Hairpin sequence HS_239, human
ggcgaaggagctgaggttggccctggcaggtgtgcagtcctcacacagaacgggcagggctcctgtcagagccaaaccagctcagggcc

SEQ ID NO: 1824 - DNA, 70 bp, Artificial
  Hairpin sequence HS_24, human
tccctctgtccccatgtcatgaaggagaaattttgtgatgatgcctcagacagtgaggggagtagagggg

SEQ ID NO: 1825 - DNA, 104 bp, Artificial
  Hairpin sequence HS_240, human
atggcctctccagtctgcagctcccggcagcctcgggccacactcccgggatccccagggactggcctgggactaccgggggtggcggccgtggctctggctat

SEQ ID NO: 1826 - DNA, 99 bp, Artificial
  Hairpin sequence HS_241, human
agttgggggtccaggaggctccagggtgagcccactcctccccctagatacaagggagggccctgggaccctgtctgctgttcctcctggactcctgct

SEQ ID NO: 1827 - DNA, 96 bp, Artificial
  Hairpin sequence HS_242, human
ggtgggctcggctctatcctgagaaggcacagcttgcacgtgacctcctgggcccggcggctgtgtcctcacaggagccgacagcggatgtaaact

SEQ ID NO: 1828 - DNA, 89 bp, Artificial
  Hairpin sequence HS_243, human
agcctgtgggaaagagaagagcagggcagggtgaaggcccggcggagacactctgcccaccccacaccctgcctatgggccacacagct

SEQ ID NO: 1829 - DNA, 82 bp, Artificial
  Hairpin sequence HS_244, human; HS_246, human; HS_247, human; HS_248, human; HS_249, human; HS_277, human; HSbrain_1386, human; HSbrain_1387, human; HSbrain_1388, human; HSbrain_1389, human; HSbrain_1390, human;
cttcagatgccagaagggcagagggaatcccacacgggctggtggatcatgtgtgtgcatttctctcccttctaatctgagg

SEQ ID NO: 1830 - DNA, 96 bp, Artificial
  Hairpin sequence HS_245, human
ggtgggctcggctctatcctgagaaggcacagcttgcacgtgacctcctgggcccggcggctgtgtcttcacaggagccgacagcggatgtaaact

SEQ ID NO: 1831 - DNA, 71 bp, Artificial
  Hairpin sequence HS_25, human
ccgcccccggccccactccaccttcctcccaccccgggaacccggaagtggaggaggaggcgcggcggcgg

SEQ ID NO: 1832 - DNA, 120 bp, Artificial
  Hairpin sequence HS_250, human
gggcctcggcgccaggagcggggctgggggcggcgccatggggcctcgcagccccgatcggcggccgccaggtccctggagccgccgcctccccgctcccggcctcagctgtcgttgtcc

SEQ ID NO: 1833 - DNA, 113 bp, Artificial
  Hairpin sequence HS_251, human; MQ_from_HS_251, macaque; PT_from_HS_251, chimp
cctttggaaataaactccagagtttctttgaaggttggagaaacaatagaatctggaacagttatattctgtgatgttttgccaggaaaagaaagcttaggatattttgttgg

SEQ ID NO: 1834 - DNA, 83 bp, Artificial
  Hairpin sequence HS_252, human; MQ_from_HS_252, macaque; PT_from_HS_252, chimp
gctcctggtggacccatgtggaaatgggacctccagatcccattctgggagtcactgaagcctttaagagggacaccaatagc

SEQ ID NO: 1835 - DNA, 78 bp, Artificial
  Hairpin sequence HS_253, human
tgaggcgcgccggctggttcaactccggccgccgcgccgaaaccagcagcggtccgggtcgaaccagcaccggcctcg

SEQ ID NO: 1836 - DNA, 92 bp, Artificial
  Hairpin sequence HS_254, human
ggaatgaagcgcggagctgttcgccgctccaggtgctgagtctgagggaggctccggacccgagagccgcgagagccgccgccgctgcggcc

SEQ ID NO: 1837 - DNA, 74 bp, Artificial
  Hairpin sequence HS_255, human; HSbrain_1305, human; PT_from_HS_255, chimp; PT_from_HSbrain_1305, chimp
atctggttcggtctctggcccgagggaagccggtccttcccggctgagctcgcggccagcgctggccggcggat

SEQ ID NO: 1838 - DNA, 117 bp, Artificial
  Hairpin sequence HS_256, human
aggaggcagtgaacctctcctgccctttccttccatctccatcaccttgagcatcttctgggcagctgaggtgaccgcagatgggaaggaagggcgcagagatgagcattttcttct

SEQ ID NO: 1839 - DNA, 110 bp, Artificial
  Hairpin sequence HS_257, human
gccgccgccacctcctccggcgtcttagcccgctcttctggccccgccccgcgctacgcgtagggaggcggggcctcggggcgagacgccggagcgtgtccccgtccggc

SEQ ID NO: 1840 - DNA, 80 bp, Artificial
  Hairpin sequence HS_258, human
tcgctttggccatggagcgggatggctccagtggaggagtgatccgcctggcagccattgcagagtcaggggtagagcgg

SEQ ID NO: 1841 - DNA, 59 bp, Artificial
  Hairpin sequence HS_260, human
tggcgttgcagcccaggagcctccaccgacatggcagcgaggttcccgagccaacgcca

SEQ ID NO: 1842 - DNA, 73 bp, Artificial
  Hairpin sequence HS_261, human
tcagagtggccagtgacaagccccaggctatgaggctgctggcctttttcctgtgctgtgctgccccttttgg

SEQ ID NO: 1843 - DNA, 112 bp, Artificial
  Hairpin sequence HS_262, human; HSbrain_1406, human
tggaaccttcctgaaagaggttggggcaggcagtgactgttcagacgtccaatctctttgggacgcctcttcagcgctgtcttccctgcctctgcctttaggacgagtctca

SEQ ID NO: 1844 - DNA, 116 bp, Artificial
  Hairpin sequence HS_263, human; PT_from_HS_263, chimp
ctcctcctcctcctcccccgtcccctggaagcagcggcccggactcccggctcccgtccctggcggcgccgtggagctcgacgcccgggggtgggggccgatcgggagcggcgggg

SEQ ID NO: 1845 - DNA, 117 bp, Artificial
  Hairpin sequence HS_264, human
gtagacaaacatctggcacagacctcctggcacagggggtgcccatccagaaactcggggtccagaataggatcccagggccatgtggggcctcctgagccagtgtccaggttctat

SEQ ID NO: 1846 - DNA, 115 bp, Artificial
  Hairpin sequence HS_265, human
tctccgtgcacgctgctgaccggctcggcgactgcctccctgctgtgagcaggagaacaggaagtctgcccgacagggaggtggccgggcgggagcggcagagtcggcgttgaga

SEQ ID NO: 1847 - DNA, 68 bp, Artificial
  Hairpin sequence HS_266, human; HSbrain_1384, human; PT_from_HS_266, chimp; PT_from_HSbrain_1384, chimp
ttgggccacttggatctgaaggctgcccctttgctctctggggtagccttcagatcttggtgttttga

SEQ ID NO: 1848 - DNA, 104 bp, Artificial
  Hairpin sequence HS_267, human
gtgaccgcgctctgggcctgcggccgctgtcggttcccccagtcaccgagcgagagggaagaaacaagatggcggctgaaggcgatccggagtggggccccagc

SEQ ID NO: 1849 - DNA, 106 bp, Artificial
  Hairpin sequence HS_268, human; PT_from_HS_268, chimp
tatatatctgaatgtatatttgctcaagactaaactgtaggctcttctctactgcacgctgttgagaagagcccacagtttagtttggagcaaatgcgggcttata

SEQ ID NO: 1850 - DNA, 118 bp, Artificial
  Hairpin sequence HS_269, human
gttccctggccatggggctgtacccgatggtaatatgtatccgggtgtatatcccctggctataggactgtactcgatggtaacatgtatccgggtgtgcgtcccctggccatggggc

SEQ ID NO: 1851 - DNA, 100 bp, Artificial
  Hairpin sequence HS_27, human
ttgaccagtcggaatggtgattctgatggtgaactgattttcattcacactctctcctactccccatccattcaccatcctgaggatcccatttggttaa

SEQ ID NO: 1852 - DNA, 95 bp, Artificial
  Hairpin sequence HS_270, human
tatccgggtgggtgtcccctggccatggggccgtacccgatggtaacacgtatccgggtgggtgtcccttggccatggggctgtacccgatggta

SEQ ID NO: 1853 - DNA, 116 bp, Artificial
  Hairpin sequence HS_271, human
tggtaacatgtatccgggtgggtgtcccctggccatggggctgtatccgatggtaacacgtatccgggtgggtgtcccctggccatggggctgtacccgatggtaatatgtatccg

SEQ ID NO: 1854 - DNA, 95 bp, Artificial
  Hairpin sequence HS_272, human
tatccgggtgggtgtcccctggccatggggctgtacccgatggtaacatgtatctgggtgggtgtcccctggccatggggctgtacctgatggta

SEQ ID NO: 1855 - DNA, 84 bp, Artificial
  Hairpin sequence HS_273, human
tggatgtgctgcggtggggccggaggggcgtcacgtgcacccaagtgacgccccttctgattctgcctcagagacagaagtcca

SEQ ID NO: 1856 - DNA, 61 bp, Artificial
  Hairpin sequence HS_274, human; PT_from_HS_274, chimp
ggcccaggagggaaggggcgtgcgcaccgggaggcctcctccccgcgcccccgatgggacc

SEQ ID NO: 1857 - DNA, 66 bp, Artificial
  Hairpin sequence HS_275, human
cttgatgagccttggggatgagcatgtaagaaagggatgcaagctggtgcctggagtctggtcaag

SEQ ID NO: 1858 - DNA, 67 bp, Artificial
  Hairpin sequence HS_276, human; PT_from_HS_276, chimp
gcccctgctgcctccttgtgcacctcctggtctcagaggtgacaagcgaggtcataacagcaaaggt

SEQ ID NO: 1859 - DNA, 84 bp, Artificial
  Hairpin sequence HS_278, human
cgcggcgaggcttccggctctgcggcctgcaggtagcgcgaaagtcctgcgcgtcccagatgcccaactaaaagcttcgctgcg

SEQ ID NO: 1860 - DNA, 111 bp, Artificial
  Hairpin sequence HS_279, human; HSbrain_1066, human; PT_322, chimp; PT_from_HS_279, chimp; PT_from_HSbrain_1066, chimp
gcatcctcaggacctgggcttgggtggtaggaggaattggtgctggtctttcattttggatttgactccagccccacagcctcagccaccccagccaattgtcataggagc

SEQ ID NO: 1861 - DNA, 65 bp, Artificial
  Hairpin sequence HS_28, human; PT_from_HS_28, chimp
gcaggccccgtcttctccagtggctccatgcgacggcgccagcggcggcggcggaaggcatctgt

SEQ ID NO: 1862 - DNA, 118 bp, Artificial
  Hairpin sequence HS_280, human; HSbrain_1418, human; PT_from_HS_280, chimp; PT_from_HSbrain_1418, chimp
gctgagaatataagaagggaagggcttcagccaggctagtgcagtctgctttgtgccaacactggggtgatgactgccctagtctagctgaagcttttcccttctttctacacccagc

SEQ ID NO: 1863 - DNA, 109 bp, Artificial
  Hairpin sequence HS_281, human; HSbrain_1076, human
gcttttatattgtaggtttttgctcatgcaccatggttgtctgagcatgcagcatgcttgtctgctcataccccatggtttctgagcaggaaccttcattgtctactgc

SEQ ID NO: 1864 - DNA, 119 bp, Artificial
  Hairpin sequence HS_282, human
gcaggcgccccgggatagctgcaggtgccccggaatagctgcaggtgccccggagtagctgcaggtgccccggaatagctgcaggtgccccggagtagctgcaggtgccccggacctgt

SEQ ID NO: 1865 - DNA, 120 bp, Artificial
  Hairpin sequence HS_284, human
gaactgggaggaggagttggaggccggagggagcccgcgctcggggcggcggctggaggtaaccccttgggccgagctggaaaggcgggccacctcggtcttcgctcctttgtggagctc

SEQ ID NO: 1866 - DNA, 98 bp, Artificial
  Hairpin sequence HS_285, human; HSbrain_932, human; MQbrain_2075, macaque; PT_326, chimp; PT_from_HS_285, chimp; PT_from_HSbrain_932, chimp
aggagccaccttccgagcctccagtaccacgtgtcagggccacatgagctgggcctcgtgggcctgatgtggtgctggggcctcaggggtctgctctt

SEQ ID NO: 1867 - DNA, 114 bp, Artificial
  Hairpin sequence HS_287, human; HSbrain_1360, human
gcgccccgggaacgcgtggggcggagcttccggaggccccgccctgctgccgaccctgtggagcggagggtgaagcctccggatgccagtccctcatcgctggcccggtcgcgc

SEQ ID NO: 1868 - DNA, 114 bp, Artificial
  Hairpin sequence HS_288, human; HS_289, human; HS_290, human; HSbrain_1362, human; HSbrain_1363, human; HSbrain_1364, human
gcgccccgggaaagcgtggggcggagcttccggaggccccgccctgctgccgaccctgtggagcggagggtgaagcctccggatgccagtccctcatcgctggcccggtcgcgc

SEQ ID NO: 1869 - DNA, 102 bp, Artificial
  Hairpin sequence HS_29, human
gtgggtctctctgtcctctgatctgtgcttggctgaggagaatggagggtttctgcagtccttgaaggctctaggatcattgggggatggagaaaattccac

SEQ ID NO: 1870 - DNA, 104 bp, Artificial
  Hairpin sequence HS_291, human; HSbrain_1437, human
ctgtgctttgtgtgttggaggatgaaagtacggagtgatccatcggctaagtgtcttgtcacaatgctgacactcaaactgctgacagcacacgtttttcacag

SEQ ID NO: 1871 - DNA, 115 bp, Artificial
  Hairpin sequence HS_292, human; HSbrain_970, human; PT_334, chimp; PT_from_HSbrain_970, chimp
tctgtttatcaccagatcctagaaccctatcaatattgtctctgctgtgtaaatagttctgagtagtgcaatattgcttatagggttttggtgtttggaaagaacaatgggcagg

SEQ ID NO: 1872 - DNA, 113 bp, Artificial
  Hairpin sequence HS_292, human; PT_from_HS_292, chimp
ctgtttatcaccagatcctagaaccctatcaatattgtctctgctgtgtaaatagttctgagtagtgcaatattgcttatagggttttggtgtttggaaagaacaatgggcag

SEQ ID NO: 1873 - DNA, 118 bp, Artificial
  Hairpin sequence HS_293, human
gtcccctggccatggggctgtacccgatggtaacatgtatccgggtgtgcgtcccctggtcatggggctgtacccgatggtaacatgtatccgggtgggtgtcccctggccatggggc

SEQ ID NO: 1874 - DNA, 113 bp, Artificial
  Hairpin sequence HS_294, human; HS_297, human
ggtaacatgtatccgggtgtgcgtcccctggccatggggctgtacccgatggtaacatgtatctgggtgggtgtcccctggccatggggctgtacccgatggtaacatgtatc

SEQ ID NO: 1875 - DNA, 106 bp, Artificial
  Hairpin sequence HS_295, human
acacgtatccgggtgggtgtcccctggccatggggctgtacccgatggtaacatgtatctgggtgggtgtcccctggccatggggctgtacccgatggtaacatgt

SEQ ID NO: 1876 - DNA, 118 bp, Artificial
  Hairpin sequence HS_296, human
gtcccctggccatggggctgtacccgatggtaatatgtatccgggtgtgcgtcccctggtcatggggctgtacccgatggtaacatgtatccgggtgggtgtcccctggccatggggc

SEQ ID NO: 1877 - DNA, 118 bp, Artificial
  Hairpin sequence HS_298, human
gccttggtgctgattcctgggctctgacctgagacctctgggttctgagctgtgatgttgctctcgagctgggatctccggggtcttggttcagggccggggcctctgggttccaagc

SEQ ID NO: 1878 - DNA, 111 bp, Artificial
  Hairpin sequence HS_299, human
tgactccctctcaccaagcaagtgcagtggggcttgctggcttgcaccgtgactccctctcaccaagcaagtgcagtggggcttgctggcttgcaccgtgactccctctca

SEQ ID NO: 1879 - DNA, 95 bp, Artificial
  Hairpin sequence HS_3, human
agcgtatggtaggacccagggcagggggcagggggtgggcggagggtggcagtgcccatctaacccaccctcctcctgcctgaccccccagggct

SEQ ID NO: 1880 - DNA, 99 bp, Artificial
  Hairpin sequence HS_30, human
tcttccataaagcaggatgcatgctcaagctcaagtcaagggaaggacccccatccacagagggctgaaatgcaaatccatgcaacaaatacatggaga

SEQ ID NO: 1881 - DNA, 113 bp, Artificial
  Hairpin sequence HS_300, human
gtgactcactctcaccaagcaagtgcagtggggcttgctggcttgcaccgtgactcactctcaccaagcaagtgcagtggggcttgctggcttgcactgtgactcactctcac

SEQ ID NO: 1882 - DNA, 104 bp, Artificial
  Hairpin sequence HS_301, human; HS_302, human; HSbrain_1404, human; HSbrain_1405, human
ggacgcacccggctgtgtgcacatgtgcccagggcccgggacagcgccacggaagaggacgcacccggctgtgtgcacatgtgcccagggcccgggacagcgcc

SEQ ID NO: 1883 - DNA, 85 bp, Artificial
  Hairpin sequence HS_303, human; HSbrain_1408, human; MQbrain_2657, macaque; PT_from_HSbrain_1408, chimp
cgtgagcagtctccaccacctcccctgcaaacgtccagtggtgcagaggtaatggacgttggctctggtggtgatggacagtccg

SEQ ID NO: 1884 - DNA, 58 bp, Artificial
  Hairpin sequence HS_304, human; HSbrain_1409, human
gctgaagctctaaggttccgcctgcgggcaggaagcggaggaaccttggagcttcggc

SEQ ID NO: 1885 - DNA, 120 bp, Artificial
  Hairpin sequence HS_305, human; HSbrain_1425, human
ggtgcggggctgctggcggctctgcagagtcgagagtgggagaagagcggagcgtgtgagcagtactgcggcctcctctcctctcctaacctcgctctcgcggcctagctttacccgccc

SEQ ID NO: 1886 - DNA, 118 bp, Artificial
  Hairpin sequence HS_306, human; HS_from_PT_313, human; MQ_from_HS_306, macaque; PT_313, chimp; PT_from_HS_306, chimp
gcaggtgaactggcaggccaggaagaggaggaagccctggaggggctggaggtgatggatgttttcctccggttctcagggctccacctctttcgggccgtagagccagggctggtgc

SEQ ID NO: 1887 - DNA, 96 bp, Artificial
  Hairpin sequence HS_307, human; HSbrain_1415, human; MQbrain_2656, macaque; PT_from_HSbrain_1415, chimp
cacaaactgtgaagtgctgtggatttctttgtgaatcaccatatctaagctaatgtggtggtggtttacaaagtaattcatagtgcttcacaggtg

SEQ ID NO: 1888 - DNA, 81 bp, Artificial
  Hairpin sequence HS_31, human; PT_from_HS_31, chimp
ggactggagcaggtgagatggaatttcctaaaggtccagatatttaggaccctggacccatctcacccgctgcctctgtcc

SEQ ID NO: 1889 - DNA, 117 bp, Artificial
  Hairpin sequence HS_32, human
ccgcctcctcctcccatccagcctgctcggcggcggaggcggcggtggcggcagcggttgttcctgcctctccgccacctccaccgcggcttatcccctggctggcggcgttggcgg

SEQ ID NO: 1890 - DNA, 92 bp, Artificial
  Hairpin sequence HS_33, human
tgagcctgtgtgtgggtctgtgtgttcccgaaccctccccggctggccatggatgctgggaggtctgggcacactcaccagcaccgggagca

SEQ ID NO: 1891 - DNA, 92 bp, Artificial
  Hairpin sequence HS_34, human
tgagtctctgtgtgggtctgtgtgttcccgtcccctccccggctggccatggatgctgggaggtctgggcacactcaccagcaccgggatca

SEQ ID NO: 1892 - DNA, 117 bp, Artificial
  Hairpin sequence HS_35, human
gcgctgggtgagagcgggaggcagctccagcccacaccgcaggatgcagggcggggtccgcgcatcctcggcggggcgcgggggttggggagctgtggcctcccgtactcgccgcgc

SEQ ID NO: 1893 - DNA, 108 bp, Artificial
  Hairpin sequence HS_36, human
atgcactttgtaagctgtagagggcagcctgtgaggagagactggggctttggagtccacagatttagtctcaaattccaggccctgcaccttgccggggatttgtat

SEQ ID NO: 1894 - DNA, 78 bp, Artificial
  Hairpin sequence HS_37, human
gtgtgtcccctgcagtgtcatggcgagacagtccttcctgcttgtgcagggaccctccctgaactgcagctgacagat

SEQ ID NO: 1895 - DNA, 91 bp, Artificial
  Hairpin sequence HS_38, human; PT_from_HS_38, chimp
tgaggggtaagtttaggctttcgcggaggggaggagacatggagcctgggaactccttgttctcccctctgctgcctctccccacccctta

SEQ ID NO: 1896 - DNA, 114 bp, Artificial
  Hairpin sequence HS_39, human
tttaggcgctgatgaaagtggagttcagtagacagcccttttcaagccctacgagaaactggggtttctggaggagaaggaaggtgatgaaggatctgttctcgtgagcctgaa

SEQ ID NO: 1897 - DNA, 111 bp, Artificial
  Hairpin sequence HS_40, human
actcaagaaaaattttgaatcttttgtagtttcttctgatagtggttgggtaggggtggaagccatgaggtgagaagaggctattggacgattttatagttttattcaagt

SEQ ID NO: 1898 - DNA, 109 bp, Artificial
  Hairpin sequence HS_41, human
ggtaagcttactcaaaggaactcagtcccggctctccccacaggcctatgtgagaaggactttgtggagggggagatggaacatgaagtcctgatgaggaactgcagcc

SEQ ID NO: 1899 - DNA, 113 bp, Artificial
  Hairpin sequence HS_42, human
agaaaataacattgtcagacgtgtcatccccagatacaatggacaatatgctattataatcgtatggcattgtccttgctgtttggagataatactgctgactttattcctct

SEQ ID NO: 1900 - DNA, 113 bp, Artificial
  Hairpin sequence HS_43, human; PT_from_HS_43, chimp
gaggaaaagtgtgttggacactgaaggcctgaactgtcagcattattgttctccaaggctttggaagaacaatgctctgctgagccttcagtaatcgctatacatgactactc

SEQ ID NO: 1901 - DNA, 99 bp, Artificial
  Hairpin sequence HS_44, human
tggaaacttctgcaggggaaaagagctaggaaagagctgcaaagcagtgtgggctttttcccttttttgctccttttcattacccctcctccgttttca

SEQ ID NO: 1902 - DNA, 59 bp, Artificial
  Hairpin sequence HS_45, human; PT_from_HS_45, chimp
ggtgcagtgcctgcatctcagggatgatccgaggcacccttaggtgcagtgctcacacc

SEQ ID NO: 1903 - DNA, 91 bp, Artificial
  Hairpin sequence HS_46, human
tcactaagcaagtgcagtggggcttgctggcttgcaccgtgactccctctcaccaagcaagtgcagtggggcttgctggcttgcactgtga

SEQ ID NO: 1904 - DNA, 98 bp, Artificial
  Hairpin sequence HS_47, human
cactgaactccacgtttatgaagtacagtactgaatgaatgtatggtgcagtaatgaatatacaaagtacagtacagtaatgaatgtggacaacgttg

SEQ ID NO: 1905 - DNA, 105 bp, Artificial
  Hairpin sequence HS_48, human
ccagactctgggtggatggagcaggtcgggggccaggggacaggaaggctagggccccagagacctgtcctgggccccatgtccagctctgcccttagtgcttgg

SEQ ID NO: 1906 - DNA, 106 bp, Artificial
  Hairpin sequence HS_49, human
ccggctctgtcctccacccggtgctttgccagctgccgtgagaaaggaggtggctgcttctctctctggtgactggacctgcctcgggtggaaacgcagagagagg

SEQ ID NO: 1907 - DNA, 89 bp, Artificial
  Hairpin sequence HS_5, human
gaggaaaagatcgaggtgggttggggcgggctctggggatttggtctcacagcccggatcccagcccacttaccttggttactctcctt

SEQ ID NO: 1908 - DNA, 93 bp, Artificial
  Hairpin sequence HS_50, human
tgtagaacatgccagatggagggtggcaatgtgtaggcacaggttgcagtaggcaatctggcaggttgaacaagctctccacagcatcagaca

SEQ ID NO: 1909 - DNA, 70 bp, Artificial
  Hairpin sequence HS_51, human; PT_from_HS_51, chimp
gggcagggtggtgtgggagagggtatcagggacattttctgagtctgctctgtctctgccgcccctgcct

SEQ ID NO: 1910 - DNA, 93 bp, Artificial
  Hairpin sequence HS_52, human
tggagtggctggcctcgtcatcggccaggtaacccgagtggtggcggcacctggccatgtggtcacctggcaggtgaccgggcctgctgccca

SEQ ID NO: 1911 - DNA, 80 bp, Artificial
  Hairpin sequence HS_53, human
gccagcccggagcccggaccccagcgcccgcccctgccggttcccgcgcggcggcccactcctggccgggcgcgggaggc

SEQ ID NO: 1912 - DNA, 83 bp, Artificial
  Hairpin sequence HS_54, human
tgcagtcgctgggaaggaaggagacgcctaaaccgcggcactgcccggtttgagcgtagccaaacctgcccaccggctttgta

SEQ ID NO: 1913 - DNA, 78 bp, Artificial
  Hairpin sequence HS_55, human; PT_from_HS_55, chimp
acggggaccctcgcagggttggggcgggggctgatactcctcggcccctccctaccctgccctgtgtgttggctttgt

SEQ ID NO: 1914 - DNA, 106 bp, Artificial
  Hairpin sequence HS_56, human
cggcaagctggctgtctgctgcctggccaggcctcttggtgcccactgtgctcctgattagttggcgccggcaatggcaggagcagcagacggcctctcccagccg

SEQ ID NO: 1915 - DNA, 68 bp, Artificial
  Hairpin sequence HS_57, human
gagggcacggacagccaggaaggtccggggatgcccggaaccatcatcccgttccttgtccgtccttt

SEQ ID NO: 1916 - DNA, 73 bp, Artificial
  Hairpin sequence HS_58, human
actgaggggaccctggtttgaggaggcacctgtgtgatgggggctttgggaggaagctgaggtacccctgtgt

SEQ ID NO: 1917 - DNA, 99 bp, Artificial
  Hairpin sequence HS_59, human; PT_from_HS_59, chimp
ggttaattgtgctccaaccaatggctcaaggttcaagaaggccaatgttgtgagcacaggccttctcgagccttgagtgtgctggtgagcacaaagact

SEQ ID NO: 1918 - DNA, 74 bp, Artificial
  Hairpin sequence HS_6, human; HSbrain_1399, human; PT_83, chimp; PT_from_HSbrain_1399, chimp
gcagtcactgtgggttctgggttggggtgatacacaagcctgaccctccccaacccctgcccgcagacgaaggc

SEQ ID NO: 1919 - DNA, 78 bp, Artificial
  Hairpin sequence HS_60, human
ggactctgaattgtactggaaaattcattggaattttcccgagggaaaattctggaatgtgatccatattctaggttc

SEQ ID NO: 1920 - DNA, 113 bp, Artificial
  Hairpin sequence HS_61, human; HSbrain_1411, human
gaaaataccctttgagaaacactttgcctttttacaggagtttattatgttttggacatagaaacataacaaacacctgtaaaacagcaaagtgtttctctctctcttttttt

SEQ ID NO: 1921 - DNA, 85 bp, Artificial
  Hairpin sequence HS_62, human
gttttctccccaggaacaacagctcagcaggtaaaccaggagactaacctttccttctgcttcctgttggtcctccaggcataac

SEQ ID NO: 1922 - DNA, 115 bp, Artificial
  Hairpin sequence HS_63, human
ctgtcctgggctccacacttggtgggttgcagattcccagagtgggacagggaggctccacattgcctgccctccttgggaatctacaaccccccaagtttgcagcatcgttcag

SEQ ID NO: 1923 - DNA, 116 bp, Artificial
  Hairpin sequence HS_64, human
agaagaaaccacaaggcagttggggggcaggggcaggcggtggaggttgtgactctgcttgctttctccctctccctccttgctcctaccccctggacgtgcctcctccccagtct

SEQ ID NO: 1924 - DNA, 67 bp, Artificial
  Hairpin sequence HS_65, human; PT_from_HS_65, chimp
gaggggagagggaaaagaaaaggcatgaaaatatctatagagccatttctggtgttctccttccctt

SEQ ID NO: 1925 - DNA, 115 bp, Artificial
  Hairpin sequence HS_66, human; PT_from_HS_66, chimp
cgatttaagatgggtttatttgttgccagttaccttaatccacaagagaaacatctagttcataattataactggcaacactttaccttcatcacagtgaacctgtcatacctcg

SEQ ID NO: 1926 - DNA, 101 bp, Artificial
  Hairpin sequence HS_67, human
ccttatgtgttgatgtgaatggacgtgatgtggagcttgatcccttcagggtgttctgggctttgcagctcacacagtcccttcacagatgcctcatcagg

SEQ ID NO: 1927 - DNA, 69 bp, Artificial
  Hairpin sequence HS_68, human
tctctggctgtgcttgctgcagctgcctgggaagaaaaatgttcccaggtactcaaagcctccagtgga

SEQ ID NO: 1928 - DNA, 119 bp, Artificial
  Hairpin sequence HS_69, human
taaattctgtaggaggcaaccctggtatttcctagtctgactggtggacttgcatatacaaggctgccattgatcaaactaaaaattggcaaggtttgcctttgacccctacttattta

SEQ ID NO: 1929 - DNA, 56 bp, Artificial
  Hairpin sequence HS_7, human
gcggggccccctgcccagacttgaagccacacaggcaggtcgggcaggcgggtcgc

SEQ ID NO: 1930 - DNA, 78 bp, Artificial
  Hairpin sequence HS_70, human
ctcattccctcttgtcccatactggagtttggggagccactttcccgtccctccactgtggagctgcgttcctgtgag

SEQ ID NO: 1931 - DNA, 111 bp, Artificial
  Hairpin sequence HS_71, human
gcttctcagggcaggcttctctgggatgcccaccttctccacccctccttctcctcccggcaggttccactgctcctggtgctggcacacctggcagtctgcccatgtggt

SEQ ID NO: 1932 - DNA, 106 bp, Artificial
  Hairpin sequence HS_72, human
tgtgggcctggggaggctggcagcatgggccatgctggcggggcccctgggtacaggggaagggcctgggcggagggacagactgtcaccacctggggatcccaca

SEQ ID NO: 1933 - DNA, 117 bp, Artificial
  Hairpin sequence HS_73, human
tgaagcactgaagcaggtcgttctcaagcagttgtcaggaggcctctgtgaatttcacctctgtgcacatccctgctacaactgcctccagagaatcacagcttctcctgctcttca

SEQ ID NO: 1934 - DNA, 83 bp, Artificial
  Hairpin sequence HS_74, human
gcggcgctccagggtgctgaggagaccggaaaggcggccaggaccttccggtcgcctcggcccaccacccacccagtgtccgc

SEQ ID NO: 1935 - DNA, 84 bp, Artificial
  Hairpin sequence HS_75, human
cagtagaggaccctgaagggctaatgggatgaggtaaggaggctgtagggcttccaggatactatagttttcagggagttgctg

SEQ ID NO: 1936 - DNA, 71 bp, Artificial
  Hairpin sequence HS_76, human
ggaagggggaaaggaggaggatccttgaaacacctgcacgcccacggtcccactccttctcctcctcggcc

SEQ ID NO: 1937 - DNA, 78 bp, Artificial
  Hairpin sequence HS_77, human
cggaaggccgggcagcgcagggcgaaaggaggctgtgtcctcagcctcctccctcggcacgcgcctcccatcctgacg

SEQ ID NO: 1938 - DNA, 101 bp, Artificial
  Hairpin sequence HS_78, human
tggcggcagcggcggaggagcggatggcagaggaaggaggcggcggccaaggcgacggcggttcctctttggcctccggctctacccagcgacagcctcca

SEQ ID NO: 1939 - DNA, 115 bp, Artificial
  Hairpin sequence HS_79, human; HSbrain_1377, human
catgagtctgcacctccaggcaggctctgtgcagtactcaccccctccgtctgctccctccaaggtgtgggggtgggcagtgctcagggcctcctcggagccaaaggacagcatg

SEQ ID NO: 1940 - DNA, 107 bp, Artificial
  Hairpin sequence HS_8, human; PT_from_HS_8, chimp
ggtgggcgaacgcccgggtggagcgggtcaggcagggccagtcacagacacagctctgtgctgactgcccgccttgcccacagctcggtctggaggtgtcgccctcc

SEQ ID NO: 1941 - DNA, 117 bp, Artificial
  Hairpin sequence HS_80, human
ctggtcgcagcatccggggccgcctctttcgccccgcgcgtggctccggaagcaggtcggcttgcctctggggatccgcgcgcctctgggggtccgcgccggccctgccttccccag

SEQ ID NO: 1942 - DNA, 104 bp, Artificial
  Hairpin sequence HS_81, human
ccctgctggagacagcgctgaacgaggatggaagtcaaattaggttattcctatggagggatatccagtctttgttttggggctgctggcttacctctgcaggg

SEQ ID NO: 1943 - DNA, 108 bp, Artificial
  Hairpin sequence HS_82, human
gaggagggagccccccatagggtggccctgaccagggctggcaggggcaagtgtggacgcccggccccttgcccaggctgggaccactctgagggacaactcatcctt

SEQ ID NO: 1944 - DNA, 108 bp, Artificial
  Hairpin sequence HS_83, human
ggcatggggaggtggggttgcgggggttagagctgtgggtgatcagaagggaagggcttcatttctacgctctgcctccgctacctcttccccaccacccctaatccc

SEQ ID NO: 1945 - DNA, 103 bp, Artificial
  Hairpin sequence HS_84, human
ttcttgtgacttaaattgcaatgtgcacagaatatggagaaataggactatattcttatgccaatgattctgatgacactggcaattgtattaaaaaatagaa

SEQ ID NO: 1946 - DNA, 104 bp, Artificial
  Hairpin sequence HS_85, human
ggataaagctgggatgtgtcaggtaggcagtgtattgctagcggctgttaatgattttaacagttgctagttgcactcctctctgttgcattcagaagcacgcc

SEQ ID NO: 1947 - DNA, 88 bp, Artificial
  Hairpin sequence HS_86, human
ttgtatgtgtggatggggtgcatgggtgtgtgagtgtgcaagagagaaagtgcacacactcaatcctccaacaccaaccacagaacaa

SEQ ID NO: 1948 - DNA, 69 bp, Artificial
  Hairpin sequence HS_87, human
ccggcagccaggtctgatggcccagatggcaaccactgcagctggcgtggctgtgggctctgctgtggg

SEQ ID NO: 1949 - DNA, 64 bp, Artificial
  Hairpin sequence HS_88, human
cgcggagttgggtccgctgcgagaggcagaaacgccagcctcctccagcggatcccgctcctcg

SEQ ID NO: 1950 - DNA, 111 bp, Artificial
  Hairpin sequence HS_89, human
gccaggcgaggggcggggccttggcgggggtggtcgcgggcggcggggaggtctcgcttccctcctctccacccgctcccagtcccggcctgggtctcagccccgccctgc

SEQ ID NO: 1951 - DNA, 85 bp, Artificial
  Hairpin sequence HS_9, human
tgtgtcaaatgggatggggtgccgagtgggctggggccaagcaggacccctgacctcactcccgcccctagacatgtactgcaca

SEQ ID NO: 1952 - DNA, 60 bp, Artificial
  Hairpin sequence HS_90, human; PT_from_HS_90, chimp
gccacctgctcaacatctgcagcaaggtcaaggccgagatgcagaatctcggcagggagt

SEQ ID NO: 1953 - DNA, 96 bp, Artificial
  Hairpin sequence HS_91, human
atccgtcgcagcagtcgctgcagccgctgcagtccgagccgactaagggcgggaggcagctcgggtggcggggcgtggcgaacagcgcggccggat

SEQ ID NO: 1954 - DNA, 110 bp, Artificial
  Hairpin sequence HS_92, human
ggcgtgcctgggagttggcactaagtacagctgtaattagtcagttttctgtcctgtccacacagaaaaccgtctagttacagttgtaagttgtgccagacctaatcgct

SEQ ID NO: 1955 - DNA, 83 bp, Artificial
  Hairpin sequence HS_93, human; PT_from_HS_93, chimp
ggcgcagagcctgccgggagttgtagtccagtgccccgggagctcatatggactggactacaatgaccagcgtgccccgcgct

SEQ ID NO: 1956 - DNA, 94 bp, Artificial
  Hairpin sequence HS_94, human
cagatgtctcccgccccttatcctatccagttccgcaattcacactcgttgccaaagagtggggagcgggaatggatacacccgggaacgactg

SEQ ID NO: 1957 - DNA, 96 bp, Artificial
  Hairpin sequence HS_95, human
ggcaagaaatgaatgggtgggggctgtgctacagtgttctggtgtcacgcttatcaaccagtgcgagctgcactctagcacctcccttccctggcc

SEQ ID NO: 1958 - DNA, 114 bp, Artificial
  Hairpin sequence HS_96, human; HSbrain_1412, human
gatctgttcatttatgatctcaccgagtcctgtgaggttggcattgttgtctggcattgtctgatatacaacagtgccaacctcacaggactcagtgaggtgaaactgaggatt

SEQ ID NO: 1959 - DNA, 114 bp, Artificial
  Hairpin sequence HS_97, human
gtgaggacagcaggggctctaatcttggctctgctgctcgtcctgcagtggcgctccctgatgctcattaggtgttcagcagagtccaggcctgccccctccctcggtcccagc

SEQ ID NO: 1960 - DNA, 96 bp, Artificial
  Hairpin sequence HS_98, human
gggctggggttcagggacaccctctcaccactgccctcccacaggctccttctacaagggagtggcagagggagaggtggacccagccttcggccc

SEQ ID NO: 1961 - DNA, 103 bp, Artificial
  Hairpin sequence HS_99, human; HSbrain_1178, human; PT_from_HS_99, chimp; PT_from_HSbrain_1178, chimp
ggatgatttggagtagcaaagcagcaattgttctttggtctttcagccatgacctgaccttctgtctgtgagaccaaagaactactttgcttggccaccatct

SEQ ID NO: 1962 - DNA, 59 bp, Artificial
  Hairpin sequence HS_from_MM_1, human
cccatcattcatttgcataatggatgcctttttatccattatgcaaatggtatgagagg

SEQ ID NO: 1963 - DNA, 113 bp, Artificial
  Hairpin sequence HS_from_MM_101, human
agcgtagttgtagcatgtggttgtattaatgaacgttacaggagagctttataatcatttataaatctgtaacattcaataaagaaacacatgttgcaatgattaattatgtt

SEQ ID NO: 1964 - DNA, 112 bp, Artificial
  Hairpin sequence HS_from_MM_104, human
ccatagtgaaggtatggattttctttctcaattgctctggagtcaccccgaggctcttaatttgggctattagccgtgggtgatttcaaaatccatattgataatgctgagg

SEQ ID NO: 1965 - DNA, 96 bp, Artificial
  Hairpin sequence HS_from_MM_105, human
gcttgagctaggggggtaacctcaagctatggaaaaaattagggttagacatgaagtattttttcatagcctgaggaaggccccatgggcagcagc

SEQ ID NO: 1966 - DNA, 86 bp, Artificial
  Hairpin sequence HS_from_MM_108, human
gggttgatgcaaaagaaaggaaaacatctttgaagttctgaaaaataggacttcaaagatgttttcctttcttctccatcgaatct

SEQ ID NO: 1967 - DNA, 71 bp, Artificial
  Hairpin sequence HS_from_MM_109, human; PT_from_MM_109, chimp
ggagccgctccaccgatggcaccatcttggcgcagaaactcgccgaggaggtgcccatggacgtggcctct

SEQ ID NO: 1968 - DNA, 106 bp, Artificial
  Hairpin sequence HS_from_MM_112, human
gggcgggtgggggtagggcggcttaccataggggttcatgtggtcacctggcatttggggcggcgtgaggccctgctggaaggggtcgctgctgccgtaggggctc

SEQ ID NO: 1969 - DNA, 78 bp, Artificial
  Hairpin sequence HS_from_MM_116, human; MQ_from_MM_116, macaque; PT_from_MM_116, chimp
aaaagctcggcataattatccctgaacaggttgagcaaggtctccgcaaaatctgctcagggtgattatttagctttt

SEQ ID NO: 1970 - DNA, 97 bp, Artificial
  Hairpin sequence HS_from_MM_119, human
aatttattttcactagaaagggaatgacccataactcatgaatggcagcgcttaaagtgagttatggaggttactctcctgtgagaggaaatggatt

SEQ ID NO: 1971 - DNA, 87 bp, Artificial
  Hairpin sequence HS_from_MM_120, human; MQ_from_MM_120, macaque; PT_from_MM_120, chimp
ggagacactatcaaagttaaggcaggagagcctgtccacatccctgcagatgtgacaggccttccaatgcctaagattgaatggtcc

SEQ ID NO: 1972 - DNA, 87 bp, Artificial
  Hairpin sequence HS_from_MM_122, human
ggccactccatctgttcaaacataatgctccaaaccaaggaatatgttccaaaccaaagagcatgatatttgacagatggagaggtc

SEQ ID NO: 1973 - DNA, 118 bp, Artificial
  Hairpin sequence HS_from_MM_124, human
gagtgaggagggctgatgagcagttcaagttccctgcatagaaatagcctcagaatagttccagtgttgtttctaattgcaatggatgagcagactgtctcattaatcctcccctatc

SEQ ID NO: 1974 - DNA, 115 bp, Artificial
  Hairpin sequence HS_from_MM_126, human
aatgtatttttctgtatttgaggtttagggaagcttgataatgaggctatgaagattcatggcctcttttctatggcttaatttaggctctatatcaaatatgtaaaataacgtt

SEQ ID NO: 1975 - DNA, 118 bp, Artificial
  Hairpin sequence HS_from_MM_127, human
gctatataaaggcttgtcagaatgaattctagggtgccaagagacattttgcatatttaagagtatgcaaagtgtctcatggcacattagaattcattctgacaagcctttatatagc

SEQ ID NO: 1976 - DNA, 111 bp, Artificial
  Hairpin sequence HS_from_MM_129, human
gtacctatctcttttctgattagagaggtggcatggagcctggctcattaggcagaagtaatgagccagtctatacgccatctctaattagagaaaagatacagtaggtac

SEQ ID NO: 1977 - DNA, 86 bp, Artificial
  Hairpin sequence HS_from_MM_13, human; PT_from_MM_13, chimp
cagagcggcgcctcccagcccctgctgatcaacatgtacctgccaggtaccagggaccagccggaggctggtggcaccggaacctg

SEQ ID NO: 1978 - DNA, 83 bp, Artificial
  Hairpin sequence HS_from_MM_136, human
gcagttaatgattggtttgttagttaatggcccaaggcaaagctgagggcggttaagactctaacaaacgagttgtgaattgt

SEQ ID NO: 1979 - DNA, 85 bp, Artificial
  Hairpin sequence HS_from_MM_14, human
ttctctgccatttgactgcatctgattgacctcactgcaacccacagaggaggcagatttagaagcaaaccagtatgacagggaa

SEQ ID NO: 1980 - DNA, 78 bp, Artificial
  Hairpin sequence HS_from_MM_145, human; MQ_from_MM_145, macaque
cgccccgccaggtggcggggcctactaggcctccgggcatccccggtctcaagtaggcctcatctgccggcaagggcg

SEQ ID NO: 1981 - DNA, 60 bp, Artificial
  Hairpin sequence HS_from_MM_146, human
ggaaaacagatgggcaatatccagtaagaaaattttgctcggtattgcccatctgcttct

SEQ ID NO: 1982 - DNA, 60 bp, Artificial
  Hairpin sequence HS_from_MM_147, human
actccagtagaagtgctgggcctggcagggggccaggcctgagtcacagctgctgggcgt

SEQ ID NO: 1983 - DNA, 64 bp, Artificial
  Hairpin sequence HS_from_MM_149, human
ggcttgctgcccagtccaaggccagcagtgttgtgtctggcctgtaagaggcaggtagcaagcc

SEQ ID NO: 1984 - DNA, 115 bp, Artificial
  Hairpin sequence HS_from_MM_153, human
tcagcctgggcatagttggacgagagggcgtcttggcaggtctctgtgtttaaagagcacaggtgtgagacactgggacgcacgctttcggctcaacattgccttctggggttgg

SEQ ID NO: 1985 - DNA, 111 bp, Artificial
  Hairpin sequence HS_from_MM_155, human; MM_155, mouse; MQ_from_MM_155, macaque; PT_from_MM_155, chimp
tggcgcctcctcactgcactcttgtctcagttcttgtttcgttagcaggattgactcagtcttgcagcgaggctcggagcagcccagggtcgcaggtagaggtatgcacta

SEQ ID NO: 1986 - DNA, 111 bp, Artificial
  Hairpin sequence HS_from_MM_156, human
ggtttagtcggagctgttacatttggcagcattccttgttagcatttgataaacaattattgccaaatgttagcaaggaaacctgccaaatgttacagctcagatttaact

SEQ ID NO: 1987 - DNA, 116 bp, Artificial
  Hairpin sequence HS_from_MM_158, human
gctactccatcccctgctgcactaaattgacacttgggcaagcaatggctctcgtcagtcactccgaagctgctacttccagaagtgtcgatttagtgcagcgggggatgaggtgc

SEQ ID NO: 1988 - DNA, 98 bp, Artificial
  Hairpin sequence HS_from_MM_159, human
cggcgcggggcgcgtcgcccccctcagtccaccagagcccggatacctcagaaattcggctctgggtctgtggggagcgaaatgcaacccaaaccccg

SEQ ID NO: 1989 - DNA, 91 bp, Artificial
  Hairpin sequence HS_from_MM_160, human
aaggatttggcatttcaatcgatgggaaatgatgtgtgatcattctaatttattatacatcatttcccatcaatcgacgaactaaagcctt

SEQ ID NO: 1990 - DNA, 106 bp, Artificial
  Hairpin sequence HS_from_MM_161, human
gaacatttgtgtttatttgaatgtgtgatggggaggtcatcaaaatgaacacactcgttgtgtttatttgaatctcacatcgctcataagaatacacgctgtgttt

SEQ ID NO: 1991 - DNA, 93 bp, Artificial
  Hairpin sequence HS_from_MM_163, human
acaggaagcagcaggtagttctgtctgctgtctctttagataaaatgtatgtctggcaccaagggaacagctgagaactacctgttgttatgt

SEQ ID NO: 1992 - DNA, 113 bp, Artificial
  Hairpin sequence HS_from_MM_164, human; MQ_from_MM_164, macaque; PT_from_MM_164, chimp
tgcacagcccttaactctttgattgccatggcaagaaccatgctgatgattctagcttgtgacatttgtgtggttaaaggttgccgcagcagtcaaagggttatagcattgta

SEQ ID NO: 1993 - DNA, 75 bp, Artificial
  Hairpin sequence HS_from_MM_165, human
cagctaatgacctactggaggacttatgtgcctaaggcaaagctgaaggccattagcccaacaggtcattaactg

SEQ ID NO: 1994 - DNA, 116 bp, Artificial
  Hairpin sequence HS_from_MM_166, human
gctgtctagatggtgcattagggagaatagttgatggattacaaatctctgcatttcaccaacaaaaatgaatttgaatccatcaattttattcccttatgccaaatttaggaagt

SEQ ID NO: 1995 - DNA, 77 bp, Artificial
  Hairpin sequence HS_from_MM_169, human
gaggccatgactggcatctcccaaaatgccaagaacggaaacctgccagagtttggagatgccatttccacagcctc

SEQ ID NO: 1996 - DNA, 107 bp, Artificial
  Hairpin sequence HS_from_MM_170, human; PT_from_MM_170, chimp
ccagtgaggattttgaaagaagcataattcctttgacttcttttagaattaatttacctattaaataaaaaggaaaggattcatcttttattcgaattcctctgagg

SEQ ID NO: 1997 - DNA, 53 bp, Artificial
  Hairpin sequence HS_from_MM_171, human
ggtgcaattggccacttgcaccatcagttgaagggcaagtggttaattgagcc

SEQ ID NO: 1998 - DNA, 76 bp, Artificial
  Hairpin sequence HS_from_MM_172, human
atccatttttctcagttagtgtcaggtttcattaggaaacatgagaggcctgacattaatcgtatgaaaaatgggt

SEQ ID NO: 1999 - DNA, 72 bp, Artificial
  Hairpin sequence HS_from_MM_173, human; MM_173, mouse
aggcagacactgtgtttgatgccaataatggttgccagtggcaccgaggttggcatcagaccctctttgtct

SEQ ID NO: 2000 - DNA, 77 bp, Artificial
  Hairpin sequence HS_from_MM_174, human
ctgaagtggggccagttctccgcctcttttaactttactgccaaggcaggagaggggtggagtggcctggaagacag

SEQ ID NO: 2001 - DNA, 78 bp, Artificial
  Hairpin sequence HS_from_MM_178, human; PT_from_MM_178, chimp
aagcagggacttcttgccagcccttggcagcatgaggcctcccatcatcatccaccgagctggcaagaagtatggctt

SEQ ID NO: 2002 - DNA, 72 bp, Artificial
  Hairpin sequence HS_from_MM_179, human
agaaggtactctgtgggagggaggagataatagccaatgattatattcctccttcatacttgcagtacctct

SEQ ID NO: 2003 - DNA, 62 bp, Artificial
  Hairpin sequence HS_from_MM_18, human
gctaattatacccacaattggctaattgtcggtgcaattagccaattgcaggcccaattggc

SEQ ID NO: 2004 - DNA, 105 bp, Artificial
  Hairpin sequence HS_from_MM_181, human
tgtatgtgaatgaccagctcacaggaagtggccttcaatagtccgatagcttcctgtatcctgacattgtgaaggcccacttcctgtgctgtctctgaaaataca

SEQ ID NO: 2005 - DNA, 77 bp, Artificial
  Hairpin sequence HS_from_MM_182, human
tctgtgcctcactgtttgttaaatattttgacccagttgccatgggtcagggtgagtgacctgaagggtgggcagga

SEQ ID NO: 2006 - DNA, 97 bp, Artificial
  Hairpin sequence HS_from_MM_184, human; PT_from_MM_184, chimp
gtgaggagcaggttagctgggtgaaaagttcacagtgaggggagctgtctgttccctcgcttaatttatccactatttggctaaccttgctctgaac

SEQ ID NO: 2007 - DNA, 101 bp, Artificial
  Hairpin sequence HS_from_MM_185, human
cttccaggtgtccaccaaggacgtgccgctggcgctgatggcctgtgccctgcggaagaaggccacagtgttccggcagccgctggtggagcagccggaag

SEQ ID NO: 2008 - DNA, 70 bp, Artificial
  Hairpin sequence HS_from_MM_187, human
gggctgcctctcacagggagttgtccatgccatcttggccttgggcctagtgtcctggcctgggctgcct

SEQ ID NO: 2009 - DNA, 106 bp, Artificial
  Hairpin sequence HS_from_MM_190, human; PT_from_MM_190, chimp
tcgtggaccaaaggaacttttctggtctattgggtaaatatgtattaaagtaatttttaaaatacttacatacttaataggctggaagtggtcaatggtttaatga

SEQ ID NO: 2010 - DNA, 86 bp, Artificial
  Hairpin sequence HS_from_MM_191, human
gctgtcacatttggaaagccgcagccagtcagagagaaattaaattgtttttctttgtctgcctgctgttccaagtctctgctggc

SEQ ID NO: 2011 - DNA, 78 bp, Artificial
  Hairpin sequence HS_from_MM_192, human
gtgttgatgcttattggtgtctcttttctcttctaggaccagcagagagaagagattccatcttccagaggttgccac

SEQ ID NO: 2012 - DNA, 93 bp, Artificial
  Hairpin sequence HS_from_MM_193, human
tttcacttccaggtaatctaattccaaggcatcaggagctttttaataaaaatcctgtgtttgctggagtaaggttgcctgaaatcaaggaaa

SEQ ID NO: 2013 - DNA, 115 bp, Artificial
  Hairpin sequence HS_from_MM_194, human
ctatggcagagtacagctggcagaaagtgttacagatataatccttattttccttgtttttgttggtattgtaggagggatctgtaggcctttctgtccagcgctctgtttttgg

SEQ ID NO: 2014 - DNA, 88 bp, Artificial
  Hairpin sequence HS_from_MM_195, human
acccagccgggccgccaacaccagatccttctccttctgtcggatcaccgacagcagctcggggtcctgggagggcggcggctgcggt

SEQ ID NO: 2015 - DNA, 94 bp, Artificial
  Hairpin sequence HS_from_MM_198, human
ctacagctgctgagagcagcaggatgagggttgacctatatctgtcaggtgtaggtcaaaccctgaatttttgttgcaaacttcagtcttctag

SEQ ID NO: 2016 - DNA, 84 bp, Artificial
  Hairpin sequence HS_from_MM_201, human
tctcagggaaatcaggcttctggagagtgagtttgtttgtaataataatacgaattattctctcagcctgaggtcaccgggagg

SEQ ID NO: 2017 - DNA, 109 bp, Artificial
  Hairpin sequence HS_from_MM_202, human; MM_202, mouse; PT_from_MM_202, chimp
gtgaggaacgtctagggagccaccagtggtgtaagtgctttggctaagtgatggagacaactgaggaggagtgtgattaccactgggttcctgaatggaaatacatcat

SEQ ID NO: 2018 - DNA, 107 bp, Artificial
  Hairpin sequence HS_from_MM_203, human
tagaggcctctgtatttaatttggctcagccgggaagatttttggctctgtgcgtgtgtatattctgaaaaatctttccgagtgagcccaggggttggaagcttctg

SEQ ID NO: 2019 - DNA, 90 bp, Artificial
  Hairpin sequence HS_from_MM_208, human
cggtagcccaagccttgcaggccccagcggaatgaccagggcgatggaaggaagtcgtgctcgttgcgggcgtggggaatgggcttaccg

SEQ ID NO: 2020 - DNA, 89 bp, Artificial
  Hairpin sequence HS_from_MM_210, human
gcttcttctcccgggcaagctgccttcggatccgctgctggcacacagccagctgggtcttggcggctttgttgttggggtagagctgc

SEQ ID NO: 2021 - DNA, 97 bp, Artificial
  Hairpin sequence HS_from_MM_214, human
taagctgacgctgcccattccctccacgtgccccgagccctttgcccgcctcctggagggtgagccggggccccgtgacgagggtaggctcagcttg

SEQ ID NO: 2022 - DNA, 90 bp, Artificial
  Hairpin sequence HS_from_MM_215, human
tgggggagggcgggcaagtcaggtgaccgggtgagaatcagagctatgctgaggtggcctggttaccttgacattcctgtgattctgcca

SEQ ID NO: 2023 - DNA, 118 bp, Artificial
  Hairpin sequence HS_from_MM_218, human
tcagggccctgtgactcaggcgcgggttggggaggatgttttggatgccgctctgctgacgctggtgccctctgttcttacatcctccttaatttactgcctgaggagggggccaggg

SEQ ID NO: 2024 - DNA, 111 bp, Artificial
  Hairpin sequence HS_from_MM_226, human
ccagacagatgatgagttatcttttcctgagggagcaataatccgtatcttgaacaaagaaaaccaagatgatgatggcttctgggaaggggaattcaatgggcgtattgg

SEQ ID NO: 2025 - DNA, 75 bp, Artificial
  Hairpin sequence HS_from_MM_229, human
gcacagaagtcctcattctctattggggctggggggcccttcttggctcctggggttcgaggaatgagtctgtgt

SEQ ID NO: 2026 - DNA, 79 bp, Artificial
  Hairpin sequence HS_from_MM_230, human
tcctgaggtagatatcatacaggaatgctggggccttatggcttacagcaatccagtaatgatataaaagatgattgga

SEQ ID NO: 2027 - DNA, 76 bp, Artificial
  Hairpin sequence HS_from_MM_234, human
gcccggctccgggtctcggcccgtacagtccggccggccatgctggcggggctggggccggggccgagcccgcggc

SEQ ID NO: 2028 - DNA, 96 bp, Artificial
  Hairpin sequence HS_from_MM_236, human
tacacctgaaacttctcacttgggggtacaattagcctctggcgcctttagaatgagttgctggtgactaattatgccctcaaggaggcatttgta

SEQ ID NO: 2029 - DNA, 108 bp, Artificial
  Hairpin sequence HS_from_MM_238, human
tcctcgatgcttgattagtcagattgatggaagaggccatatgtggccatgtcaaaacttggctacaaggctctttccctctctatgaaggacaggcaataaagagga

SEQ ID NO: 2030 - DNA, 106 bp, Artificial
  Hairpin sequence HS_from_MM_239, human
tcagcatggtcttggtttggtagcgccccaggatggagtaggcagggccaaggtccttgccagtcctcagtatcttggggtttacattgtaacggggccctgggga

SEQ ID NO: 2031 - DNA, 108 bp, Artificial
  Hairpin sequence HS_from_MM_240, human
cctgaatggcccctctgtgtggctgctgctggctcagacccctgcccaccttgggcgggtgggtctgggtcttggctggcacgcacacccaggggcctgaaatcatgg

SEQ ID NO: 2032 - DNA, 120 bp, Artificial
  Hairpin sequence HS_from_MM_242, human
aatgatggaggtgcaggcatttcctgaggattaatgaccagctgggaggaaccagtggcccttggctctgcctcccagccagccattaattctaaggaaatgtcttttgctgaggtcgtt

SEQ ID NO: 2033 - DNA, 110 bp, Artificial
  Hairpin sequence HS_from_MM_251, human
ctgcaggcagctaggagcctgccaagtgctggtggaagtagaggccgaaaaggctggcgagcagctggcaggcagccgtccaccagatgaggtaggccaggacgccacgg

SEQ ID NO: 2034 - DNA, 111 bp, Artificial
  Hairpin sequence HS_from_MM_254, human
tcaggccgttgtagttgttgctgttcttgcaggcactgaccagattgaagtcagtgatgatgatcttggagtcagtgcctggatggtggtagagcagattgtgaggcttga

SEQ ID NO: 2035 - DNA, 71 bp, Artificial
  Hairpin sequence HS_from_MM_256, human; PT_from_MM_256, chimp
gggttgaccaaagcggccatgatggcaatgtctgagtatgaagatcggttgtcatctggtctggtcagccc

SEQ ID NO: 2036 - DNA, 88 bp, Artificial
  Hairpin sequence HS_from_MM_269, human
tgctgaagttggtatggcagcctgaacacttcctgttcccaggaatgggcttgggatcaaaggttgctatcactccaaagtcttcaca

SEQ ID NO: 2037 - DNA, 93 bp, Artificial
  Hairpin sequence HS_from_MM_273, human
agagtgtaattccatcttggggcttctggtgagttgagcttgtggttctgtggtttatgatgtcaccagaacccctggatggaattacagcct

SEQ ID NO: 2038 - DNA, 76 bp, Artificial
  Hairpin sequence HS_from_MM_275, human
tcttttctcctttttgcacaaagagtctcatgtctgatatttagacatgatgagctttgtgcaaaaggggagctgg

SEQ ID NO: 2039 - DNA, 99 bp, Artificial
  Hairpin sequence HS_from_MM_276, human; MQ_from_MM_276, macaque; MQ_from_MM_39, macaque
attataataaattaaatgcctaaactggcagagtgcaaacaattttgactcagatctaaatgtttgcactggctgtttaaacatttaatttgttagaat

SEQ ID NO: 2040 - DNA, 114 bp, Artificial
  Hairpin sequence HS_from_MM_28, human
tcttgttctcctctatataccctcagagctgatatgagtgtggagattccattcacttcaaaggaagcttcacgcttggatcttctccacaggggtgcttagactaagacaaga

SEQ ID NO: 2041 - DNA, 89 bp, Artificial
  Hairpin sequence HS_from_MM_283, human; PT_from_MM_283, chimp
gagtacctgtgggcagcatcagggtctgccttgcggtgggaccgcttgggtttcagagcagggtccctgttgtttcctgacaggcgatc

SEQ ID NO: 2042 - DNA, 118 bp, Artificial
  Hairpin sequence HS_from_MM_285, human; PT_from_MM_285, chimp
ttcactgtgtttcccatgtgcctttaaggaatcattcttgatctcagccataaaattggaaagctgcataactgacaagatgatccctgaaggcagctgaaacatggggtagattgaa

SEQ ID NO: 2043 - DNA, 112 bp, Artificial
  Hairpin sequence HS_from_MM_287, human
ggctctactcagcggcaggggatttgaggggtggttgtgtgatttgtacagctgtcattagggtaattgcatgatattttcccaaatttctcctgcagcttcaggatgggtt

SEQ ID NO: 2044 - DNA, 81 bp, Artificial
  Hairpin sequence HS_from_MM_288, human
gtaagaaatgagaaatttttagggccattgagcaccatgcattttcagtgttcagtagccctgaaaatttctcatttaggc

SEQ ID NO: 2045 - DNA, 102 bp, Artificial
  Hairpin sequence HS_from_MM_29, human
actgtcggctcagaagtccatggagctgtgggccaggtagtccttgcgaccgatgttgctgacctgcttggtctgcatagcctcgagtttggggcagtcagt

SEQ ID NO: 2046 - DNA, 89 bp, Artificial
  Hairpin sequence HS_from_MM_290, human
ctctgtggccatttcggtttttccagtccgatgcccctgagggggagggtcgggccccttggaaaatccgttttcatggcaacacggag

SEQ ID NO: 2047 - DNA, 89 bp, Artificial
  Hairpin sequence HS_from_MM_292, human
caagaaaccaaagggaaagatgtctgcttatgccttctttgtgcagatgtgcagagaagaacataagaagaaaaacccagaggtccttg

SEQ ID NO: 2048 - DNA, 93 bp, Artificial
  Hairpin sequence HS_from_MM_293, human
tctcggtagctatggaaatcccagggtttccctagcaacagctccagatgggtcttgttgctagggaacgctgggatttcccaggctgccaga

SEQ ID NO: 2049 - DNA, 81 bp, Artificial
  Hairpin sequence HS_from_MM_294, human
aggtgaagatggattgccaggagtgccctgagggctaccgcgtcacctatacccccatggcacctggcagctacctcatct

SEQ ID NO: 2050 - DNA, 82 bp, Artificial
  Hairpin sequence HS_from_MM_296, human
cctgaacgcatgactcttcaacctcaggacttgcagaattaatggaatgctgtcctaaggttgttgagttgtgcatttctgg

SEQ ID NO: 2051 - DNA, 112 bp, Artificial
  Hairpin sequence HS_from_MM_298, human
ttctctgtggattaattggtcaggaaagacactttttatattgtcaagtggcacttaagccattaattcttgactgtgaaactgcttttcctgggcaatgctctttaaggaa

SEQ ID NO: 2052 - DNA, 65 bp, Artificial
  Hairpin sequence HS_from_MM_299, human
gcttcctgctcctcctcatactgttcccgcagcaggtcacagtcatggcgggaggactgcagggc

SEQ ID NO: 2053 - DNA, 106 bp, Artificial
  Hairpin sequence HS_from_MM_30, human
ctttctttcacaaagagcaaagggtttcagaatcaagtttgtcttcaagcagcagcaaacgcttgctgacaagatattttggaacaactcgctattaggaaggaag

SEQ ID NO: 2054 - DNA, 104 bp, Artificial
  Hairpin sequence HS_from_MM_300, human
tccaaacaagcatttgtgtgcataaaatgggtaattgcacacacaaatgggcaattttgtatgcaattatccattttgcatacgcaattatatgcttctgaggg

SEQ ID NO: 2055 - DNA, 89 bp, Artificial
  Hairpin sequence HS_from_MM_301, human
tgggtgtggggatgggggcacttctgttcctgacaacctcattatgtggttatcaggagcagacactgcccaggttgtcacgacaacca

SEQ ID NO: 2056 - DNA, 105 bp, Artificial
  Hairpin sequence HS_from_MM_303, human
ggggcacttcacctggcacactgggctggaagactttattcagatccaaggaggaggctctggaatgggttttctgtggccgaggtggcggggtgggagggtcct

SEQ ID NO: 2057 - DNA, 110 bp, Artificial
  Hairpin sequence HS_from_MM_304, human
cctgtcccagcgcgtggccgaccgcctgggcctggagctgggcaaggtggtcacgaagaagttcagcaaccaggagaccaggtgggggccgcgccggcggccgggctagg

SEQ ID NO: 2058 - DNA, 95 bp, Artificial
  Hairpin sequence HS_from_MM_305, human
ggtgtgaaagggtaggagagatgctggaggtgggggtgctgtgttttagaccccccatattatcccagtgtcccctgcccccctcttcccccacc

SEQ ID NO: 2059 - DNA, 104 bp, Artificial
  Hairpin sequence HS_from_MM_306, human
gctgtgaggtcagaatcctgtgcttacgacacctcggtctgttgccatggaaacaggggcggattaaggctggagcgtggagcgcagggatcaggcccctcggc

SEQ ID NO: 2060 - DNA, 78 bp, Artificial
  Hairpin sequence HS_from_MM_307, human
acctgagaactgctgaggagcacaaatgtcatggggataaatcaagcccgtgagattggcatctctcagcagctaggt

SEQ ID NO: 2061 - DNA, 117 bp, Artificial
  Hairpin sequence HS_from_MM_310, human
tgtcataataaaatgcatttcagagaatatgcattttacctttgggaatatgttaatttcaggcagcattccctatgggaaaggtgataccagctctgatatgcaaagcatatgata

SEQ ID NO: 2062 - DNA, 77 bp, Artificial
  Hairpin sequence HS_from_MM_313, human
gtctaaaggaagaagtttgttctactgtaaacagttatgggaactgtttgctttggatgggcttggtcctcattggc

SEQ ID NO: 2063 - DNA, 90 bp, Artificial
  Hairpin sequence HS_from_MM_315, human
ggcctcagtctgcgggccccgaggagggttgtgggcccttttttgtgaatgaagcgccacggaacagccctcctggggtccccacgagcc

SEQ ID NO: 2064 - DNA, 76 bp, Artificial
  Hairpin sequence HS_from_MM_317, human
cacacatgtgatgaattgtgggtgcttgcctggcttcccaggcgagaaccataagcaattattaaatgccattgtg

SEQ ID NO: 2065 - DNA, 119 bp, Artificial
  Hairpin sequence HS_from_MM_318, human; HS_from_MM_340, human; HS_from_MM_346, human; MQ_from_MM_318, macaque; MQ_from_MM_340, macaque; MQ_from_MM_346, macaque
tctggcttgctgttgtccttggagaagtctgggcctgggacagaggagggatgtaatctgaacactcctttgtcacaggtcaccagggtgtgcttgaggggacggtagacataaacgga

SEQ ID NO: 2066 - DNA, 86 bp, Artificial
  Hairpin sequence HS_from_MM_319, human
gatgctgctgatgctggcggtgatcccgatggtgtgagctggaaatggggtgctacgtcatcgttgtcatcgtcatcatcatcatc

SEQ ID NO: 2067 - DNA, 105 bp, Artificial
  Hairpin sequence HS_from_MM_32, human
gagggaaagaggactattatttaaaaggcttttaaatgatgtcactatatattcttttaacaacatcctctaaaagcctttgaaaaaatagtcccttcctccctc

SEQ ID NO: 2068 - DNA, 106 bp, Artificial
  Hairpin sequence HS_from_MM_320, human
gggcacgaggcaggcacgcagagctctttaaatattgctgagcatttcctggatcagcatgatatttaaagatttttgttccacctgcctgcgaaatatagagtcc

SEQ ID NO: 2069 - DNA, 111 bp, Artificial
  Hairpin sequence HS_from_MM_323, human
tagatcaaacagcgagaggcactttgtacttctgccaggagaccatatgatatctctcagtgactctcctgcatgccaggaacacggacccatgcctcttagctgggtctg

SEQ ID NO: 2070 - DNA, 84 bp, Artificial
  Hairpin sequence HS_from_MM_324, human
agccctccaggggttaagggggcgggaccagctagttgccatggtgccagactgtttgggtctgctctctgacccttgggggct

SEQ ID NO: 2071 - DNA, 73 bp, Artificial
  Hairpin sequence HS_from_MM_326, human
tgtggtaggagctatcagaacttagtgatcaagtgaagtcgtagttactaatttctgatgctcttcccctgca

SEQ ID NO: 2072 - DNA, 98 bp, Artificial
  Hairpin sequence HS_from_MM_329, human
gcccccatttgagaggctgatgtcatctatcttcccaaagaaaaggccactttttcctttgtggaaatcctgggtgacatcacctcctgatcacatgc

SEQ ID NO: 2073 - DNA, 94 bp, Artificial
  Hairpin sequence HS_from_MM_33, human
cagctggagtcggggattaccccctgctgctgacgtgaggacggtgaacaatcgggaacgttcggtggaagggggaattccccgccgctccctg

SEQ ID NO: 2074 - DNA, 112 bp, Artificial
  Hairpin sequence HS_from_MM_334, human; MQ_from_MM_334, macaque; PT_from_MM_334, chimp
gccgcttttcctttaactctcagcttctatttaaaaagctaatttgggagcttgtcgatgctcccaattcagacattttaaataggaactgaaagtcaggagctgccagggc

SEQ ID NO: 2075 - DNA, 101 bp, Artificial
  Hairpin sequence HS_from_MM_335, human
cagattattccaaattttatgggcgaaattctgccctcaattatgcacatgcaactaattgcacacacataactgagggtagagtttggcttttggagctg

SEQ ID NO: 2076 - DNA, 109 bp, Artificial
  Hairpin sequence HS_from_MM_336, human
caagtgttgttattaaatcaccttgaagtgtctcttgtaaaagataactccctgcattgtagaaatgtctttgacaagagaggattagggtgaaactgcaattaccttg

SEQ ID NO: 2077 - DNA, 78 bp, Artificial
  Hairpin sequence HS_from_MM_338, human; PT_from_MM_338, chimp
ggcgcctggaggtgatgtcgaagcaggtgatcatcatgagatgggccttgcagaagttgacacggctctccaggcgct

SEQ ID NO: 2078 - DNA, 69 bp, Artificial
  Hairpin sequence HS_from_MM_339, human
gctctaattagaattcccttattccatttctgtttctcaggagaggacagggggctttttaattggggc

SEQ ID NO: 2079 - DNA, 118 bp, Artificial
  Hairpin sequence HS_from_MM_34, human
ctgtttattcctcatttgagtcataatcctccatttgtgacatcacaattagccacttgtggtgatgattataatgtcatgaacaaaggattatgactgggagttggaaacaaaacag

SEQ ID NO: 2080 - DNA, 106 bp, Artificial
  Hairpin sequence HS_from_MM_347, human
gagcctgtgagtggctgggccggggtttgggtggtgccaacagggggagcatttgtccctctctgagccccactccccgaccctggccagagcgccccattggctc

SEQ ID NO: 2081 - DNA, 109 bp, Artificial
  Hairpin sequence HS_from_MM_349, human
gcaaagaagtggtttggagggctgcgttcattttgagtgctgttgtaatcaattttagatacagcattccacaatggatcagtttgcatccaaacctgccttattatgt

SEQ ID NO: 2082 - DNA, 87 bp, Artificial
  Hairpin sequence HS_from_MM_350, human; MM_350, mouse; MQ_from_MM_350, macaque; PT_from_MM_350, chimp
atggcaggggaggaggcggaaagccgacattgtttacttaattaaaagtaaacaacaatttgccgctgccagcctcccattagctgt

SEQ ID NO: 2083 - DNA, 77 bp, Artificial
  Hairpin sequence HS_from_MM_351, human; MQ_from_MM_351, macaque; PT_from_MM_351, chimp
gcggctgaagccatactgtctggctcaaggccctctggtgcagaggagccaaaaccacgggacagggcctcagatgc

SEQ ID NO: 2084 - DNA, 72 bp, Artificial
  Hairpin sequence HS_from_MM_353, human; PT_from_MM_353, chimp
ctaaaagattgaaggatgctgtggcccactgccatgaggcagagaggaacatagctttgcgttcaagtttag

SEQ ID NO: 2085 - DNA, 73 bp, Artificial
  Hairpin sequence HS_from_MM_354, human
ggaattaatggcccgctgaggttaatgagtccctcctctgggccatcaactctcccagctggccattaatccc

SEQ ID NO: 2086 - DNA, 107 bp, Artificial
  Hairpin sequence HS_from_MM_355, human
ctttggcaagggtgggtatggtgaagttggtggtcttggaggtggacatttatctaacaaaatgcagctattagacaagccatttttacctggattcctttaaaaag

SEQ ID NO: 2087 - DNA, 89 bp, Artificial
  Hairpin sequence HS_from_MM_40, human; PT_from_MM_40, chimp
ggagggggcggcgcgcgagagcctggtggccctggtcagcacctcggacagggactcgggcgccaacgggcaagtgcgctgcgccctct

SEQ ID NO: 2088 - DNA, 116 bp, Artificial
  Hairpin sequence HS_from_MM_43, human
gtgtaaaaggcagaaataatcatgtaatcatcttgtaattatatggtacttactatgcaattacatagtaaatacattgtaaattcaaaataattgcatggttatttgcattatgc

SEQ ID NO: 2089 - DNA, 103 bp, Artificial
  Hairpin sequence HS_from_MM_44, human
gggcattttctgaggattgatgaccagctaggaggagttgatggtccttggctgaaacttgggccattaactctagccagtcattaattgcctggaaatgtcc

SEQ ID NO: 2090 - DNA, 86 bp, Artificial
  Hairpin sequence HS_from_MM_45, human
aggtgggggaggcggtttgtgctggtgcctggtgtataatcgggttaatccagtagacaaagaataaaccaatagccctcccacct

SEQ ID NO: 2091 - DNA, 92 bp, Artificial
  Hairpin sequence HS_from_MM_47, human; MQ_from_MM_47, macaque; PT_from_MM_47, chimp
gaccatcgttgttcaaggtgttgtgttcagggcccttccaggtaattgaggctttggggcggccacagactcgacatctaagaacaacggtc

SEQ ID NO: 2092 - DNA, 68 bp, Artificial
  Hairpin sequence HS_from_MM_48, human
gtgagacacaacctcagtgtttccaggtgattttaagaacacctgataaaactgaggtatagtaccac

SEQ ID NO: 2093 - DNA, 113 bp, Artificial
  Hairpin sequence HS_from_MM_49, human
ctccccgcccctggcagcgggctctgcttcggaaactgttgactcagagggtggccgggcggccagcgtctgatgtcagcctggagctgggccagggagtgcagggcgggcgg

SEQ ID NO: 2094 - DNA, 96 bp, Artificial
  Hairpin sequence HS_from_MM_5, human
gccggccggccgcgtcgccgcttcatgaatggagcccacgtgaccaaacatcatgtgacgtctgtggagcggcggcggcggcggcggatcccgagc

SEQ ID NO: 2095 - DNA, 99 bp, Artificial
  Hairpin sequence HS_from_MM_50, human; HS_from_MQbrain_1312, human; HS_from_MQbrain_601, human; HS_from_PT_333, human
gtggggtaaaaccccagacgccatgaaagctgccatggccctggagaaaaagctgaaccaggcccttttggatcttcatgccctgggttctgcccgcac

SEQ ID NO: 2096 - DNA, 93 bp, Artificial
  Hairpin sequence HS_from_MM_57, human; PT_from_MM_57, chimp
tcaagtgcagtagatttacacttcaaaaagtcagatacgacttcataattgaattgcacctgatcttttcaagtgcgaggccctggaacttgg

SEQ ID NO: 2097 - DNA, 113 bp, Artificial
  Hairpin sequence HS_from_MM_6, human
tagacctgggcatttcctggggattaatgaatagctgggtggagttaattgcctaaagtatagtctcaggccattaacctcagttggtcactaatccctaggaatttcttcta

SEQ ID NO: 2098 - DNA, 99 bp, Artificial
  Hairpin sequence HS_from_MM_70, human
tcagagtgttttgttgtcaggattcttagttgcttgcattggcttatgaaaaggtcattatgagagaagggatctgaatagcaacgagattccagctgg

SEQ ID NO: 2099 - DNA, 74 bp, Artificial
  Hairpin sequence HS_from_MM_73, human
cgcagctttggagacgccgaggggaaaatggatttaattgattcgttacctctggtattgtaatgcctgctgcg

SEQ ID NO: 2100 - DNA, 84 bp, Artificial
  Hairpin sequence HS_from_MM_74, human; PT_from_MM_74, chimp
atttcctgaggattaatgatcaactggaagagcttgtggtcctgggaccattaactccatgtggtcattaattttgttggaaat

SEQ ID NO: 2101 - DNA, 101 bp, Artificial
  Hairpin sequence HS_from_MM_8, human
cactgtaacaacattttactcctgactgattacattacatattgatattagtgagcatcagtatgtagtgcaatcagtcaggagaaaatgagtgaaatgtg

SEQ ID NO: 2102 - DNA, 74 bp, Artificial
  Hairpin sequence HS_from_MM_80, human; MQ_from_MM_80, macaque; PT_from_MM_80, chimp
tctgttgctcaatgggtggctgatgggggagctgatctggaaagaggctccaaaaagaattaatgagttccaga

SEQ ID NO: 2103 - DNA, 106 bp, Artificial
  Hairpin sequence HS_from_MM_81, human
agcatcggtccagtatatggttggttggtcctgagcatgttggaagagtttctgttcaacatgacatgctctgaggccacttggccagaaatgagctgagagggtt

SEQ ID NO: 2104 - DNA, 64 bp, Artificial
  Hairpin sequence HS_from_MM_82, human
ccgtgaaacccagatgctaagcactggaagatatttcttccaatagcagcatctggcgtgctgg

SEQ ID NO: 2105 - DNA, 116 bp, Artificial
  Hairpin sequence HS_from_MM_83, human
ggaatctgagttggtgccctgataaagccgagccctggcagataaatgctgaggtgcagccaagccatttatttgaggagcagcagggctcctatcagggcaccaactctgcttcc

SEQ ID NO: 2106 - DNA, 87 bp, Artificial
  Hairpin sequence HS_from_MM_84, human; MQ_from_MM_84, macaque; PT_from_MM_84, chimp
gtatttttatcttggggttctaatgactaaccacttgagctctgcttttgtggtttataatgtcaccagaaccctccatggaattat

SEQ ID NO: 2107 - DNA, 107 bp, Artificial
  Hairpin sequence HS_from_MM_85, human
caaaggtatcgaatttgtggcttttgctagctttgcagaaaagatttttttaaaatacatttcttgatagtgcaaaactagcaaaagccacaaatggaatgggtttg

SEQ ID NO: 2108 - DNA, 101 bp, Artificial
  Hairpin sequence HS_from_MM_87, human
agcacggcttggcattggaagttttatttgaatcaggggagaatattatttgagatattttcctaaatgacaaatgaatgatttacctgcagcaatgtgtt

SEQ ID NO: 2109 - DNA, 108 bp, Artificial
  Hairpin sequence HS_from_MM_89, human
ggcgcggcaccagctccgccagctccagccccaggtcctgcgcgatccggcccacgaaggtgccgtgtttggcctcctcggggacggagtagtggagctggccgctcc

SEQ ID NO: 2110 - DNA, 109 bp, Artificial
  Hairpin sequence HS_from_MM_9, human
aggtatattagcatgttaataggtctttgtgcccagaggctttggattataaattatgaagactgcattagccagatgggcaggattaattagcatgctagtattacct

SEQ ID NO: 2111 - DNA, 116 bp, Artificial
  Hairpin sequence HS_from_MM_90, human
ggaacaggcgcggcaccagctcctccagctccagccccaggtcctgcgcgatgcggcccacgaaggtgccgtgtttggcctcctcggggacggagtagcggagctggccgctcccc

SEQ ID NO: 2112 - DNA, 107 bp, Artificial
  Hairpin sequence HS_from_MM_91, human
tgccctgacctccacctccactgactccctcttttccttcttccctcagccaatgctgaggccttgaaggagatgctgggggacagtgaaggagaagggacagtgca

SEQ ID NO: 2113 - DNA, 84 bp, Artificial
  Hairpin sequence HS_from_MM_92, human
tacttgaaaggagtgtttgtaggttccagtaaagctttgtggcgaagaattgcaggacctgcagacaaactctcttcggcggta

SEQ ID NO: 2114 - DNA, 113 bp, Artificial
  Hairpin sequence HS_from_MM_93, human; MQ_from_MM_93, macaque; PT_from_MM_93, chimp
cggtatgcaggatggctggggtcgtacatctgtgggtaaggataagcatgcaagtactgtatgtatgactgatgctgactcatgggtgaggagacagccactcttgttccccg

SEQ ID NO: 2115 - DNA, 119 bp, Artificial
  Hairpin sequence HS_from_MM_96, human
cctttcctttcgtctggccgtgctggcggggctggctctgggcctcagacactctggaatcgccaaggtctgagctcagggcctggcccccttcccaggctaacagccgggaggacggg

SEQ ID NO: 2116 - DNA, 111 bp, Artificial
  Hairpin sequence HS_from_MM_98, human; PT_from_MM_98, chimp
ggggtgctgtaaagcctttattgccacttgttaaggaagacctgtatagctcactcgtgagtaataaggcggtcaacccaaactaaggcactaaaaattttatagcacccc

SEQ ID NO: 2117 - DNA, 90 bp, Artificial
  Hairpin sequence HS_from_MM_99, human
cctctttgcaaaatcatatttttgtgggaatgggccctgctttttgtggcaaggcctgttctgattaataaaggatcgtgaaaaagtagg

SEQ ID NO: 2118 - DNA, 93 bp, Artificial
  Hairpin sequence HS_from_MQbrain_1, human; HS_from_MQbrain_222, human; MQbrain_222, macaque
tttatacccgatgtcaagggagcagtactggtttgtgacatgtcctcaaacttcctgtccaagccagtggatgtttccaaggtagagtataaa

SEQ ID NO: 2119 - DNA, 59 bp, Artificial
  Hairpin sequence HS_from_MQbrain_100, human
ggcctagagccaggagtttgggggcccaccttcctgggcttccaaggaactttaggacc

SEQ ID NO: 2120 - DNA, 105 bp, Artificial
  Hairpin sequence HS_from_MQbrain_1001, human; PT_from_MQbrain_1001, chimp
ctgtgctgtggacttgccttctggacttgaggcttgctcagtcctgggcctatgcaggctccaggcaagccagggcagggcaagtccaggcaagtctaggcagag

SEQ ID NO: 2121 - DNA, 88 bp, Artificial
  Hairpin sequence HS_from_MQbrain_1002, human; PT_from_MQbrain_1002, chimp
gcctctctacagcagcattgtcactgtggaggcttctaagccaaatggacagaggtatgatagtgtcaatgagaagctgtcagacagc

SEQ ID NO: 2122 - DNA, 113 bp, Artificial
  Hairpin sequence HS_from_MQbrain_1004, human; PT_from_MQbrain_1004, chimp
tcattctagtactcttgtccatctgttctctgttgtgtgatcccaatccagatgatcctttagtgcctgagattgctcggatctacaaaacagatagagaaaagtaagtatgg

SEQ ID NO: 2123 - DNA, 112 bp, Artificial
  Hairpin sequence HS_from_MQbrain_1006, human; PT_from_MQbrain_1006, chimp
tccctccttgccagcccctgatgcctgccagacttttgcctctgctggagcccctgcctgaccagcttcccctccctgtctggttgggatttgggggctgagctgtctgggg

SEQ ID NO: 2124 - DNA, 95 bp, Artificial
  Hairpin sequence HS_from_MQbrain_1007, human
gggcccacccggtgggacccccgtggggcagggagctgggcccgacatggctccggcctctgcctttgcaccacgggacatcacagggtgggcct

SEQ ID NO: 2125 - DNA, 69 bp, Artificial
  Hairpin sequence HS_from_MQbrain_1010, human; PT_from_MQbrain_1010, chimp
ggaaattaggacagggccaggagctgtagcagcacaggttcagcttttggctcctggggccaatggtcc

SEQ ID NO: 2126 - DNA, 96 bp, Artificial
  Hairpin sequence HS_from_MQbrain_1018, human
tcgggataagaaaaggtggggattaagacatttctggaggcttagggaccaaggatggtctcttttccccacttgatccctttctctgatctgcga

SEQ ID NO: 2127 - DNA, 66 bp, Artificial
  Hairpin sequence HS_from_MQbrain_102, human
ctcggctctcctgtcctgcccacgccaaccagtggaatcaggctgtggggtgggcaggggactggg

SEQ ID NO: 2128 - DNA, 118 bp, Artificial
  Hairpin sequence HS_from_MQbrain_1020, human
ggtggcgccccaagctgtcctcctaggctccccagggaaggcggggaccaaccacccgaaatcacgccccttcctcctcccttccctagggagcttgcgaaggcgtccgggtcgcacc

SEQ ID NO: 2129 - DNA, 86 bp, Artificial
  Hairpin sequence HS_from_MQbrain_1021, human
ggttgaaggaggggcctgaaggaggttggggctgactgggcagggccagccctgccttctttcccctcacagcccctcccaaagct

SEQ ID NO: 2130 - DNA, 93 bp, Artificial
  Hairpin sequence HS_from_MQbrain_1022, human; HS_from_MQbrain_1136, human
tcttaacctggcctttcccctgtgactctccttggccccaggcaaagaaagcattttgcctgaggtcatctgtcaggtagggacagagtgaga

SEQ ID NO: 2131 - DNA, 119 bp, Artificial
  Hairpin sequence HS_from_MQbrain_1024, human
tggttcctttttgcatcttttttctccaaaggccccttggcccctggctgaggtagtttatcacataataagccctacctgcagggtccagcagcctttgggattccagagcagagcca

SEQ ID NO: 2132 - DNA, 96 bp, Artificial
  Hairpin sequence HS_from_MQbrain_1027, human
cactcatttgacttcctaggcacccactatccactaaaatgcagccatcctgtatcccagtgactagaaaatgggtgctgatgggttaatatggtg

SEQ ID NO: 2133 - DNA, 74 bp, Artificial
  Hairpin sequence HS_from_MQbrain_1028, human
tcctggagaaggtgcaccataagcaggagagcatcatggatgcagggccggtcttggtgcactgcagtgctgga

SEQ ID NO: 2134 - DNA, 93 bp, Artificial
  Hairpin sequence HS_from_MQbrain_1030, human; HS_from_MQbrain_1590, human; PT_from_MQbrain_1590, chimp
ccgcggtggcttccgcggaggtttcggcagtggcatccggggccggggtcgcggccgtggacggggccggggccgaggccgcggagctcgcgg

SEQ ID NO: 2135 - DNA, 76 bp, Artificial
  Hairpin sequence HS_from_MQbrain_1031, human
agtccctttggagcaggaaggccaggctcacaggtgccgccaggcacatgaaagggcagggcagctgagccatgct

SEQ ID NO: 2136 - DNA, 93 bp, Artificial
  Hairpin sequence HS_from_MQbrain_1034, human; PT_from_MQbrain_1034, chimp
gactgttgtttgagtgactctggggccattttcccacttgcgtctggcttcaagttgggaagctggcccaatgggggcaagttagaaaacgtt

SEQ ID NO: 2137 - DNA, 73 bp, Artificial
  Hairpin sequence HS_from_MQbrain_1036, human; PT_from_MQbrain_1036, chimp
ttctttccttattctgctgctggtttgggtctggctcttggttgaagagctgatggtggtggggaggagggga

SEQ ID NO: 2138 - DNA, 96 bp, Artificial
  Hairpin sequence HS_from_MQbrain_1037, human
cgccttcttctgagtctgacatagacatctccagccccaatgtatctcacgatgagagcattgccaaggacatgtccctgaaggactcaggcagtg

SEQ ID NO: 2139 - DNA, 78 bp, Artificial
  Hairpin sequence HS_from_MQbrain_1042, human; PT_from_MQbrain_1042, chimp
ggttgagggtgtagtgggcagagcaatgcatttctccagcgctgagaacagtctgctgctgctggcctgctctctgct

SEQ ID NO: 2140 - DNA, 108 bp, Artificial
  Hairpin sequence HS_from_MQbrain_1043, human
ctacgagacaggaagcacctcactgccctcagactgtctccaaatcctggctgagggaaaccagacaagggaagagagagggtgggggcagagaaaggttcctggtgg

SEQ ID NO: 2141 - DNA, 92 bp, Artificial
  Hairpin sequence HS_from_MQbrain_1046, human
gaagagtcggggcccaaaataactggggactgtcatcccaggcccgcctgcctgtgaagtggatggccccagagagcatctttgactgtgtc

SEQ ID NO: 2142 - DNA, 71 bp, Artificial
  Hairpin sequence HS_from_MQbrain_1048, human; PT_from_MQbrain_1048, chimp
ccgggtccccgcttccgggttccgtactgtcggccaggctacttccggcagcgcgatggctgggttcccgg

SEQ ID NO: 2143 - DNA, 78 bp, Artificial
  Hairpin sequence HS_from_MQbrain_105, human; PT_from_MQbrain_105, chimp
aggtcagggagaatgtctgtgacttagctgcagactaggagactgccctgctaactaattagcaagcagctttgacct

SEQ ID NO: 2144 - DNA, 118 bp, Artificial
  Hairpin sequence HS_from_MQbrain_1051, human
ctccgtctgaaggccagcgtgtgtggggtcagggacagagccccaggccagagaactctctggagcgggaggagatgggtcccgtgccagcgcacacggatgccttccaggactgggg

SEQ ID NO: 2145 - DNA, 72 bp, Artificial
  Hairpin sequence HS_from_MQbrain_1053, human
cccggcaccctgctcagccctagcaggggagaaactgaaactggctatgctcgggctggggagggtgctggg

SEQ ID NO: 2146 - DNA, 87 bp, Artificial
  Hairpin sequence HS_from_MQbrain_1055, human
gcctacctggagggcacgtgcgtggagtggctccgcagatacctggagaacgggaaggagacgctgcagcgcgcaggtaccaggggc

SEQ ID NO: 2147 - DNA, 113 bp, Artificial
  Hairpin sequence HS_from_MQbrain_1056, human; HS_from_MQbrain_1080, human; PT_from_MQbrain_1056, chimp; PT_from_MQbrain_1080, chimp
aagaatctgaatataaatttgttttctcaaatatttgctatgagaggttgatggattaattaaataagtcaattcctggaatttgagagagcaaataaagacctgagaacctt

SEQ ID NO: 2148 - DNA, 97 bp, Artificial
  Hairpin sequence HS_from_MQbrain_1058, human
tttgtagaggagaggtttcaccagggggttcactggtatttaaagttaaaatagagaatgaaaagtgaaagcctttgcgttggagactcgtttcaaa

SEQ ID NO: 2149 - DNA, 98 bp, Artificial
  Hairpin sequence HS_from_MQbrain_1059, human; HS_from_MQbrain_172, human; MQbrain_1059, macaque
agtcagcctatatgcaccagctcttgggcctcaacctcctcttcctgctgtcccagaaccgggtggctgagttccacacggagttggagcggctgcct

SEQ ID NO: 2150 - DNA, 86 bp, Artificial
  Hairpin sequence HS_from_MQbrain_106, human; MQbrain_106, macaque
ggcggcagcgtctcgggcgggcgggaggtgcaccagcggcggcggcggcggtaaatcctcccggccgctcacagcactgtggagcc

SEQ ID NO: 2151 - DNA, 76 bp, Artificial
  Hairpin sequence HS_from_MQbrain_1061, human; PT_from_MQbrain_1061, chimp
gcagagcagtcaggtgggaggctcctgaagcaactcaaagatgcagcaggggcccgagcgctgactttcagtctgc

SEQ ID NO: 2152 - DNA, 119 bp, Artificial
  Hairpin sequence HS_from_MQbrain_1062, human
ctggccccctgggaccccctggtcatggccaaaccctgggtaagagtgagggcatcagggcaggctgagctctgggtagagaaagggaagggctgagtgggtgggttgaaggggtccag

SEQ ID NO: 2153 - DNA, 88 bp, Artificial
  Hairpin sequence HS_from_MQbrain_1064, human; HS_from_MQbrain_1143, human
ctgccccccagctggagctgcctttggcctggcacctcccttccccagaggctggtgcccgcctcccagcccttcttggatggggtgg

SEQ ID NO: 2154 - DNA, 76 bp, Artificial
  Hairpin sequence HS_from_MQbrain_1065, human
tttcagtgactcctaaagggacagcctgatggcaagtggctcttctcattggcctggcttccccttgagactgggg

SEQ ID NO: 2155 - DNA, 116 bp, Artificial
  Hairpin sequence HS_from_MQbrain_1070, human; HS_from_MQbrain_1566, human
tggacccagcacaaatggttcccagtttttcatctgcactgccaagagtgagtggttggatggcaagcaagtggtctttggcaagatgaaagaaggcatgaatattgtggaggcca

SEQ ID NO: 2156 - DNA, 68 bp, Artificial
  Hairpin sequence HS_from_MQbrain_1072, human
cggggcatggggggcgccttcgtgctggtcctgtacgacgagctcaagaaggtgatctaagggccgcg

SEQ ID NO: 2157 - DNA, 91 bp, Artificial
  Hairpin sequence HS_from_MQbrain_1073, human
gagggctgcggggtgagccctgcggcccctctagcttcggcggtcacatttccgagaggtcggcgggggctgcgcggactcggtggtcctc

SEQ ID NO: 2158 - DNA, 86 bp, Artificial
  Hairpin sequence HS_from_MQbrain_1074, human; PT_from_MQbrain_1074, chimp
gcgcgcgtgggaaggggaggggtgggcggggctaacggtccaatccgggtaactccgcccctgcctgactccccctgcgcggacgc

SEQ ID NO: 2159 - DNA, 77 bp, Artificial
  Hairpin sequence HS_from_MQbrain_1075, human
tgggcagggggagagaggtggggtccgggcagagtttctccactgggacattaaagcccctcctgtctcctctccta

SEQ ID NO: 2160 - DNA, 117 bp, Artificial
  Hairpin sequence HS_from_MQbrain_108, human
gtcaggacacagagagagacttggtgtggggttgagggtgagggacgagtggaggacacccccaggtctatctgaccctcccctctctaaaccaggctccttctgtgtccacagggc

SEQ ID NO: 2161 - DNA, 109 bp, Artificial
  Hairpin sequence HS_from_MQbrain_1081, human; HS_from_MQbrain_1648, human
gcatcttgtccatggcaaatgctggacccaacacaaacagttcccagtttttcatctgcactgccaagactgagtggttggatggcaagcatgtggtctttggcaaggc

SEQ ID NO: 2162 - DNA, 96 bp, Artificial
  Hairpin sequence HS_from_MQbrain_1082, human
ggtccgcaggccccccagtttttccccctgccctgcctcctgatgtcacggctggcagcagggcactggggccaggcctggtggggcctttgggct

SEQ ID NO: 2163 - DNA, 87 bp, Artificial
  Hairpin sequence HS_from_MQbrain_1083, human
catttctgggcagggggagagaggtggggtccgggcagagtttctccactgggacattaaagcccctcctgtctcctctcctagttg

SEQ ID NO: 2164 - DNA, 119 bp, Artificial
  Hairpin sequence HS_from_MQbrain_1084, human
gctttaattttcatttttagcactctaaagtttgggaagtaattaagaaccacctcaaaatctgcagttttttgttcttgtttcttataggctgaaggggatgctaagggagataaagc

SEQ ID NO: 2165 - DNA, 97 bp, Artificial
  Hairpin sequence HS_from_MQbrain_1085, human
cattgttgctggcctggctgtcctagcagttgtggtcatcggagctgtggtcgctgctgtgatgtgtaggaggaagagttcaggtagggaaggggtg

SEQ ID NO: 2166 - DNA, 88 bp, Artificial
  Hairpin sequence HS_from_MQbrain_1087, human; PT_from_MQbrain_1087, chimp
gggccgtctgccctgcccagagctgtgtcctgatgccgtgttcaggctcatggagcagtgctgggcctatgagcctgggcagcggccc

SEQ ID NO: 2167 - DNA, 69 bp, Artificial
  Hairpin sequence HS_from_MQbrain_1088, human; HS_from_MQbrain_403, human; HS_from_MQbrain_404, human; PT_from_MQbrain_1088, chimp; PT_from_MQbrain_403, chimp; PT_from_MQbrain_404, chimp
gggcagaggggtgagggattgcttcgaaaggatttcctaaagaggtatcagtgcttcattggaatgccc

SEQ ID NO: 2168 - DNA, 107 bp, Artificial
  Hairpin sequence HS_from_MQbrain_1089, human
caagaaaatcacagcctttgtacccaacgacggttgcttaaactttattgaggaaaatgatgaagttctggttgctggatttggtcgcaaaggtcatgctgttggtg

SEQ ID NO: 2169 - DNA, 70 bp, Artificial
  Hairpin sequence HS_from_MQbrain_1090, human; PT_from_MQbrain_1090, chimp
ggccctggtggccctgggatggggaaccgcggtggcttccgcggaggtttcggcagtggcatccggggcc

SEQ ID NO: 2170 - DNA, 64 bp, Artificial
  Hairpin sequence HS_from_MQbrain_1091, human; HS_from_MQbrain_1223, human; HS_from_MQbrain_1224, human
gcaagctgctggagggcgaggagtgcaggtgggtaactgacgcgacttcctccaacagctgagt

SEQ ID NO: 2171 - DNA, 116 bp, Artificial
  Hairpin sequence HS_from_MQbrain_1092, human
catgagtgggtaactggatgggcttccaggatgagcccctgtgactttggtgggtttacatccatgcaatacaaatccacaggctcttactctagaagcttctgccggggctgatg

SEQ ID NO: 2172 - DNA, 77 bp, Artificial
  Hairpin sequence HS_from_MQbrain_1095, human; PT_from_MQbrain_1095, chimp
gttggcatggtgacaacatgctggagccaagtggtaacatgccttggttctaggaatggaaagtcacctataaagat

SEQ ID NO: 2173 - DNA, 58 bp, Artificial
  Hairpin sequence HS_from_MQbrain_1097, human; MQbrain_1097, macaque; PT_from_MQbrain_1097, chimp
ggaactcactccagtgtgcagccttcttcaaaatggctgccagccatggaggagatcc

SEQ ID NO: 2174 - DNA, 106 bp, Artificial
  Hairpin sequence HS_from_MQbrain_1099, human
aggatagtgctggtcatgcccccgatgcagctatgctctgaatgatttcattcctgagagtgatagcattctggtcctggctgcagtggggtacaatttacgtcct

SEQ ID NO: 2175 - DNA, 119 bp, Artificial
  Hairpin sequence HS_from_MQbrain_11, human
gttagtagggcagtcactctctcatctcaccttatgtctgagattctggcccttcctatgctttggggaggtccattattttacactaaagggaggaagggtgatggagaattgttgac

SEQ ID NO: 2176 - DNA, 79 bp, Artificial
  Hairpin sequence HS_from_MQbrain_110, human; MQbrain_110, macaque
atctactcagcttcattgactcggcgtccagcaacatcaagctggcgctggacaagccgggcaagtcgaagcggaaggt

SEQ ID NO: 2177 - DNA, 68 bp, Artificial
  Hairpin sequence HS_from_MQbrain_1100, human
tcctgtggaggcctcctgggaacaggacttcttaaaggaagtatgtctggaaggctgtggtccaaggg

SEQ ID NO: 2178 - DNA, 120 bp, Artificial
  Hairpin sequence HS_from_MQbrain_1102, human
agcaggggaaggggaggagcgggacgagggtgaagacaggcagaaagaaagggcaagagctgctcccagcgctgaatatggaaaaacccacatctgcactccaaggatccgtctcttgtt

SEQ ID NO: 2179 - DNA, 87 bp, Artificial
  Hairpin sequence HS_from_MQbrain_1103, human
ggtactggcttctttatgccctctgggtctgctgggttgccatggtgagcccagctcacacacagtaggtgactcaggccacctgcc

SEQ ID NO: 2180 - DNA, 117 bp, Artificial
  Hairpin sequence HS_from_MQbrain_1108, human
cgcccgcccacccgccctcggtttcgatgcgcccggagcgatcctccttccctctcctcgggggagggtgggtcacttcgcggcgctcggtgaacgccgaggaaaggggaagccgcg

SEQ ID NO: 2181 - DNA, 119 bp, Artificial
  Hairpin sequence HS_from_MQbrain_1109, human
aggacccttcccccctccggctgtaggaaggaggcggctggctcctgcctatatttggtgggattgtctctggctccttagggacaggaatgcagggagtgggggaagaaagccgtcct

SEQ ID NO: 2182 - DNA, 78 bp, Artificial
  Hairpin sequence HS_from_MQbrain_111, human; MQbrain_111, macaque
cttttattctcctattggagggtctaatttgtcccaaaataggggcaagtggggttgagggtggggtttgggtggggg

SEQ ID NO: 2183 - DNA, 116 bp, Artificial
  Hairpin sequence HS_from_MQbrain_1110, human
ggtcttcatctttgcagtctcgggtgcccacctcagctgtgggcctggtgagagtgcctcagtcatcagtgtcctcaggtgacctgttgcccaaggctgcactgggaggagagact

SEQ ID NO: 2184 - DNA, 53 bp, Artificial
  Hairpin sequence HS_from_MQbrain_1112, human
gcagcttctgacacaccagccccaggacctggggcgactggaggaagccaggc

SEQ ID NO: 2185 - DNA, 99 bp, Artificial
  Hairpin sequence HS_from_MQbrain_1114, human
ggcactgcctgcggaaggtaggattagatcattagctcagtgacctcctagggtttcgatgtgctgtgttctcatcctacagttggtttggtaatgatc

SEQ ID NO: 2186 - DNA, 118 bp, Artificial
  Hairpin sequence HS_from_MQbrain_1116, human
gccccagttccgggctgtcttgggggaactgaaactgtgtgagaagatggcccagtttgatgctaaaaagtttgcagagacccagcctaaaaaggacacaccacggaaagagaagggt

SEQ ID NO: 2187 - DNA, 54 bp, Artificial
  Hairpin sequence HS_from_MQbrain_1119, human
acccagccctgccctggctctggcatgtatgtgggagagagggacagggggagt

SEQ ID NO: 2188 - DNA, 114 bp, Artificial
  Hairpin sequence HS_from_MQbrain_112, human; PT_from_MQbrain_112, chimp
ggacctcatggtcagcctgtgggtggacttagatttgataatccccgaggtcagcctgtaggtggacttagatttgaggggggtcatggtccatcaggggctgcgattaggttt

SEQ ID NO: 2189 - DNA, 106 bp, Artificial
  Hairpin sequence HS_from_MQbrain_1120, human; PT_from_MQbrain_1120, chimp
gatctatggctgaggtagtgatggaaggagctgttgggcttggagaaatttggtgtcataaagaaaaagagcttgctgtttattattgttgctgggctggggggtc

SEQ ID NO: 2190 - DNA, 73 bp, Artificial
  Hairpin sequence HS_from_MQbrain_1124, human
aagagtgtcactgagctgtgttttgtctgagcctctctcggtcaacagcaaagcttggtgtcttggcactgtt

SEQ ID NO: 2191 - DNA, 112 bp, Artificial
  Hairpin sequence HS_from_MQbrain_1126, human; HS_from_MQbrain_88, human
ggtcaaaaagatagtgtctcttgtgagatcagcgtgcagcttccctggccttgaagcccaaggcacagaggtaatcacatctgtagctttaggtgcactctttccttgtgcc

SEQ ID NO: 2192 - DNA, 97 bp, Artificial
  Hairpin sequence HS_from_MQbrain_1127, human
ggccttcaacctggtcaaggacagtgccacggggctctccaagggctacgccttctgtgagtacgtggacatcaacgtcacggatcaggtgagtccc

SEQ ID NO: 2193 - DNA, 94 bp, Artificial
  Hairpin sequence HS_from_MQbrain_1128, human; HS_from_MQbrain_1462, human
agtggtatcactgtaggtggtgtcactgtagtgcaatgtcactgtggagcagcactgtcactgtagaggggtgtcactgtaaggtggtgtcact

SEQ ID NO: 2194 - DNA, 68 bp, Artificial
  Hairpin sequence HS_from_MQbrain_113, human
tccccgcgggagggcgtcggagctgccccggcgccgccgctcctccctcgcgccctcccgctcccgga

SEQ ID NO: 2195 - DNA, 72 bp, Artificial
  Hairpin sequence HS_from_MQbrain_1131, human
ggtcagggtttgactggagaggctgatttggaacatctggagcaggtctgacctctctagttggcctttatt

SEQ ID NO: 2196 - DNA, 109 bp, Artificial
  Hairpin sequence HS_from_MQbrain_1134, human
cggggtgagggctgggggcgctggagcgggaggggccaggcagggaggtgggaccatgggggccttgctgtgtgaccaccgttcctgcaggcccatcagcctcactgtg

SEQ ID NO: 2197 - DNA, 72 bp, Artificial
  Hairpin sequence HS_from_MQbrain_1137, human
tgggcgggggctcctggcttggtccccctgtggtaccccttttctgggtcccctccagcccagcctccccca

SEQ ID NO: 2198 - DNA, 114 bp, Artificial
  Hairpin sequence HS_from_MQbrain_1139, human
tgagattagttaatattaattgagtggccaaatgatggatgattctgtgctgagtgtttctgataaggcagtcaagtatagaaacatggatggtttttcatttagctgatttca

SEQ ID NO: 2199 - DNA, 109 bp, Artificial
  Hairpin sequence HS_from_MQbrain_114, human; PT_from_MQbrain_114, chimp
tcctcatttgttaaaattaagcactttgcatttttctttccactctttaagaagaaggaggtcttcgaggggagaagaggaaacgagatgctgaagacgatggagagga

SEQ ID NO: 2200 - DNA, 83 bp, Artificial
  Hairpin sequence HS_from_MQbrain_1144, human
gcctgggttcatattggccaagtcatcaggtccatctgcaccaagcagaacaaggagcatgtgattgaggccctacacagtgc

SEQ ID NO: 2201 - DNA, 66 bp, Artificial
  Hairpin sequence HS_from_MQbrain_1145, human; PT_from_MQbrain_1145, chimp
tctttttgcccccctttgctgtctttcaggggacttgtatacccaggcagcagaggcagcgatgga

SEQ ID NO: 2202 - DNA, 62 bp, Artificial
  Hairpin sequence HS_from_MQbrain_1146, human
ggaggcctctgctgtggctgcccactggctgtgctcagaccttgaagccgcagcgaacctct

SEQ ID NO: 2203 - DNA, 114 bp, Artificial
  Hairpin sequence HS_from_MQbrain_1147, human
gagctgaactgtggcagaggtgcaggctggcaggaatggatgtgccctgggctgctgcaagctcctgtccccaatcacatccattcatgcagcccaactgcctccaggggcctc

SEQ ID NO: 2204 - DNA, 56 bp, Artificial
  Hairpin sequence HS_from_MQbrain_115, human
cttaaccaccagcatccctcctctccccaaggtgaagtggagggtgctgtggtgag

SEQ ID NO: 2205 - DNA, 77 bp, Artificial
  Hairpin sequence HS_from_MQbrain_1150, human
ggaacttcccatcaatcagccaagaatgctctgccagtgggtgagagtctgtgaggcaggagagcttggggacttcc

SEQ ID NO: 2206 - DNA, 73 bp, Artificial
  Hairpin sequence HS_from_MQbrain_1152, human
ggccaagtggaggtgactggcaatgaatacaatgtggaaagcattgatggccagccaggtgcctttacctgct

SEQ ID NO: 2207 - DNA, 97 bp, Artificial
  Hairpin sequence HS_from_MQbrain_1156, human; HS_from_MQbrain_1479, human
gattccttggtagaggaaatttcagtgttggcttggcaaaagaaattgtttctttagccaaggatatatgatcctgaagagtctttggccttgagtt

SEQ ID NO: 2208 - DNA, 105 bp, Artificial
  Hairpin sequence HS_from_MQbrain_1159, human
gtaagtgggcccacccggtgggacccccgtggggcagggagctgggcccgacatggctccggcctctgcctttgcaccacgggacatcacagggtgggcctcggc

SEQ ID NO: 2209 - DNA, 109 bp, Artificial
  Hairpin sequence HS_from_MQbrain_116, human
ctgcacattattctgatgaaaatccacaatgtctttgagcttctggttgtgtaatgctggggtttaaagtcaccatttgtgggtttggcatcaattaatatttagccag

SEQ ID NO: 2210 - DNA, 112 bp, Artificial
  Hairpin sequence HS_from_MQbrain_1160, human
aattgggccgtaggtggagaggagttggaggtgcagatatagggaggaacccagttgtaggtttcttagaaaatcaccatggccttctcagagaccctttattagctcattt

SEQ ID NO: 2211 - DNA, 116 bp, Artificial
  Hairpin sequence HS_from_MQbrain_1163, human
cctgcaggaattagtgctgagaagcaggagcttgggggtaggaggaagagatccagtcccagatacaggtgaagaaatcccttccctctcccaagcatggcagtcagcactgcagg

SEQ ID NO: 2212 - DNA, 113 bp, Artificial
  Hairpin sequence HS_from_MQbrain_1164, human; PT_from_MQbrain_1164, chimp
ttgatgttccctctccctttgcagagggcaggtgaggaccatgtggatctttctagaaatacatgtggatgtttgcaaatgcagaactgactggtggagacagggaacatgaa

SEQ ID NO: 2213 - DNA, 102 bp, Artificial
  Hairpin sequence HS_from_MQbrain_1167, human
ggggcgtggggtgagcaggccctgtctccatggcagaggagggacctgggtgctgcctgtccccccttctctcggtggaccctggcctgcttccagagcttt

SEQ ID NO: 2214 - DNA, 87 bp, Artificial
  Hairpin sequence HS_from_MQbrain_1168, human; HS_from_MQbrain_1892, human; HS_from_MQbrain_800, human; HS_from_MQbrain_808, human; HS_from_MQbrain_809, human
cagtcatccacggtctctggcaggaaccaagctggagctcagaaagctttaaaatgggctccagacttgtgggagtccctgggtttg

SEQ ID NO: 2215 - DNA, 67 bp, Artificial
  Hairpin sequence HS_from_MQbrain_1169, human
cctgtggaggcctcctgggaacaggacttcttaaaggaagtatgtctggaaggctgtggtccaaggg

SEQ ID NO: 2216 - DNA, 61 bp, Artificial
  Hairpin sequence HS_from_MQbrain_117, human
aatgagacggaggatggcatcatctgtgaataacacagatgatgccatcctccatctcatt

SEQ ID NO: 2217 - DNA, 76 bp, Artificial
  Hairpin sequence HS_from_MQbrain_1174, human; MQbrain_1174, macaque; PT_from_MQbrain_1174, chimp
ggctctgctctgtccagctgggctgtgaactaccaaccagtgaagtacaccagcctgctggcagacaaagtgggct

SEQ ID NO: 2218 - DNA, 64 bp, Artificial
  Hairpin sequence HS_from_MQbrain_1175, human; PT_from_MQbrain_1175, chimp
caaacggcgccaggagcccctgcggcagcctagccctcagcggggagccggggccccggagttg

SEQ ID NO: 2219 - DNA, 64 bp, Artificial
  Hairpin sequence HS_from_MQbrain_118, human; MQbrain_118, macaque; PT_from_MQbrain_118, chimp
tgagaggttccgaggatgcggcagctggaacagtattgcagcggctgatccaggaacaactgcg

SEQ ID NO: 2220 - DNA, 85 bp, Artificial
  Hairpin sequence HS_from_MQbrain_1180, human
cacaaagtctggcagcacccccagcccagctgcacgataagataagacgtgcccaagggacctggggcgagaagccagactggtg

SEQ ID NO: 2221 - DNA, 109 bp, Artificial
  Hairpin sequence HS_from_MQbrain_1181, human
ggggatgaacgggacctagaagaaaagtgcctacgacttccgtgatgccttgcggttgctgtagcctaatgcctcgtgggagttgtagttttctttggaaaccgtccct

SEQ ID NO: 2222 - DNA, 83 bp, Artificial
  Hairpin sequence HS_from_MQbrain_1182, human
ggaagtgggacaggatcagtggaaacgctgcttgggtatttgaaattcaagcagtgagacctgagagactggagttcctcgcc

SEQ ID NO: 2223 - DNA, 62 bp, Artificial
  Hairpin sequence HS_from_MQbrain_1183, human
ggagcctgcaatccaggtggaacagactgtcctccatgtcagttccttctggcttcaggccc

SEQ ID NO: 2224 - DNA, 91 bp, Artificial
  Hairpin sequence HS_from_MQbrain_1184, human
ggttccagcacctctggctgcctgggcctccttcctctgactgttggcaccagctgtcagcccctggaggaatgggcagcctgtcggcacc

SEQ ID NO: 2225 - DNA, 60 bp, Artificial
  Hairpin sequence HS_from_MQbrain_1185, human
gtgtgtgattttgtatcccctgctgtgcctcagtagaggacagcaggatgtagtcagcat

SEQ ID NO: 2226 - DNA, 72 bp, Artificial
  Hairpin sequence HS_from_MQbrain_1188, human
ggggaccctctgccttagggctcagcctccagcctggccctgggtgatggaggctctgccctcagggtctct

SEQ ID NO: 2227 - DNA, 76 bp, Artificial
  Hairpin sequence HS_from_MQbrain_1190, human; PT_from_MQbrain_1190, chimp
ccatgtgccccctctggtcctatcttccattctggtttcactctcagggagggaaaggtgagcggggcctgcctgg

SEQ ID NO: 2228 - DNA, 107 bp, Artificial
  Hairpin sequence HS_from_MQbrain_1193, human; MQbrain_1193, macaque; PT_from_MQbrain_1193, chimp
gaggcccagtctggcctgatgcttctgtgctcggtgctcctgggtagcaaggcgcttctgtgaccctgggggagctgggtgcttgagccccaggcccctctggcctc

SEQ ID NO: 2229 - DNA, 119 bp, Artificial
  Hairpin sequence HS_from_MQbrain_1195, human
gtatgcctgcctggccttgtctcttggaagagcaccttaggccaggttcccatttccctcttcccctgggcttgcctccctagtttgcttttcctaccgatgtgctggctaggatgtgc

SEQ ID NO: 2230 - DNA, 61 bp, Artificial
  Hairpin sequence HS_from_MQbrain_1196, human
ggcagttcctactggcttggccggaggaggctgtcccttcatctgtccaggaggagctgct

SEQ ID NO: 2231 - DNA, 71 bp, Artificial
  Hairpin sequence HS_from_MQbrain_1197, human
agggtacagaggggaggggttcctcggctgtgcacgtgaggtgcagctgggaattctgatctgaggatgct

SEQ ID NO: 2232 - DNA, 97 bp, Artificial
  Hairpin sequence HS_from_MQbrain_1198, human; PT_from_MQbrain_1198, chimp
tcccggaaaacctgggagcggttgcggagaggggaggaagcgacttgtttgtcccctgacccctctgttaagatctagctcccttcaggagatgggg

SEQ ID NO: 2233 - DNA, 73 bp, Artificial
  Hairpin sequence HS_from_MQbrain_1199, human
gctctaggaagctgcagctggagcggcccgtgtcccctgagacccaggctgacctccagcggaatctggtggc

SEQ ID NO: 2234 - DNA, 79 bp, Artificial
  Hairpin sequence HS_from_MQbrain_120, human
tcgcgctgggcagcctcttcgccctggctgggctgctggaaggccggctcgtgggcgaggaggaagccggctttggcga

SEQ ID NO: 2235 - DNA, 72 bp, Artificial
  Hairpin sequence HS_from_MQbrain_1200, human
ccagtgcaggatagcacccagatcacttgctctctgcaactgtctgctgctccccattactgtcctgactgg

SEQ ID NO: 2236 - DNA, 93 bp, Artificial
  Hairpin sequence HS_from_MQbrain_1201, human; HS_from_MQbrain_1404, human
caagaaagccgaggctggggctgggtcagcaaccgaattccagtttagaggcggatttggtcgtggacgtggtcagccacctcagtaaaattg

SEQ ID NO: 2237 - DNA, 108 bp, Artificial
  Hairpin sequence HS_from_MQbrain_1202, human; PT_from_MQbrain_1202, chimp
ggtgggtgttgggtggtggggaggaggcttatgttgtgcatgggaggctgtggatgtacttctcctttgcagagagtaatgcccttccctgccaggtacactcctgcc

SEQ ID NO: 2238 - DNA, 60 bp, Artificial
  Hairpin sequence HS_from_MQbrain_1203, human; PT_from_MQbrain_1203, chimp
aggcctgttgatcctgacagaccccagacacctgtggtagcccagagatgaatgaggcct

SEQ ID NO: 2239 - DNA, 114 bp, Artificial
  Hairpin sequence HS_from_MQbrain_1204, human; PT_from_MQbrain_1204, chimp
ctgacaggtccccaggctgtctggctctgtgcctgtctctccagcccagctctgacattcagtgacagggagtgagggtggggcaggccacagtgctggtgccaggggagttag

SEQ ID NO: 2240 - DNA, 84 bp, Artificial
  Hairpin sequence HS_from_MQbrain_1205, human
cagaagctgccactttgcctggcccccagggcccagcaggcaccctcagctgaggccccaggaggctgggcttggggagaactg

SEQ ID NO: 2241 - DNA, 112 bp, Artificial
  Hairpin sequence HS_from_MQbrain_1206, human; MQbrain_1206, macaque
ggaacgagaaggacgactccgagctgcctacaacctggtgaagcgtgggatcaccaatctctgtgtcattgggggtgatggcagcctcactggggctgacaccttccgttct

SEQ ID NO: 2242 - DNA, 105 bp, Artificial
  Hairpin sequence HS_from_MQbrain_1207, human; HS_from_MQbrain_591, human; MQbrain_1207, macaque
cagtcgtgtgagtgtgtggctgttatgtttgcctccattgccaacttctctgagttctatgtggagctggaggcaaacaatgagggtgtcgagtgcctgcggctg

SEQ ID NO: 2243 - DNA, 74 bp, Artificial
  Hairpin sequence HS_from_MQbrain_1208, human; PT_from_MQbrain_1208, chimp
tgtagctttggcttggggatggctgtcgctaccactgttcaggtcagcagcagccagccccaggcttttctcca

SEQ ID NO: 2244 - DNA, 97 bp, Artificial
  Hairpin sequence HS_from_MQbrain_1209, human; PT_from_MQbrain_1209, chimp
gagtccccggctgctcaccaagctccctggtcagctgctccctggccatgggctgcagccaccacaggggcctccgggtgggcaagccggaggtctt

SEQ ID NO: 2245 - DNA, 101 bp, Artificial
  Hairpin sequence HS_from_MQbrain_121, human
tcagttgttatcttaattgacttcaactcatatgtatgtatgtgtgtatgtattacatatatacatataactacatctgtcagagggaagtggcaaattga

SEQ ID NO: 2246 - DNA, 70 bp, Artificial
  Hairpin sequence HS_from_MQbrain_1210, human; PT_from_MQbrain_1210, chimp
ggcatatgctaagtgggcagcatggagggcaggcaggcttggtaccccagcagagctcacagccagtgct

SEQ ID NO: 2247 - DNA, 106 bp, Artificial
  Hairpin sequence HS_from_MQbrain_1211, human; PT_from_MQbrain_1211, chimp
ccttgacccatgggtttctcctggcatttacaggacctgaggatgggggcgtgaaggcatccccagtgcccagtgaccctgagaagccaggcaccccaggtgaagg

SEQ ID NO: 2248 - DNA, 95 bp, Artificial
  Hairpin sequence HS_from_MQbrain_1212, human
gccctgatgccagcaccaatcccaggctgctgcttctcccctcagggttccttgtgggccttgggacagagcaacttgggatggtgggggagggt

SEQ ID NO: 2249 - DNA, 82 bp, Artificial
  Hairpin sequence HS_from_MQbrain_1213, human
gggttctcctggggcctttgggtcagggagcctctgacagttagtctcttcctttcccctgcccctagctgctggaagacct

SEQ ID NO: 2250 - DNA, 102 bp, Artificial
  Hairpin sequence HS_from_MQbrain_1214, human; HS_from_MQbrain_1216, human; HS_from_MQbrain_1217, human
acttctctgctggtggaatgttctttctgttgattatggcaagaagtccaagttggagttctccgcatacccaaccccccatatttccacagctatagttgt

SEQ ID NO: 2251 - DNA, 98 bp, Artificial
  Hairpin sequence HS_from_MQbrain_1215, human; PT_from_MQbrain_1215, chimp
gaggctccagcgccggccccgccctagtgcgttacttacctcgactcttagcttgtcggggacggtaaccgggacccggtgtctgctcctgtcgcctt

SEQ ID NO: 2252 - DNA, 66 bp, Artificial
  Hairpin sequence HS_from_MQbrain_1219, human
aggaagcgtaggaagggggtggggtgagggagccctgttcctctcctgaccccctgctgtgcccct

SEQ ID NO: 2253 - DNA, 74 bp, Artificial
  Hairpin sequence HS_from_MQbrain_1221, human
tcctgtgcaatcagatggtgtggtttctgccttggaaagagggttggaagaggaggcaagtctgaagtacaggg

SEQ ID NO: 2254 - DNA, 110 bp, Artificial
  Hairpin sequence HS_from_MQbrain_1222, human
gaggtgatgaactccaagctggcctggactttgagatcgccacctacaggcgcctgctggagggcgaggagcagaggtgaggaccacagctgtggggagggtgtcccctc

SEQ ID NO: 2255 - DNA, 96 bp, Artificial
  Hairpin sequence HS_from_MQbrain_1225, human
ccatcccctggggcttagggatgggaggccaggatgaagattaatccctaatccccaacactggccttgctatccccagggcggaccaggcactgg

SEQ ID NO: 2256 - DNA, 96 bp, Artificial
  Hairpin sequence HS_from_MQbrain_1227, human; PT_from_MQbrain_1227, chimp
gggagaatctgcagtgggaaagtcaagcctggtattacgttttgtcaaagggcagttccatgagtaccaggagagcaccattggaggtgagtgcct

SEQ ID NO: 2257 - DNA, 98 bp, Artificial
  Hairpin sequence HS_from_MQbrain_1228, human
ctgggcagtctctggcttcctcccctacccctaaaggaaacattgttcttttctggtcagcctttggggataaggggacagagggaagaagaccttgg

SEQ ID NO: 2258 - DNA, 59 bp, Artificial
  Hairpin sequence HS_from_MQbrain_1229, human
ctgagccacacatctccctgcccttctggcactgaagggccttggggtagtttgctcag

SEQ ID NO: 2259 - DNA, 119 bp, Artificial
  Hairpin sequence HS_from_MQbrain_123, human
agggatgaaatgggcacctagtcagatcttctcagcttgctagccaaaaatgactgtgattctgctgggggctgctgagaaggtaatgtaggttgaaaaggggctctaagtttatttct

SEQ ID NO: 2260 - DNA, 50 bp, Artificial
  Hairpin sequence HS_from_MQbrain_1231, human
gcgggagcccctctggccaactcatgaggttgtgctggagaaggccctgc

SEQ ID NO: 2261 - DNA, 98 bp, Artificial
  Hairpin sequence HS_from_MQbrain_1234, human; PT_from_MQbrain_1234, chimp
agtgtcaccttctggaccaggtgtagtggtcatgcagctgaatgtccctaatggaccccagccccctcagaacccatccatggtccagtggagtcatt

SEQ ID NO: 2262 - DNA, 97 bp, Artificial
  Hairpin sequence HS_from_MQbrain_1235, human; HS_from_MQbrain_1323, human
gggtggggggactgggtctgggatgggtacccttctcattagtaagatccgggaggagtacccagacaggatcataaacacattcagcatcctgccc

SEQ ID NO: 2263 - DNA, 114 bp, Artificial
  Hairpin sequence HS_from_MQbrain_1236, human
ggtgacaccaggagagagggacaggttctgttgggggtgacaagaggagacagggacaggttctgtcgggggtgacaccaggagagagggacaggttctgtcaggggtgacacc

SEQ ID NO: 2264 - DNA, 117 bp, Artificial
  Hairpin sequence HS_from_MQbrain_1237, human; HS_from_MQbrain_1812, human; HS_from_MQbrain_1813, human
gggacaggttctgtcgggggtgacaccaggagagagggacaggttctgtcaggggtgacaccaggagagagggacaggttctgttgggggtgacaccaggacacaggaataggttct

SEQ ID NO: 2265 - DNA, 86 bp, Artificial
  Hairpin sequence HS_from_MQbrain_1238, human; PT_from_MQbrain_1238, chimp
gggaaaggcagcatctgcagtcccaagctcagtggggctgtgtaccgcacccagcttccactggggctccagaggccaggattccc

SEQ ID NO: 2266 - DNA, 79 bp, Artificial
  Hairpin sequence HS_from_MQbrain_1239, human; PT_from_MQbrain_1239, chimp
caataggtgatgacaggtggacagacggacgccacaaagggaggcagaggtggtctgtcccatcacattgccaaggttg

SEQ ID NO: 2267 - DNA, 95 bp, Artificial
  Hairpin sequence HS_from_MQbrain_1241, human; PT_from_MQbrain_1241, chimp
aggaataatcaacgtgaaaggaaagggggacctgaagacgtactttgtaaacacagaaatgtcaaggtccctttcccagagcaacgtggcatcct

SEQ ID NO: 2268 - DNA, 88 bp, Artificial
  Hairpin sequence HS_from_MQbrain_1243, human
gctatagattcagaactcgtgttcaaagcctttagcccagcaatgggagagtgctaaaggcttcaagcacgagttctgaatctatggc

SEQ ID NO: 2269 - DNA, 75 bp, Artificial
  Hairpin sequence HS_from_MQbrain_1245, human
gtggggagacctcgagcctgagttctgcctagaggtggatgggtgggaagggtacagggggtgggattccagggc

SEQ ID NO: 2270 - DNA, 75 bp, Artificial
  Hairpin sequence HS_from_MQbrain_1246, human
tcaaggaaaagctgtgctacgtcgccctggacttcgagcaggagatggccacggcagcctccagctcctccctgg

SEQ ID NO: 2271 - DNA, 100 bp, Artificial
  Hairpin sequence HS_from_MQbrain_1248, human
cctggccaacgtcatccacaactttggtatcgtggaaggacccatgaccacagtccatgctatcactgccacccagaagattgtggatggcccctccggg

SEQ ID NO: 2272 - DNA, 102 bp, Artificial
  Hairpin sequence HS_from_MQbrain_1250, human
tctcgtttcagctgtgggattaattattgccattctcatcccagtggcagtggctgtcattgttggagtggtgacaagtatcctttgctatcggaaacgaga

SEQ ID NO: 2273 - DNA, 89 bp, Artificial
  Hairpin sequence HS_from_MQbrain_1253, human; PT_from_MQbrain_1253, chimp
gtcctagcctcttgtccatggcaactgctggacccaatataaatggttcccagtttttaatctacactgccaagactgagtggttggat

SEQ ID NO: 2274 - DNA, 94 bp, Artificial
  Hairpin sequence HS_from_MQbrain_1256, human; MQbrain_1256, macaque
ggctatggctatggatttgggtcagatagatttggaagagacctcaattattgtttttcaggaatgtctgatcacaaatatggggatggtggct

SEQ ID NO: 2275 - DNA, 82 bp, Artificial
  Hairpin sequence HS_from_MQbrain_1257, human
caggactggagaaggtggtggttctagcttggtctctgttggccttgaagcaagcatcccccctgccctttttccttgactg

SEQ ID NO: 2276 - DNA, 106 bp, Artificial
  Hairpin sequence HS_from_MQbrain_1259, human
tgggggttgggatggtggtgctggtggagcaacagacggaagaaatttcttacattaagaaggcttccagtcttttttccagaggtactgctacaaatacatgcca

SEQ ID NO: 2277 - DNA, 76 bp, Artificial
  Hairpin sequence HS_from_MQbrain_1260, human; PT_from_MQbrain_1260, chimp
gggcaggaggcagggagaggtccattccccatggtagggcttgggggatgtagttgccccctccctctccctgtct

SEQ ID NO: 2278 - DNA, 109 bp, Artificial
  Hairpin sequence HS_from_MQbrain_1261, human
tttatttctgttatagtatttccacttagtattatgatttatttctgtccctcatgaaagggacagaaagtagtcaggcggttatgagatgaaaagacagtaagatggg

SEQ ID NO: 2279 - DNA, 79 bp, Artificial
  Hairpin sequence HS_from_MQbrain_1263, human
ggttatctggtggttgggctgagaggagaaaggtgctcctcaagcttggcttctccagcttcaccgaagccagggatcc

SEQ ID NO: 2280 - DNA, 95 bp, Artificial
  Hairpin sequence HS_from_MQbrain_1264, human
cccgcctgcactcctgagggcccctctcacagacagaccatctccctgtggttgtttgactgctcattttacctctggaatctgcctgggcttgg

SEQ ID NO: 2281 - DNA, 116 bp, Artificial
  Hairpin sequence HS_from_MQbrain_1266, human; PT_from_MQbrain_1266, chimp
tggacccaacacaaatggttcccagtttttcatctgcactgccaagactaagtggttggatggcaagcatgtggcctttggcaaggtgaaagaaggcatgaatattgtggaggcca

SEQ ID NO: 2282 - DNA, 90 bp, Artificial
  Hairpin sequence HS_from_MQbrain_1267, human
catattttgcgagtactcaacaccaacatccatgttggcagaaaatagcctttgccatcactgccattgagggtgtgggtcgaagatatg

SEQ ID NO: 2283 - DNA, 67 bp, Artificial
  Hairpin sequence HS_from_MQbrain_1268, human
tgttcgtggctggctgtgtcttctaaaacagatcacactgttctggggcacagtgagtcattccacg

SEQ ID NO: 2284 - DNA, 100 bp, Artificial
  Hairpin sequence HS_from_MQbrain_1269, human; PT_from_MQbrain_1269, chimp
gtaacaaaagatggtgtgactgttacaaagtcaattggcttcaaggataaatgtaaaaatattggagctaagcttgttgccagtaacactaagatgttgc

SEQ ID NO: 2285 - DNA, 111 bp, Artificial
  Hairpin sequence HS_from_MQbrain_1272, human; PT_from_MQbrain_1272, chimp
aaggcaaacatttctgaaatcctgagggctttggtggatgaggtggcttctggctgtagaggctatagaacagagccaaaactattaggagggaaaaaaatgctgtgcttt

SEQ ID NO: 2286 - DNA, 77 bp, Artificial
  Hairpin sequence HS_from_MQbrain_1273, human
tcctcactggaggccacaggggcaagagggtggttttcctgaagcagctggctagtggcttattacttgtgactgga

SEQ ID NO: 2287 - DNA, 98 bp, Artificial
  Hairpin sequence HS_from_MQbrain_1279, human; MQbrain_1279, macaque
ctttaagctcactgtgctttcataaagtagtacattaacaccagagcagtgtgtctctggggtttatgactggggtggcggcacactagggcataaag

SEQ ID NO: 2288 - DNA, 99 bp, Artificial
  Hairpin sequence HS_from_MQbrain_128, human
gctgtccgctcgggctccggaggcagccaacgccgccagtctgaggcaggtgcccgacatggcgagtgtagtgctgccgagcggatcccagtgtgcggc

SEQ ID NO: 2289 - DNA, 72 bp, Artificial
  Hairpin sequence HS_from_MQbrain_1280, human
ggccatgtggaggaggaggcctgtgagcactggttctctggacattgctcatctccctccttgacaagcgcc

SEQ ID NO: 2290 - DNA, 91 bp, Artificial
  Hairpin sequence HS_from_MQbrain_1283, human
ttgaattccagcatgagtggggaggcatttctgcggctcctaacggtgctatccagggccgcagtgctcttggctcatgctgcagcttcag

SEQ ID NO: 2291 - DNA, 105 bp, Artificial
  Hairpin sequence HS_from_MQbrain_1286, human
ttctgtctgctggaagagaagcactgatgctgctgactggaccctgggcagcccaggcttcacccaagtgggcagtctcaggctttctcactctggaggagagag

SEQ ID NO: 2292 - DNA, 73 bp, Artificial
  Hairpin sequence HS_from_MQbrain_1287, human
tagaaatcaaggccatctggagtgttctgcatgggagagaattctattcagttcgctttagtggcccttttta

SEQ ID NO: 2293 - DNA, 100 bp, Artificial
  Hairpin sequence HS_from_MQbrain_1288, human
cttgtacccctgactttagatggagcctggggttctctaccattgctgcctcttgagacagacctgtgacctcactctactgtaagtgcaggggtgcagg

SEQ ID NO: 2294 - DNA, 71 bp, Artificial
  Hairpin sequence HS_from_MQbrain_1289, human; MQbrain_1289, macaque; PT_from_MQbrain_1289, chimp
atggtccataggaaggggaaggctaaggtggaaaaatcttcaggtagtctttctctcctctgcagactcat

SEQ ID NO: 2295 - DNA, 87 bp, Artificial
  Hairpin sequence HS_from_MQbrain_129, human; PT_from_MQbrain_129, chimp
ggaatctgggaaaggctgggtgggacagcggggtgggacaggggtaagccctcagactgctgtccctgcctggcccctcccagctcc

SEQ ID NO: 2296 - DNA, 67 bp, Artificial
  Hairpin sequence HS_from_MQbrain_1290, human
ccagtcttcactggcagtggctggtacttggctctcagcctggagtggcagctctgctagcagctgg

SEQ ID NO: 2297 - DNA, 111 bp, Artificial
  Hairpin sequence HS_from_MQbrain_1292, human; PT_from_MQbrain_1292, chimp
cttctccatgccatcatgtctaagtcacaagtctcctaaagagcccgaacagctgaggaagctcttcattggagggttgagctttgaaacaaccgatgagagcctgaggag

SEQ ID NO: 2298 - DNA, 72 bp, Artificial
  Hairpin sequence HS_from_MQbrain_1293, human; HS_from_PT_188, human; PT_188, chimp; PT_from_MQbrain_1293, chimp
tagctggttggcattctggccctggttcatgccaactcttgtgttgactaccccaggatgccagcatagttg

SEQ ID NO: 2299 - DNA, 109 bp, Artificial
  Hairpin sequence HS_from_MQbrain_1294, human; PT_from_MQbrain_1294, chimp
tcttgtccatctgttctctgttgtgtgatcccaatccagatgatcctttagtgcctgagattgctcggatctacaaaacagatagagaaaagtaagtatggcctcaaga

SEQ ID NO: 2300 - DNA, 47 bp, Artificial
  Hairpin sequence HS_from_MQbrain_1295, human; MQbrain_1295, macaque
ggtgctgtggccagcctgctgagcaaggcagagcgggccacggagct

SEQ ID NO: 2301 - DNA, 95 bp, Artificial
  Hairpin sequence HS_from_MQbrain_1296, human
ggttcctcgcctcacacaaacaagatgaagtccaggcttgcagagtcagaaaaaattctggtctacaggcctcttctctatagggaggatgttcc

SEQ ID NO: 2302 - DNA, 70 bp, Artificial
  Hairpin sequence HS_from_MQbrain_1297, human
gaaaaggaaacctggcctgggcaaaggagtatgggcctatagggtcccctgctaggccaggaccctcttc

SEQ ID NO: 2303 - DNA, 98 bp, Artificial
  Hairpin sequence HS_from_MQbrain_1298, human
gcctgccacctctgcccaggacactcttccctctcgggatgtgtgatgaactcccaggagagggaagatgggagccagggcaagataggaagctctgc

SEQ ID NO: 2304 - DNA, 69 bp, Artificial
  Hairpin sequence HS_from_MQbrain_1299, human
gggtggggcaactcaggctcagacctgccttgatctgaggcagggacagggctgggtgtgtctgtgtcc

SEQ ID NO: 2305 - DNA, 62 bp, Artificial
  Hairpin sequence HS_from_MQbrain_1300, human
cagtctctgggtcctggcctgggtaggactcaagggtgttctatcggcccatttagaggttg

SEQ ID NO: 2306 - DNA, 74 bp, Artificial
  Hairpin sequence HS_from_MQbrain_1301, human
ccagtccttgtaccgggcgcgcgtcctggaggatgcaccctccggcacgcgcgtggtacaagtccttgcaacgg

SEQ ID NO: 2307 - DNA, 99 bp, Artificial
  Hairpin sequence HS_from_MQbrain_1303, human
tgggccagcagctccaggctgtgccagagttcccagaaagcaccaagaatcttgaggcagaggactgactggctggcctggggaaggcttggcaaccca

SEQ ID NO: 2308 - DNA, 95 bp, Artificial
  Hairpin sequence HS_from_MQbrain_1304, human
tacaagcagatacaaggatgcccttgtacacaacacacgtgctgcttgtatagacatgagtgttgtctacgagggcatccttgtgtctgtgtgtg

SEQ ID NO: 2309 - DNA, 64 bp, Artificial
  Hairpin sequence HS_from_MQbrain_1306, human; HS_from_MQbrain_1711, human
ttgagctctcgggcgaggttcactggtccgcagggggagggccagggaagtctcgctgtgccaa

SEQ ID NO: 2310 - DNA, 80 bp, Artificial
  Hairpin sequence HS_from_MQbrain_1307, human
gcctaactgtagccagtgctggctgccccaggaattgttttggggaggaagttggtgagatctggattgctaaagttggc

SEQ ID NO: 2311 - DNA, 106 bp, Artificial
  Hairpin sequence HS_from_MQbrain_1308, human
ttagggaagctgtgtcaaatcaagagatgcctagtgcttcatctagccgaaaagggtgaagtgcttctggaaactttggtggtggttgtggaggtggttttggtgg

SEQ ID NO: 2312 - DNA, 79 bp, Artificial
  Hairpin sequence HS_from_MQbrain_131, human; PT_from_MQbrain_131, chimp
tgtttttcttatagcatggcggacaccgacctgttcatggaatgtgaggaggaggagttggagccatggcagaaaatca

SEQ ID NO: 2313 - DNA, 115 bp, Artificial
  Hairpin sequence HS_from_MQbrain_1311, human
ggccttgcaaggctcttaaccgaaagggggagggggaaggtcgccaacaaacggctgagctcacaatcctggccggggcgtccccctcccccatggagagagccagacccgagcc

SEQ ID NO: 2314 - DNA, 77 bp, Artificial
  Hairpin sequence HS_from_MQbrain_1313, human
tgcatttgctagtgggaggggttgttgtgtgtccccttttgctatatatatacagccttcttttgctaagtcttgca

SEQ ID NO: 2315 - DNA, 72 bp, Artificial
  Hairpin sequence HS_from_MQbrain_1314, human
ctctgctttatttctcttgggcacagtgtctgtgttcactgcaagtggaatcagcattgtgtcctggtaggg

SEQ ID NO: 2316 - DNA, 87 bp, Artificial
  Hairpin sequence HS_from_MQbrain_1315, human; MQbrain_1315, macaque
tcctcttcctggagcccgggcggtggtggatatggtggctggggaggttcccaaggccgagatcaccgcagagggctgaatggtgga

SEQ ID NO: 2317 - DNA, 84 bp, Artificial
  Hairpin sequence HS_from_MQbrain_1317, human
ggaagagtcaagtcaaggccagaggtcccacagcagggctggaaagcacacctgtgggacttctggccttgacttgactctttc

SEQ ID NO: 2318 - DNA, 74 bp, Artificial
  Hairpin sequence HS_from_MQbrain_1318, human; PT_from_MQbrain_1318, chimp
ggtaagataggctggcctggagggcaggccagagattggggctgccatctggtgccagcctttgtccctctgcc

SEQ ID NO: 2319 - DNA, 73 bp, Artificial
  Hairpin sequence HS_from_MQbrain_132, human
catttagcctttggttgtacagttgtgtaatgggctatggactgttacacaccttaccacctctaggcctatg

SEQ ID NO: 2320 - DNA, 84 bp, Artificial
  Hairpin sequence HS_from_MQbrain_1320, human
ggggtgcagcactgatggtgacttgtcttgcttggactaagccagcactagcagggcacgctaagccggtcactgcacaacccc

SEQ ID NO: 2321 - DNA, 64 bp, Artificial
  Hairpin sequence HS_from_MQbrain_1322, human; MQbrain_1322, macaque
gaggcaattctcttggaagcgaaggtgtcggctatgagccggagcctccttccttgaatttctc

SEQ ID NO: 2322 - DNA, 94 bp, Artificial
  Hairpin sequence HS_from_MQbrain_1325, human
gggagatgtcacaggtccccggccctgcaggatgggaggagggcagagacgcccttcttggccctgtctgctgggcagatgggtcctgggtccc

SEQ ID NO: 2323 - DNA, 86 bp, Artificial
  Hairpin sequence HS_from_MQbrain_1326, human; PT_from_MQbrain_1326, chimp
cgcctgcgcggccgcagaggcaggctggcgcgcatgctcaggcggggatgtgtgcgaagcctgccgctgctgcagcgagtctggcg

SEQ ID NO: 2324 - DNA, 100 bp, Artificial
  Hairpin sequence HS_from_MQbrain_1327, human; PT_from_MQbrain_1327, chimp
gccaaaaagaaaaggctcaacgagagtgagcttattcgagggtctgtagcctaaagcatgggctcttttaaagcctcttgttgggccgtgaagcataggt

SEQ ID NO: 2325 - DNA, 83 bp, Artificial
  Hairpin sequence HS_from_MQbrain_1328, human
ccagatggtgagcctggaggaagactcgtgttgggcccacaggccccaggccagtgtacgtcagccaggtgctcagcccatgg

SEQ ID NO: 2326 - DNA, 88 bp, Artificial
  Hairpin sequence HS_from_MQbrain_133, human
ttactcaagtggcacctagaagggcaggagttcctttggtgacttcacagtgaagtcttgccctctctgtgggatatcacatcagtgg

SEQ ID NO: 2327 - DNA, 115 bp, Artificial
  Hairpin sequence HS_from_MQbrain_1330, human
ttatggtaattaatgacaggttttgcataattccttgcaccagagatcaaaattcttgctctgtttgattctggtgcaaggaattatgcaaaacctgtcatcattaaatgcatga

SEQ ID NO: 2328 - DNA, 94 bp, Artificial
  Hairpin sequence HS_from_MQbrain_1331, human
gccgccccggctcggtccgcacccttctcctcggggcgcctgagcggcaggctgcgtggccggggaggagaggtgcagagcaggcggggcgcgc

SEQ ID NO: 2329 - DNA, 112 bp, Artificial
  Hairpin sequence HS_from_MQbrain_1332, human
ccctgtgaagcccttgcaactctcagacccgtgcagttaatcggaggggaacagaccctctttgctgtgacggctgatgggaaggtaagagctctttttctatgtcacaagg

SEQ ID NO: 2330 - DNA, 110 bp, Artificial
  Hairpin sequence HS_from_MQbrain_1334, human
tgagacaggcccctgcagagggatgccttaaagctgtccctggctggaggagcactccaccttggggatagtggagggggccttcagccctctgcaccctgcctgcctca

SEQ ID NO: 2331 - DNA, 106 bp, Artificial
  Hairpin sequence HS_from_MQbrain_1339, human
tggggcagtaaatgaggttggcagagtggcagtgggggctctgcagagccagccttggagcctgctcattctgggcccttgctgccaaggagcccagcctcaccta

SEQ ID NO: 2332 - DNA, 91 bp, Artificial
  Hairpin sequence HS_from_MQbrain_1340, human; PT_from_MQbrain_1340, chimp
gacagtcaagccagggcctgaagagggcacactagagaaggaagagaaagttcctcctcccaggagcccccaggcccaggaagcacctgtc

SEQ ID NO: 2333 - DNA, 114 bp, Artificial
  Hairpin sequence HS_from_MQbrain_1343, human
caaatagacctgatgtgttagatactgctttgttacgacctggaagattagataagatcatctatatcccacctccagatcacaaggtagtcatttacacatttactctgtgtg

SEQ ID NO: 2334 - DNA, 110 bp, Artificial
  Hairpin sequence HS_from_MQbrain_1344, human; HS_from_MQbrain_317, human
aggctgaaggggatgctaaaggagataaagccaaggtaaaggacgaaccacagagaagatctgcaaggttgtccgctaaacctgcttctccaaagccagagcccaggcct

SEQ ID NO: 2335 - DNA, 85 bp, Artificial
  Hairpin sequence HS_from_MQbrain_1345, human
tggaaaggggaatttagaaggagaggttcagtgggctggagatttaccctagaccttggcacccttttgaagattcctaaccccg

SEQ ID NO: 2336 - DNA, 93 bp, Artificial
  Hairpin sequence HS_from_MQbrain_1346, human
tgggggtgggtgtggtggaggggaatgtgttgagttgtgccctaaagaatgggtaagatttagattttttggaactcattccaactcatacca

SEQ ID NO: 2337 - DNA, 119 bp, Artificial
  Hairpin sequence HS_from_MQbrain_1347, human; PT_from_MQbrain_1347, chimp
ttactgtgatgttttcatgcggtgcagattagtagatgctgatggtcctctagctaggcttaaaaaagcaatttttagtccagagctctatgaaaacattgctgaatggattgtggtaa

SEQ ID NO: 2338 - DNA, 93 bp, Artificial
  Hairpin sequence HS_from_MQbrain_1348, human
ctcttcagcaatggagggaaatagggtttggggtcactttgttgtgcgtcttggggatgaggtggcttttcccagatggcccttgctggagag

SEQ ID NO: 2339 - DNA, 93 bp, Artificial
  Hairpin sequence HS_from_MQbrain_1349, human
ggagtcaggtgaggagaagagaggttggtgtccaggggagatggacaaatctctttctttggatggaacctctctttcttcctcctctgtttt

SEQ ID NO: 2340 - DNA, 54 bp, Artificial
  Hairpin sequence HS_from_MQbrain_135, human; MQbrain_135, macaque
ggaggttgattctctgaggacccagcatgtgggaggacccagagcacagcctcc

SEQ ID NO: 2341 - DNA, 99 bp, Artificial
  Hairpin sequence HS_from_MQbrain_1350, human
cacggactgttgattctcctccctgggatttggcagcctgtgcgttagctataccgccatgcttgttaaaatgaccacagggctggaaaattatctatg

SEQ ID NO: 2342 - DNA, 70 bp, Artificial
  Hairpin sequence HS_from_MQbrain_1353, human; PT_from_MQbrain_1353, chimp
gatgtaagattccagccatttttctcctttcactagaaagagtgaggtggctggatcactgaagcgcatc

SEQ ID NO: 2343 - DNA, 101 bp, Artificial
  Hairpin sequence HS_from_MQbrain_1354, human; PT_from_MQbrain_1354, chimp
ggcactctcccagctggctgaggtggaagaaaaaattgagcagctccaccaggaacaggccaacaatgacttcttcctccttgctgagctcctgagtgact

SEQ ID NO: 2344 - DNA, 78 bp, Artificial
  Hairpin sequence HS_from_MQbrain_1355, human
gcccacccgcttgccttggtgctcagccctcccattgggagcaggttggggcgagctggaggcccgggctggaggggc

SEQ ID NO: 2345 - DNA, 54 bp, Artificial
  Hairpin sequence HS_from_MQbrain_1357, human; MQbrain_1357, macaque; PT_from_MQbrain_1357, chimp
ctgggagcgggcgggagcgggagcgcggcgcacgccccgggccggcccagccag

SEQ ID NO: 2346 - DNA, 99 bp, Artificial
  Hairpin sequence HS_from_MQbrain_1360, human
ggtcccctgacttctcactgggtgggttgagttaaagaggtgggattaataactaatctaaatgccgctttcttacttttccagaagaagaaaggggtc

SEQ ID NO: 2347 - DNA, 95 bp, Artificial
  Hairpin sequence HS_from_MQbrain_1361, human
aggatgtttgagaaaggttgggggcacagagagcaaggagccttccccagaggagtcaggccttgttcctgtccccattcctcagagtttatcct

SEQ ID NO: 2348 - DNA, 116 bp, Artificial
  Hairpin sequence HS_from_MQbrain_1362, human; PT_from_MQbrain_1362, chimp
ggccttgcacctgctgccggcagctgttgccggggctcccgttaatggcacaaatggagcctctaatggatgggacctaagccctggctggcagcggggctgggaggatgtgggct

SEQ ID NO: 2349 - DNA, 69 bp, Artificial
  Hairpin sequence HS_from_MQbrain_1363, human; PT_from_MQbrain_1363, chimp
cagggcccaatctggcacatgccccttttcctccaggcccagagcaggggctgttgccgaaaggctgtg

SEQ ID NO: 2350 - DNA, 97 bp, Artificial
  Hairpin sequence HS_from_MQbrain_1364, human
tgctggaactgcactggggtaaggataggagggtcaggtctgcagccttgtatctgctgatcctctttcgtccttcccactccaggtcagtgctgca

SEQ ID NO: 2351 - DNA, 70 bp, Artificial
  Hairpin sequence HS_from_MQbrain_1365, human
ccctggccccaaaccgtgcaaccccagctggaggatgaggagatgctgggcttgggtgggggaatcaggg

SEQ ID NO: 2352 - DNA, 78 bp, Artificial
  Hairpin sequence HS_from_MQbrain_1366, human
tcagatgggtccagatgcagggtgcaggtcaatgtggtatacttttgcttgcatctgcagatcttctgggctggctgg

SEQ ID NO: 2353 - DNA, 98 bp, Artificial
  Hairpin sequence HS_from_MQbrain_1367, human; HS_from_MQbrain_1544, human
cgtccagcacctacgtcctgctgccgtcgccgccaccaccatgcccaagagaaaggctgaaggggatgctaagggagataaagccaaggtgaaggacg

SEQ ID NO: 2354 - DNA, 77 bp, Artificial
  Hairpin sequence HS_from_MQbrain_137, human
agtggcggctgaagcgccgccggcggggctcactgtggtggtgtgagtgggaggcggcggcgctggtggctgcagct

SEQ ID NO: 2355 - DNA, 64 bp, Artificial
  Hairpin sequence HS_from_MQbrain_1372, human
ggctttcttgcttctggggaaatggcaggtggttgaaaccctgcacatcctcccagggccagcc

SEQ ID NO: 2356 - DNA, 71 bp, Artificial
  Hairpin sequence HS_from_MQbrain_1373, human
ggctgcctatgagagctctgccttgtgggggagcctccaaaatcccccatcagctgagttccatgaacgcc

SEQ ID NO: 2357 - DNA, 107 bp, Artificial
  Hairpin sequence HS_from_MQbrain_1374, human
tagaaggggtgaggaagagctgctaagggtgactgtgtttggaaggggatcagcagctggggctcctccttcaaaccagggcccccatgctcatcatttcccctcta

SEQ ID NO: 2358 - DNA, 106 bp, Artificial
  Hairpin sequence HS_from_MQbrain_1376, human; PT_from_MQbrain_1376, chimp
ttgatagtggctctgtgtcttcagccttggacccttgggggaggtgagtctgcactctgccttggcaaggagtccagaaggaagaactcagaggtgtcacttccaa

SEQ ID NO: 2359 - DNA, 92 bp, Artificial
  Hairpin sequence HS_from_MQbrain_1377, human
ttccaggccaatgctgaagacacagctccgcttgggagcctgagaacccaggcttcccaggccagagtgtggcttcttaaacggcaaaggaa

SEQ ID NO: 2360 - DNA, 117 bp, Artificial
  Hairpin sequence HS_from_MQbrain_1378, human
cctggtgtttgcctccaaggtgtccccacccagtgactctggccggcatgctggagatgggtgtctcctacctgcctgtcaaccagaactgggagcgttacctggcagaggcacagg

SEQ ID NO: 2361 - DNA, 99 bp, Artificial
  Hairpin sequence HS_from_MQbrain_1379, human
cctattccagatccgccgacagagggcgccgggggcccgagaggagcatgttcgggcgcctctcccgggtccctggcgccacgctgtggggcttggtgg

SEQ ID NO: 2362 - DNA, 82 bp, Artificial
  Hairpin sequence HS_from_MQbrain_138, human
cctaggaaccatggcatcagtaagactgatttgagatgagaacagtctcaaatccagtcctattaatgccatggttcctagg

SEQ ID NO: 2363 - DNA, 119 bp, Artificial
  Hairpin sequence HS_from_MQbrain_1380, human
gtccctcctcccactcccgcaatgcttcttccatctagggcagatggtgtcccacagagggaaatccaggcaccagcaggacaggaaggggcgatgcagtggggtaagtggagtggggc

SEQ ID NO: 2364 - DNA, 101 bp, Artificial
  Hairpin sequence HS_from_MQbrain_1381, human
gcagatggtactcagcaagtgcaaagccgaggtttcttgggcctctcacatcagcacctcccagacctcggttctgtatttccctggagctccactcctgc

SEQ ID NO: 2365 - DNA, 88 bp, Artificial
  Hairpin sequence HS_from_MQbrain_1382, human; MQbrain_1382, macaque
gggccccagggtgtggcaggagacccagtggatggggccagctggcctgccctgatcctctgcttcctcctcacaaccccaagagccc

SEQ ID NO: 2366 - DNA, 114 bp, Artificial
  Hairpin sequence HS_from_MQbrain_1383, human; MQbrain_1383, macaque; PT_from_MQbrain_1383, chimp
ggagtgttgcgggccctcctcttttcaattgcagccacgacgttaattttattgggattactgatgggaaatgaggtggcgcaggcttccgagaggaaaagcttgatcattacc

SEQ ID NO: 2367 - DNA, 71 bp, Artificial
  Hairpin sequence HS_from_MQbrain_1384, human; MQbrain_1384, macaque
agaaaatttgctggaaaaggcctcctcagagctgggcatagctctgtctgatggaggcctgacttgcttct

SEQ ID NO: 2368 - DNA, 87 bp, Artificial
  Hairpin sequence HS_from_MQbrain_1387, human
tccttgtggaggggccggtgggtctagatgacttgtctcaggggcccccgatgaggcgacccaggcagccctgccctttttagagga

SEQ ID NO: 2369 - DNA, 75 bp, Artificial
  Hairpin sequence HS_from_MQbrain_1388, human; PT_from_MQbrain_1388, chimp
gagggaggtgctggcccctgggtgctgttcttagctaagcttctcctaggcaccagggctcagcagctctggttc

SEQ ID NO: 2370 - DNA, 74 bp, Artificial
  Hairpin sequence HS_from_MQbrain_1389, human; PT_from_MQbrain_1389, chimp
gatataggccaggcctggaggggaacgggcctagtctccctttcagttccgctccaggcctagtccccagtgtc

SEQ ID NO: 2371 - DNA, 75 bp, Artificial
  Hairpin sequence HS_from_MQbrain_1390, human
aagctggtttcagtggtcacttttggggaggaggaaactgatactgaaggaagtggccaaggtgaatgctggttt

SEQ ID NO: 2372 - DNA, 81 bp, Artificial
  Hairpin sequence HS_from_MQbrain_1391, human; MQbrain_1391, macaque
cagtgactgttagtgtgtgccgctgccagcctgacggctctgtggcatcctgctggcctgaggctcacctctcagctgctg

SEQ ID NO: 2373 - DNA, 112 bp, Artificial
  Hairpin sequence HS_from_MQbrain_1392, human
cctggctccatgaaggtcctttggcacagctctgctcctcccctgcctgccaaagcccccctttaggccttgggtggctggaaggctttgttaagggactaggagaaatggg

SEQ ID NO: 2374 - DNA, 65 bp, Artificial
  Hairpin sequence HS_from_MQbrain_1393, human
gtagctgggcttccaggggcttgtctggcctcagccccgggccagccaagggagtctgaggctgc

SEQ ID NO: 2375 - DNA, 106 bp, Artificial
  Hairpin sequence HS_from_MQbrain_1394, human
ggggtggaagggatggggaggtcgggggagttggagaaccaaaagggaagtgaaggaactggactgaggggagccgatttctcgataaccagaaagcagaagccct

SEQ ID NO: 2376 - DNA, 67 bp, Artificial
  Hairpin sequence HS_from_MQbrain_1395, human; PT_from_MQbrain_1395, chimp
tgacatcatgcccaggaccacccccacctaagggaaaggggatggggtggcccttgtggtaaggtta

SEQ ID NO: 2377 - DNA, 79 bp, Artificial
  Hairpin sequence HS_from_MQbrain_1396, human
ggaaaggatggtcccacggagaccctggaggagctggtcctgggactagccgctgaggtgtgtgatgattttcttgtct

SEQ ID NO: 2378 - DNA, 78 bp, Artificial
  Hairpin sequence HS_from_MQbrain_1398, human; PT_from_MQbrain_1398, chimp
tcaaggtcattggcaggtgttggaggtagggtctgagtcaggagtcccctgtcctctggcacctcaacaggattgtgg

SEQ ID NO: 2379 - DNA, 82 bp, Artificial
  Hairpin sequence HS_from_MQbrain_1399, human
ggggcgccggggaaggaggtgggggagtgccaggttaactaagtcccggcacaccctactgcaccttcctgttttgcaaacc

SEQ ID NO: 2380 - DNA, 120 bp, Artificial
  Hairpin sequence HS_from_MQbrain_14, human
ggtggggcattcccctgcagcaaggggcggggccaccccaacgccgcttctgcggccaaagtaggttgggagtggaaggtggtggctgctgctccgcagtgtcgggaagatggcgccgcc

SEQ ID NO: 2381 - DNA, 73 bp, Artificial
  Hairpin sequence HS_from_MQbrain_140, human
ccctgagccagacccatatgggctgtagctggaagactgcccagaaccagacccatgtcggccacggctaggg

SEQ ID NO: 2382 - DNA, 77 bp, Artificial
  Hairpin sequence HS_from_MQbrain_1400, human
ctgggagctgggctgtcaggctctccattgcctttgccttcaaaggtggcatagtggaaaatgaaccacagtcccag

SEQ ID NO: 2383 - DNA, 56 bp, Artificial
  Hairpin sequence HS_from_MQbrain_1402, human
tgagcttgcatgtgtgggggtggggccctgtggcttccccctgcacctccaggcca

SEQ ID NO: 2384 - DNA, 67 bp, Artificial
  Hairpin sequence HS_from_MQbrain_1405, human
gctggaaggcctccggatgcgtgccagcaatgagttggcactggcagagctggaggaggaggagggc

SEQ ID NO: 2385 - DNA, 66 bp, Artificial
  Hairpin sequence HS_from_MQbrain_1408, human
gctttcgctccccagcagctaaagggagcctctgcccatggagctgtgctcaccggggagccaggc

SEQ ID NO: 2386 - DNA, 97 bp, Artificial
  Hairpin sequence HS_from_MQbrain_141, human
tgggtactgcattgattaggagattatatggagctgcgggagctgccgcctgggggaagagaggtgcagcttctgctaggtttgtgctctcctccca

SEQ ID NO: 2387 - DNA, 106 bp, Artificial
  Hairpin sequence HS_from_MQbrain_1410, human; PT_from_MQbrain_1410, chimp
ttgcagtcactcggttatctatgaagggttgtgcaaaacaggaaggtctgggaatgaccagatatcttgttggcataaatgttatgaaaaggcagaatactggcaa

SEQ ID NO: 2388 - DNA, 86 bp, Artificial
  Hairpin sequence HS_from_MQbrain_1412, human
tgtttgcttcaaggtccctagatatctaccctgtgggcctgctttgaggtttcagggtggactggtggtgggctctgcagtaccca

SEQ ID NO: 2389 - DNA, 87 bp, Artificial
  Hairpin sequence HS_from_MQbrain_1413, human
aggagggtgcgcttatccagtggctggagtaggccaggggtttgccccctgctctgacagtttctctggagtgctggtgtgccacct

SEQ ID NO: 2390 - DNA, 115 bp, Artificial
  Hairpin sequence HS_from_MQbrain_1414, human
ctgacagcgaagatcgagctcaggttcgccacatagatcccgtgcaggagccacatgggtcctgtgcaggacccctagcagtggtgggctgagcccaggtctaggtttctgtggg

SEQ ID NO: 2391 - DNA, 99 bp, Artificial
  Hairpin sequence HS_from_MQbrain_1415, human
gcctgctcatcagccagagggtaggaactatgggccagggaggggcttggtccctgtcctccctcccttgcccagagcagcccctaagcatggccaggc

SEQ ID NO: 2392 - DNA, 110 bp, Artificial
  Hairpin sequence HS_from_MQbrain_1416, human; HS_from_MQbrain_341, human
aggctgaaggggatgctaagggagataaagccaaggtgaaggacgaaccgcagagaagatccgcgaggttgtctgccaaacctgctcctccaaagccagagcccaagcct

SEQ ID NO: 2393 - DNA, 59 bp, Artificial
  Hairpin sequence HS_from_MQbrain_1417, human; MQbrain_1417, macaque
ggtctgggatgggtacccttctgctcagtaagatccgggaggagtacccagacaggatc

SEQ ID NO: 2394 - DNA, 99 bp, Artificial
  Hairpin sequence HS_from_MQbrain_1419, human
ctcattcccacctctggggccccttcctcgtgcttctccttcctgagggtttgggaaggtcctggggcagactctggggctcccatggggtggaaggag

SEQ ID NO: 2395 - DNA, 69 bp, Artificial
  Hairpin sequence HS_from_MQbrain_142, human
gcttggttccacggctgggctggtggagggtgctgtggcacttaccgcatcagcccacagcaggaaggc

SEQ ID NO: 2396 - DNA, 106 bp, Artificial
  Hairpin sequence HS_from_MQbrain_1420, human
caaaggtcagctctccagacatgccattcccctggcaggcctgggctgaggtatgcacctgtcttcctggttgcttgggaatggcattgagaagtggcttccattg

SEQ ID NO: 2397 - DNA, 97 bp, Artificial
  Hairpin sequence HS_from_MQbrain_1421, human
aggcagctgggtgggagtgctggtgggaagctccggaagggaggctgctcggggcctccctgtggctgtggctgcatgggcagccccgaagcggctt

SEQ ID NO: 2398 - DNA, 70 bp, Artificial
  Hairpin sequence HS_from_MQbrain_1422, human
ttccctgccctgcctgttttctcctttgtgattttatgagaacaaaggaggaaataggcaggccagggaa

SEQ ID NO: 2399 - DNA, 70 bp, Artificial
  Hairpin sequence HS_from_MQbrain_1423, human
gggtggaggctgggctggggagttagccgcggtgtgcgtgaatggctctgtctccagcaagtctctctcc

SEQ ID NO: 2400 - DNA, 72 bp, Artificial
  Hairpin sequence HS_from_MQbrain_1424, human
agcctcccgtcccacccgcctggctggctgccccctctgtcagtctacatcccagcctcctgggacggggct

SEQ ID NO: 2401 - DNA, 109 bp, Artificial
  Hairpin sequence HS_from_MQbrain_1425, human
cagggtggcttttcccctgactgtgtccgatgccaaggagtcctggcctccgcagatgcttcattttgacccttggctgcagtggaagtcagcacagagcagtgccctg

SEQ ID NO: 2402 - DNA, 68 bp, Artificial
  Hairpin sequence HS_from_MQbrain_1426, human; PT_from_MQbrain_1426, chimp
aggaaaaagccacagactgagggagagaagggaaccgagacccctgcctcccaggtcagaggctgcct

SEQ ID NO: 2403 - DNA, 109 bp, Artificial
  Hairpin sequence HS_from_MQbrain_1427, human
ccctggtgtaggaaaggcctgaggtgggtctcatctgctaacattatttagagctctttgggttaacgggggcaggcacccaattcactgttgtttacactcacaaggg

SEQ ID NO: 2404 - DNA, 119 bp, Artificial
  Hairpin sequence HS_from_MQbrain_1428, human; PT_from_MQbrain_1428, chimp
gaccaaggctgacttgatcaataaccttggtactatcgccaagtctgggaccaaagcgttcatggaagctttgcaggctggtgcagatatctctatgattggccagttcggtgttggtt

SEQ ID NO: 2405 - DNA, 117 bp, Artificial
  Hairpin sequence HS_from_MQbrain_143, human; PT_from_MQbrain_143, chimp
aggcggcccttgtctctttcccagccttgcttgccccgttcctttctctccaggcagcagtggatggtgcaggggaaagaggtgggaaggaggtcctgggagggacactggatgtct

SEQ ID NO: 2406 - DNA, 115 bp, Artificial
  Hairpin sequence HS_from_MQbrain_1432, human
gccctgggatcctgggcactcttggcagcctcgtaggaggggctggtggtgtggacagtcctgtggcccctcacatgcagaggtttccgggtttctgcccagggatgcctggggc

SEQ ID NO: 2407 - DNA, 89 bp, Artificial
  Hairpin sequence HS_from_MQbrain_1433, human
gttccaggtcccaggttcgcccttttctgctactgggcattccttctggaagccccggaggagtggctggtgcctagggcccagggggc

SEQ ID NO: 2408 - DNA, 73 bp, Artificial
  Hairpin sequence HS_from_MQbrain_1437, human
gagcacgaagggccatgtgtctgtcctcagtgcacagaagtgcagagaagcagaccgggggcccacagtcctc

SEQ ID NO: 2409 - DNA, 70 bp, Artificial
  Hairpin sequence HS_from_MQbrain_1439, human
gccccggggcgccttcgccgtggcgcatgaggccaccacctgccacggcgagatctacgtgtccgggggc

SEQ ID NO: 2410 - DNA, 79 bp, Artificial
  Hairpin sequence HS_from_MQbrain_144, human; MQbrain_144, macaque
gttgctcggtgcttaatgaatgcagcatgagcctcatgttagcacatgccagctgcatctctgagaaccaggaagcagc

SEQ ID NO: 2411 - DNA, 99 bp, Artificial
  Hairpin sequence HS_from_MQbrain_1442, human
agcacgaggaggtgttgcagcagtggcagatgtgcatcgagctgctctcgccgggctcgctgccgtcgccgccgccgccgcagccgcctcccccgggct

SEQ ID NO: 2412 - DNA, 90 bp, Artificial
  Hairpin sequence HS_from_MQbrain_1443, human
cctctgctccagttcgcccgagggcctgtcagtttcagtccgctgcgggcgggcggagtggaaccgtcaggcagagggggacggaagagg

SEQ ID NO: 2413 - DNA, 75 bp, Artificial
  Hairpin sequence HS_from_MQbrain_1444, human
cccagcatcgtggtgtccttcctcattgctgccctggcttcagtgatggctggcctctgctatgccgaatttggg

SEQ ID NO: 2414 - DNA, 74 bp, Artificial
  Hairpin sequence HS_from_MQbrain_1445, human; MQbrain_1445, macaque; PT_from_MQbrain_1445, chimp
cctttcccttcaggccaagatggacaatcaggtgctgggctacaaggacctggctgccatccccaaggacaagg

SEQ ID NO: 2415 - DNA, 110 bp, Artificial
  Hairpin sequence HS_from_MQbrain_1446, human; PT_from_MQbrain_1446, chimp
tctgaagcccaaatggagagaaaccccggccacttcccaccaccctggtggcccaccacctgccaggaaggtgggggcgtggcagagggggcgcacatctccgcagcgga

SEQ ID NO: 2416 - DNA, 71 bp, Artificial
  Hairpin sequence HS_from_MQbrain_1447, human
attcttggctccagcctggctctcctccttggaaaggaagatggagagcgggaaggggagtgggaaggggt

SEQ ID NO: 2417 - DNA, 70 bp, Artificial
  Hairpin sequence HS_from_MQbrain_145, human
gccttcttggcaggtgtgggaggaacaagcctgcgtggtgctgtccctccctccccaccaggagcagagc

SEQ ID NO: 2418 - DNA, 62 bp, Artificial
  Hairpin sequence HS_from_MQbrain_1450, human
ggtaggaggcctgggcagggaagattccagtcatcctgcccagtaggaaggggctttctgcc

SEQ ID NO: 2419 - DNA, 115 bp, Artificial
  Hairpin sequence HS_from_MQbrain_1453, human
gggcggagcgggcagctgggggcgagggcgcaggggcgccagcctgacggagcgggacctgcaccgatggcgttggcttcccaacttgcgccctgcacctcggcgctccaagccc

SEQ ID NO: 2420 - DNA, 99 bp, Artificial
  Hairpin sequence HS_from_MQbrain_1454, human
cctgggaagaggaaagctggcctgggggcctggcgaggtgtccacattcctcacgtcctccttcctgccctttcccaggagctgagcgcctttcccagg

SEQ ID NO: 2421 - DNA, 118 bp, Artificial
  Hairpin sequence HS_from_MQbrain_1455, human; PT_from_MQbrain_1455, chimp
gaggcagggagagactaaagagggcctggcaagggagaaatggggaactgcgggctgggggcctgccactgtcccgatgtttgatttggcaatcccattttcagttcctcctttcttc

SEQ ID NO: 2422 - DNA, 105 bp, Artificial
  Hairpin sequence HS_from_MQbrain_1456, human
ggggagaggtgttggcagctgctggggtggtgggtgccctatctgctctgattaaggagggcagcccccaaaccttagtagacacatgctagaaaaattctgact

SEQ ID NO: 2423 - DNA, 93 bp, Artificial
  Hairpin sequence HS_from_MQbrain_1457, human; MQbrain_1457, macaque; PT_from_MQbrain_1457, chimp
gagggattggggagggcctggagtttctggctgtccttggaaagttgatttaataagggttccaggaaaaccagcctccctcccctctccctc

SEQ ID NO: 2424 - DNA, 70 bp, Artificial
  Hairpin sequence HS_from_MQbrain_1458, human
gagggtgacagggctgtcctcaggggcttcagtgagagcagcgaggaggaggaggagccggaaagccctc

SEQ ID NO: 2425 - DNA, 108 bp, Artificial
  Hairpin sequence HS_from_MQbrain_1459, human
agtgatccagaccatggggaaggacctcactcccatcacgccgtccaggtaagcctgggctggtggacgagcagggcaggtcttgtcatccgaggcctgggtagagct

SEQ ID NO: 2426 - DNA, 74 bp, Artificial
  Hairpin sequence HS_from_MQbrain_146, human
gcaatcataacccagacttgacctgccagggcacactggagtgaagcggcgccctggtgggagggtgtgggggc

SEQ ID NO: 2427 - DNA, 64 bp, Artificial
  Hairpin sequence HS_from_MQbrain_1461, human
acttgcccacttctcggggcagagctgccacttccacgaggtgctcctgctcccaaggggcagt

SEQ ID NO: 2428 - DNA, 79 bp, Artificial
  Hairpin sequence HS_from_MQbrain_1463, human; HS_from_MQbrain_973, human
gttgggccaacccgctgagcgctggaaggacacctgggaccgggtgaaggctgcacagcgcctcgagggccggccagac

SEQ ID NO: 2429 - DNA, 106 bp, Artificial
  Hairpin sequence HS_from_MQbrain_1466, human
accatcttgaagcttttagaggcctgctgggaataggacttctaaaaggcaaatatgtctggaaggctgtggtccaaggccattttttgttggctgtaagtgtggt

SEQ ID NO: 2430 - DNA, 71 bp, Artificial
  Hairpin sequence HS_from_MQbrain_1469, human; PT_from_MQbrain_1469, chimp
agtaacaccctcaaaccattacctggagctctgaagactgagctctgaggtagtatggttttgacattgct

SEQ ID NO: 2431 - DNA, 118 bp, Artificial
  Hairpin sequence HS_from_MQbrain_147, human
ctggccctgccttgcctccccacccagtattgcccagcccctcagaagctagccatggtaaaaaggcttggctcaggaggggctggaaggactgagaaaggagaagggtcagagccag

SEQ ID NO: 2432 - DNA, 117 bp, Artificial
  Hairpin sequence HS_from_MQbrain_1470, human
gctcgctgcaggctcgctcctcacctctccgccgcccgcccccttctccgcgcgggacgctgcccggagcgcggcggggcgggggtggaggacgagagagcggtcggaggcgtcggc

SEQ ID NO: 2433 - DNA, 70 bp, Artificial
  Hairpin sequence HS_from_MQbrain_1471, human
acattgctgctttgagagtgggaagggcactttgcactgcatgccattttctattctttgagtggcatgt

SEQ ID NO: 2434 - DNA, 104 bp, Artificial
  Hairpin sequence HS_from_MQbrain_1474, human; MQbrain_1474, macaque; PT_from_MQbrain_1474, chimp
tggatttattaaatattttctgtggtgtgaagtgacttattaaatccacagacattgagtgacttcttacaacatccacataagaatttgttgtaatgagttca

SEQ ID NO: 2435 - DNA, 116 bp, Artificial
  Hairpin sequence HS_from_MQbrain_1475, human
tgtgttagagggtggaacagatgtgtttggcactgcatgggatctggtgttcctcttctcctggattcacatccccacccaaggccctcttaagtgttctgccctagcctggttca

SEQ ID NO: 2436 - DNA, 64 bp, Artificial
  Hairpin sequence HS_from_MQbrain_1477, human
gctggccttgcctaggactgttgaacactgaaagtcatacatcagttctaggcaagccaaaagc

SEQ ID NO: 2437 - DNA, 113 bp, Artificial
  Hairpin sequence HS_from_MQbrain_1478, human
cttcaaagatagagcaaggcttggggaggcagtgcttcaagggaggaaacctacttgcgtctgttctccctgtgaagtaatggagctcacccccatttgttcttcctttggag

SEQ ID NO: 2438 - DNA, 113 bp, Artificial
  Hairpin sequence HS_from_MQbrain_148, human
gagaggacgcgggagtcaccctctagatgaaggaagctgcggcactttgctcatgtcatgtaaggtgcttggagtttcatttgataagcagatggattctctggtagtccctc

SEQ ID NO: 2439 - DNA, 111 bp, Artificial
  Hairpin sequence HS_from_MQbrain_1480, human; PT_from_MQbrain_1480, chimp
actcggattagtgttgtctggggttctcactttctgactcctggaggacgaaacgccacttgtctgagagggagtgggagtgattcttgagaatgaaaacatgatttgggt

SEQ ID NO: 2440 - DNA, 81 bp, Artificial
  Hairpin sequence HS_from_MQbrain_1481, human
gggacacaacaactgacagactgcccagtgtggcctgggaaaaccaccagggctgaggtggcctgacagctgctgcatctt

SEQ ID NO: 2441 - DNA, 93 bp, Artificial
  Hairpin sequence HS_from_MQbrain_1484, human; PT_from_MQbrain_1484, chimp
tcaggactgcgaagatggtgaccctgcggaagaggaccctgaaagtgctcaccttcctcgtgctcttcatcttcctcacctccttcttcctga

SEQ ID NO: 2442 - DNA, 106 bp, Artificial
  Hairpin sequence HS_from_MQbrain_1485, human
gcttccccggggttacacctcctaacagcataatggggagcatgatgcctccaccagtaggcatggttgctcagccaggagcttctgggatggttgcccccatggc

SEQ ID NO: 2443 - DNA, 98 bp, Artificial
  Hairpin sequence HS_from_MQbrain_1487, human; HS_from_MQbrain_1884, human
cctcgccctggtatgatgccagcaccccatatggggggccctcccatgatgccaatgatgggccctcctcctcctgggatgatgccagtgggacctgg

SEQ ID NO: 2444 - DNA, 71 bp, Artificial
  Hairpin sequence HS_from_MQbrain_1489, human
gggactgtggccttccttggggacaggcagtgccttcatcatctgtttgttcccaagacagccatgtaatc

SEQ ID NO: 2445 - DNA, 86 bp, Artificial
  Hairpin sequence HS_from_MQbrain_149, human
gaggggggcattgggagagtaaagatggtggcaaaaggtaacttaggttgccactttttaccacaacacttttctaggctattctc

SEQ ID NO: 2446 - DNA, 61 bp, Artificial
  Hairpin sequence HS_from_MQbrain_1490, human
ggtgcagtgaccacagtgaccatgggtgatcacagatggtcacgtgtggccatgactgact

SEQ ID NO: 2447 - DNA, 75 bp, Artificial
  Hairpin sequence HS_from_MQbrain_1493, human
gcatggggcctagacccagtgaggcctcaagccagggtggcggaggtggcactgggagctctgggtcacctaggt

SEQ ID NO: 2448 - DNA, 68 bp, Artificial
  Hairpin sequence HS_from_MQbrain_1494, human
gtggacccttctctgggagcctctgttcagaggggtcatccctgtgtgtggctcccatggggcaacac

SEQ ID NO: 2449 - DNA, 72 bp, Artificial
  Hairpin sequence HS_from_MQbrain_1497, human
gcaggagtcggcgcggcagctgcagctggcccaggaggccgcccagaagcggctgcaggcggaagagaaggc

SEQ ID NO: 2450 - DNA, 114 bp, Artificial
  Hairpin sequence HS_from_MQbrain_15, human; PT_from_MQbrain_15, chimp
ccaatcaagggaagaaggaggaatgctggactggaggcccctggagccagatggcaagagggtgacagcttcctttcctgtgtgtactctgtccagttcctttagaaaaaatgg

SEQ ID NO: 2451 - DNA, 79 bp, Artificial
  Hairpin sequence HS_from_MQbrain_150, human
aggaggagagagcaggctggcagggccagggacagtcttcagaggcccctggctcaggcagctttgtttctgtctttct

SEQ ID NO: 2452 - DNA, 105 bp, Artificial
  Hairpin sequence HS_from_MQbrain_1500, human
ctctcggagcagcctggcctgtgtggcagccatggacaggtacagcatggaggagctgattcagctgggccaaggtagggcaggcagagctgggggctgtgggag

SEQ ID NO: 2453 - DNA, 80 bp, Artificial
  Hairpin sequence HS_from_MQbrain_1501, human
caggaggacctgtggggctgcctgtggggcatcctgaggctgggtgggagaggcagagaccagggtgcaggtcggacctg

SEQ ID NO: 2454 - DNA, 82 bp, Artificial
  Hairpin sequence HS_from_MQbrain_1502, human
cgaggaggaggtgggcctgcatcctgggggccgggaccctgtccccatgcttccctgtgaccctccccacccctgtgtcttg

SEQ ID NO: 2455 - DNA, 115 bp, Artificial
  Hairpin sequence HS_from_MQbrain_1503, human
tgcagtcgctggcagacacactctgtggccaggtaggcccagacctgtctgagtatggactgacagcaagctcagagaggtctggacctggccacggagcacctcatgctaggca

SEQ ID NO: 2456 - DNA, 79 bp, Artificial
  Hairpin sequence HS_from_MQbrain_1504, human
tacgtgttccctaccctgccacccagccaccccactgggctgggctcgggctggagggggtcatcaaggtacacatgtg

SEQ ID NO: 2457 - DNA, 73 bp, Artificial
  Hairpin sequence HS_from_MQbrain_1507, human
ctggagcccccagagaccagaggcggccggcggggggccggccctcgccctcggccatggggaagcgtctcag

SEQ ID NO: 2458 - DNA, 118 bp, Artificial
  Hairpin sequence HS_from_MQbrain_1509, human
tttcttcctgcttgctcatttggcctcctgcctgttaaaatattgaggatgagagcagttttgtgatgtgaggtcttccgtgggggaaggaggagatgggcgtaggagtagggaggag

SEQ ID NO: 2459 - DNA, 97 bp, Artificial
  Hairpin sequence HS_from_MQbrain_151, human
ggtcttggccggcaggctagctcctggggtacagatgccatcagatgttttgactatggactgtggctcagggcctggtcttccatcctatcaggcc

SEQ ID NO: 2460 - DNA, 72 bp, Artificial
  Hairpin sequence HS_from_MQbrain_1513, human
cccatgatcaggactattctaatttctcttcatccatggaaaaagagtctgaggatggtccagtttcctggg

SEQ ID NO: 2461 - DNA, 110 bp, Artificial
  Hairpin sequence HS_from_MQbrain_1514, human; PT_from_MQbrain_1514, chimp
gggctggtgcatcgccggcgagtacgggtgtcctatgtaagtttctattgctgtagaattgcagctgggagctgaaaatactattcgtgtctgtctggtgcatgttgcct

SEQ ID NO: 2462 - DNA, 110 bp, Artificial
  Hairpin sequence HS_from_MQbrain_1515, human
tacatactgagctcctaaagtttaaattcaggtactgagtgtacaatttcaccaacattctaacccatgaaacttttacactctgtgccaagaaactgttggcttttgta

SEQ ID NO: 2463 - DNA, 93 bp, Artificial
  Hairpin sequence HS_from_MQbrain_1516, human; PT_from_MQbrain_1516, chimp
actggaaagtgactctgggagtgacaaggccaacagcccagcaggaggtattccctccacctcttcttgtttgcctagccccagtactccagt

SEQ ID NO: 2464 - DNA, 120 bp, Artificial
  Hairpin sequence HS_from_MQbrain_1517, human
tcagaggtcttcagtgatgctgccaaggaagggtggcttcatttccgaccccttgtcaccgataagggcaaggtagtgtgttttctaagccaccctgagtgtcagaaatgcagaccctga

SEQ ID NO: 2465 - DNA, 90 bp, Artificial
  Hairpin sequence HS_from_MQbrain_1518, human
gtccatcaccaggcagctgggccaggttctgggaggtgggtccccctgttcaccaccaggcagctgggccaggctttttgggaggtgggc

SEQ ID NO: 2466 - DNA, 119 bp, Artificial
  Hairpin sequence HS_from_MQbrain_152, human; PT_from_MQbrain_152, chimp
cctgttcttttctcccctgtgctgccgccgcccgtggccgcccctctcctgaacttaccgccactcaggtaatgaggagccgtgggtgcagccagccttggagatgccgaagagacggg

SEQ ID NO: 2467 - DNA, 74 bp, Artificial
  Hairpin sequence HS_from_MQbrain_1520, human
ggcctcgtacctcccctccccagagtctgctgcccgcctcccagcccttcttggatggggtggaggtttccgtc

SEQ ID NO: 2468 - DNA, 112 bp, Artificial
  Hairpin sequence HS_from_MQbrain_1522, human; HS_from_MQbrain_212, human; HS_from_MQbrain_839, human; PT_from_MQbrain_1522, chimp; PT_from_MQbrain_212, chimp; PT_from_MQbrain_839, chimp
ctcttcaccctgccgtcatgtctaagtcagagtctcctaaagagcccgaacagctgaggaagctcttcattggagggttgagctttgaaacaactgatgagagcctgaggag

SEQ ID NO: 2469 - DNA, 95 bp, Artificial
  Hairpin sequence HS_from_MQbrain_1523, human
gctatgctttctctccctctcgtgcagcagcgaaatgtctgctgattgttattgtctggacagttcctgtggcgagaggggcgagacttgtccgc

SEQ ID NO: 2470 - DNA, 79 bp, Artificial
  Hairpin sequence HS_from_MQbrain_1525, human; HS_from_MQbrain_972, human
ggtggagaacaagaaagctcagctggtggtgattgcacacgatgtggatcccatcgagctggttgtcttcttgcctgcc

SEQ ID NO: 2471 - DNA, 118 bp, Artificial
  Hairpin sequence HS_from_MQbrain_1527, human
cagtgcatcatcgaccagttcatcagcaccggccaggccaagtgggtgcggcataatggcattgtgctgctgctgccccatggcatggaaggcatggtgagggctgcggtggtggctg

SEQ ID NO: 2472 - DNA, 120 bp, Artificial
  Hairpin sequence HS_from_MQbrain_1528, human
cctgggcgaagcgctgttgctgtcccgggccgggcccgctgccctgggctcggcgtccgccgactcggccgcgttgctgggctgggcccggggacagcccgccgccgccccgcagccggg

SEQ ID NO: 2473 - DNA, 67 bp, Artificial
  Hairpin sequence HS_from_MQbrain_1529, human; PT_from_MQbrain_1529, chimp
actttgtgtctgggacctctgggttctgccagttggctggttgggggtcaggggtcagtcagtgagt

SEQ ID NO: 2474 - DNA, 89 bp, Artificial
  Hairpin sequence HS_from_MQbrain_153, human; PT_from_MQbrain_153, chimp
ctgggcgggggcacaggctccgggatgggcactctgctcatgaacaagattagagaggagtacccggaccggatcatgaattccttcag

SEQ ID NO: 2475 - DNA, 98 bp, Artificial
  Hairpin sequence HS_from_MQbrain_1531, human
ccagggactcaataactgaccagaacacctgggcttccaatgtgcctgcctctaccctgcccagtgcttgcccaggtggaaagtcagtgccttcctgg

SEQ ID NO: 2476 - DNA, 76 bp, Artificial
  Hairpin sequence HS_from_MQbrain_1535, human
ctctgggctcagcacctgaggcgggtttcctgggtcccctctccagcaagcctccaccagcaagctcggcccagag

SEQ ID NO: 2477 - DNA, 90 bp, Artificial
  Hairpin sequence HS_from_MQbrain_1537, human
ctcactggggacagggcggtggccaggcagatggctggagggaagcagagcctccttgccggctgcctgtgctgttctgagcccagagag

SEQ ID NO: 2478 - DNA, 79 bp, Artificial
  Hairpin sequence HS_from_MQbrain_1539, human
gcccggccggctggaggtcgggcggcctctgcccttcggaaaccagggcatcgatcctgcccgccccgcgcccccgcgc

SEQ ID NO: 2479 - DNA, 50 bp, Artificial
  Hairpin sequence HS_from_MQbrain_154, human
gtggagtggggtgcctgtcccctgccactgggtgacccacccctctccac

SEQ ID NO: 2480 - DNA, 116 bp, Artificial
  Hairpin sequence HS_from_MQbrain_1540, human
gagattgtattggattttactaaattgtgtcagtgagggagtaagttgaataagagacccaaccagggcatattcataactctgtctcctgacagtggttgattatgtacaatttt

SEQ ID NO: 2481 - DNA, 106 bp, Artificial
  Hairpin sequence HS_from_MQbrain_1541, human; PT_from_MQbrain_1541, chimp
gcagctcctgagaaagccagcccacatgtcaataaatctagatctgtttgaagctaacgtcactaaatcttcgtcttgactgtttgctggtcgtgtcaagagctgc

SEQ ID NO: 2482 - DNA, 113 bp, Artificial
  Hairpin sequence HS_from_MQbrain_1542, human; MQbrain_1542, macaque; PT_from_MQbrain_1542, chimp
agaggcacaaagatatctggtccaaggagaaaacctgtgatcgtctcccgaagttcctcattgtgggaccccagaaaacaggtgaagtatccttagctaacttctcttgccct

SEQ ID NO: 2483 - DNA, 91 bp, Artificial
  Hairpin sequence HS_from_MQbrain_1545, human
ttctgtgggaaaggggggaattttactttctcgtcgctctgttctgagagtggatgattgaactgccactttctccctgactctcatggga

SEQ ID NO: 2484 - DNA, 115 bp, Artificial
  Hairpin sequence HS_from_MQbrain_1546, human; PT_from_MQbrain_1546, chimp
aacatgtctgagtacagccagcaggcacagagattcaacattggtgaggactgtccagtatttcatggcctctttgagtttcgtcagttgtctgtgggcggctctgtggcaagtt

SEQ ID NO: 2485 - DNA, 62 bp, Artificial
  Hairpin sequence HS_from_MQbrain_1547, human
cagtagagggcgcacttttgcgagcggctttcgtagccagttgcttcctgggttctttactg

SEQ ID NO: 2486 - DNA, 92 bp, Artificial
  Hairpin sequence HS_from_MQbrain_1548, human; PT_from_MQbrain_1548, chimp
gccttaaggaagggtacggtgaagccaagcagtgggaggtgggaaagtatgcttatctccataattgacttctcttccctctttctgcaggc

SEQ ID NO: 2487 - DNA, 102 bp, Artificial
  Hairpin sequence HS_from_MQbrain_1549, human
ggaggagatgagtgtaccccaggactgtcacctccttccctccactgaaagcttttccgggggagtcagtgaagatgtcatttctaggcctcattctcctcc

SEQ ID NO: 2488 - DNA, 59 bp, Artificial
  Hairpin sequence HS_from_MQbrain_155, human; PT_from_MQbrain_1417, chimp; PT_from_MQbrain_155, chimp
ggtctgggatgggtaccctcctcatcagcaagatccgggaggagtacccagacaggatc

SEQ ID NO: 2489 - DNA, 97 bp, Artificial
  Hairpin sequence HS_from_MQbrain_1550, human
ctactgggagttggagtttgcttctctgtagttgggcagctgctcttggtctagtgaccaccagcctggacagctacggagaacccgccttaggtag

SEQ ID NO: 2490 - DNA, 118 bp, Artificial
  Hairpin sequence HS_from_MQbrain_1551, human; HS_from_MQbrain_1552, human
ctgcgggggcatcgctggagccgccggcagctccggcacccggagaagacaaccccgccggggctgggggagcggcggtggccggggctgcaggaggggctcggcggttcctctgcgg

SEQ ID NO: 2491 - DNA, 115 bp, Artificial
  Hairpin sequence HS_from_MQbrain_1553, human; PT_from_MQbrain_1553, chimp
ttccaaccacccttgccattcctttcctccccttaattcctcccccagcccggtccccagatggggttgatttgtgactggcggggaggggacagggaacagagggacaatggga

SEQ ID NO: 2492 - DNA, 85 bp, Artificial
  Hairpin sequence HS_from_MQbrain_1555, human; PT_from_MQbrain_1555, chimp
gcagcctcctagggacacgcgtggggtctggagcgggacacgcgtgtgcagccgggccttacgtgtggctcaaggggcggtgggc

SEQ ID NO: 2493 - DNA, 88 bp, Artificial
  Hairpin sequence HS_from_MQbrain_1556, human
gaagatgtgggtctccaagaaggaatatgaggaagacggtgcctgatctatccacaggaaaaccttctaatgttgggatatcatcttc

SEQ ID NO: 2494 - DNA, 113 bp, Artificial
  Hairpin sequence HS_from_MQbrain_1557, human; MQbrain_1557, macaque
tccctccctcgccggttgcctttttttccacttctctccctcccccttccgtttctatttgtgaagggaggaggaaggcagaggcgggctggtgtctctggccggggactgga

SEQ ID NO: 2495 - DNA, 71 bp, Artificial
  Hairpin sequence HS_from_MQbrain_1558, human
gttttcgtggagccagtgcagctgccgtgcaaacacaacttctgccggggctgcatcggcgaggcgtgggc

SEQ ID NO: 2496 - DNA, 117 bp, Artificial
  Hairpin sequence HS_from_MQbrain_1560, human; PT_from_MQbrain_1560, chimp
ggaatatcctttactgtgggtggcatagctttttagggttggcttcctaaacattttggggagaatgaatctaccagcagagaagctttcctttggcagtctgagggtgtatcttcc

SEQ ID NO: 2497 - DNA, 82 bp, Artificial
  Hairpin sequence HS_from_MQbrain_1561, human
ctaatgttaaaaaaagtggtgggagctgatcacctatgctgccgtaaaatgaaacagctccccctcttatatttgaccagag

SEQ ID NO: 2498 - DNA, 96 bp, Artificial
  Hairpin sequence HS_from_MQbrain_1565, human
gtgaagagcagacatgcctggtgcctgggtcaagctgtccctgcaggccttggggacactgcatgaaccaggccaggtgtagggggtctctcttgc

SEQ ID NO: 2499 - DNA, 88 bp, Artificial
  Hairpin sequence HS_from_MQbrain_1569, human
gctgtggacaggtccctggggtgtccagccagctgctaggcctgaccaggaggcttgctggggcccatccctgggtcattgtatgagc

SEQ ID NO: 2500 - DNA, 99 bp, Artificial
  Hairpin sequence HS_from_MQbrain_157, human
ccaagggccttcagaaacctaagctggtccaggcctgtggcctgggaggtgtcccttcccttcccaggctggagccaagctggccagctgggggtatgg

SEQ ID NO: 2501 - DNA, 69 bp, Artificial
  Hairpin sequence HS_from_MQbrain_1570, human
gtttctgactggtgtctagcagccctgccagagagagcggcagtgtgtctgcaggcgaccaggagaaat

SEQ ID NO: 2502 - DNA, 80 bp, Artificial
  Hairpin sequence HS_from_MQbrain_1571, human
cgcgccggcacgagggtgttttcgacgttggctgtggggaaacagcaagcggcgtggacgaccgttgctgagctggtgtg

SEQ ID NO: 2503 - DNA, 108 bp, Artificial
  Hairpin sequence HS_from_MQbrain_1572, human
agttgatgcatctgtggctgtcttttgtgagatccagaacacattaattaacacactgattagaaaacatggaacagaagaacaaaaggccacctatttgcctcagct

SEQ ID NO: 2504 - DNA, 115 bp, Artificial
  Hairpin sequence HS_from_MQbrain_1573, human
ctctgagccaggaagccttgttagaggaaggaactctggcattcagaggtgtccccttgggggcacttgcttgggtcttggatcaaactctactggggcagcctggctgtgggag

SEQ ID NO: 2505 - DNA, 102 bp, Artificial
  Hairpin sequence HS_from_MQbrain_1574, human
caatgaaaagatgaggggcaaggaggaaaagctgctgatcagttgtatctctccctttaaataaagctgctccttgtggctcctcttagtccttccttggtg

SEQ ID NO: 2506 - DNA, 88 bp, Artificial
  Hairpin sequence HS_from_MQbrain_1575, human
tggccatgtcaaaacttggctacaaggctctttccctctctatgaaggacaggcaataaagaggaggcctggggtggcggcgtgggca

SEQ ID NO: 2507 - DNA, 80 bp, Artificial
  Hairpin sequence HS_from_MQbrain_1576, human
gagcctctcccggcacgttgagactgcctttctgtgttatgagaacagagaagtaagctcctcgctctggcagggtaatc

SEQ ID NO: 2508 - DNA, 113 bp, Artificial
  Hairpin sequence HS_from_MQbrain_158, human
ggccctggccctgctactgccccagggtgcctgcactggccggacccccggacccccagccagtggtgcgggtggggcggccaatggcactggggcaggggcagtcatgggcc

SEQ ID NO: 2509 - DNA, 78 bp, Artificial
  Hairpin sequence HS_from_MQbrain_1581, human; HS_from_PT_285, human; PT_285, chimp; PT_from_MQbrain_1581, chimp
gcagaagcgggagggcctgggcccggggcgcacaggagggctcagccccaccgaccctgacccggcccctcccgcagc

SEQ ID NO: 2510 - DNA, 106 bp, Artificial
  Hairpin sequence HS_from_MQbrain_1584, human
tggccgcattcttagggaacgtcttcagtgtgcacactgcggtggtcccttagccacaagcttagggaatgtcttcagtttgtacttggtggcggtcccttggcta

SEQ ID NO: 2511 - DNA, 93 bp, Artificial
  Hairpin sequence HS_from_MQbrain_1585, human
cttagggaacgtcttcagtgtgcacactgcggtggtcccttagccacaagcttagggaatgtcttcagtttgtacttggtggcggtcccttgg

SEQ ID NO: 2512 - DNA, 80 bp, Artificial
  Hairpin sequence HS_from_MQbrain_1587, human
ctgtggttcatccctgctttcccctccccggcaaggcttctgggccagcagaggggcaggagcagaatgccagtccccag

SEQ ID NO: 2513 - DNA, 99 bp, Artificial
  Hairpin sequence HS_from_MQbrain_1589, human; HS_from_MQbrain_1831, human
gttcatcaattatgtgaggagtgcttccggatgactgaccaggaggttattcaaaatctctggcagtggaggaagtctctttaggaaaatagtttaaac

SEQ ID NO: 2514 - DNA, 78 bp, Artificial
  Hairpin sequence HS_from_MQbrain_1592, human; HS_from_MQbrain_1700, human; HS_from_MQbrain_1724, human; HS_from_MQbrain_468, human; HS_from_MQbrain_555, human; HS_from_MQbrain_664, human
ggtggggaacaagaaggctcagctggtggtgactgcacaggacatggatcccatcgagctggtgtcttcctgcctgcc

SEQ ID NO: 2515 - DNA, 77 bp, Artificial
  Hairpin sequence HS_from_MQbrain_1593, human
ttcccatagtggtgaaagctgggaatgcagagtgtgttaaagagaggctgtgttcccagcatgcaccactaccagag

SEQ ID NO: 2516 - DNA, 111 bp, Artificial
  Hairpin sequence HS_from_MQbrain_1595, human; PT_from_MQbrain_1595, chimp
cctcttctcatgcatgacacctctaggcatcgggctgggtgcagctctggcagagtcggcaggacctctgcaccagctggcccagtctgtgctagagggcatggcagctgg

SEQ ID NO: 2517 - DNA, 111 bp, Artificial
  Hairpin sequence HS_from_MQbrain_1596, human; MQbrain_1596, macaque; PT_from_MQbrain_1596, chimp
ctgcggagtgtcgctcgctaccgccgccgctgccgccgccgctttcggtgatgaggaaaagaaaatggcggcgggaaaagcgagcggcgagagcgaggaggcgtcccccag

SEQ ID NO: 2518 - DNA, 76 bp, Artificial
  Hairpin sequence HS_from_MQbrain_1598, human
gctatactttgatgcccttgagtgtctccctgaggacaaagaggtcctcacagaggacaagtgcctccaggtatgt

SEQ ID NO: 2519 - DNA, 116 bp, Artificial
  Hairpin sequence HS_from_MQbrain_1599, human; PT_from_MQbrain_1599, chimp
gccccctatctcctggggagggtgaggcagggcagggacagtctccagggtcagtccctggatgggtggttacctccccttcctccaccctaagccctggggccctgaaatggggt

SEQ ID NO: 2520 - DNA, 46 bp, Artificial
  Hairpin sequence HS_from_MQbrain_16, human
cgctgtggtccccgaggtcccggagctggccctgcggggcccggcg

SEQ ID NO: 2521 - DNA, 96 bp, Artificial
  Hairpin sequence HS_from_MQbrain_160, human
ggcccgggtaccgggggtgtggccagcgccaaagctgtgaaggatttgctcacaggctggtggtcctggccatggccatgctgcaggcctgaggtc

SEQ ID NO: 2522 - DNA, 94 bp, Artificial
  Hairpin sequence HS_from_MQbrain_1600, human; PT_from_MQbrain_1600, chimp
gccccagtaccttcgcctgtgcacagcttgccactggcgctgcctgccgcctggtggaggctgtgctctcaggagaggtgtgtcctctgtgggc

SEQ ID NO: 2523 - DNA, 86 bp, Artificial
  Hairpin sequence HS_from_MQbrain_1601, human
tttcggcagtggcatccggggccggggtcgcggccatggacgtggctggggctgagaccgcggagctcatggaggcaaggctgagg

SEQ ID NO: 2524 - DNA, 101 bp, Artificial
  Hairpin sequence HS_from_MQbrain_1602, human
ctgagctctattcctgggctctgaaggtgctcacagtgagaaatgccctgcatacattgttggcctataccctgagacctgagaccccaggaggagttggg

SEQ ID NO: 2525 - DNA, 79 bp, Artificial
  Hairpin sequence HS_from_MQbrain_1603, human; PT_from_MQbrain_1603, chimp
agctttttggacatttgtgtccctgggtgtgagagctctatgtaggtgtctgcaccccaggatgtgaagtctctgagct

SEQ ID NO: 2526 - DNA, 99 bp, Artificial
  Hairpin sequence HS_from_MQbrain_1605, human
gagataatcttgagacaaccttgcatttccagtttccctccttgggcagcctaactatgagggagggaaacatggcttgcaataaattagcattgtgtc

SEQ ID NO: 2527 - DNA, 80 bp, Artificial
  Hairpin sequence HS_from_MQbrain_1606, human
ctcaggagactgaggctgcaccctctcaggccccagcagatgaacctgagcctgagagtgcagctgcccagtctcaggag

SEQ ID NO: 2528 - DNA, 114 bp, Artificial
  Hairpin sequence HS_from_MQbrain_1608, human; HS_from_MQbrain_18, human
tcatgtcataaaaatgacttcatagttattggggttagggaggtggagaagagataatctttttcattatgttttgtctggatggctggttttgaggttttaaacctgacttga

SEQ ID NO: 2529 - DNA, 119 bp, Artificial
  Hairpin sequence HS_from_MQbrain_161, human
gcccagggccaggagatcctccttgatctgggtgcagccccttctgcctggagagaagggtataccaggagctgcagtgcccagacagggaggaggctccagcctggctttctgagggc

SEQ ID NO: 2530 - DNA, 58 bp, Artificial
  Hairpin sequence HS_from_MQbrain_1610, human
ttgccatgggcagtgctccaggcctgcttggtgtggacatggtggtgagccgtggcaa

SEQ ID NO: 2531 - DNA, 83 bp, Artificial
  Hairpin sequence HS_from_MQbrain_1612, human; PT_from_MQbrain_1612, chimp
caagactattcccagcaggatgagagggaaggcctgccatattccaggccacttcccaaatccaccctgctgagagtgtggtg

SEQ ID NO: 2532 - DNA, 91 bp, Artificial
  Hairpin sequence HS_from_MQbrain_1616, human
tgaaggctcaggggaaagggaggcagggaagggccatgatgagatgtctctgcctttcccagcgccatcctttacctaaatggggacttcg

SEQ ID NO: 2533 - DNA, 70 bp, Artificial
  Hairpin sequence HS_from_MQbrain_1617, human; MQbrain_1617, macaque; PT_from_MQbrain_1617, chimp
ccattgcctcgagtccttgtgtctgactgtctgttcctgctgctgtatgacacagcacctcgaggcaagg

SEQ ID NO: 2534 - DNA, 71 bp, Artificial
  Hairpin sequence HS_from_MQbrain_1619, human
caggctcctctgtttacccacctagttggccaagcagtgactgccacaggggagggaaaggggagggactg

SEQ ID NO: 2535 - DNA, 72 bp, Artificial
  Hairpin sequence HS_from_MQbrain_162, human
ctgcgtcctttggtcctgtccccgcagccctggcagggggcatgcggtcgggcaggggctggagggaggcgg

SEQ ID NO: 2536 - DNA, 95 bp, Artificial
  Hairpin sequence HS_from_MQbrain_1620, human; PT_from_MQbrain_1620, chimp
gtcaggggagtgaggggtggaggtaggggccagaggggcttacacgatatcccatacctttaatgcctttggccttccattctgatttctctgat

SEQ ID NO: 2537 - DNA, 63 bp, Artificial
  Hairpin sequence HS_from_MQbrain_1621, human
ggcaacctctctcttctcctctgtttcgtgaaggcaggggacacagatgggagagattgagcc

SEQ ID NO: 2538 - DNA, 117 bp, Artificial
  Hairpin sequence HS_from_MQbrain_1623, human; MQbrain_1623, macaque; PT_from_MQbrain_1623, chimp
tgctgatgaaccgggcttacttgcagagcattacccctcaggggtactctgactcggaggagagggagagtatgccgagggatggcgagagcgagaaggagcacgagaaagaaggcg

SEQ ID NO: 2539 - DNA, 65 bp, Artificial
  Hairpin sequence HS_from_MQbrain_1624, human
tcctgtagggaaggggctgggctcgtgtcctgctgtgtgcccaatctccttctcttcactgagga

SEQ ID NO: 2540 - DNA, 101 bp, Artificial
  Hairpin sequence HS_from_MQbrain_1625, human
gtcaaagcaagagatggcgactggcttcatccagccaaagaggacaaagtggttctggaaactttggtggtggtcttggacgtggtttcagtgggaatgac

SEQ ID NO: 2541 - DNA, 91 bp, Artificial
  Hairpin sequence HS_from_MQbrain_1626, human
tggacattagccaagttcaaactgagccttgctttgctttgggaaaacatagagcaaagcaaagctcagttggagcttgactatgaattca

SEQ ID NO: 2542 - DNA, 97 bp, Artificial
  Hairpin sequence HS_from_MQbrain_1627, human
gggggtggctgggaggggaagggaagggagaggcaagctggctgtgaactgtcctgttgtggggctggagctgctcccacctccctgacctacccct

SEQ ID NO: 2543 - DNA, 84 bp, Artificial
  Hairpin sequence HS_from_MQbrain_1628, human; PT_from_MQbrain_1628, chimp
ggcaaaaagaggcaggcagtggagtctccctgtcgacagtaaagttgaaatggtgacgtccactgctggctttattgaacagct

SEQ ID NO: 2544 - DNA, 113 bp, Artificial
  Hairpin sequence HS_from_MQbrain_163, human
agaggccacctaagaagctgcacattgtcctctgatgccttccctggatttgtgcagagactgggagggctttcagggaggatcagtgtcatcagagtcccgggctgaccttt

SEQ ID NO: 2545 - DNA, 71 bp, Artificial
  Hairpin sequence HS_from_MQbrain_1630, human
gtgctgctggagaagggctggagaaggcaatggcatgctgccgctttgccagtccctagaagtcgcggtgc

SEQ ID NO: 2546 - DNA, 111 bp, Artificial
  Hairpin sequence HS_from_MQbrain_1631, human
ccagtggccccactctgggctgccctgttcttcttcatgctgttgctgcttggtctcgacagccaggtttgcatggggctctgggacagggagccaggaggggggcggagg

SEQ ID NO: 2547 - DNA, 76 bp, Artificial
  Hairpin sequence HS_from_MQbrain_1632, human
ggcagggcaggatgtgggcggtgtaggcgcctggctaggggtcagcacagcctccgctccccatctctgccaggtc

SEQ ID NO: 2548 - DNA, 85 bp, Artificial
  Hairpin sequence HS_from_MQbrain_1633, human
cagtaggctggagtacatggggcggagatcacgatggcaggccagggcctcacgcccacgcctgccctgcgcccccagtctgctg

SEQ ID NO: 2549 - DNA, 72 bp, Artificial
  Hairpin sequence HS_from_MQbrain_1635, human
tctggaccctgatcctgcactactccatctccatgcccatgtgggacgaggaggaggatgaggaggccaaga

SEQ ID NO: 2550 - DNA, 109 bp, Artificial
  Hairpin sequence HS_from_MQbrain_1636, human; PT_from_MM_294, chimp; PT_from_MQbrain_1636, chimp
ggcccctccaaggtgaagatggattgccaggagtgccctgagggctaccgcgtcacctatacccccatggcacctggcagctacctcatctccatcaagtacggcggcc

SEQ ID NO: 2551 - DNA, 96 bp, Artificial
  Hairpin sequence HS_from_MQbrain_1637, human; PT_from_MQbrain_1637, chimp
ggcttcttctttgtggcagctggccaacagccaggtgggtcccatggggagccttcttcagcggcctgggcttggcacagtcatgaggacagggct

SEQ ID NO: 2552 - DNA, 104 bp, Artificial
  Hairpin sequence HS_from_MQbrain_1638, human
gcttctagtggctcctgtaccttggcaggtttgtgggctgggtgggccttgaccccagagcccggtccacagggtctgtctgagctgtggggtgcgtgtgaggc

SEQ ID NO: 2553 - DNA, 68 bp, Artificial
  Hairpin sequence HS_from_MQbrain_1640, human; MQbrain_1640, macaque
ccttaagggccacctccaccctggccaggcccccaaactggcacactggtctggacggaagcccctgg

SEQ ID NO: 2554 - DNA, 118 bp, Artificial
  Hairpin sequence HS_from_MQbrain_1641, human
ctgaggtatggaaggccagggtggtggcgggaatccattccagtgtgttctacacattccttagagattggatggggtgcatcaggatggtttctgattacttttcttcttccctcag

SEQ ID NO: 2555 - DNA, 110 bp, Artificial
  Hairpin sequence HS_from_MQbrain_1642, human
gcacccctctctatcctcccaggctactccatgtttggggctggcctcaccgtaggcctgtctaacctcttctgtggagtctgcgtgggcatcgtgggcagtggggctgc

SEQ ID NO: 2556 - DNA, 102 bp, Artificial
  Hairpin sequence HS_from_MQbrain_1644, human
gctgaaactaagaatgctgccttggagagggtggaagaactggaagaaaacatttctcatgtaactatatctcagaaaaggaaaaattgcttacatttcagc

SEQ ID NO: 2557 - DNA, 68 bp, Artificial
  Hairpin sequence HS_from_MQbrain_1645, human
ggccttcagccctctctgcctctgcagctgaccacaaggaagctggtggacagagagggactgattcc

SEQ ID NO: 2558 - DNA, 72 bp, Artificial
  Hairpin sequence HS_from_MQbrain_1646, human; MQbrain_1646, macaque; PT_from_MQbrain_1646, chimp
aggagctgggtccctttgcctcccttgagggcttccgggagctgctagacaaggcacaggtgggccaggcct

SEQ ID NO: 2559 - DNA, 73 bp, Artificial
  Hairpin sequence HS_from_MQbrain_1649, human
ttgttttgatgagagctgtggggagcatccttttgagagcagcaggaagcctcccccaaagtctcatatacag

SEQ ID NO: 2560 - DNA, 84 bp, Artificial
  Hairpin sequence HS_from_MQbrain_165, human
gcagattcatcttgtcaggtgacctggggaagaggcccttgttggccctgtccccactcgtgggtcactggtctgtggacctgc

SEQ ID NO: 2561 - DNA, 108 bp, Artificial
  Hairpin sequence HS_from_MQbrain_1651, human
gctgtgggccgcgctgcctggcgcctccggggtcgccctggcctgctgcttcgtggcggcggccgtggccctgcgctggtccgggcgccggacggcgcggggcgcggt

SEQ ID NO: 2562 - DNA, 99 bp, Artificial
  Hairpin sequence HS_from_MQbrain_1652, human
ccctccagagcctcataatcatctattattccaactactaagaacaggcagcaagagcctggctgcagtacgggatgggaaggagtggcctgggagcgg

SEQ ID NO: 2563 - DNA, 98 bp, Artificial
  Hairpin sequence HS_from_MQbrain_1654, human; MQbrain_1654, macaque; PT_from_MQbrain_1654, chimp
gaacagataaaactggatgaaggctgggtacctttggagataatgataaaattcaacaggtaacaagcttttaaaaataatctttaggttttctgttt

SEQ ID NO: 2564 - DNA, 103 bp, Artificial
  Hairpin sequence HS_from_MQbrain_1655, human
ggagcgcggtggcgcccggcgggagaagccgactggagcgcggccaccgctcggagctgcagtgcctcagtccggttctccggccagaagtccccattgttcc

SEQ ID NO: 2565 - DNA, 79 bp, Artificial
  Hairpin sequence HS_from_MQbrain_1656, human
ggccaccagggtgctcctgagtgctgggtgccgggcggacgccatcaacagcacccagagcacagcactgcacgtggcc

SEQ ID NO: 2566 - DNA, 98 bp, Artificial
  Hairpin sequence HS_from_MQbrain_1657, human; PT_from_MQbrain_1657, chimp
tcttcctgctgtcatgtctaagtcagagtctcctaaagagcccgaacagctgaggaggctcttcattggagggttgagctttgaaacaacagatgaga

SEQ ID NO: 2567 - DNA, 99 bp, Artificial
  Hairpin sequence HS_from_MQbrain_1658, human
ggaaatgctagtttgggaccttctgacctctttgccccacctgtgtcgagataagctcgacacaagtgggccaaagagctggggctcaagccagtcacc

SEQ ID NO: 2568 - DNA, 89 bp, Artificial
  Hairpin sequence HS_from_MQbrain_1659, human; PT_from_MQbrain_1659, chimp
gtatgctcctgtggcttccacgacctaatcctaactccagggactcgcaggagttaggattaggtcgtggaagccacaggcgcctgggc

SEQ ID NO: 2569 - DNA, 119 bp, Artificial
  Hairpin sequence HS_from_MQbrain_1660, human
gtgtagcaaagaggaaatactgtgccttgggattattttgtttatattcatgctacctttttggcatatatatttgagatacattttgggaaggggtggtttgttctctttgaaatcac

SEQ ID NO: 2570 - DNA, 70 bp, Artificial
  Hairpin sequence HS_from_MQbrain_1661, human
ctcgagaggggctgtatggggatgccacgtggaaggtattctgtgcccagactcatgtggccatctcgag

SEQ ID NO: 2571 - DNA, 98 bp, Artificial
  Hairpin sequence HS_from_MQbrain_1662, human
tgtaaaggggaagctggggagtttttatgttttgatttggaagagggactctagacattctgtccctctgagagaagctggctccttgctgctttgca

SEQ ID NO: 2572 - DNA, 92 bp, Artificial
  Hairpin sequence HS_from_MQbrain_1663, human; PT_from_MQbrain_1663, chimp
gtgggctgggttacaaggggaggaggggcatagagaaggcctgaaccccccttgggcttcgcaaccctcttcctcccctctgcctgattcac

SEQ ID NO: 2573 - DNA, 107 bp, Artificial
  Hairpin sequence HS_from_MQbrain_1664, human
caagttcatcaattatgtgaagaattgcttccggacaactgaccaggagactattcaagatcctggcagtggaggaagtctctttagaaaatagtttaaacaatttg

SEQ ID NO: 2574 - DNA, 71 bp, Artificial
  Hairpin sequence HS_from_MQbrain_1665, human
gggtgtgaaatgtttgctgccagtgagggagaaaggtttgccttggctaggagtagcaggatttcaggctc

SEQ ID NO: 2575 - DNA, 94 bp, Artificial
  Hairpin sequence HS_from_MQbrain_1667, human
aatatctccttatttaaggcagcagctctgctggggcctacattccaggattctcagcagagaaaacatgttttctttatagaggagttttatt

SEQ ID NO: 2576 - DNA, 94 bp, Artificial
  Hairpin sequence HS_from_MQbrain_1668, human
gtccagggttctagaacggctagcaggggtgtcatgggaaaattgggatacccacatacccggctattgctgcttttgtaaaaggatcctgaac

SEQ ID NO: 2577 - DNA, 91 bp, Artificial
  Hairpin sequence HS_from_MQbrain_1670, human; MQbrain_1670, macaque; PT_from_MQbrain_1670, chimp
gtggtgggcgcgctcgggcggctcctgcgcgttcccgccgaggcagtggcggcgggagcggcagagacggcagcggccggagtcccgttgc

SEQ ID NO: 2578 - DNA, 87 bp, Artificial
  Hairpin sequence HS_from_MQbrain_1671, human
gccccaggaattttggtgtctgctgctgccatggcctcagggaaggaagccgagggcccaggaagcagggctgccatttcccagggt

SEQ ID NO: 2579 - DNA, 91 bp, Artificial
  Hairpin sequence HS_from_MQbrain_1672, human; PT_from_MQbrain_1672, chimp
attctctgaatttcatccttctacaaattcacccctcacattatctacaatggtgatgggtgaatttgtagaaggatgaaagtcaaagaat

SEQ ID NO: 2580 - DNA, 71 bp, Artificial
  Hairpin sequence HS_from_MQbrain_1673, human; PT_from_MQbrain_1673, chimp
gggcagcatgggcacactctcttctctggacggggtcaccaacaccagtgaggggggctacccagaggccc

SEQ ID NO: 2581 - DNA, 66 bp, Artificial
  Hairpin sequence HS_from_MQbrain_1674, human
cccacaggtcctctttagccacagggaacctcctctggagctgaaagacacagacgccgctgtggg

SEQ ID NO: 2582 - DNA, 110 bp, Artificial
  Hairpin sequence HS_from_MQbrain_1675, human; MQbrain_1675, macaque; PT_from_MQbrain_1675, chimp
tatttgtatgtggggagtaggtgtttgaggttcccgttctttcccttcccaagtctctgggggtggaaaggaggaagagatactagttaaagattttaaaaatgtaaata

SEQ ID NO: 2583 - DNA, 78 bp, Artificial
  Hairpin sequence HS_from_MQbrain_1676, human
tccaagccagaaatccttgattatttacagtgcataagagttcttacatgctgtgggtaaaagagtgcagggcatgga

SEQ ID NO: 2584 - DNA, 78 bp, Artificial
  Hairpin sequence HS_from_MQbrain_1677, human; PT_from_MQbrain_1677, chimp
ccggggctagaaccggggctagggccgggggcaggtggtcctgcctgctctatacttagaccagtggagccagtctgg

SEQ ID NO: 2585 - DNA, 94 bp, Artificial
  Hairpin sequence HS_from_MQbrain_1678, human
tcgagatcgccacctacaggaagctgctggaagatggagaacatgagtatccatacgaagaccaccagcggctatgcaggtggtgtgagcttgg

SEQ ID NO: 2586 - DNA, 84 bp, Artificial
  Hairpin sequence HS_from_MQbrain_168, human; PT_from_MQbrain_168, chimp
ttggtggagaacaagaaagctcagctggtggtgattgcacacgacgtggatcccatcgaggtgcgtttgcctgttgactgctaa

SEQ ID NO: 2587 - DNA, 69 bp, Artificial
  Hairpin sequence HS_from_MQbrain_1681, human
ctgccagtgatggacacgggtggagaggccagcagagatagtggccgccagctgggacaacggtggtag

SEQ ID NO: 2588 - DNA, 116 bp, Artificial
  Hairpin sequence HS_from_MQbrain_1682, human
gctgggcagcccttcaagccctccagccccttcctcttaagtagataatgaagaaagtggctgtattgtgtgtctcctggagtattggcgttggttggggggcggagggtcccagc

SEQ ID NO: 2589 - DNA, 104 bp, Artificial
  Hairpin sequence HS_from_MQbrain_1683, human
gttttgtgttcttcctagtggaaggagcctgggagaggccaggcctccccggactgctagcctgcttttcctggggtccctggagccggaggaagaaccaggat

SEQ ID NO: 2590 - DNA, 62 bp, Artificial
  Hairpin sequence HS_from_MQbrain_1684, human; PT_from_MQbrain_1684, chimp
agctaggggcttggactactgggtataggacttgctctagctctcaggtcctagcccaagct

SEQ ID NO: 2591 - DNA, 119 bp, Artificial
  Hairpin sequence HS_from_MQbrain_1685, human
gcacggttggggaccatattccccatggtgtctagggggactctagcacggtcagggacccttccccacagtgtctagggggactccagcacggtcggggaccatattccccacagtgt

SEQ ID NO: 2592 - DNA, 101 bp, Artificial
  Hairpin sequence HS_from_MQbrain_1686, human
ggcggctgggccgagtgggtgtctggtgccggcgtttgggctacggttgttgttggcgactgtgcttcaagcggtgagtgtagatcaccttcgcagctgcc

SEQ ID NO: 2593 - DNA, 118 bp, Artificial
  Hairpin sequence HS_from_MQbrain_1687, human
gactccactctggccaagacgagctctcagattgcacttcagaatcggtgatgcgcactcattcccctgcacccacccttttttctgtggtcagcatgtgtttcccagactgggcgtc

SEQ ID NO: 2594 - DNA, 77 bp, Artificial
  Hairpin sequence HS_from_MQbrain_1689, human
gggtactgtgtgcagtcaggggtctcccaccaggttcctaaggttggaggtgaggctggaggctgccacagttatcc

SEQ ID NO: 2595 - DNA, 72 bp, Artificial
  Hairpin sequence HS_from_MQbrain_1690, human
gctgttctccagacactgatgtgggtggattctccatgagccccgcctctcaccaggctgtcctggagtggc

SEQ ID NO: 2596 - DNA, 58 bp, Artificial
  Hairpin sequence HS_from_MQbrain_1692, human
caggacgtggtagctactgcggtgcaataaccccagaattgcagtagctactaacctg

SEQ ID NO: 2597 - DNA, 98 bp, Artificial
  Hairpin sequence HS_from_MQbrain_1694, human
ctggccaacgtcatccacaactttggtatcgtggaaggacccatgaccacagtccatgctatcactgccacccagaagattgtggatggcccctccgg

SEQ ID NO: 2598 - DNA, 115 bp, Artificial
  Hairpin sequence HS_from_MQbrain_1695, human
gggagggagggaaggatgggtgtgtgggtgagttgtttgccgttttgagggcagacatgaaagttactaccagaatggtaagggagccactcacagaccccaggcaggcacccct

SEQ ID NO: 2599 - DNA, 81 bp, Artificial
  Hairpin sequence HS_from_MQbrain_1696, human
ctgcagaacccgctccacatgaagatcagcatccattgaaagcaggagccaatgggtgctgaggagaggacagagttgcag

SEQ ID NO: 2600 - DNA, 65 bp, Artificial
  Hairpin sequence HS_from_MQbrain_1697, human
ccagccaaaacccccaagccgggcgtggtaggtgttggcagcccggaggtggggagtggtggtgg

SEQ ID NO: 2601 - DNA, 118 bp, Artificial
  Hairpin sequence HS_from_MQbrain_1698, human
tttatctttacctttaaaaaactttgtctatttaaatcaggagctgcaggcagaaattcttatctggaagttcttctgaagttggcagacaaatacaaaaagaaaatgtgggggtaag

SEQ ID NO: 2602 - DNA, 78 bp, Artificial
  Hairpin sequence HS_from_MQbrain_1699, human
gaccaatcctaggcttagagggcagaggttcagggtgcccaaggagcctgacgcaactgctctgagagccctggggtc

SEQ ID NO: 2603 - DNA, 102 bp, Artificial
  Hairpin sequence HS_from_MQbrain_17, human
taagagctgtctcaataaatgattcagctacgatcaccagggcatatcatagctgaaaggccctggtgatggtagctgaataatttattgagacaaatctta

SEQ ID NO: 2604 - DNA, 73 bp, Artificial
  Hairpin sequence HS_from_MQbrain_170, human
ccgtgacctctgccctcgggatgcaattgtctggttgttactagacacctgccaatccctgcagtcccactgg

SEQ ID NO: 2605 - DNA, 91 bp, Artificial
  Hairpin sequence HS_from_MQbrain_1701, human
ggactgtgtatgcgcctctgtctggagggggctgtctgttggttaaagggtgtcttttccaggccctggagattgcaggcactaacagtcc

SEQ ID NO: 2606 - DNA, 90 bp, Artificial
  Hairpin sequence HS_from_MQbrain_1703, human
agggctgtggtttcatgtgtggtgggtcttgggtacacaattaggctgtgagtaacagaggcctagagccccatcatgtctactagctct

SEQ ID NO: 2607 - DNA, 105 bp, Artificial
  Hairpin sequence HS_from_MQbrain_1706, human; PT_from_MQbrain_1706, chimp
cctcaggttggcccaagggacccctgctgtaacaattccaggatggggagtcagatagactacaggatataggagaaaaggcaggggcagagcggggccgtgggg

SEQ ID NO: 2608 - DNA, 90 bp, Artificial
  Hairpin sequence HS_from_MQbrain_1708, human; PT_from_MQbrain_1708, chimp
atctatgaaggccaagtggaggcgactagtgatgaatacaatgtggaaagcattgatggtcagccaggtgcctttacctgctatttgggt

SEQ ID NO: 2609 - DNA, 78 bp, Artificial
  Hairpin sequence HS_from_MQbrain_1709, human; PT_from_MQbrain_1709, chimp
ctgaagggcggctccgtgcgcaagctccggcgtgccaagcagttggtgctggagctgggcgaggaggcgatcttggag

SEQ ID NO: 2610 - DNA, 113 bp, Artificial
  Hairpin sequence HS_from_MQbrain_171, human; PT_from_MQbrain_171, chimp
gctgtttcaaggtctcttgaaagagtccctactccctccctaagctccattctctcctgggtttggatatgctgagagagggtagggaaaactgaaaggaacattgatcaagt

SEQ ID NO: 2611 - DNA, 82 bp, Artificial
  Hairpin sequence HS_from_MQbrain_1712, human
gcccggaggccctggtggccctgggatggggaaccgcggtggcttccgcggaggtttcggcagtggcatccggggccagggt

SEQ ID NO: 2612 - DNA, 116 bp, Artificial
  Hairpin sequence HS_from_MQbrain_1715, human
ctaaaggaggagcccgaggagctggcccagctggctcccaccccaggagacgccatcatctctctggatttcggtgggtgcttcttagctaagccaggcccctggaaccccgttgg

SEQ ID NO: 2613 - DNA, 77 bp, Artificial
  Hairpin sequence HS_from_MQbrain_1716, human; MQbrain_1716, macaque; PT_from_MQbrain_1716, chimp
gagcttgaatggctttcaggtgctccagctgatgatcctagaggaagccaggaccatctgaaagcccaaagacaatc

SEQ ID NO: 2614 - DNA, 94 bp, Artificial
  Hairpin sequence HS_from_MQbrain_1717, human
ggtgggtatctaaatcattaagaatgttgggaggaaggaggccaatggtaaagaagctcttccttctaacaaacatgaatcctttaccttgacc

SEQ ID NO: 2615 - DNA, 97 bp, Artificial
  Hairpin sequence HS_from_MQbrain_1718, human; HS_from_MQbrain_413, human; HS_from_MQbrain_414, human; PT_from_MQbrain_1718, chimp; PT_from_MQbrain_413, chimp
tccgcggaggtttcggcagtggcatccggggccggggtcgcggccgtggacggggccggggccgaggccgcggagctcgcggaggcaaggccgagga

SEQ ID NO: 2616 - DNA, 97 bp, Artificial
  Hairpin sequence HS_from_MQbrain_1719, human
tccgcggaggtttcggcagtggcatccggggccagggtcgcggccgtggacggggccggggccaaggccgcggagctcgcggaggcaaggccgagga

SEQ ID NO: 2617 - DNA, 68 bp, Artificial
  Hairpin sequence HS_from_MQbrain_1720, human
gctggtggggtggaggtggggggtgagtgggaagaagccactccatcagctttgtcttggcctttggt

SEQ ID NO: 2618 - DNA, 119 bp, Artificial
  Hairpin sequence HS_from_MQbrain_1721, human
gctctagggacatgacagccctggagggtgggtctgacggtcgggagtgcatgtggaggctgggagcaagctgggcagagtgccctgggtgaatctgctctccaggggttcctgggagc

SEQ ID NO: 2619 - DNA, 106 bp, Artificial
  Hairpin sequence HS_from_MQbrain_1722, human; MQbrain_1722, macaque; PT_from_MQbrain_1722, chimp
agcacatggtattcctgggtggtgcagttctagcggatatcatgaaagacaaagacaacttttggatgacccgacaagagtaccaagaaaagggtgtccgtgtgct

SEQ ID NO: 2620 - DNA, 87 bp, Artificial
  Hairpin sequence HS_from_MQbrain_1723, human
gggcatcagggtggtgcctctgattctggaatggcctctttcccctcctattcagccaaattccatgaccacaggcctctcctgctc

SEQ ID NO: 2621 - DNA, 99 bp, Artificial
  Hairpin sequence HS_from_MQbrain_1725, human; PT_from_MQbrain_1725, chimp
ttaggctcttggatgtttgttgtataaattatgctacttcactttgccatttggggaaagtcaggtggcaatttgtgatggaaacttcacaattcctga

SEQ ID NO: 2622 - DNA, 110 bp, Artificial
  Hairpin sequence HS_from_MQbrain_1726, human
cacgctctgcttgcttgggcgtggcctcctgtgagagggggccctaggatgaggcgatatgctggattcctgggcttccttaacatgagccctcccctgctgtagacgtg

SEQ ID NO: 2623 - DNA, 97 bp, Artificial
  Hairpin sequence HS_from_MQbrain_1727, human
ggggtcctaacaaatgaccagttaagttggcctgggatagagtgagaggctatgaaccaggatcagcatgaggtgggggtcggacaatgtggacccc

SEQ ID NO: 2624 - DNA, 85 bp, Artificial
  Hairpin sequence HS_from_MQbrain_1728, human
cctccttcctgaggggcctcagggcttgtggggggtaggctgagaccccaccaccaaaggttaagtgaggtccccttgattgagg

SEQ ID NO: 2625 - DNA, 116 bp, Artificial
  Hairpin sequence HS_from_MQbrain_1729, human; PT_from_MQbrain_1729, chimp
ctatcagttgatgcctcctctttctaggtaccttccagcagcccttctccctatcctccccgtaacacaggtggatgctgctctgggtgctgaggagatggtggagatgctgacag

SEQ ID NO: 2626 - DNA, 86 bp, Artificial
  Hairpin sequence HS_from_MQbrain_1730, human; HS_from_MQbrain_1739, human; HS_from_MQbrain_1743, human; HS_from_MQbrain_1749, human;
gttcccagtttttcatctgcactgccaagactgagtggttggatggcaagcatgtggtctttggcaaagtgaaagaaggcatgaat

SEQ ID NO: 2627 - DNA, 68 bp, Artificial
  Hairpin sequence HS_from_MQbrain_1734, human; PT_from_MQbrain_1734, chimp
tgtccccgggccaggcaagccggctctgtctaaaaagaaccccggcgtggtggcctaccaaggaggcg

SEQ ID NO: 2628 - DNA, 104 bp, Artificial
  Hairpin sequence HS_from_MQbrain_1740, human
cgtgtgggttcaggaggtgcccaaactgaaggtgtgtgcactgggcgtgaccagccgggcccgcagccacatcttcagggtggggggcaagaacctcactttcg

SEQ ID NO: 2629 - DNA, 62 bp, Artificial
  Hairpin sequence HS_from_MQbrain_1741, human
ggcagtgggtagcagcggggctggggcggacccctcctttcagcctgtcctgtccgcgcgcc

SEQ ID NO: 2630 - DNA, 56 bp, Artificial
  Hairpin sequence HS_from_MQbrain_1744, human; HS_from_MQbrain_1745, human
tcaagggcctgccttcgcctcagggactctcttcctttggatgagggggtccttgg

SEQ ID NO: 2631 - DNA, 114 bp, Artificial
  Hairpin sequence HS_from_MQbrain_1746, human
gcttctgatttggggcttgggctccaggcactggcttctcttctctgtgtccttagcatttgagagaagaggccaggggccttgttcatggatccctggacccaaggcagatgt

SEQ ID NO: 2632 - DNA, 87 bp, Artificial
  Hairpin sequence HS_from_MQbrain_1747, human
agtggtggacctgacctgccgtctggaaaaacctgccaattatgatgacgtcaagaaggtggtgaaccaggcatcggagggccccct

SEQ ID NO: 2633 - DNA, 84 bp, Artificial
  Hairpin sequence HS_from_MQbrain_1748, human; MQbrain_1748, macaque; PT_from_MQbrain_1748, chimp
caaagcccttggaggggcggccagagcggcagttctttgtgaaatggcaaggcatgtcttactggcactgctcctgggtttctg

SEQ ID NO: 2634 - DNA, 116 bp, Artificial
  Hairpin sequence HS_from_MQbrain_1750, human
agctgatagcctgttaataagcactggtctaacacagccaaccctcctccacagcgccatattaatggaggaggggaggaaggtgaaatctactgcatgggattcaggaaacagtt

SEQ ID NO: 2635 - DNA, 116 bp, Artificial
  Hairpin sequence HS_from_MQbrain_1752, human
tgtgcagggtatgtccttgaacttggaacctgacaatgttggtgttgtcgtgtttggaaatgataaactaattaaggaaggagatatagtgaagaggacaggagccattgtggacg

SEQ ID NO: 2636 - DNA, 99 bp, Artificial
  Hairpin sequence HS_from_MQbrain_1753, human; HS_from_MQbrain_1882, human; HS_from_MQbrain_1893, human
gggtttaaatgtagattctctggtcattgagcatatccaagtgaacaaagcacctaagatgtgccgctggacctacagagctcatggttggattaaccc

SEQ ID NO: 2637 - DNA, 75 bp, Artificial
  Hairpin sequence HS_from_MQbrain_1754, human
gggtcctgtggctggggggcacggccgtgtggctcggaggctgcatgaccaacgtgcccgcagcctgccacatcc

SEQ ID NO: 2638 - DNA, 68 bp, Artificial
  Hairpin sequence HS_from_MQbrain_1755, human
ggctctggcagggactggtggggacgcggggagcggcccaggcccctgccccgccgggctcagcctcc

SEQ ID NO: 2639 - DNA, 76 bp, Artificial
  Hairpin sequence HS_from_MQbrain_1756, human
cacaggtaagcaggggctctgggtgatgtgaggagcaacaggcaccctcctccacagcccctgctcattcctgctg

SEQ ID NO: 2640 - DNA, 76 bp, Artificial
  Hairpin sequence HS_from_MQbrain_1757, human; PT_from_MQbrain_1757, chimp
ctacccctggggaccccatgctggcctcatggcccactggggaagtgtggctaagcacggtggcccccagccctag

SEQ ID NO: 2641 - DNA, 99 bp, Artificial
  Hairpin sequence HS_from_MQbrain_1758, human
cacaaatggttctcagtttttcatctgcactgccaagactgagtggttggatggcaagcatgtggtcttggcaaggtgaaagaaggcatgaatattgtg

SEQ ID NO: 2642 - DNA, 112 bp, Artificial
  Hairpin sequence HS_from_MQbrain_1759, human; MQbrain_1759, macaque; PT_from_MQbrain_1759, chimp
gccagaacctgttttgtggacaaaggatggcggagaattaccagatcctgaccgaatggttgtgagtggtagggagctaaacattcttttcctgaacaaaacggataatggt

SEQ ID NO: 2643 - DNA, 109 bp, Artificial
  Hairpin sequence HS_from_MQbrain_176, human
ccttccgtagttctcatgcagcggaggggttcgacttgtaaccggcctgaaaccaagcgtggcgcaagatttgctcaagcccctcctcttggccaaactttccggaggg

SEQ ID NO: 2644 - DNA, 92 bp, Artificial
  Hairpin sequence HS_from_MQbrain_1760, human
ctccacaatgctcccaacacctgtgacccctaggaagacagggagcaaggtggatctggccaggagtcacaggatatacacccattctggag

SEQ ID NO: 2645 - DNA, 80 bp, Artificial
  Hairpin sequence HS_from_MQbrain_1761, human
ctatgttttccccaagtggggccagggtgtgggctggctgatggctctgtcttccatggtcctcatccccgggtacatgg

SEQ ID NO: 2646 - DNA, 75 bp, Artificial
  Hairpin sequence HS_from_MQbrain_1762, human
gttctctcccatccttgcccctggttcaggagccattctacctgcctcagtggccaggcgcaaggctacaggtgc

SEQ ID NO: 2647 - DNA, 66 bp, Artificial
  Hairpin sequence HS_from_MQbrain_1765, human
tgaggggggcatccggccctggcacctggtgaagccaagtgatgagccggagccgcccaggcctcg

SEQ ID NO: 2648 - DNA, 57 bp, Artificial
  Hairpin sequence HS_from_MQbrain_1767, human
aagctggtggtggtgggggatgggggtgtgggcaaaagtgccctcaccatccagttt

SEQ ID NO: 2649 - DNA, 105 bp, Artificial
  Hairpin sequence HS_from_MQbrain_1768, human
agtggggtgaccccgggctgctctggtgggagccatgagggtctgtgctgtctctgagcaccgtctcttctgttccccaggatcctgcaggcccaggtgcctcct

SEQ ID NO: 2650 - DNA, 113 bp, Artificial
  Hairpin sequence HS_from_MQbrain_1770, human
ggcctcactccctcccagacctgtctgagcttctggagcacgagtgtggccctggcttctgccttggcctcgctgcctcccagacctgcaggcgctgtctgggctttgtggcc

SEQ ID NO: 2651 - DNA, 105 bp, Artificial
  Hairpin sequence HS_from_MQbrain_1771, human
ctgctgctccaaggcctggccacatgcagacaggaggaagctgagctcgacattaggcctcaaggctgccatctgtcttgtagggcctggccttgtgggcagggg

SEQ ID NO: 2652 - DNA, 66 bp, Artificial
  Hairpin sequence HS_from_MQbrain_1772, human
gggtgggctccatgacgctggctgtgcctgagctcctgctgtggcagctggcacaggagcctgccc

SEQ ID NO: 2653 - DNA, 97 bp, Artificial
  Hairpin sequence HS_from_MQbrain_1773, human
agctggagccacgcttgctattagggcagggaggtgcctggtgaagtctgctgccacctctcactctccccttcttccccaggctgctgcttctgct

SEQ ID NO: 2654 - DNA, 91 bp, Artificial
  Hairpin sequence HS_from_MQbrain_1776, human
gttggtagtggctggtgtggctgtgtgccgagggtccgtggtccctgcgactctcaggacaccgctgcacgtgacagctctcgcccccggc

SEQ ID NO: 2655 - DNA, 74 bp, Artificial
  Hairpin sequence HS_from_MQbrain_1777, human
gtcctggggagattggaggggacggcagcgttctgcatgatggaggcgctgccgggccccgggtctgtgggggc

SEQ ID NO: 2656 - DNA, 113 bp, Artificial
  Hairpin sequence HS_from_MQbrain_1778, human
gccgcctccgcccctccgcagagcacaagtgcaatgcctcgtcacagttcctgtgcagcagtgggcgctgtgtggctgaggcactgctctgcaacggccaggatgactgtggc

SEQ ID NO: 2657 - DNA, 77 bp, Artificial
  Hairpin sequence HS_from_MQbrain_1779, human
ggaagagccttagacctgggcgggccttcaggggcatctagacccctgcacagcccaggcctggtgtctgcatttcc

SEQ ID NO: 2658 - DNA, 113 bp, Artificial
  Hairpin sequence HS_from_MQbrain_178, human
tcaggccttacttgtagggggctggtccctcttctgatgcctgtgccctgtcctcctgattctgttctctgtcttgccaggtgatctctctggccacctccttgcctacctga

SEQ ID NO: 2659 - DNA, 116 bp, Artificial
  Hairpin sequence HS_from_MQbrain_1780, human
tcacccactctgcactggggcgtttcctactgcgcctcgtgctggcggacgcagctgggtgcagaagctgtggggtcggagaggcgtttggagaaggtctgtggtgcagtgtgtga

SEQ ID NO: 2660 - DNA, 103 bp, Artificial
  Hairpin sequence HS_from_MQbrain_1781, human
ctggtgccccttgctgatctgagcgcttggccaagtacaaccagctcctcagaattgaagaggagctgggcagcaaggctaagtttgccggcaggaacttcag

SEQ ID NO: 2661 - DNA, 98 bp, Artificial
  Hairpin sequence HS_from_MQbrain_1782, human
tgtacgagcaactctctgggaactagtgggttagcttggggacctgaactgttctggaggccccaagccatgttccccagttcagtgttgcatgtata

SEQ ID NO: 2662 - DNA, 73 bp, Artificial
  Hairpin sequence HS_from_MQbrain_1783, human; PT_from_MQbrain_1783, chimp
gcatcatgctgtctggagaaacagtcaaaggggattatcctctggaggcagttcgcatgcagcacctgattgc

SEQ ID NO: 2663 - DNA, 83 bp, Artificial
  Hairpin sequence HS_from_MQbrain_1784, human
ctgcatgttagtctaacgttctgatagaaatgacatgcatttatgctgccatttgttactatcaggactcgactcgtgtgcgg

SEQ ID NO: 2664 - DNA, 116 bp, Artificial
  Hairpin sequence HS_from_MQbrain_1785, human
tggacccaacacaaatggttcccagtttttcatctgcactgccaagactgagtggttggatggcaagcatgtggtctttggcaaggtgaaagaaggcgtgaatattgtggaggcca

SEQ ID NO: 2665 - DNA, 111 bp, Artificial
  Hairpin sequence HS_from_MQbrain_179, human
ctcaggaagccccaggtgcactcagcgagagccctgcctttcagttgccaaaagctgcatcaggggaatgcggcaaggcacacagggctctggcagcccctggggactggg

SEQ ID NO: 2666 - DNA, 92 bp, Artificial
  Hairpin sequence HS_from_MQbrain_1790, human; PT_from_MQbrain_1790, chimp
cgggtccccccgcacccctcctcagaacggcgcgcagtgtacatcggggcactgtttcccatgagcgggggctggccagggggccaggcctg

SEQ ID NO: 2667 - DNA, 81 bp, Artificial
  Hairpin sequence HS_from_MQbrain_1791, human
ccttcatcggcagtagcacggccatccaggagctcttcaagcacatctcggagcagttcactgccatgttccgccggaagg

SEQ ID NO: 2668 - DNA, 85 bp, Artificial
  Hairpin sequence HS_from_MQbrain_1792, human
ccaggggcactgcctggaagattcaggagcctgggcggccttcgcttactctcacctgcttctgagttgcccaggagaccactgg

SEQ ID NO: 2669 - DNA, 108 bp, Artificial
  Hairpin sequence HS_from_MQbrain_1793, human
ggtgagccagcggttcgaacagctctgtctacagcagcaagaaaaggagagctccctaaagaagcttctaccccaggcagagatgtttgaacacctctctggtaagct

SEQ ID NO: 2670 - DNA, 74 bp, Artificial
  Hairpin sequence HS_from_MQbrain_1794, human; PT_from_MQbrain_1794, chimp
ggcaccctggtttgtttggagcattgctgcccagaagcttctatgggataggtggtgcttgggattgatgtgtt

SEQ ID NO: 2671 - DNA, 98 bp, Artificial
  Hairpin sequence HS_from_MQbrain_1795, human
tgtacgagcagctgtctgggaagtagggggttagcttggggacctgaactgtcctggaggccccaagccatgttccccagttcagtgttgcatgtata

SEQ ID NO: 2672 - DNA, 101 bp, Artificial
  Hairpin sequence HS_from_MQbrain_1798, human; HS_from_MQbrain_1802, human
tgtcaaagcaagagatggctagtgtttcatccagccaaagaggtgaagtggttctggaaactttggtggtggtcgtggaggtggtttcagtgggaatgaca

SEQ ID NO: 2673 - DNA, 114 bp, Artificial
  Hairpin sequence HS_from_MQbrain_1799, human
ctgtgaactaggattttctacagtgtgaccctgtgaactaggcttttctacagtgtgacttctgtgaactaggcttttctacagtgtgaccctgtgaactaggcttttctacag

SEQ ID NO: 2674 - DNA, 77 bp, Artificial
  Hairpin sequence HS_from_MQbrain_180, human
agggaggtcttgtctcccctcctgggctttcctcctgccctgtgggcagcagcctaggctgggtcaggggcttccct

SEQ ID NO: 2675 - DNA, 112 bp, Artificial
  Hairpin sequence HS_from_MQbrain_1801, human
tcagaaagcaagaccaggaagcaaatagcagctcaggaaatcccacggttgacttgccttgatggcaagcttggtggagagggctgaagctgttgctgggggccgattctga

SEQ ID NO: 2676 - DNA, 93 bp, Artificial
  Hairpin sequence HS_from_MQbrain_1803, human; PT_from_MQbrain_1803, chimp
gttcctgtgaacaatgcactgggaagggtggagatcaggtcccggcctggaatatattttctacccccctggagctttgattttgcactgagc

SEQ ID NO: 2677 - DNA, 71 bp, Artificial
  Hairpin sequence HS_from_MQbrain_1804, human; PT_from_MQbrain_1804, chimp
ctggcggccgtggtggagggagagggtgttccttgtggagactagcttaccgtcgctttcctggccgccag

SEQ ID NO: 2678 - DNA, 67 bp, Artificial
  Hairpin sequence HS_from_MQbrain_1805, human; MQbrain_1805, macaque; PT_from_MQbrain_1805, chimp
tccagtctcaatagtggcagtagcctgggcctcagcctaggcagcaactccactgtcacagcctcga

SEQ ID NO: 2679 - DNA, 66 bp, Artificial
  Hairpin sequence HS_from_MQbrain_1806, human; HS_from_MQbrain_1817, human; HS_from_MQbrain_1840, human
ctgcagaacaaggagcatgtgattgaggccctgcacagggccaagttcaagttctctggctgccag

SEQ ID NO: 2680 - DNA, 77 bp, Artificial
  Hairpin sequence HS_from_MQbrain_1807, human; PT_from_MQbrain_1807, chimp
cttgaggaacttcctccttttccagctttgggagtcaaggtgagactcctggggacctaggtaggaagtatctgaag

SEQ ID NO: 2681 - DNA, 101 bp, Artificial
  Hairpin sequence HS_from_MQbrain_1808, human
gggttctccatcctgctgtggattggggctatcctctgcttcctggcctacggcatccaggctgccatggaggatgaaccatccaacgacaatgtgagccc

SEQ ID NO: 2682 - DNA, 93 bp, Artificial
  Hairpin sequence HS_from_MQbrain_1809, human
tatctaacacttttgctctgcaggcagccttgcccattctctaagcctggcttagaaggcactgggaatgtcctgtagagagagacctagata

SEQ ID NO: 2683 - DNA, 69 bp, Artificial
  Hairpin sequence HS_from_MQbrain_181, human; MQbrain_181, macaque; PT_from_MQbrain_181, chimp
tcaggagttcaaatcttgcctgcgctccctgggctatgacctgcccatggtggaggaaggggaacctga

SEQ ID NO: 2684 - DNA, 72 bp, Artificial
  Hairpin sequence HS_from_MQbrain_1810, human; PT_from_MQbrain_1810, chimp
aggaggatggggccttggaggagacgcagggaagccctcggggcaacctgcccctgaggaaactgtcctctt

SEQ ID NO: 2685 - DNA, 85 bp, Artificial
  Hairpin sequence HS_from_MQbrain_1811, human
ctgtgccacttggaattgcaacccatgagttcagaaggcacactctgccatgctgagctccaagggtgctaccaggggaagatgg

SEQ ID NO: 2686 - DNA, 96 bp, Artificial
  Hairpin sequence HS_from_MQbrain_1814, human; MQbrain_1814, macaque; PT_from_MQbrain_1814, chimp
tctcctggggatcttaacggccttgttctctctccctggcacccacccccagggcgggtgatgccgccaagagagagggaggccgttgctaggtga

SEQ ID NO: 2687 - DNA, 102 bp, Artificial
  Hairpin sequence HS_from_MQbrain_1815, human; PT_from_MQbrain_1815, chimp
tgtatccggtgaccgagagctcctacagtgcctatgccatcatgcttctggcgctggtggtgtttgcggtgggcattgtgggcaacctgtcggtcatgtgca

SEQ ID NO: 2688 - DNA, 75 bp, Artificial
  Hairpin sequence HS_from_MQbrain_182, human
gtgaatgatgtctgcaccaatggacaagacctcattaagaaggtgagtccagcccattggtaagacctccatcgc

SEQ ID NO: 2689 - DNA, 75 bp, Artificial
  Hairpin sequence HS_from_MQbrain_1820, human
gcctgggcccacagctgcaccggcagcccaaggggaaggaccggttgggggagccgggcatgtgaggccctgggc

SEQ ID NO: 2690 - DNA, 85 bp, Artificial
  Hairpin sequence HS_from_MQbrain_1823, human
catggtttggtgccagccccttcacctccttccagagcccaagatcaatgctcaagttttggaggacatgatcaccatccccatg

SEQ ID NO: 2691 - DNA, 61 bp, Artificial
  Hairpin sequence HS_from_MQbrain_1824, human
aggcagtgggctggatagggctcctggggttggaggggcctttgacagtctttctctgctt

SEQ ID NO: 2692 - DNA, 115 bp, Artificial
  Hairpin sequence HS_from_MQbrain_1827, human
ctgcggcgggaggtggaggagctgagaagcagcctgcgagggcttgcgggggagattgttggggaggtccggtgagtaatgcggcttcttctcctgctttatccctcccctgcag

SEQ ID NO: 2693 - DNA, 119 bp, Artificial
  Hairpin sequence HS_from_MQbrain_183, human; MQbrain_183, macaque; PT_from_MQbrain_183, chimp
aaggaaaataaacagctgagtctgaaggtggatgaactggagaggttagaggcacttggtcccatctctgtcctcttcctaggacctgagactttcagccacttagctgttttttgctt

SEQ ID NO: 2694 - DNA, 93 bp, Artificial
  Hairpin sequence HS_from_MQbrain_1832, human; PT_from_MQbrain_1832, chimp
actgtgtgctgagggaaggaggcagtccaggaaggagtgtctccacatgccacttctgcctctgtcttcttcccttcatccccatcccactgt

SEQ ID NO: 2695 - DNA, 90 bp, Artificial
  Hairpin sequence HS_from_MQbrain_1833, human
gccgaggtaggaaaggccagccccagacatcctatcgccacaatgccatgtcgcaataggaagcaggggccggccatcgctaccttcagc

SEQ ID NO: 2696 - DNA, 117 bp, Artificial
  Hairpin sequence HS_from_MQbrain_1834, human
gagacccttggcttctccttctcctactccctgtctttctggcattttgtagcttgttagattttctgccagaggggtgggtcagagcagtggaggggagacatcgcccatgtgctt

SEQ ID NO: 2697 - DNA, 65 bp, Artificial
  Hairpin sequence HS_from_MQbrain_1836, human
ccacgtgtgcctgggtggcctgttcgtgcctgaggcgtacatcactgccaccaggcagtatgtgg

SEQ ID NO: 2698 - DNA, 63 bp, Artificial
  Hairpin sequence HS_from_MQbrain_1838, human
gcctggccgtggggcagaggggtttgcccttctcggagggtacctcctgttccctgtctgagc

SEQ ID NO: 2699 - DNA, 113 bp, Artificial
  Hairpin sequence HS_from_MQbrain_1839, human; PT_from_MQbrain_1839, chimp
gaccctgaccagccgcgagaggaccctgcagaggaggagaaggaggagaaggacgcacccgaggttcacctcctgttccatttcctgcaggtcctcaccgcctgtttcgggtc

SEQ ID NO: 2700 - DNA, 95 bp, Artificial
  Hairpin sequence HS_from_MQbrain_184, human
ccgcccccagagcccccagcagggccctccgaggtggagcagcagctacaagcggaggctgagcacctgcggaaggagctggagggtctggcagg

SEQ ID NO: 2701 - DNA, 81 bp, Artificial
  Hairpin sequence HS_from_MQbrain_1841, human; MQbrain_1841, macaque
agtttcccgaggtggctttagaggcaactctggaggagactacagagggcctagtggaggctacagaggatctgggggatt

SEQ ID NO: 2702 - DNA, 95 bp, Artificial
  Hairpin sequence HS_from_MQbrain_1843, human
gagccccatgtcatggccctgagccccgctttcccgccaggctcaagaccatcagcctggtgatccgcggcacgcagggggccgaggaggtgctc

SEQ ID NO: 2703 - DNA, 96 bp, Artificial
  Hairpin sequence HS_from_MQbrain_1844, human; MQbrain_1844, macaque; PT_from_MQbrain_1844, chimp
gtgagtcctcttggcgatgtctccctccaggttccaagccctgcgtctgacgatgctgcagcgcctggagcagctggtggaggccaagtaactggc

SEQ ID NO: 2704 - DNA, 77 bp, Artificial
  Hairpin sequence HS_from_MQbrain_1845, human; HS_from_MQbrain_1846, human; PT_from_MQbrain_1845, chimp; PT_from_MQbrain_1846, chimp
gcagccttgctctgtggcttttcccagcacaatcagtgctagtgctggggaagggacagtcaagagcagtcagttgc

SEQ ID NO: 2705 - DNA, 78 bp, Artificial
  Hairpin sequence HS_from_MQbrain_1848, human; PT_from_MQbrain_1848, chimp
tggatgctggggtgtgggggttggaagctgtctgtggcccacttgggcacccacgcttctgtccacttctggttgcca

SEQ ID NO: 2706 - DNA, 97 bp, Artificial
  Hairpin sequence HS_from_MQbrain_1849, human
ctctgcctaggacaggcagcccactgtggccctgggtgacaaaggaagcccacagaggcccagggtttgtcaactgtggctgccagtgtctgcagag

SEQ ID NO: 2707 - DNA, 79 bp, Artificial
  Hairpin sequence HS_from_MQbrain_1851, human
gcactatgcccactgcctcctcttcagactctttgcatttcagtgaagagcctggaagaaacccaggggcctcctatgc

SEQ ID NO: 2708 - DNA, 59 bp, Artificial
  Hairpin sequence HS_from_MQbrain_1855, human
ccctcctttttttccctatcactgaagctttttagtgcattagtggggaggagggtggg

SEQ ID NO: 2709 - DNA, 115 bp, Artificial
  Hairpin sequence HS_from_MQbrain_1856, human
ccactatcagtcgtgctgtgggcagtgccctattcagaaaggtgccagtcacttagattacatgtcactgtttcctttctgagtggagtagggcttaccaagtacaagtgtgtgg

SEQ ID NO: 2710 - DNA, 91 bp, Artificial
  Hairpin sequence HS_from_MQbrain_1857, human; HS_from_PT_297, human; PT_297, chimp; PT_from_MQbrain_1857, chimp
tgctgtgggaagtgccctacttggaaaggcatcagttgcttagattacatgtaactattccctttctgagtagagtaagtcttaccaagta

SEQ ID NO: 2711 - DNA, 115 bp, Artificial
  Hairpin sequence HS_from_MQbrain_1858, human
gggagcctgctggagcggctgtgcctcctggcacggcgcctcctctgcccactgtcctgtccactgggcacagagcggccggccagcgggtgcagctcctcatctgcagagcctc

SEQ ID NO: 2712 - DNA, 87 bp, Artificial
  Hairpin sequence HS_from_MQbrain_1859, human; HS_from_MQbrain_1860, human; HS_from_MQbrain_1891, human; PT_from_MQbrain_1859, chimp; PT_from_MQbrain_1860, chimp; PT_from_MQbrain_1891, chimp
ctcagaaccccagcaatcccttcctttcactaccttcttttttgggggtagttggaagggactgaaattgtggggggaaggtaggag

SEQ ID NO: 2713 - DNA, 80 bp, Artificial
  Hairpin sequence HS_from_MQbrain_186, human
tcctgatggtcacctacatcacttcctgctggctgttagaggaattccagtagcaggaagaagtagatcaggccccaggg

SEQ ID NO: 2714 - DNA, 92 bp, Artificial
  Hairpin sequence HS_from_MQbrain_1861, human
aggattggtggtttcagagagtgtacttcctgaggcctctgggtgtgtaccctctgtggcttccagattcattcgtcctgcagcctcaacct

SEQ ID NO: 2715 - DNA, 102 bp, Artificial
  Hairpin sequence HS_from_MQbrain_1862, human
ctagagatgacacattagctgttctctcttcttcttttctaacagcagtattgagcccaggcttctgtgggagagagtggagaagctggtgcccagacctgg

SEQ ID NO: 2716 - DNA, 118 bp, Artificial
  Hairpin sequence HS_from_MQbrain_1863, human
gggaaaacattgggtggcgttccctggagagagtaggatggtttcgggggaagacgttgggtggcattccctggagagagtagaatggtttcgggggaagacgttgggtggcgttccc

SEQ ID NO: 2717 - DNA, 110 bp, Artificial
  Hairpin sequence HS_from_MQbrain_1864, human; HS_from_MQbrain_39, human; HS_from_MQbrain_40, human
gacgttgggtggcgttccctgcagagagtaggatggttttgggggaagacgttgggtggcgttccctggagagagtaggatggttttgggggaagacgttgggtggtgtt

SEQ ID NO: 2718 - DNA, 108 bp, Artificial
  Hairpin sequence HS_from_MQbrain_1865, human; PT_from_MQbrain_1865, chimp
ctgtgctgtgtgccaatgtttcgtttgcctcagacaggtatctcttcgttatcagaagagttgcttcatttcatctgggagcagaaaacagcaggcagctgttaacag

SEQ ID NO: 2719 - DNA, 62 bp, Artificial
  Hairpin sequence HS_from_MQbrain_1867, human
aggacgtgagtagggctagggaggggctgcaggctgttcaggagccctttgtctcctgtctt

SEQ ID NO: 2720 - DNA, 83 bp, Artificial
  Hairpin sequence HS_from_MQbrain_1869, human
cggcttcaaaggagagggccctgaagtggatgtgaagctgcccaaagctgacgttgatgtctcaggacccaaaatggatgctg

SEQ ID NO: 2721 - DNA, 84 bp, Artificial
  Hairpin sequence HS_from_MQbrain_187, human
agagcttctcaagggggactacaactcccaaggtacatacaaagcaattgtggtgcacactgggagttgtagtccttgagctct

SEQ ID NO: 2722 - DNA, 109 bp, Artificial
  Hairpin sequence HS_from_MQbrain_1872, human; HS_from_MQbrain_227, human; HS_from_MQbrain_895, human
tgcgaggttgtggtgtctgggaaactccgaggacagagggctaaatccatgaagtttgtggatggcctgatgatccacagcggagaccctgttaactactacgttgaca

SEQ ID NO: 2723 - DNA, 95 bp, Artificial
  Hairpin sequence HS_from_MQbrain_1873, human
gcccctctccagtctccccctcgcgcttgtctctcgcagtctcctcctcccaaaccgcgagcgaaaagggcgagggggagaggagcctcggcggc

SEQ ID NO: 2724 - DNA, 62 bp, Artificial
  Hairpin sequence HS_from_MQbrain_1874, human; MQbrain_1874, macaque; PT_from_MQbrain_1874, chimp
gcccaccccacatgaagaactttgtgaccaaggtttcggttggggagtttgtgggggaaggt

SEQ ID NO: 2725 - DNA, 82 bp, Artificial
  Hairpin sequence HS_from_MQbrain_1875, human
gctcctgctctccctctccctcctccaggccacggatttcatgtccctgtgactggtggggcccatggaggagacaggaagc

SEQ ID NO: 2726 - DNA, 98 bp, Artificial
  Hairpin sequence HS_from_MQbrain_1876, human
cggcccaggcccgcagccagggctgctccgcccgctgcgccccaggtaagccgggccagcgtgggggagtagcggggcctgggctgcggagggggccg

SEQ ID NO: 2727 - DNA, 78 bp, Artificial
  Hairpin sequence HS_from_MQbrain_1877, human
tggaagctcttggccctgaggactttgcctggggcattggccctgccatggcgttccggagggccgagggcacgtcta

SEQ ID NO: 2728 - DNA, 74 bp, Artificial
  Hairpin sequence HS_from_MQbrain_1879, human
tttagattctctcgggcctagccgtccttggaacccgatattcgggctgggcggttccgcggcctgggcctagg

SEQ ID NO: 2729 - DNA, 78 bp, Artificial
  Hairpin sequence HS_from_MQbrain_188, human
gagcttctggtctgcagccctctggtagaaactttggttttgccttgggcctcctgtttctgtgcggccctcttgctt

SEQ ID NO: 2730 - DNA, 98 bp, Artificial
  Hairpin sequence HS_from_MQbrain_1880, human
tccctggctgcagtgccaggtgtggcctttcctgtgacagcaagtcacgtgctgtggctccagcttcataggaaggctcttgtctgtcaggcagtgga

SEQ ID NO: 2731 - DNA, 93 bp, Artificial
  Hairpin sequence HS_from_MQbrain_1883, human; PT_from_MQbrain_1883, chimp
aacttgaggctatgtagcctgaaaatgccctgcagtctgcagtgttctactgtgaactgcttgtgtgttggcaggctaccggtaagaatggtt

SEQ ID NO: 2732 - DNA, 67 bp, Artificial
  Hairpin sequence HS_from_MQbrain_1885, human; PT_from_MQbrain_1885, chimp
ctgtcatactgctgggttttcatgggtaggaaagcttgtcctgaccccagcagcaaagaggtggcag

SEQ ID NO: 2733 - DNA, 65 bp, Artificial
  Hairpin sequence HS_from_MQbrain_1888, human; PT_from_MQbrain_1888, chimp
ctgctcatgggtaaacccccagggcagcccaaaagagaagggagagctgtggggtctgtgaggag

SEQ ID NO: 2734 - DNA, 94 bp, Artificial
  Hairpin sequence HS_from_MQbrain_1889, human
attgcagagtcaggggtagagcggcaagtacttttgggagaccagatacccaaattcgccgttgccactttaccacccgcctgaatcctgggat

SEQ ID NO: 2735 - DNA, 112 bp, Artificial
  Hairpin sequence HS_from_MQbrain_189, human; MQbrain_189, macaque; PT_from_MQbrain_189, chimp
gtctcttcagactcagtatctactcttaatagtgaagattttgtcttggtttccaggcaaggagatgagacaccatctacaaataatggaagtgatgatgagaaaacaggac

SEQ ID NO: 2736 - DNA, 81 bp, Artificial
  Hairpin sequence HS_from_MQbrain_1890, human
ccaagacaccagttacagatccagccacaggagccgtgaaggagaagatcacagcttttgtggtggagaggggcttcgggg

SEQ ID NO: 2737 - DNA, 68 bp, Artificial
  Hairpin sequence HS_from_MQbrain_1894, human
cacagcccttggcccagccatctgcacccacttttgcttgtagtcatggccagggccaaatagctatg

SEQ ID NO: 2738 - DNA, 82 bp, Artificial
  Hairpin sequence HS_from_MQbrain_1895, human; PT_from_MQbrain_1895, chimp
tttctgaagctccttctgaaagagcagttggtgtttattttttactaaatagcaattgctcttttggaaggaacttgagaag

SEQ ID NO: 2739 - DNA, 73 bp, Artificial
  Hairpin sequence HS_from_MQbrain_1896, human
cacacgtcaccatgagctacccaggggtgaagatggcattcccacccctgggtagctgttccggggttgtctg

SEQ ID NO: 2740 - DNA, 119 bp, Artificial
  Hairpin sequence HS_from_MQbrain_1897, human
tgttgaccggcaggccccatctgtgctcacagctcctccccttgtttggccaccctttcctcagggcatctgcagcaagtggggggcacagcacgggaaacggggccaaggccacagca

SEQ ID NO: 2741 - DNA, 100 bp, Artificial
  Hairpin sequence HS_from_MQbrain_1901, human; PT_from_MQbrain_1901, chimp
gctctcctgcctgcttctgtgtgatatgtttgatattgggttgtttaattaggaaccaactaaatgtcaaacatattcttacagcagcaggtgattcagc

SEQ ID NO: 2742 - DNA, 84 bp, Artificial
  Hairpin sequence HS_from_MQbrain_191, human
ccaggtcccatctgatgccgaggctgaaggagtctcgctcccacgagtccctgctcagccccagcagtgcggtggaggcgctgg

SEQ ID NO: 2743 - DNA, 103 bp, Artificial
  Hairpin sequence HS_from_MQbrain_192, human
ggtaagtgtgttagtggtgggagagtgatggagacctgggatgggccccacgtctgcccatccttcagctctaattcttctcccaccctccccatttttttcc

SEQ ID NO: 2744 - DNA, 114 bp, Artificial
  Hairpin sequence HS_from_MQbrain_193, human; PT_from_MQbrain_193, chimp
ccaacgaggtggtggtgcagagactcttccaggtcaaagggcggcgtgtggtccgtgccaccgaggtacctgtgtcctgggagagcttcaacaatggcgactgcttcatcctgg

SEQ ID NO: 2745 - DNA, 114 bp, Artificial
  Hairpin sequence HS_from_MQbrain_194, human
ttttagcatccttgagtcccagggcctgaagggttcttggacatgggccgattttcctgtcacctatgtcccctcaacctcatcaccactgggcagctcattatctctctggaa

SEQ ID NO: 2746 - DNA, 99 bp, Artificial
  Hairpin sequence HS_from_MQbrain_1946, human
gcttgcctccccccgtttttggcaatggtagaactcacactggtgaggtaacaggatccggtggttctagacttgccaactatggggcgaggactcagc

SEQ ID NO: 2747 - DNA, 98 bp, Artificial
  Hairpin sequence HS_from_MQbrain_195, human; PT_from_MQbrain_195, chimp
tgtccatatgttttccaattagatcagacgggattgctgttatactggtaatataacagctgttctatatgataccttgccagggagacagctaagca

SEQ ID NO: 2748 - DNA, 91 bp, Artificial
  Hairpin sequence HS_from_MQbrain_1958, human; HS_from_MQbrain_1985, human
gggtgcggggactgagtctgggatgggtacccttctcattagtaagatccgggaggagtatccagacaggatcataaaccattcagcatcc

SEQ ID NO: 2749 - DNA, 63 bp, Artificial
  Hairpin sequence HS_from_MQbrain_198, human; HS_from_MQbrain_387, human
gctctcgggcgaggttcactggtcctaacaaggagggccagggaagtcgcgcccgactggggc

SEQ ID NO: 2750 - DNA, 114 bp, Artificial
  Hairpin sequence HS_from_MQbrain_20, human
caataccaggttttcttccctgtgcaaatggccattacaattcctataatatttacactgatgatataaagctacgaaggccaaatgctgggaaaggtgaaaacatgtttattg

SEQ ID NO: 2751 - DNA, 98 bp, Artificial
  Hairpin sequence HS_from_MQbrain_203, human
cctagaagaaccttcttagacaatggggggaggatgggactttgttttttccaagaataaacttcaactcctgtcatgtgtcttggctactttcttgg

SEQ ID NO: 2752 - DNA, 107 bp, Artificial
  Hairpin sequence HS_from_MQbrain_2050, human
agtcctgtagccagtcagaaatgagcttattcataaaagtgcagtatggtgaagtcaatctgtaattttatgtataagctagtctctgattgaaacatgcagcagct

SEQ ID NO: 2753 - DNA, 95 bp, Artificial
  Hairpin sequence HS_from_MQbrain_207, human; PT_from_MQbrain_207, chimp
cctgaaccgccgcattcagctggttgaggaggagctggaccgggcccaggagcgcctggctacagccctgcagaagctggaggaggccgagaagg

SEQ ID NO: 2754 - DNA, 93 bp, Artificial
  Hairpin sequence HS_from_MQbrain_2087, human
gacgtgcggtacttaatgagaagttgcccgtgtttttttcgctttatttgtgacgaaacattcgcggtgcacttctttttcagtatcctattc

SEQ ID NO: 2755 - DNA, 68 bp, Artificial
  Hairpin sequence HS_from_MQbrain_209, human; MQbrain_209, macaque
gctgctgcttgtgctggccgcggtggtggcctggtgctactacagcgtctccctacgcaaggcggagc

SEQ ID NO: 2756 - DNA, 67 bp, Artificial
  Hairpin sequence HS_from_MQbrain_21, human
tgctctcctctctgcaccccaagcaacagagtctgactttgttgcttggggtgcacagtggaaagca

SEQ ID NO: 2757 - DNA, 100 bp, Artificial
  Hairpin sequence HS_from_MQbrain_210, human
tgggccaactgtttccacctcctgacatcctttccccactctcttagtcattctgggactctgggttgggatcaggggtgggaatagaaaagatggagca

SEQ ID NO: 2758 - DNA, 118 bp, Artificial
  Hairpin sequence HS_from_MQbrain_211, human
gagcgggccagggcgtgcgcgaggtcgggggtagctgggaacggaggaggaggggcccgctcgaggctccgcctctcaccggctgcggcctcggctacagccagggcccagagggctc

SEQ ID NO: 2759 - DNA, 69 bp, Artificial
  Hairpin sequence HS_from_MQbrain_215, human; PT_from_MQbrain_215, chimp
cactctgcgcggcgcagacatggcctcttcctatctttgaggcggtgtctgcggcagcgcctcagagtg

SEQ ID NO: 2760 - DNA, 69 bp, Artificial
  Hairpin sequence HS_from_MQbrain_216, human; MQbrain_216, macaque; PT_from_MQbrain_216, chimp
cctggagtggctgcgaaggggaaacacgcctccgaaaagaggcacaagtgcccctacagtggctgtggg

SEQ ID NO: 2761 - DNA, 88 bp, Artificial
  Hairpin sequence HS_from_MQbrain_218, human
gagttgttgttgcagagagaggggaagaaagggagcaggaagaacaaagttgccccttcctgtctttttctaagtcaactgcagtctc

SEQ ID NO: 2762 - DNA, 90 bp, Artificial
  Hairpin sequence HS_from_MQbrain_219, human; PT_from_MQbrain_219, chimp
gccaaactggaatgtggaggaggcccgtgggggaataaaggctactttgtccagcccacagtgttctctaatgttacagatgagatgcgc

SEQ ID NO: 2763 - DNA, 84 bp, Artificial
  Hairpin sequence HS_from_MQbrain_22, human
cctcggatgggcttgtaaaccagctcctggcctagcctcatcaaacgtgaggatgaggaagagagagcctggtgggccctgggg

SEQ ID NO: 2764 - DNA, 80 bp, Artificial
  Hairpin sequence HS_from_MQbrain_221, human; PT_from_MQbrain_221, chimp
ggtgtctgaggggcagctggatggccaaactgagggaactggcgccatcagtggctaccctgccactcaatccatgaccc

SEQ ID NO: 2765 - DNA, 71 bp, Artificial
  Hairpin sequence HS_from_MQbrain_224, human
gcatgccaacgggaggctgtgcccagaccaagcactggaagtgtgcttctaggcatagtcattggttttgc

SEQ ID NO: 2766 - DNA, 70 bp, Artificial
  Hairpin sequence HS_from_MQbrain_228, human
ctttcctgatgcgccgtctcttcgccgccctccgtgggggcgcggcgaacgggttgcgtgctctggagag

SEQ ID NO: 2767 - DNA, 101 bp, Artificial
  Hairpin sequence HS_from_MQbrain_229, human
ctccatattttgtaatcacatccacgaagctctgaagccatggtggtcctggcaccagctggctccgttagaggcttggggtgggagtgagcaggtgggag

SEQ ID NO: 2768 - DNA, 75 bp, Artificial
  Hairpin sequence HS_from_MQbrain_234, human
gaggcaaatggaggcgcctggtgccccgcccaggaccctgacgtgggaagccatggagcagatacggtgagactc

SEQ ID NO: 2769 - DNA, 66 bp, Artificial
  Hairpin sequence HS_from_MQbrain_235, human; PT_from_MQbrain_235, chimp
agggctgcctcactctgtggtgtcaggcactgggctgtgtcctgattcctcagagtatggggacct

SEQ ID NO: 2770 - DNA, 77 bp, Artificial
  Hairpin sequence HS_from_MQbrain_236, human; HS_from_MQbrain_237, human; PT_from_MQbrain_236, chimp; PT_from_MQbrain_237, chimp
cctgggaggcaaagccactgcagagtgtgcttgacattacctcccttgttggggacatcctgtgggcatgcatttgg

SEQ ID NO: 2771 - DNA, 78 bp, Artificial
  Hairpin sequence HS_from_MQbrain_238, human
gcggcggcggctgaggagggcccggcctgcgagagcctcagtgggagccggctcagccctcggccaccatgtcggcgc

SEQ ID NO: 2772 - DNA, 99 bp, Artificial
  Hairpin sequence HS_from_MQbrain_2380, human
agctccaccccactgtttcttggtcagcctcagtgatggcctgaccccagctgtgaggccttgtgagctaaggctgaagagaccttgcctgtgggagct

SEQ ID NO: 2773 - DNA, 88 bp, Artificial
  Hairpin sequence HS_from_MQbrain_239, human
ggtgtgagctgcagattcgtggcctgtctgtggcagatgccggggagtactcgtgcgtgtgtgggcaggagaggacctcagccacact

SEQ ID NO: 2774 - DNA, 79 bp, Artificial
  Hairpin sequence HS_from_MQbrain_24, human; HS_from_MQbrain_25, human
cttcagtggaacctttgtgaagctcaacaagccttcagttaacatactgaggcttgtagagccacatattgcatcaggg

SEQ ID NO: 2775 - DNA, 97 bp, Artificial
  Hairpin sequence HS_from_MQbrain_240, human
ggggccgtgatggagcagggcacgtcctcgtcaatgacaggtaacagcttcctgctgaaccctgcgttcacaaggtgctgcctggcttccttgcccc

SEQ ID NO: 2776 - DNA, 96 bp, Artificial
  Hairpin sequence HS_from_MQbrain_241, human
gcagaggtggatcacccccaggcctcactggctcaggcggatgttctccgcttctcctttgtagctctgaggcctgggtctgtccttggtccttgc

SEQ ID NO: 2777 - DNA, 98 bp, Artificial
  Hairpin sequence HS_from_MQbrain_244, human
agcccggggcaggctaggagctggtgctgcacccatctcctgcatgcacccttgggggatggcacactgcagcattgcctccttctgttcccaggact

SEQ ID NO: 2778 - DNA, 109 bp, Artificial
  Hairpin sequence HS_from_MQbrain_2441, human
agccttccttcctgggtatggaatcttgcggcatccacgagaccacgttcaactccatcatgaagtgtgacgtagacatccgcaaagacctgtacaccaacatagggct

SEQ ID NO: 2779 - DNA, 99 bp, Artificial
  Hairpin sequence HS_from_MQbrain_249, human
ggcagcttttgggaactaggcagaagagagtcctgtatgggaggccggagtcaaggcagaagcccagtgcagccctctctaggccagcaggggagggtc

SEQ ID NO: 2780 - DNA, 97 bp, Artificial
  Hairpin sequence HS_from_MQbrain_251, human
tggcatccagaggccgccgctgcatttcccacagggaggacacctgctgtcctttctgtcctgtctggagaatgggctgctgcctcggggacagcta

SEQ ID NO: 2781 - DNA, 70 bp, Artificial
  Hairpin sequence HS_from_MQbrain_253, human
gaccacgaaggctggggagccagatggctatggacctcacgagggcctgccagttcccaggaagggggtc

SEQ ID NO: 2782 - DNA, 68 bp, Artificial
  Hairpin sequence HS_from_MQbrain_255, human
gccctttttggagaaaggccatgtgaaaagggatttcacattgaggtctgcttcctgtttaagggggt

SEQ ID NO: 2783 - DNA, 71 bp, Artificial
  Hairpin sequence HS_from_MQbrain_256, human; PT_from_MQbrain_256, chimp
ccatgcactcctagggtgaatgggctcagcaccaaacctggctgtgcccattccccacaaccccagcttgg

SEQ ID NO: 2784 - DNA, 83 bp, Artificial
  Hairpin sequence HS_from_MQbrain_257, human
gagggacgaaggtttcgggaagagaggtggacaggaaggggtcctcatcagcggtcccaccctcctctccttccttcgccctc

SEQ ID NO: 2785 - DNA, 105 bp, Artificial
  Hairpin sequence HS_from_MQbrain_258, human
gagcctggtcaagtgagaggtggctggtggagttggttttgggtggtggagtcacagaggctcgtcctaggtctaagatgatgccagcacctttgggtggagctt

SEQ ID NO: 2786 - DNA, 87 bp, Artificial
  Hairpin sequence HS_from_MQbrain_26, human
tgtatatgtggttgagttagggttggccagcccaccctcaggggtggtgagaaaagcaaggctgatgacaggctcagaagcatgaca

SEQ ID NO: 2787 - DNA, 64 bp, Artificial
  Hairpin sequence HS_from_MQbrain_260, human
tgccttgcctggcccaagccacattgagggagtgaaagagctgtgggcggtaggccaggctgcg

SEQ ID NO: 2788 - DNA, 82 bp, Artificial
  Hairpin sequence HS_from_MQbrain_261, human
cggcctccgagtccccgaaggtcccaccatccccgcaggaactccctggatggagggggccgatcccggggagcgggttctg

SEQ ID NO: 2789 - DNA, 69 bp, Artificial
  Hairpin sequence HS_from_MQbrain_262, human
ggatgacgcctccggaggccctggcctcactcccacctgggcgctaggagccatcccggggctccagcc

SEQ ID NO: 2790 - DNA, 76 bp, Artificial
  Hairpin sequence HS_from_MQbrain_2630, human
gcttggtggcttcaggagtgtggccctccccaggactccacttcatcctgggcttgcaccctccttgagccaatgc

SEQ ID NO: 2791 - DNA, 64 bp, Artificial
  Hairpin sequence HS_from_MQbrain_2633, human
gtgggggcgggagctggggtctgcaggttcgcactgatgcctgctcgccctgtctcccgctagc

SEQ ID NO: 2792 - DNA, 89 bp, Artificial
  Hairpin sequence HS_from_MQbrain_264, human
ccttccattctccagtccactttccatcttccccttcctccatctcctcttctggggacacaggatggggaggactggagagcaccagg

SEQ ID NO: 2793 - DNA, 115 bp, Artificial
  Hairpin sequence HS_from_MQbrain_265, human
gtgtcagaccagccttctcctcagctgaccaccctcctctgacccacgccccctccttgtctgaaagaaaggagccttgaatggtggagggaggcagtggggagaaaggtctcac

SEQ ID NO: 2794 - DNA, 79 bp, Artificial
  Hairpin sequence HS_from_MQbrain_266, human
ctcctctcttggggggctggttagattggagggcgtgggatctaaacagcaccagctgtccccaagaaaatttaagggg

SEQ ID NO: 2795 - DNA, 90 bp, Artificial
  Hairpin sequence HS_from_MQbrain_2669, human
gtggatcggcggctccatcctggcctcgctgtccaccttccagcagatgtggatcagcaagcaggagtatgacgagtccggcccctccat

SEQ ID NO: 2796 - DNA, 92 bp, Artificial
  Hairpin sequence HS_from_MQbrain_267, human
tctgtatgtttgcccctcatgagcctgcccagcgtgtcagggtcacccggaggagaggctgggcggccacaagggaagtaagcttagacaga

SEQ ID NO: 2797 - DNA, 114 bp, Artificial
  Hairpin sequence HS_from_MQbrain_2670, human
ctttgctccagtcaacgttacaactgaagtctattgaaatgcaccatggagctttgagtgaagctcttcttggagacattatgggcttcaatgttatgaatgtgtctgtcaaag

SEQ ID NO: 2798 - DNA, 66 bp, Artificial
  Hairpin sequence HS_from_MQbrain_2679, human
tctcttaggctttctcttcccagatttcccaaagttgggaaaagctgggttgagagggcaaaagga

SEQ ID NO: 2799 - DNA, 99 bp, Artificial
  Hairpin sequence HS_from_MQbrain_268, human
gcccccttggagttgggtagtatggtggaatggggtttcataaaacctccaacctgcacccctcccttctccatctcgcttgctgcccaacaccatggc

SEQ ID NO: 2800 - DNA, 85 bp, Artificial
  Hairpin sequence HS_from_MQbrain_2689, human; HSbrain_203, human; PT_from_HSbrain_203, chimp; PT_from_MQbrain_2689, chimp
aagctgtaccagagtgcaggaggcatgccaggaggaatgcctgggggattccctggtggtggagctcctcgctttggtggtgctt

SEQ ID NO: 2801 - DNA, 119 bp, Artificial
  Hairpin sequence HS_from_MQbrain_2699, human
agagtctacaaatgttgtctccttaatccttgcaacttacctgagtcattgattcagtaaaacattcaatggcacatgtttgttgttagggtcaaaagagataatccatctaaaggcct

SEQ ID NO: 2802 - DNA, 88 bp, Artificial
  Hairpin sequence HS_from_MQbrain_270, human; MQbrain_270, macaque; PT_from_MQbrain_270, chimp
ccggctggcggccggctggggcacgggggatcctgcagatggaagacggagccccgcgggacccggtgcccccgtccccgcctgccgg

SEQ ID NO: 2803 - DNA, 114 bp, Artificial
  Hairpin sequence HS_from_MQbrain_2700, human
aggtactgtgctttgtgtgttggaggatgaaagtacggagtgatccatcggctaagtgtcttgtcacaatgctgacactcaaactgctgacagcacacgtttttcacagtactt

SEQ ID NO: 2804 - DNA, 117 bp, Artificial
  Hairpin sequence HS_from_MQbrain_271, human
aggcacgtttcccgggaagatctgaactggctgcatctccctttcctctgtcctccatccttctcccaggatggtgaagggggacctggtacccagtgatccccaccccaggatcct

SEQ ID NO: 2805 - DNA, 77 bp, Artificial
  Hairpin sequence HS_from_MQbrain_272, human
tgactcagggtgagggctctgggcttgggggatgggagctaggtccatccctcggcagccaggaggccctgggctca

SEQ ID NO: 2806 - DNA, 74 bp, Artificial
  Hairpin sequence HS_from_MQbrain_273, human
ggtgggcactggacaggcatagcagactctcttgtggccacactaggttgtcgcctttcaggcagtgtcccgcc

SEQ ID NO: 2807 - DNA, 81 bp, Artificial
  Hairpin sequence HS_from_MQbrain_278, human
gggaactcgagccagggaagtggggggcactcagccagggcttgtggactggtctgactggcactcttctgccctggtccc

SEQ ID NO: 2808 - DNA, 105 bp, Artificial
  Hairpin sequence HS_from_MQbrain_279, human
ggccatcacagggctggagagtcaccggtcgggcggcacccggcctgggacgcgtagaggcgcacgtgtcccggcccggagccgccaagggaccccggcccggcc

SEQ ID NO: 2809 - DNA, 91 bp, Artificial
  Hairpin sequence HS_from_MQbrain_28, human
ggcctgcgtgccctgaccctccccacagcccctctgagaggctaggtctgagcctcaggagtgtgtgggattggagctgggccgctgggct

SEQ ID NO: 2810 - DNA, 61 bp, Artificial
  Hairpin sequence HS_from_MQbrain_280, human
ccacgcccactagcctgccatgtccacagttccttgggctgctgaggggctagtgcagtgg

SEQ ID NO: 2811 - DNA, 79 bp, Artificial
  Hairpin sequence HS_from_MQbrain_281, human; PT_from_MQbrain_281, chimp
gttcaagtgggaggacaggaggcaggtgtggttggaggaagcagcctgaacctgcctccctgacattccacaggtgaac

SEQ ID NO: 2812 - DNA, 74 bp, Artificial
  Hairpin sequence HS_from_MQbrain_282, human; MQbrain_282, macaque; PT_from_MQbrain_282, chimp
ccaagtgaaggcgaagccagtggcagaaccgacacctcaaggtgaggagccactattaatacttcgctgctagg

SEQ ID NO: 2813 - DNA, 110 bp, Artificial
  Hairpin sequence HS_from_MQbrain_283, human
ttctttgctgtgagctggaaagtgtgcagttggtcgtctttcttctcctttctttaggatagtaagagactcactcactgcacttctgctcagttggcttctgcatcggg

SEQ ID NO: 2814 - DNA, 69 bp, Artificial
  Hairpin sequence HS_from_MQbrain_284, human
gcctgatcccggggactgaactctggacggtctcagggactgactagggatgcggccgcgggagggggc

SEQ ID NO: 2815 - DNA, 86 bp, Artificial
  Hairpin sequence HS_from_MQbrain_285, human; PT_from_MQbrain_285, chimp
gctcaaaaagatgcccaacgtcttccagaatctggtctcttgcaaaagggtcttccgggaattgaagatgttgtgtttttttaagc

SEQ ID NO: 2816 - DNA, 64 bp, Artificial
  Hairpin sequence HS_from_MQbrain_287, human
gccattgctctgcctgagccatgccaggcatgtgtgactggccctggctggggtcagcaagggc

SEQ ID NO: 2817 - DNA, 73 bp, Artificial
  Hairpin sequence HS_from_MQbrain_288, human
ttgggtctaggggtgggaactgggcactgcagtcagctctgaccctggccagttcccccatccctacccccag

SEQ ID NO: 2818 - DNA, 59 bp, Artificial
  Hairpin sequence HS_from_MQbrain_29, human
gggcagggacgggtggccccaggaagaagggcctggtggagccgctcttctccctgccc

SEQ ID NO: 2819 - DNA, 78 bp, Artificial
  Hairpin sequence HS_from_MQbrain_291, human
ctccaccctgggcggaaatggccttggcatggggaccaagtgccgtgctgatgccttatttgtacccctaggacagag

SEQ ID NO: 2820 - DNA, 62 bp, Artificial
  Hairpin sequence HS_from_MQbrain_293, human
cctggggctgtgtcccaggatgatgtctgcattgtctggggtgagtcactggctttttcagg

SEQ ID NO: 2821 - DNA, 113 bp, Artificial
  Hairpin sequence HS_from_MQbrain_295, human; PT_from_MQbrain_295, chimp
agactatttgaacgagggggccatggccgacacagctgacctggtggtccttggagccttctatgggcaagggagcaaaggtcagggtggcctctgccccctggggtggtact

SEQ ID NO: 2822 - DNA, 108 bp, Artificial
  Hairpin sequence HS_from_MQbrain_296, human
ttacttttctcttcccacaggccaatggccatgtgtctcaggatcaagaggaacccgtctacctggagagcgtggccagagtacctgctgaggatgagacccaggtgg

SEQ ID NO: 2823 - DNA, 113 bp, Artificial
  Hairpin sequence HS_from_MQbrain_297, human
ctggccgagcggagggcggggccgtactgcggggctggggcggggagcgggcgggaaatggaactgtgacggtcccggcctgaggcccctgcagccacgcacctcccggtgag

SEQ ID NO: 2824 - DNA, 113 bp, Artificial
  Hairpin sequence HS_from_MQbrain_298, human; PT_from_MQbrain_298, chimp
tgttgttcaaagttatattactggccagaatggaaattataggaactagctatgtatgaaattgcatgttttccatccattgtggccaggtttggtattcccttaagatggca

SEQ ID NO: 2825 - DNA, 106 bp, Artificial
  Hairpin sequence HS_from_MQbrain_3, human; MM_from_MQbrain_3, mouse; MQbrain_3, macaque; PT_from_MQbrain_3, chimp
gttttattttcaaaaccaggtccaatgagctttctgaacagctggtgtagctacagagaaaccagcttccttcagagagcagtgcttttggcggggaggaggaaat

SEQ ID NO: 2826 - DNA, 65 bp, Artificial
  Hairpin sequence HS_from_MQbrain_300, human
ggctgaggctgtgtcaacaaccaaattccagtaagaggcagatttggttgtggatgtggtcagcc

SEQ ID NO: 2827 - DNA, 65 bp, Artificial
  Hairpin sequence HS_from_MQbrain_301, human
cccaccacagctctgcccctcagcttcctgcctgcgagaggccatggggtgggatgcagggtggg

SEQ ID NO: 2828 - DNA, 90 bp, Artificial
  Hairpin sequence HS_from_MQbrain_303, human; PT_from_MQbrain_303, chimp
ctctctctgcagggagtcagtggaggggtccggcaggtcagggggctccccgttcctgcctttttcctggttcacggacagcggcaaggg

SEQ ID NO: 2829 - DNA, 92 bp, Artificial
  Hairpin sequence HS_from_MQbrain_304, human; MQbrain_304, macaque; PT_from_MQbrain_304, chimp
gcaaagcatttgtagaaataattaatagtactcatgcatcagtttatgaggctggtccttgctgggtgctatatttagatccaactctttgt

SEQ ID NO: 2830 - DNA, 77 bp, Artificial
  Hairpin sequence HS_from_MQbrain_308, human
aggaaataagaaggatgggagtaaaaagaggacaagccccgatgtcctgtttatcagctccccctctctcctctcct

SEQ ID NO: 2831 - DNA, 88 bp, Artificial
  Hairpin sequence HS_from_MQbrain_309, human
tcttgagttataacctccgcagccccaccctgctgctgaaggcctttgccttttgcctgctgtagctgtggttgtgcctaaccccaga

SEQ ID NO: 2832 - DNA, 106 bp, Artificial
  Hairpin sequence HS_from_MQbrain_31, human
tccaaggcctcgctgcgggagctggccctgggcagcaacaagctgggtgatgtgggcatggcggagctgtgcccagggctgctccaccccagctccaggctcagga

SEQ ID NO: 2833 - DNA, 98 bp, Artificial
  Hairpin sequence HS_from_MQbrain_311, human
gcagcatcaggggaggccagaccaggagtggggcaaagaggaaagggagggtctctcctctcagcctcaacctgaatctgtcaggccctgtgggctgc

SEQ ID NO: 2834 - DNA, 75 bp, Artificial
  Hairpin sequence HS_from_MQbrain_313, human
tctgtgtctcttcttccatgagtctgtctgtccttaggggctgggggatacagggggagtgtggaggtgcacaga

SEQ ID NO: 2835 - DNA, 114 bp, Artificial
  Hairpin sequence HS_from_MQbrain_314, human
aggccgccacttgctggtgtccttggctgtggacgtgtgtgggagtgcagattgtgttttctcccatgtcccacgcaaccacagcctcgaggtgacgagtgtacctggcgtcct

SEQ ID NO: 2836 - DNA, 78 bp, Artificial
  Hairpin sequence HS_from_MQbrain_315, human; PT_from_MQbrain_315, chimp
gtggcctctgggcatgggctggcctggcaagtgcctctactttccttggccagggagggcctagcctgagaatgccac

SEQ ID NO: 2837 - DNA, 99 bp, Artificial
  Hairpin sequence HS_from_MQbrain_316, human; PT_from_MQbrain_316, chimp
gaagccatgagggaattctctgagtacatgcattttcacacatctgctaatgcaaaagccccgtgtgagcattagtactcaggaatgtgatgtggattc

SEQ ID NO: 2838 - DNA, 72 bp, Artificial
  Hairpin sequence HS_from_MQbrain_318, human; MQbrain_318, macaque
ttcctggggcctgatggggctggggtagaggtggtgattgagtctcgggccaacgccaagggggttcgggag

SEQ ID NO: 2839 - DNA, 76 bp, Artificial
  Hairpin sequence HS_from_MQbrain_319, human
cttaggtttcctccagctttcttgctgtcttggcattgctgggcccagagaggaggggagatgtttggaacttgag

SEQ ID NO: 2840 - DNA, 66 bp, Artificial
  Hairpin sequence HS_from_MQbrain_322, human; PT_from_MQbrain_322, chimp
ttcataactgggtgataactggggaccctgcccatgaggcagggtgaccccaggtccggaggtgga

SEQ ID NO: 2841 - DNA, 113 bp, Artificial
  Hairpin sequence HS_from_MQbrain_324, human; MQbrain_324, macaque
atcatttttttcatgatggagtagatttcaatcctgatttattgaacagccagagccaaagtggttttggagaagaatattttgatgaaagcagccaaagtggggataatgat

SEQ ID NO: 2842 - DNA, 74 bp, Artificial
  Hairpin sequence HS_from_MQbrain_325, human; PT_from_MQbrain_325, chimp
tggctgggtgactaaagggcttgtcttggtggggtctcccacccctccaagacccattctgcacagtccctcca

SEQ ID NO: 2843 - DNA, 89 bp, Artificial
  Hairpin sequence HS_from_MQbrain_327, human; PT_from_MQbrain_327, chimp
gctgaagaattaagttttccccaagcaaggaaggcaggtggtcagagagatcaaacgctgaggcgtggggattgcaggattcaggaggc

SEQ ID NO: 2844 - DNA, 92 bp, Artificial
  Hairpin sequence HS_from_MQbrain_329, human
gactttttgctccccttcctggaagaggtgagtgagtcaggccaacttaaagggtgcaggcctggcctcagatccccaggaacagcattgtt

SEQ ID NO: 2845 - DNA, 102 bp, Artificial
  Hairpin sequence HS_from_MQbrain_33, human
ggaggcgattgcctatggccggaagctgggcgggtgagtgcctggactcgggagggtcccagctaggccctcgtgctagtctagttggccttgcttccctcc

SEQ ID NO: 2846 - DNA, 99 bp, Artificial
  Hairpin sequence HS_from_MQbrain_330, human
cccaccgcccgccccccttggggcgcagggcatggtgtgaaaggccaagtgctgaggcgggtatcatgggtgctgtgccctagggcctgggtggcaggg

SEQ ID NO: 2847 - DNA, 80 bp, Artificial
  Hairpin sequence HS_from_MQbrain_331, human; PT_from_MQbrain_331, chimp
ggggccccaggggaggggtggtcggtgctcctttttctttaaagctcttttggccagctgcccctctgccccgggacccc

SEQ ID NO: 2848 - DNA, 65 bp, Artificial
  Hairpin sequence HS_from_MQbrain_332, human
ctgctctctcctcctttttcccccgcctccattttgttcgcggacgctggggacggtgggagcag

SEQ ID NO: 2849 - DNA, 110 bp, Artificial
  Hairpin sequence HS_from_MQbrain_333, human
tctttgacctttgccacttacctctccttattgatcctcatacctaagcctctctgacttagagtaaagtggacttttgagtgggggtaagtttgaccaattgttggaga

SEQ ID NO: 2850 - DNA, 88 bp, Artificial
  Hairpin sequence HS_from_MQbrain_334, human
gaaagttgctagcagaagcagtacaaagctcagaaaggtctaagatcctatgttttctgagcttagctactgtatctagagtttgttc

SEQ ID NO: 2851 - DNA, 112 bp, Artificial
  Hairpin sequence HS_from_MQbrain_336, human
ggagtggtctttggtttgggcggtggggcagaccttgggaaggggcttaggaagggagaggcagctcttccttcagctggctctcatcaggctgcagccccctccccgctcc

SEQ ID NO: 2852 - DNA, 103 bp, Artificial
  Hairpin sequence HS_from_MQbrain_337, human
agagcagctgcctgagagaggaccattgtcatccccagccgctgagtgcagaactcattccggcctcgtggcagggatgtccacctctttctacggaaggcct

SEQ ID NO: 2853 - DNA, 110 bp, Artificial
  Hairpin sequence HS_from_MQbrain_338, human; PT_from_MQbrain_338, chimp
tctggcaagtctgatctagagaattcctcccagtctggaagccttcctgagacccctgagcatagttctggggaggaagatgactgggaatctagtgcagatgaagcaga

SEQ ID NO: 2854 - DNA, 97 bp, Artificial
  Hairpin sequence HS_from_MQbrain_339, human; PT_from_MQbrain_339, chimp
ggtttgctgtttggaagccattggcagggctgccgtgcatgtggctgtgagggctgcacagtcctgccaaggggcttcctccttgtcaccccgaacc

SEQ ID NO: 2855 - DNA, 115 bp, Artificial
  Hairpin sequence HS_from_MQbrain_34, human
ctatgccgccccacagacacccttgtctctttcctggaggcactgagcccataaaacagcagggctcacgttctgaggacagagggcaggggccctgggtggtttggtggcagag

SEQ ID NO: 2856 - DNA, 64 bp, Artificial
  Hairpin sequence HS_from_MQbrain_340, human; PT_from_MQbrain_340, chimp
ggctggcgtgcggcgccgttgcgggcgggagcggctgcaacgccggtgcctgaggagcgatgcc

SEQ ID NO: 2857 - DNA, 97 bp, Artificial
  Hairpin sequence HS_from_MQbrain_342, human
gcttgcctgccccaggctgctgcctgtgcccccgacctccctgccttctcccacgggggcttctctcacaactaggcggtcctgggatggggcatgt

SEQ ID NO: 2858 - DNA, 110 bp, Artificial
  Hairpin sequence HS_from_MQbrain_343, human; HS_from_MQbrain_349, human; HS_from_MQbrain_350, human
agactgcaccaatgaatcctgagcaggttctagttcagtaggtggacctgtgacttcagtcaggcttcgatgcagagtctgaacctggtctggatgaggagctgtagtct

SEQ ID NO: 2859 - DNA, 64 bp, Artificial
  Hairpin sequence HS_from_MQbrain_345, human
gccagggcacctagctgaggagtgtgagtggcagaagccactggtgtctgagcagggtgagggc

SEQ ID NO: 2860 - DNA, 116 bp, Artificial
  Hairpin sequence HS_from_MQbrain_346, human
ggctccttctctgttactgtggacttggtgttgtccttccgcctccagccaagccagttctgtgaacagcttttggtgttgaggaggaagattcccaggccaccaacagtaatgtc

SEQ ID NO: 2861 - DNA, 85 bp, Artificial
  Hairpin sequence HS_from_MQbrain_347, human
gggagaggctggtgaaacggcttccctctgcggtctttccacaggggcgcggatcctgaggccgagctctgccagcttccctccc

SEQ ID NO: 2862 - DNA, 79 bp, Artificial
  Hairpin sequence HS_from_MQbrain_348, human; MQbrain_348, macaque
tgtgccttctctggcctctattactgtgacatctgccaccaagacgatgcctcagtgattccggccaggatcatccaca

SEQ ID NO: 2863 - DNA, 63 bp, Artificial
  Hairpin sequence HS_from_MQbrain_353, human
ccaccaggcctggctcagggctgggctgggcttggctcgtctcagagcagctggggctggtgg

SEQ ID NO: 2864 - DNA, 74 bp, Artificial
  Hairpin sequence HS_from_MQbrain_354, human
cctgggcactccagtgacgccggagctgccggggccagatcccacgcccagcctcactggctcctgtccccagg

SEQ ID NO: 2865 - DNA, 113 bp, Artificial
  Hairpin sequence HS_from_MQbrain_355, human; PT_from_MQbrain_355, chimp
tgccgggcttggttggctggttgtgctcgttgcataatctgggccctggggccagccctgtgaagctgccagggacagtgtgtgcaaggcagagctgccaaacaggccttgca

SEQ ID NO: 2866 - DNA, 109 bp, Artificial
  Hairpin sequence HS_from_MQbrain_358, human
agacttatactcatgctcttggctatactgtgaattactgaaatgttgaacaaacctgtgaaagacatacattagccctttaagatggccaggagctaagcttgagtct

SEQ ID NO: 2867 - DNA, 105 bp, Artificial
  Hairpin sequence HS_from_MQbrain_36, human
gacatcttgcccgcccctcagcaccctgccttgtctccaggaggtccgaagctctgtgggacctcttgggggcaaggtggggtgaggccggggagtagggaggtc

SEQ ID NO: 2868 - DNA, 96 bp, Artificial
  Hairpin sequence HS_from_MQbrain_360, human
ctcctcatccattccatggtctctgagcctggtcctcagcccaaagctggctccctagaccaatgagagccagagaaccagaatgggccataggag

SEQ ID NO: 2869 - DNA, 68 bp, Artificial
  Hairpin sequence HS_from_MQbrain_361, human
agaggcaccacacaggacacagtgacttcaggctccttttcttggaaacactgttggctgtggcctct

SEQ ID NO: 2870 - DNA, 96 bp, Artificial
  Hairpin sequence HS_from_MQbrain_362, human
cagacttcagggtagcagaggactaggagagcagggcagaagattctggaagggaggattggcctgtcctacattacgaagctacccaggggtctg

SEQ ID NO: 2871 - DNA, 102 bp, Artificial
  Hairpin sequence HS_from_MQbrain_363, human
gggacgaagggaatgtaatagaatgtgtgttgggagagggtttccttatgagccagtgcagaggaaagtcttgaaatgcactaaggaaatacagtctgtgcc

SEQ ID NO: 2872 - DNA, 83 bp, Artificial
  Hairpin sequence HS_from_MQbrain_365, human
aacctcaacaggcgtcctgtggcttggggtcagcctaggctgttgcctctgaaccctgtgttgcactgcagcctgaggaagtt

SEQ ID NO: 2873 - DNA, 87 bp, Artificial
  Hairpin sequence HS_from_MQbrain_366, human; PT_from_MQbrain_366, chimp
tgctacacctgcctctgatgtgacaaaaccaaagccatgaatcaaagccttctatgattcttgcgcattctgaggctggtgaaagca

SEQ ID NO: 2874 - DNA, 83 bp, Artificial
  Hairpin sequence HS_from_MQbrain_367, human; PT_from_MQbrain_367, chimp
acaccaggcatggtggaaatcaggacctctgtttattcagtcggtcatctgctgattgagtgggtctgttcaatcgtgcatgt

SEQ ID NO: 2875 - DNA, 79 bp, Artificial
  Hairpin sequence HS_from_MQbrain_369, human; PT_from_MQbrain_369, chimp
ccagtttccttttctttgctctgttttctctgaggagcccatgctgagtggagacagagccaggaatactaacagttgg

SEQ ID NO: 2876 - DNA, 78 bp, Artificial
  Hairpin sequence HS_from_MQbrain_37, human
gggcagcagggtgaggacagccaggctctctggggccaccccccagcccccacccttcctgcctctcctgcactgtcc

SEQ ID NO: 2877 - DNA, 108 bp, Artificial
  Hairpin sequence HS_from_MQbrain_370, human
ggcagcaaagactcagtctctttcatttgtccagatcaatgcccacatgcccaatttaggtcaaggcatcaggcagaggaaaggactggagactgacattgagatgct

SEQ ID NO: 2878 - DNA, 76 bp, Artificial
  Hairpin sequence HS_from_MQbrain_372, human
ccctggggctcactgtggaggagctgacggcctgggcccttggccagtcctggctcttccctgggcctcaccaggg

SEQ ID NO: 2879 - DNA, 98 bp, Artificial
  Hairpin sequence HS_from_MQbrain_374, human; MQbrain_374, macaque
ctgtaaagcaaaacactgcctgggaatttgaagaatcccctaggtctgaaaggaaaaatgacaatgggacagaggcctggggttgtgcagctactcag

SEQ ID NO: 2880 - DNA, 108 bp, Artificial
  Hairpin sequence HS_from_MQbrain_375, human; PT_from_MQbrain_375, chimp
gctgatgctgctgcctgcatcctgtcacctcccctgggcttgcccagccagagagctatgggcggcggccttggaggggagccagggagcagagccagaggctccagc

SEQ ID NO: 2881 - DNA, 107 bp, Artificial
  Hairpin sequence HS_from_MQbrain_377, human
aaagtcacctgcaggcctcccaaagaggtgatagacatggagctgagtgccctgaggagtgacacagagcctgggatggatctgtgggagttctgcagcgaaacttt

SEQ ID NO: 2882 - DNA, 89 bp, Artificial
  Hairpin sequence HS_from_MQbrain_379, human
ctctcccgtggaggagaggggatggctgaggacactggcccttaccccagggccagacagcatccatccctgctgtttgcatctgagag

SEQ ID NO: 2883 - DNA, 117 bp, Artificial
  Hairpin sequence HS_from_MQbrain_38, human
gaggccggaacctgagggactgcctgtgttgtgggtgtctgtggtcagcattgctggtgttggcggtgaccgctgagcttgtgagcacgtgaggaggcagtgtgtgggtgtggcctt

SEQ ID NO: 2884 - DNA, 115 bp, Artificial
  Hairpin sequence HS_from_MQbrain_382, human; PT_from_MQbrain_382, chimp
ctgcccagccccagctatgtgcacccggcccttgtgggcaaggacaagaaggggcgggcacccatccccccgctgcccatggggctggcgctgcgcaagtacgcgggccaggcag

SEQ ID NO: 2885 - DNA, 68 bp, Artificial
  Hairpin sequence HS_from_MQbrain_383, human
gggcttgtgccgatgggtggtgtgatgtctggggctgtccctgctgcagcagcccaggaggtgagtcc

SEQ ID NO: 2886 - DNA, 82 bp, Artificial
  Hairpin sequence HS_from_MQbrain_384, human
cccacctccaagaggctacagccctgtgtctggccatgtgagccctggcctttcaccgggttgctggtttcttttctgtggg

SEQ ID NO: 2887 - DNA, 96 bp, Artificial
  Hairpin sequence HS_from_MQbrain_385, human; PT_from_MQbrain_385, chimp
gccaagctcatcaccagcttcctggagctgcactgccttgagagccccacagagctgtctcagagcagcgacagtgaggccggtgaccctgcaagc

SEQ ID NO: 2888 - DNA, 86 bp, Artificial
  Hairpin sequence HS_from_MQbrain_386, human
tttcggcagtggcatccggggccggggtcgcggccgtggacggggccagggccaaggctgcggagctcgcggaggcaaggctgagg

SEQ ID NO: 2889 - DNA, 103 bp, Artificial
  Hairpin sequence HS_from_MQbrain_388, human
tgggttcaactaaagttccagcctgctccacccagagaagcacactttgtgagaaccaatgggaaggagcctgagctgctggaacttattccctatgaattca

SEQ ID NO: 2890 - DNA, 85 bp, Artificial
  Hairpin sequence HS_from_MQbrain_389, human
ggcttcctgggaggtagctggcccagtgtgcagggaccatgagggtcccttgccttggaactgtgcacctccctgtgtgtgagcc

SEQ ID NO: 2891 - DNA, 117 bp, Artificial
  Hairpin sequence HS_from_MQbrain_391, human
agatagtaattgtttgtttctcctgactcctctggttgttcttctcacacaggcactgctgggagacagtggcagccagaactggagcactggaacaacagataaatatgggcgtct

SEQ ID NO: 2892 - DNA, 77 bp, Artificial
  Hairpin sequence HS_from_MQbrain_392, human
ggtggatggtgcaggtttagggggctgaggatgaggaaacagaggagctcttcctgagctatagcctgaggcccact

SEQ ID NO: 2893 - DNA, 90 bp, Artificial
  Hairpin sequence HS_from_MQbrain_393, human; PT_from_MQbrain_393, chimp
ccatgctccaaagtcatcatccggtttctaactgtgataatgaagcatggttacattggcgagtctgaaatcattgatgatcagagctgg

SEQ ID NO: 2894 - DNA, 59 bp, Artificial
  Hairpin sequence HS_from_MQbrain_397, human
cccctggggcgggtgtgaggttcaagtgtgctcagaccctagccacctgcggcaggcgg

SEQ ID NO: 2895 - DNA, 104 bp, Artificial
  Hairpin sequence HS_from_MQbrain_398, human
tcttccaccttcgacgctggggctagcattgccctcaacgaccactttttcaagctcatttcctggtatgacaatgaatttggctacagcaacagggtgatgga

SEQ ID NO: 2896 - DNA, 69 bp, Artificial
  Hairpin sequence HS_from_MQbrain_399, human; PT_from_MQbrain_399, chimp
gccctctatatgaggttggggagcggctgagtcggccttttccgcccgctcccccctccccccgagcgc

SEQ ID NO: 2897 - DNA, 113 bp, Artificial
  Hairpin sequence HS_from_MQbrain_401, human
cccaggcctcccaagcctctgcccagggctctgtccccaactccgaggactgggacagggtgaactatgccgaggagggaggggacggagcctgaggctggcccaggccgagg

SEQ ID NO: 2898 - DNA, 88 bp, Artificial
  Hairpin sequence HS_from_MQbrain_402, human; MQbrain_402, macaque; PT_from_MQbrain_402, chimp
ctcaaagtggtggaaaagaggatagcttgtggtcctccacaggctaaactgaatggacagcaggctgctctcgcttcccagtatagag

SEQ ID NO: 2899 - DNA, 99 bp, Artificial
  Hairpin sequence HS_from_MQbrain_405, human
gggccagaaggagggcagagccatgggcctgggcctgcttttccaggatcctgcaggaacgagcactggccagagagggcccagctgtagccatggctc

SEQ ID NO: 2900 - DNA, 79 bp, Artificial
  Hairpin sequence HS_from_MQbrain_406, human
cctcccctgctcctccccattggggaaagcatctctggagggctgttgactggagaaagggggaaggaggaggtggggg

SEQ ID NO: 2901 - DNA, 119 bp, Artificial
  Hairpin sequence HS_from_MQbrain_409, human
ctccaatgattccaggactgtggagagcatcctggtgtgacaatgttgtctgctcatacagagcagacattcctcattttcctcattccaggtcccacagagtaagagtcacttggtag

SEQ ID NO: 2902 - DNA, 110 bp, Artificial
  Hairpin sequence HS_from_MQbrain_41, human
gaagtggggttgggcagggactgaggagcagtgtggcggcaccccaagtgcaaaggccctgtggtgggaagctgccaagctgtttccctttcctttgtgtaagtatcttt

SEQ ID NO: 2903 - DNA, 118 bp, Artificial
  Hairpin sequence HS_from_MQbrain_412, human; MQbrain_412, macaque
atgtggcactggtaaatctacctggttctggcatgcttcactttgatttcctgctatcctctactgcttgcctctaaatcaaggtaaagagcagagcaggtatgtattaatgtcacat

SEQ ID NO: 2904 - DNA, 79 bp, Artificial
  Hairpin sequence HS_from_MQbrain_42, human; MQbrain_42, macaque
ccctgctgcccttctacgaccccgacaccagtgtggtctacgtctgcggcaaggtggggctgggcagggctggcgaggg

SEQ ID NO: 2905 - DNA, 93 bp, Artificial
  Hairpin sequence HS_from_MQbrain_420, human
ctgcagagcaacccccactcagcctcctggacagccaggttcagtttcatatggtggctatcctccaggctggtgtgggtagcctctttctag

SEQ ID NO: 2906 - DNA, 75 bp, Artificial
  Hairpin sequence HS_from_MQbrain_421, human
cagaggtctttctccccttcctgcctccccctaccagtcactgggagagagaaggggacagaagctcaccatttg

SEQ ID NO: 2907 - DNA, 104 bp, Artificial
  Hairpin sequence HS_from_MQbrain_427, human
tgccaagactgaggggttggatggcaagcacgtggtctttggcacggtgaaagaaggcatgaagattgtggaggccatggagtactttgggcccaggaatggca

SEQ ID NO: 2908 - DNA, 115 bp, Artificial
  Hairpin sequence HS_from_MQbrain_428, human; HS_from_MQbrain_429, human; PT_from_MQbrain_428, chimp; PT_from_MQbrain_429, chimp
acttcttccagctctttgtcccagacaacgtcctcaagaacatggtggtgcagacaaacatgtatgccaagaagttccaggagcggtttgggagcgacggagcctgggtggaggt

SEQ ID NO: 2909 - DNA, 95 bp, Artificial
  Hairpin sequence HS_from_MQbrain_43, human
gtcctccaggggacaggctcggccaccttgagcaagtcgtgaggtctctttggaccttgttgcctggtgcctgccctctcccatcccctgggggc

SEQ ID NO: 2910 - DNA, 118 bp, Artificial
  Hairpin sequence HS_from_MQbrain_432, human
aagtgagcacattcagtaatatctagaagtgtcctagcttactaataatttgatttatggaaaaatgtttgaaattaataggtaaacacttttagttttctgttacatgtgtttattt

SEQ ID NO: 2911 - DNA, 87 bp, Artificial
  Hairpin sequence HS_from_MQbrain_433, human; PT_from_MQbrain_433, chimp
gggtcgggacggggaggactgctggaggaccacaaagaaatgagcctactcctctggggccctgggcagacctcccagttcctgttc

SEQ ID NO: 2912 - DNA, 115 bp, Artificial
  Hairpin sequence HS_from_MQbrain_435, human; PT_from_MQbrain_435, chimp
ctcacctggctcttgtcatctcgctcatcttgaagtgacccgtggacaatgctgctccctgccgcagctccgccggtcactcaggcagaacggggtatgcaaatggcctggagag

SEQ ID NO: 2913 - DNA, 83 bp, Artificial
  Hairpin sequence HS_from_MQbrain_436, human
gggagggaaagaccgggaaggcgacagtatccttgcctacgggtgttttttggtttcttgttgcttttttttttttttttccc

SEQ ID NO: 2914 - DNA, 104 bp, Artificial
  Hairpin sequence HS_from_MQbrain_437, human
gcccacagggaggaggtccccagtgagcctcctgccccacaggctcttgcaacctacctgcagcgggcccgtggcacaggcttcctgccgccatcctgtgtggt

SEQ ID NO: 2915 - DNA, 60 bp, Artificial
  Hairpin sequence HS_from_MQbrain_438, human
gtgtcacgtgctctggcagtctctaggcccaggtcttgttctgccttggttcagtggcac

SEQ ID NO: 2916 - DNA, 77 bp, Artificial
  Hairpin sequence HS_from_MQbrain_441, human; PT_from_MQbrain_441, chimp
gctctggggaaagagagcgttggcactgagaatattctccctttctcctagtgcactgctttttgcctgttctaggc

SEQ ID NO: 2917 - DNA, 71 bp, Artificial
  Hairpin sequence HS_from_MQbrain_442, human
cagctgacccaagttgagcaccagccatgctgtcccacctggagtggaatgggtgtgtgctcgggtccctg

SEQ ID NO: 2918 - DNA, 106 bp, Artificial
  Hairpin sequence HS_from_MQbrain_444, human
gggaaacggctggaggatggccacactctctcaggctacaacatccagaaagagtccaccctaaacctggtgctgcgcctgcgaggtggcattactgagccttccc

SEQ ID NO: 2919 - DNA, 68 bp, Artificial
  Hairpin sequence HS_from_MQbrain_447, human
gcctcatcgggaggtctgtggagtgaaagctggggctccccacagctcccttccatgccccgtgaggc

SEQ ID NO: 2920 - DNA, 80 bp, Artificial
  Hairpin sequence HS_from_MQbrain_448, human; PT_from_MQbrain_448, chimp
catggaagtgtggtggtggaggtggcagtcatagtcatgaagagaagactaatgcctccaccagtaacagtaccaccatg

SEQ ID NO: 2921 - DNA, 73 bp, Artificial
  Hairpin sequence HS_from_MQbrain_449, human; PT_from_MQbrain_449, chimp
aggaagacatagcaggaggaggaagaggaaggtgtaggaacatttcctaatttttccttccatttgtcttctt

SEQ ID NO: 2922 - DNA, 64 bp, Artificial
  Hairpin sequence HS_from_MQbrain_45, human
gccaccttcccagggtcctcttcggggagaaaagagcttctgagggacttctggggatgggagc

SEQ ID NO: 2923 - DNA, 79 bp, Artificial
  Hairpin sequence HS_from_MQbrain_450, human
gctgggacgggggaaggatgcgagcgctgcaggtaatggctgtggctttgctgcgctcgcctcttcccggcgctgcggt

SEQ ID NO: 2924 - DNA, 85 bp, Artificial
  Hairpin sequence HS_from_MQbrain_451, human
ctgtgggcccctgagcagaaggctctatggaaaacggcttttctctacggtctttttgatggctttctgttacatgggcctatag

SEQ ID NO: 2925 - DNA, 89 bp, Artificial
  Hairpin sequence HS_from_MQbrain_452, human
gtgcaggctgaaattgagagcccaggcactggagaagaacccaagacacaagcttggggtgtgtctggggatgacaagagaggctggat

SEQ ID NO: 2926 - DNA, 104 bp, Artificial
  Hairpin sequence HS_from_MQbrain_453, human
tcagcaaagcctgtgcggagcgagccagagctacctgtggaagggacctcagcgaaaaccagtgattgcccacacagcagtagctcctctgacggcccagcgga

SEQ ID NO: 2927 - DNA, 71 bp, Artificial
  Hairpin sequence HS_from_MQbrain_458, human; PT_from_MQbrain_458, chimp
cagttagtccatcctgtctttccagacactctggtgaaaggctttggataagagagaggatggaactactg

SEQ ID NO: 2928 - DNA, 93 bp, Artificial
  Hairpin sequence HS_from_MQbrain_459, human
gtagagctcttttgattggtgtggggttgagggtggcctcgggccctgcccgctgggccttgttcacccccataccagatgaaaatggacagc

SEQ ID NO: 2929 - DNA, 114 bp, Artificial
  Hairpin sequence HS_from_MQbrain_461, human
gcccaggagtggggggagccttcctcagggctctggcagcctctcctcacaggacatggccttgctttaggtgagggtctgcctagagccttggatgaaggtctcccatccggc

SEQ ID NO: 2930 - DNA, 114 bp, Artificial
  Hairpin sequence HS_from_MQbrain_462, human
ggactgcagagaaccttctggctgtgcagctgagaactgagtcaatgcaagagctcctggctcctgcttgacctcgagcagctgaggttagcagacgggcaaagcctgcagttc

SEQ ID NO: 2931 - DNA, 100 bp, Artificial
  Hairpin sequence HS_from_MQbrain_464, human
agatgtctggggatgaggttgaggcaaaagtgacttcttgaggactttgctttttggagaagtcaaatttcctacttcttgatttcagcccttcaactct

SEQ ID NO: 2932 - DNA, 78 bp, Artificial
  Hairpin sequence HS_from_MQbrain_465, human
gagatgtcaagcaggtggcctctggacgtcaccgttgccctgcatggtggccccagagcagcctctatgaacaacctc

SEQ ID NO: 2933 - DNA, 91 bp, Artificial
  Hairpin sequence HS_from_MQbrain_466, human
gaagcttgctctgctctgggtgctgaatgctgggaaggtggacaggaagcctcaccacgttagggcccaggggacaaagagctttggcttc

SEQ ID NO: 2934 - DNA, 81 bp, Artificial
  Hairpin sequence HS_from_MQbrain_467, human; PT_from_MQbrain_467, chimp
gactgagacggtgtccaccaaggggatccgataatgccagtgtggtgtctaaatattttcctctgtgggcctgtctttttc

SEQ ID NO: 2935 - DNA, 118 bp, Artificial
  Hairpin sequence HS_from_MQbrain_47, human
gtcaggcattttgcaaggaaaagccacttggggaaagatggaaaaggacaaaaaaaattaataaatttccattggccctcgggtgagctgagggtttttgcaaggaagttgtggtggc

SEQ ID NO: 2936 - DNA, 101 bp, Artificial
  Hairpin sequence HS_from_MQbrain_470, human
cctgtgaccactaccctggggttggaatggccatgggcatggggctggaccctagccttaaccccaggccacatgtcattctggctttggtgggtggaggg

SEQ ID NO: 2937 - DNA, 110 bp, Artificial
  Hairpin sequence HS_from_MQbrain_471, human
tccatgggctctggagaccatcagttcaacctcgcagagatcctgtcacagaactacagtgttaggggggagtgcgaggaggcctcgaggtgcccagacaagcccaagga

SEQ ID NO: 2938 - DNA, 73 bp, Artificial
  Hairpin sequence HS_from_MQbrain_472, human
tgcaggctcctcagaacacgcatgcctcgaaggtcttccctggccttaggggtggagtgtgtgagggtctcca

SEQ ID NO: 2939 - DNA, 118 bp, Artificial
  Hairpin sequence HS_from_MQbrain_475, human
tggaggacccactgtgtctgtccgtgatggacgcatggagggccccactgtgtctgtccgtgatggaggcgtggaggaccaactgtgtctgtccgtgatggaggcgtggagggcccca

SEQ ID NO: 2940 - DNA, 118 bp, Artificial
  Hairpin sequence HS_from_MQbrain_476, human
tccgtgatggacctgtggagggccccactgtgtctgtctgtgatggacgcgtggaggacccactgtgtctgtccgtgatggacgcatggagggccccactgtgtctgtccgtgatgga

SEQ ID NO: 2941 - DNA, 104 bp, Artificial
  Hairpin sequence HS_from_MQbrain_477, human
ggtgaaggccctggagtaggcggtgcgtacccggtgtcccgaggcccggccaggggctgggcagggatgccaggtgggcccagccagctcctggggtcccggcc

SEQ ID NO: 2942 - DNA, 67 bp, Artificial
  Hairpin sequence HS_from_MQbrain_478, human
gcctggggttggaggtgcccagcgcgccgcctcttaactcgggggtgacgctgcccgtttcccaggt

SEQ ID NO: 2943 - DNA, 88 bp, Artificial
  Hairpin sequence HS_from_MQbrain_48, human
cagggctgggcaggctgggggtctgggaggcaggggcccgggcagccctgagcccaacccctggctccctctcccatcccaggtcctg

SEQ ID NO: 2944 - DNA, 84 bp, Artificial
  Hairpin sequence HS_from_MQbrain_482, human
gcacagtggcctctccccatggtcttcgttggtggctgggatgaggccccaccccggagagcataggaggagaggcctctctgt

SEQ ID NO: 2945 - DNA, 95 bp, Artificial
  Hairpin sequence HS_from_MQbrain_483, human
gacccctgtgtcccccacaggcgtcctgcatcctgcagctggtcaagcacatccagaagcttcaggccaaggacgtgcctgtggcagaggaggtc

SEQ ID NO: 2946 - DNA, 86 bp, Artificial
  Hairpin sequence HS_from_MQbrain_484, human
cagagctgggaaattccgcagcagggcagatgagggatcgatctgagtcccatgatcctcggccctgctgaggtcccaggaggctg

SEQ ID NO: 2947 - DNA, 88 bp, Artificial
  Hairpin sequence HS_from_MQbrain_485, human
gcctggcgggcggcaccttcctcttcatcaccttcctggagatcctggccaaggagctggaggagaagagtgaccgtctgctcaaggt

SEQ ID NO: 2948 - DNA, 75 bp, Artificial
  Hairpin sequence HS_from_MQbrain_486, human
cctcttggaacctgggctcgggctgtagtctgggcttcctggcccatgacatctcagagtgtgggaacagggtgg

SEQ ID NO: 2949 - DNA, 111 bp, Artificial
  Hairpin sequence HS_from_MQbrain_487, human
ccccaggctattgtcatccccaggtcttagggctgagtctcccagggctgaggttggtggaatttgccgggcaggactgaggaatttggcactgggggtggaaggctgggg

SEQ ID NO: 2950 - DNA, 68 bp, Artificial
  Hairpin sequence HS_from_MQbrain_488, human
ggatctcttctcagcctgagcttctcttttagcctgagctgaaagagatcatcttgggaaggagctcc

SEQ ID NO: 2951 - DNA, 99 bp, Artificial
  Hairpin sequence HS_from_MQbrain_490, human
ggcagcctgtctcatctaccctgggtggcatcccctgcagaaagatgatttgatgagacagcaagagggcatggctacctgggaaagatgagtagggcc

SEQ ID NO: 2952 - DNA, 87 bp, Artificial
  Hairpin sequence HS_from_MQbrain_491, human
aggaaaagatcgaggtgggttggggcgggctctggggatttggtctcacagcccggatcccagcccacttaccttggttactctcct

SEQ ID NO: 2953 - DNA, 79 bp, Artificial
  Hairpin sequence HS_from_MQbrain_492, human
tggacagtggaacgcatgccaggggagagctgattggctggattagttaccatccaaactggagtgatcctattggaca

SEQ ID NO: 2954 - DNA, 68 bp, Artificial
  Hairpin sequence HS_from_MQbrain_493, human
ggcactgcccttgcagactcacctttctccacctgccctggagaaaggtagggtgtgctgggcctgcc

SEQ ID NO: 2955 - DNA, 69 bp, Artificial
  Hairpin sequence HS_from_MQbrain_494, human
ggaatcttctgacccaaaggctgggcacgacgctggtcccgaccttgtgcccagcccagaccttgatcc

SEQ ID NO: 2956 - DNA, 118 bp, Artificial
  Hairpin sequence HS_from_MQbrain_495, human
tgaagccgtggtctggggcagggtggtgggagaggtgggcgggggggggtggtcccggctctgaggtgtgtgcccctccccccttcctgtcccacccgcttctccacccctagcttca

SEQ ID NO: 2957 - DNA, 71 bp, Artificial
  Hairpin sequence HS_from_MQbrain_496, human; PT_from_MQbrain_496, chimp
ccctccctctcctcccagcgctaccaggcagaaatcaacgacctggagaacttgggcgagatgggcagcgg

SEQ ID NO: 2958 - DNA, 59 bp, Artificial
  Hairpin sequence HS_from_MQbrain_497, human
cactggtgggtgaggctctgtggtcagcaggtgcccggcccaaggtctcgcccctcgtg

SEQ ID NO: 2959 - DNA, 100 bp, Artificial
  Hairpin sequence HS_from_MQbrain_498, human
gtccttcatcgagacctcagccttggattccactaacgtagaggaagcattcaagaacatcctcacaggtggccggggaccagatgggtgtgggtagggc

SEQ ID NO: 2960 - DNA, 94 bp, Artificial
  Hairpin sequence HS_from_MQbrain_499, human
tcgagcgcatgggccctgccatgggcccggccctgggcgctggcattgagcgcatgggcctggccatgggtggcggtggcggtgccagctttga

SEQ ID NO: 2961 - DNA, 119 bp, Artificial
  Hairpin sequence HS_from_MQbrain_500, human
ggccgtcacggtggaatgtgagtaggggcaccgcggagttaggcaggatctgtgggacaaccccggctggacttcctggcccccgtgtgagcccctgcaatcctgtttcccagatggcc

SEQ ID NO: 2962 - DNA, 77 bp, Artificial
  Hairpin sequence HS_from_MQbrain_501, human; PT_from_MQbrain_501, chimp
tgttagcgttgcctggtgcggggcagggcctaacaaggaaacctgggccctccaagccaggttgaggtctggtaaca

SEQ ID NO: 2963 - DNA, 59 bp, Artificial
  Hairpin sequence HS_from_MQbrain_502, human
ggcctttgtcctggccgtcactggcaacctgacgctggtgctggcccagaggagggacc

SEQ ID NO: 2964 - DNA, 99 bp, Artificial
  Hairpin sequence HS_from_MQbrain_504, human; PT_from_MQbrain_504, chimp
ttgggggtggaacggggcatggggctgccttggggctggagtaggggctgtccctgggtggccccgagtcagccctgtgtctccaggagttctacacgg

SEQ ID NO: 2965 - DNA, 105 bp, Artificial
  Hairpin sequence HS_from_MQbrain_506, human
gagacttggcagctgtaggcatcttgggccagccccaggtagtcctgaaacccaggatcaggaaaaggcagagggtgggctgaggtcgcatcactgtaaagtttc

SEQ ID NO: 2966 - DNA, 68 bp, Artificial
  Hairpin sequence HS_from_MQbrain_508, human
tgggcgcagggggactgggggtgagcaggcccagaacccagctcgtgctcactctcagtccctcccta

SEQ ID NO: 2967 - DNA, 104 bp, Artificial
  Hairpin sequence HS_from_MQbrain_509, human
cgttggtgcccaaagcaggtgccaggtctttgcttcctaagtttcagactcttaaagaggctggttcttaaggttagcaattcctcaccatcccaggcccattg

SEQ ID NO: 2968 - DNA, 59 bp, Artificial
  Hairpin sequence HS_from_MQbrain_513, human
ctggctctgcagagatggagtctgaggacttgggactccgagctttctgaggggcacag

SEQ ID NO: 2969 - DNA, 93 bp, Artificial
  Hairpin sequence HS_from_MQbrain_514, human
ctccttaaggaagagccggggccccgctgtcgctgatgaatgggaaatttccatttgcacatgcgcatgggatcctggccgccctcctaggag

SEQ ID NO: 2970 - DNA, 77 bp, Artificial
  Hairpin sequence HS_from_MQbrain_516, human
gcctctgatccttggatgtgcatggccgtgctggcctcccaggccacactgctgacagtgtccagggatggtgtggt

SEQ ID NO: 2971 - DNA, 64 bp, Artificial
  Hairpin sequence HS_from_MQbrain_517, human; PT_from_MQbrain_517, chimp
gatggctctgacaccgtgttggtggcgatgtcccagacaatcccaccaggacggcccagacatc

SEQ ID NO: 2972 - DNA, 93 bp, Artificial
  Hairpin sequence HS_from_MQbrain_519, human
gcgcgtgcgcgtggtgtgcacacgcgtgtgcgcgcctgcctgtgtcagcgggtctgtgtgcacccttgcttgtgtacctggatatgctcgtgt

SEQ ID NO: 2973 - DNA, 72 bp, Artificial
  Hairpin sequence HS_from_MQbrain_52, human
tccaggtttcgggattcccatccgtcctggcgatcctgccagcagtgggtgggcagcctgagctccctcggg

SEQ ID NO: 2974 - DNA, 98 bp, Artificial
  Hairpin sequence HS_from_MQbrain_520, human; PT_from_MQbrain_520, chimp
tcgtaaacaggagataaggcccacagcggccctcttccctgtccctggtctgcgggtggagatggggatggggtggggccgagggagctggcctatga

SEQ ID NO: 2975 - DNA, 66 bp, Artificial
  Hairpin sequence HS_from_MQbrain_521, human; PT_from_MQbrain_521, chimp
gcaaggctcccgtccgccctcctgggccaactggcctctccaggggtggccgagagctcactttgc

SEQ ID NO: 2976 - DNA, 106 bp, Artificial
  Hairpin sequence HS_from_MQbrain_524, human
gtgaggccaccgccacggctccaccctcccctgctgcagagaccaaggtgtattccctgcctctctctttgaccccaacaggacagggtggagaggccatgcccac

SEQ ID NO: 2977 - DNA, 61 bp, Artificial
  Hairpin sequence HS_from_MQbrain_525, human
ggccaccaggctccagggagcccagggcaggaggcagctctgggtgtcgtggccgtgggcc

SEQ ID NO: 2978 - DNA, 111 bp, Artificial
  Hairpin sequence HS_from_MQbrain_526, human; PT_from_MQbrain_526, chimp
attgaaagtggcattctggattatccttttccatgtgatggagtctgcatttatcagactacattgcagtttttccttatgtggtgcaaggttataaaaatgccatccagt

SEQ ID NO: 2979 - DNA, 110 bp, Artificial
  Hairpin sequence HS_from_MQbrain_527, human; HS_from_MQbrain_962, human
aggctgaaggggatgctaaaggaggtaaagccaaggtgaaggacgaaccacagagaaggtctgcaaggttgtctgctaaacctgctcctccaaagccagagcccaagcct

SEQ ID NO: 2980 - DNA, 75 bp, Artificial
  Hairpin sequence HS_from_MQbrain_528, human
gaccaacagcgggcgcaggtggaaagtgaaggctcagagcattgctctgagacttgtcctgggaggctcctggtc

SEQ ID NO: 2981 - DNA, 72 bp, Artificial
  Hairpin sequence HS_from_MQbrain_529, human
gcacccccatccccgccctcctcgtctgtgtaagttgggggacctgggccaggcagggcgtggaggcagggc

SEQ ID NO: 2982 - DNA, 93 bp, Artificial
  Hairpin sequence HS_from_MQbrain_530, human
ctgaggaagtaggatctgatacaggtattaggatctgggtctatgtctgaggaggtagcatctgatacaggtatgaagacctgagtctgtcag

SEQ ID NO: 2983 - DNA, 67 bp, Artificial
  Hairpin sequence HS_from_MQbrain_531, human
tcctttttgccctccacatgagctgagcaccctgggtgtttcacaggggctggctgtgggcaatgga

SEQ ID NO: 2984 - DNA, 79 bp, Artificial
  Hairpin sequence HS_from_MQbrain_532, human; MQbrain_532, macaque
gcaatactgccgctgcccccaccctgcttctgctgcctgtttggggaggggggcggtgaggtgggggcagcggccccgc

SEQ ID NO: 2985 - DNA, 117 bp, Artificial
  Hairpin sequence HS_from_MQbrain_533, human
ccgtggctgtgactctgttttccgcagtggagcggaggcggagggacaagatcaacaactggatcgtccagctttcgaaaatcattccagactgtaacgcagacaacagcaagacgg

SEQ ID NO: 2986 - DNA, 95 bp, Artificial
  Hairpin sequence HS_from_MQbrain_534, human
gggtcctctcctgctccctcagtgacccctccacccggtcctggcccccggggagcagagtagagggggctgaggacgaggaagaggaggaatcc

SEQ ID NO: 2987 - DNA, 79 bp, Artificial
  Hairpin sequence HS_from_MQbrain_535, human
gagcaagggactcgcggttgacgggacacggatcctctaaggcccagagtgtcccgagtagcggcagtggggagtgctc

SEQ ID NO: 2988 - DNA, 89 bp, Artificial
  Hairpin sequence HS_from_MQbrain_536, human; MQbrain_536, macaque; PT_from_MQbrain_536, chimp
cagtgacaactcactgctgtcctctccccacagtgccctgggcttgctgtacttcatccggcgaggaaagcagtgtctggatttcactg

SEQ ID NO: 2989 - DNA, 82 bp, Artificial
  Hairpin sequence HS_from_MQbrain_537, human
cctcttgggagagccagcctgactgcctgctgccactcactctgccagcttgggagttgctcaggcttgtcctccagggagg

SEQ ID NO: 2990 - DNA, 88 bp, Artificial
  Hairpin sequence HS_from_MQbrain_538, human; PT_from_MQbrain_538, chimp
gcctctggaggccacaggggaaagcttcagggacaactttgggtatgacaaaggctcccctttcttccttgctgcagtgtctccaagc

SEQ ID NO: 2991 - DNA, 92 bp, Artificial
  Hairpin sequence HS_from_MQbrain_539, human; MQbrain_539, macaque
gccctgggctcccatcctcatctctctccttgactggaattgctgctacccagctggggtgggtgaggcctgcactgattggggcctggggc

SEQ ID NO: 2992 - DNA, 119 bp, Artificial
  Hairpin sequence HS_from_MQbrain_54, human
agagacagccgacagctatggccctaccaccacactcaaccaggagcagaacgctggccccatggcgagcctgcccctggcgggcatcatcggcggggcagtggctctggtcttcctct

SEQ ID NO: 2993 - DNA, 79 bp, Artificial
  Hairpin sequence HS_from_MQbrain_540, human
gcagacgacctgaaggcggtgggcgggaagcccgccggatggcaggtgggcggcgcccagggctgcggggaatgtgtgt

SEQ ID NO: 2994 - DNA, 112 bp, Artificial
  Hairpin sequence HS_from_MQbrain_541, human; PT_from_MQbrain_541, chimp
catgtgtttgtggtttcagggatcagtgacattcagggatgtggccattgacttctctcaggaggagtgggagtgcctgcagcctgatcagaggaccttgtacagggatgtg

SEQ ID NO: 2995 - DNA, 112 bp, Artificial
  Hairpin sequence HS_from_MQbrain_542, human; MQbrain_542, macaque; PT_from_MQbrain_542, chimp
agcatcccccaccccccagagcagtgctggtggaaagcattcctgagggcctggacttccccaatgcctccacggggaacccttccaccagccaggcctggctgggcctgct

SEQ ID NO: 2996 - DNA, 80 bp, Artificial
  Hairpin sequence HS_from_MQbrain_543, human
gggcattaccttgtggggttggagagctggctggtccagcccctcagaagctctcccctccccgcagggtgaggaggtcc

SEQ ID NO: 2997 - DNA, 116 bp, Artificial
  Hairpin sequence HS_from_MQbrain_544, human; PT_from_MQbrain_544, chimp
tccttcttgttgccacagaggatgaccacgatgttggggctggccagggtgcgggcatccgtcagccaggcagccagtgagttgtatgtctcccggctgtggagaagggagaaggg

SEQ ID NO: 2998 - DNA, 72 bp, Artificial
  Hairpin sequence HS_from_MQbrain_545, human
ggtgctgggagatctggggactttctggttggcttctagaagaggtatagggagccctggtgtccagaggct

SEQ ID NO: 2999 - DNA, 81 bp, Artificial
  Hairpin sequence HS_from_MQbrain_546, human; PT_from_MQbrain_546, chimp
cggtccaaccccttcatccccagctgctcctaggactggcccatgggcaggcgggtggggggatgggaagggggtgccctg

SEQ ID NO: 3000 - DNA, 116 bp, Artificial
  Hairpin sequence HS_from_MQbrain_549, human
gggacactgaccagggtctgcatggtatgagctggccctgacccctgggcagaagtgggatctgacctccagactgcagggtcaggtcaccccaggtcctgttcactgcaggtccc

SEQ ID NO: 3001 - DNA, 93 bp, Artificial
  Hairpin sequence HS_from_MQbrain_55, human; PT_from_MQbrain_55, chimp
tcctctgggcctcaggcctcctgtccacagaatgggagcacagtttgtcctccctgtgggccagggttggcaggaggctgtattcagacagga

SEQ ID NO: 3002 - DNA, 105 bp, Artificial
  Hairpin sequence HS_from_MQbrain_550, human
actttgatgggggcagtgagggagacagccccaacccttttctccaatcccccttccccaggttcctgggctccccttctctctaccttctcccccaacgtctgt

SEQ ID NO: 3003 - DNA, 76 bp, Artificial
  Hairpin sequence HS_from_MQbrain_552, human
ggtgagtggggcacggaggctgctgctcccctcggccaccgtgagcagggagccgccctcacaccccctcctctcc

SEQ ID NO: 3004 - DNA, 63 bp, Artificial
  Hairpin sequence HS_from_MQbrain_553, human
cctggagtcagggtggaaggtggaagaactgggtcttatttccttctccccttgttctttagg

SEQ ID NO: 3005 - DNA, 88 bp, Artificial
  Hairpin sequence HS_from_MQbrain_554, human
gaggtgtggaaaggtgtagtctgggaggatgcctccgttttccccttctgtgaaatggattcatcctccaatttccctgaggagcctc

SEQ ID NO: 3006 - DNA, 98 bp, Artificial
  Hairpin sequence HS_from_MQbrain_557, human
cttaggtctagtcgctagatcccccgttttcccaagaagagggttcgagcccttggtggggacagctggggagatggcagtgcaggctggaacctggg

SEQ ID NO: 3007 - DNA, 92 bp, Artificial
  Hairpin sequence HS_from_MQbrain_558, human
gtttctgaagttggtggccgccatcaaagccgccttggctcagggctaatgcgccctgaaggcagaggtgagggggcccactagacagggac

SEQ ID NO: 3008 - DNA, 90 bp, Artificial
  Hairpin sequence HS_from_MQbrain_559, human
gcagtttggttctgctgggggttggggcaggatgaagaggaaggggctgccttcccaactcagccacctcctcactccacaggagcctgc

SEQ ID NO: 3009 - DNA, 77 bp, Artificial
  Hairpin sequence HS_from_MQbrain_56, human
ccagataaaaagagctggtgaggcgacttccactggttcttaatgaattccaggtctcggttcctcatcagccctgg

SEQ ID NO: 3010 - DNA, 78 bp, Artificial
  Hairpin sequence HS_from_MQbrain_560, human; PT_from_MQbrain_560, chimp
aggaacaccgagggcagggctccaggccagggctccactggagcccttcagccttccctccctgcccccgtgctttct

SEQ ID NO: 3011 - DNA, 83 bp, Artificial
  Hairpin sequence HS_from_MQbrain_561, human
cgggatggggggggctcggcaactcctgggggcctggcgaggaggcgggcttcccgggggggggacacgggaccgcttacctg

SEQ ID NO: 3012 - DNA, 98 bp, Artificial
  Hairpin sequence HS_from_MQbrain_562, human
ggcagtggtcgggcaggcaagaggggccgctggtcaggggtcaaggaggagccctccaaggtcagcagctgcctctgggtcctggactgagcagggct

SEQ ID NO: 3013 - DNA, 73 bp, Artificial
  Hairpin sequence HS_from_MQbrain_564, human
ggtgcagagcccagctgcccccagggctcctgggccttctcagtgagtctgggggagctaaagtccatccgcc

SEQ ID NO: 3014 - DNA, 94 bp, Artificial
  Hairpin sequence HS_from_MQbrain_566, human
cccatgggccccccactccttgacagatgagtggttttgatccagccagaaatgctggatttacaatggcagagaagtggcggggttgggtggg

SEQ ID NO: 3015 - DNA, 64 bp, Artificial
  Hairpin sequence HS_from_MQbrain_567, human
agatgagggtgggccctgagccatgctttcagaggatggcaggctcagggcctcaagtttctct

SEQ ID NO: 3016 - DNA, 68 bp, Artificial
  Hairpin sequence HS_from_MQbrain_569, human
gcttctggcctcattctctcctgtgtccctgctgagactggggacacaagagagaatgagtgtcctgc

SEQ ID NO: 3017 - DNA, 53 bp, Artificial
  Hairpin sequence HS_from_MQbrain_57, human
ggtccagatgtggatgtgagcctgcccaaggccgacatcgatgtctcgggacc

SEQ ID NO: 3018 - DNA, 83 bp, Artificial
  Hairpin sequence HS_from_MQbrain_571, human
gcgaaagcctggcgcgcgcgcgcgccattgtgtggctggactcggccgcccctgtggtgtgaggcgcgtgttcgggctcttgc

SEQ ID NO: 3019 - DNA, 108 bp, Artificial
  Hairpin sequence HS_from_MQbrain_572, human; PT_from_MQbrain_572, chimp
tgttatggtcctttctttttataagcaggagtctctttctgacctgctgtctccatgttggagcaagggaaagagccctggactgtggagagttaagtgaaaataaca

SEQ ID NO: 3020 - DNA, 57 bp, Artificial
  Hairpin sequence HS_from_MQbrain_573, human; MQbrain_573, macaque; PT_from_MQbrain_573, chimp
ggcctctccttggtggtgggcttggttctttacatctccagcatcaacgacgaggtc

SEQ ID NO: 3021 - DNA, 96 bp, Artificial
  Hairpin sequence HS_from_MQbrain_574, human
aagtccagagactttcagatttcagccctggcactgtctcccattctcagaggagacagggcagagccagaggctgatcaggctgtgggtggactt

SEQ ID NO: 3022 - DNA, 73 bp, Artificial
  Hairpin sequence HS_from_MQbrain_575, human
ctccatgggcctggaggcagccacggccgtggtgagtgccagggccgggccattgggctctgggactcagggg

SEQ ID NO: 3023 - DNA, 102 bp, Artificial
  Hairpin sequence HS_from_MQbrain_576, human
ggcgtttgacatgagtggggtcaggggatctctggctgaggctgtgggcagccccccacctgcagccacaccaactcccacgccccccacccggaagacgcc

SEQ ID NO: 3024 - DNA, 65 bp, Artificial
  Hairpin sequence HS_from_MQbrain_578, human
cctagagaatcagggcacctgccaggggttatttagacccgcgggtggggatctggtgccgtagg

SEQ ID NO: 3025 - DNA, 88 bp, Artificial
  Hairpin sequence HS_from_MQbrain_579, human
ctgggtgcggggactgagtctgggatgggtacccttctcattagtaagatccgggaggagtatccagacaggatcataaaccattcag

SEQ ID NO: 3026 - DNA, 116 bp, Artificial
  Hairpin sequence HS_from_MQbrain_58, human
ggcaagttacaggggagtggggtgtccctggcctctaagaagtcccgactgtcctcctcttctagcaatgacagtgggaataaggttggcatccagcttcccgaggtggagctgtc

SEQ ID NO: 3027 - DNA, 103 bp, Artificial
  Hairpin sequence HS_from_MQbrain_580, human; PT_from_MQbrain_580, chimp
aagaggaggctgctgaggatgagggtggagaagaggatttggccagtgagctaagggtctctggtgaaaatggctctctggaaatgcccagcagccatatctt

SEQ ID NO: 3028 - DNA, 107 bp, Artificial
  Hairpin sequence HS_from_MQbrain_581, human
ctattattaattgaattttgtgtttgaccagagcccttgaatacttataacttttcagtttcaaggctctggatgatacatcactaactattgttcaaccttgatag

SEQ ID NO: 3029 - DNA, 108 bp, Artificial
  Hairpin sequence HS_from_MQbrain_582, human
tctgttttccctccatcctcttctaatctttctcctttttatcctggcactctcatcagccccccagaagaggatttgaataggaagactttgggattgggagccaga

SEQ ID NO: 3030 - DNA, 98 bp, Artificial
  Hairpin sequence HS_from_MQbrain_584, human; PT_from_MQbrain_584, chimp
ggtttctctgggtgaattccaacgaagcatacctaggggtaacagtgaacctacctgggtttgttttgttttggtaaggatttatgtagtgtctggct

SEQ ID NO: 3031 - DNA, 80 bp, Artificial
  Hairpin sequence HS_from_MQbrain_585, human
agggatcttgcccacctcctctttgactctgtggattatccatccatctgctcactgtgaagatggagaggcagtgccct

SEQ ID NO: 3032 - DNA, 79 bp, Artificial
  Hairpin sequence HS_from_MQbrain_586, human; MQbrain_586, macaque; PT_from_MQbrain_586, chimp
gcctgctggtacattacatttccggaggcttgggtgaataatagttttcccagtctccctcggatggtggccttaaggc

SEQ ID NO: 3033 - DNA, 87 bp, Artificial
  Hairpin sequence HS_from_MQbrain_587, human
gtgaactgagttgtgtgccacttgtgtgtaatttttggtacaggtacccctgtccttcacagataagtgacacacctccttattcat

SEQ ID NO: 3034 - DNA, 68 bp, Artificial
  Hairpin sequence HS_from_MQbrain_59, human
tctcaggaggaggctgccctgaggggctggggagggggtacctcatgaggaccagggtggagctgaga

SEQ ID NO: 3035 - DNA, 98 bp, Artificial
  Hairpin sequence HS_from_MQbrain_590, human
gcagggagcaggtcttacccattgagcctgcagcactcctggcctggctcaggagagccagtgggggctgctggccctgggatggtacctcccccagc

SEQ ID NO: 3036 - DNA, 68 bp, Artificial
  Hairpin sequence HS_from_MQbrain_592, human
agtgtcgtccgtgagtgcttggctggtgttcaagtgcatcttccagcctgagaccgcgtggactcgct

SEQ ID NO: 3037 - DNA, 96 bp, Artificial
  Hairpin sequence HS_from_MQbrain_593, human; MQbrain_593, macaque; PT_from_MQbrain_593, chimp
aggcattcgatgagatctccgacgatgccaaggatttcatcagcaatctgctgaagaaagatatgaagtaatgagttgggatttcagtctttgctt

SEQ ID NO: 3038 - DNA, 66 bp, Artificial
  Hairpin sequence HS_from_MQbrain_594, human
tttttccctacactggttgcagggggagggagcctgccagctgcgaggacctctgtggtggaggag

SEQ ID NO: 3039 - DNA, 95 bp, Artificial
  Hairpin sequence HS_from_MQbrain_596, human
acttggatgcctgcagccagctctcagctgggccacacaagagccacctccatcctgggtccagcgggagagagcgctgttcccctccaccaggt

SEQ ID NO: 3040 - DNA, 77 bp, Artificial
  Hairpin sequence HS_from_MQbrain_597, human
gtcccacctaaaaacaggcacattgggttagttccattagacccactgatggaactgtgcctgtacagccccaggac

SEQ ID NO: 3041 - DNA, 71 bp, Artificial
  Hairpin sequence HS_from_MQbrain_599, human
cgcccgggctctcgacgcgccgacggccgggcggacggacggacggacgccgagcgcagtgccccgcggtg

SEQ ID NO: 3042 - DNA, 70 bp, Artificial
  Hairpin sequence HS_from_MQbrain_6, human; PT_from_MQbrain_6, chimp
cccagctggtggatccggtggcgctgagcttcaagaagctgaagaccattttggagtgccgggggttggg

SEQ ID NO: 3043 - DNA, 104 bp, Artificial
  Hairpin sequence HS_from_MQbrain_600, human
gctctctcctgagcctgtgatctgcctgtggcttgctgcagagtacggctgctctcactgctgcacaggccacggccggagcaatgcgctggacaggggagggt

SEQ ID NO: 3044 - DNA, 79 bp, Artificial
  Hairpin sequence HS_from_MQbrain_603, human
agcagcttcctttgagagctacctgtgaggcaggacttgttcctatgcctaacacagtagctggcagataacagatgct

SEQ ID NO: 3045 - DNA, 75 bp, Artificial
  Hairpin sequence HS_from_MQbrain_604, human
cttgaaaggagacttctgggctgggtgggcctgtgtggtctttcccagtcccattgggttgaggtttcctggaag

SEQ ID NO: 3046 - DNA, 71 bp, Artificial
  Hairpin sequence HS_from_MQbrain_605, human
gcctctgggagcacctgctctgttctagcctggcatcagatgtaggggtggcaagacgaaggtgccagggt

SEQ ID NO: 3047 - DNA, 70 bp, Artificial
  Hairpin sequence HS_from_MQbrain_606, human; PT_from_MQbrain_606, chimp
gcgggcacctcctacctgggcaaggaacactggaagacgtgcttcgtggtgctcaggtgggagccctggc

SEQ ID NO: 3048 - DNA, 104 bp, Artificial
  Hairpin sequence HS_from_MQbrain_608, human
tgatatataagccagtttaatgttttctatacagaccctggcttttcttaaattttatatattggaaagcccatgtttgtattggaaactgctggtttctttca

SEQ ID NO: 3049 - DNA, 72 bp, Artificial
  Hairpin sequence HS_from_MQbrain_609, human; PT_from_MQbrain_609, chimp
tatgtaaaataaactcagggctgcgggtgatgagggctgggattacccaggccccagtcactgagctacata

SEQ ID NO: 3050 - DNA, 108 bp, Artificial
  Hairpin sequence HS_from_MQbrain_610, human
tcaggccttgttttaaccctcttgttgtcactgctgtaggtcagaggcctggcttcaagtactggtatgacaaggagtggctgagcaggggacatatgcatggcctgg

SEQ ID NO: 3051 - DNA, 105 bp, Artificial
  Hairpin sequence HS_from_MQbrain_612, human
ctattggccagaagcatctgggaaggcagcccacccctcctttctgcagtcattgattaaggcagaagctgaacagtgagcagtcatcccagatgctcaccatgg

SEQ ID NO: 3052 - DNA, 68 bp, Artificial
  Hairpin sequence HS_from_MQbrain_613, human
agagaccatagctggagacctgagtgggaaacataacttttcctgcagctgggaggctgctggtctct

SEQ ID NO: 3053 - DNA, 113 bp, Artificial
  Hairpin sequence HS_from_MQbrain_618, human; PT_from_MQbrain_618, chimp
gggggtgtgctcaggccatgggcagtgccaggacaggttcctgggcagcggggagtgccactgccacgagggcttccatggaacggcctgtgaggtgtgtgagctgggccgct

SEQ ID NO: 3054 - DNA, 117 bp, Artificial
  Hairpin sequence HS_from_MQbrain_619, human; PT_from_MQbrain_619, chimp
gcccacttgtatttttcccaccgctctcaggacccaagtgcccgcatcggccagaactgcagcattggccccaatgtgagcctgggacctggcgtggtggtcgaagatggtgtgtgt

SEQ ID NO: 3055 - DNA, 88 bp, Artificial
  Hairpin sequence HS_from_MQbrain_62, human
tagagcacagcctctcacctctcacgcactcataagcctgtcaacccagggcttaatgagtgcgccaggtagtattggttagtttcta

SEQ ID NO: 3056 - DNA, 86 bp, Artificial
  Hairpin sequence HS_from_MQbrain_620, human; MQbrain_620, macaque
tgagaagagcagtgaggatgatgtctacctgcacacagtcattccggccgtggtggtcgcagccatcctgctcattgctggcatca

SEQ ID NO: 3057 - DNA, 109 bp, Artificial
  Hairpin sequence HS_from_MQbrain_621, human
gagggctcgggcccgagaccgttcacctccccttatccctgttcccctcttcaggatggagctgacctcaagggaaagagggaggggacagcctctgccctgggaactt

SEQ ID NO: 3058 - DNA, 68 bp, Artificial
  Hairpin sequence HS_from_MQbrain_622, human; PT_from_MQbrain_622, chimp
ctgccctggagcgccaggccacctttgaacgctaccaatgccatgaggagggtctggtgcccagcaag

SEQ ID NO: 3059 - DNA, 95 bp, Artificial
  Hairpin sequence HS_from_MQbrain_625, human
gggattcagctaacagctgtggcagtcaccatggaagatggacacaccatcgctttcctgggtgatagtcaagggcagctgcacagggtgagccc

SEQ ID NO: 3060 - DNA, 114 bp, Artificial
  Hairpin sequence HS_from_MQbrain_626, human
tttgtgctcaaactggactcggagaaacacaagcttttttagaccaccacaataagagctgtggggggatgggagatggggaagaaaagaaagggccaggaagaaagacacaaa

SEQ ID NO: 3061 - DNA, 117 bp, Artificial
  Hairpin sequence HS_from_MQbrain_628, human; PT_from_MQbrain_628, chimp
cattgtagactgagggcggtggcagcgaggctcctctgtgtccgggtccccctgctggggaggagccggccatctctgaggcagcgcctgaagctggcgcccccacttcagccagtg

SEQ ID NO: 3062 - DNA, 70 bp, Artificial
  Hairpin sequence HS_from_MQbrain_629, human; MQbrain_629, macaque; PT_from_MQbrain_629, chimp
agggcatgcaggcctggatggggcagctgggatggtccaaaagggtggcctcaccagccctgtgttccct

SEQ ID NO: 3063 - DNA, 119 bp, Artificial
  Hairpin sequence HS_from_MQbrain_63, human
ggtgtacccggctgtgggccagcgtgtgagctcagggaaggaggggtggccccaggaggtccagccctgccatgcctcctgccctcagctccaggagctgcaccgagctgggggcgacc

SEQ ID NO: 3064 - DNA, 61 bp, Artificial
  Hairpin sequence HS_from_MQbrain_630, human
gccccctacttcctggcggcagctgaatccagagagtattcgaccagggggacctgggggc

SEQ ID NO: 3065 - DNA, 98 bp, Artificial
  Hairpin sequence HS_from_MQbrain_631, human; PT_from_MQbrain_631, chimp
agctacaggcatgatggaggtggtgatggtggctgtgggcaacgcctttgggactcactgccctggccactctagaccagctccagcaggccagggct

SEQ ID NO: 3066 - DNA, 108 bp, Artificial
  Hairpin sequence HS_from_MQbrain_632, human; MQbrain_632, macaque
agatagactgaatttgtatttgtggaaagcggcttggcttggaagattccattgtgcagaactggagtctttactgacccgctttccacatcagcccaaggtcttttt

SEQ ID NO: 3067 - DNA, 82 bp, Artificial
  Hairpin sequence HS_from_MQbrain_634, human; PT_from_MQbrain_634, chimp
ctccttcgctagcttctgctgcctgccttcctggtctttcccaccttcccaccaggacttcaggcccagaggtcctgaagag

SEQ ID NO: 3068 - DNA, 94 bp, Artificial
  Hairpin sequence HS_from_MQbrain_635, human; PT_from_MQbrain_635, chimp
cctgtccacctcccaagcctatcagggatccctggcctcatcctcacaatgggatggggaggaggcttgatggtaagttgggagatgggaaagg

SEQ ID NO: 3069 - DNA, 114 bp, Artificial
  Hairpin sequence HS_from_MQbrain_636, human; PT_from_MQbrain_636, chimp
cctactcaatggcaaggcccggggctgggggtgggggtgcttgttgaatgccacagagcaagtcactagagccagggccctgactcccagcccaggcctctcagggatatcagg

SEQ ID NO: 3070 - DNA, 87 bp, Artificial
  Hairpin sequence HS_from_MQbrain_637, human; MQbrain_637, macaque
gctgggcctctactctctggtgctgagtggggccctggcctatgctggccggggcctccttgaggcttcacaaggtaatggctgtgc

SEQ ID NO: 3071 - DNA, 69 bp, Artificial
  Hairpin sequence HS_from_MQbrain_638, human
gggagccccagacctcagcctcctcatttgctgaggcagggttgggcaggcagagtgtgtagggcaccc

SEQ ID NO: 3072 - DNA, 64 bp, Artificial
  Hairpin sequence HS_from_MQbrain_639, human; PT_from_MQbrain_639, chimp
gccatccctccagaatgcagctgtctcgggtggaggctctgggacagctgcttctggctaaggc

SEQ ID NO: 3073 - DNA, 94 bp, Artificial
  Hairpin sequence HS_from_MQbrain_64, human
gctctggtctcctaaggggcctctgcctgcctgtgagtttgcaatgagggactaactggagcaggtggggtgacccacaggaggtggcctgggt

SEQ ID NO: 3074 - DNA, 89 bp, Artificial
  Hairpin sequence HS_from_MQbrain_640, human
gcttccgcggaggtttcggcggtggcatccggggccagggtcatggccgtggactgggccggagccgaggccatggagctcgcagaggc

SEQ ID NO: 3075 - DNA, 110 bp, Artificial
  Hairpin sequence HS_from_MQbrain_641, human
tttctccctgccttcatgtctaagtcagagtctcctaaagagcctgaacagctgaggaagctcctctttggagggttgagctttgaaacaaccgatgagagcctgaggag

SEQ ID NO: 3076 - DNA, 103 bp, Artificial
  Hairpin sequence HS_from_MQbrain_642, human
ctcctcctcttcctcctccccagggtggagtccatgtccctggctgacagagggaaccctggaaatattacttcgcgcttgatggagaaggagaaggccagag

SEQ ID NO: 3077 - DNA, 115 bp, Artificial
  Hairpin sequence HS_from_MQbrain_644, human
ctcacaggtactgagctgtcaaaagtgcatgaaggcctctcactgtactctagtcctgacttggggtgcagagggctgcttgcaatcctgtttgtaaggctgtgcctgctcagag

SEQ ID NO: 3078 - DNA, 76 bp, Artificial
  Hairpin sequence HS_from_MQbrain_645, human
ggcgaaggcggcagcggcggcgacagctctggggtttgcgtctcggggtgtgtcggccgccgctgctgcttgggcc

SEQ ID NO: 3079 - DNA, 88 bp, Artificial
  Hairpin sequence HS_from_MQbrain_648, human
agtggtggaaggcactggagtcaggaatctctgaatggcaagagtgatcagagaggtctgaaggataggaggatgctgggctgtggct

SEQ ID NO: 3080 - DNA, 76 bp, Artificial
  Hairpin sequence HS_from_MQbrain_65, human
catggcctgtacccagcagagtggtggcaccaccatggttacagcggatgccccgagactctgcttggtaaacgtg

SEQ ID NO: 3081 - DNA, 118 bp, Artificial
  Hairpin sequence HS_from_MQbrain_650, human
tctggcatcttgtccatggcaaatgctggacccaacacaagcagttcccagtttttcatctgcactgcaagattgactggttggatggcaagcatgtggtctttggcaaggtgaaaga

SEQ ID NO: 3082 - DNA, 114 bp, Artificial
  Hairpin sequence HS_from_MQbrain_653, human
gttctggagagtctaggtttgcaggaatccagccaaggacaaggctttgcattttttaaaaagtctaatatttgctttggtgtttcattgcagagacctagatttaatttgaat

SEQ ID NO: 3083 - DNA, 116 bp, Artificial
  Hairpin sequence HS_from_MQbrain_654, human; PT_from_MQbrain_654, chimp
agagatcttctatgtaaggagaaaaacttcacattctgttcccacttcttaatgaaacttcttataaaagtggttctgaagagaaggtgatgcttctgaccttggacaatatttct

SEQ ID NO: 3084 - DNA, 95 bp, Artificial
  Hairpin sequence HS_from_MQbrain_655, human
cgcgctccctccccctcccgctcctctataacttggctggcgtggaggaggcgccgccggagtcggagggcggggagctaggaggagggagctcg

SEQ ID NO: 3085 - DNA, 98 bp, Artificial
  Hairpin sequence HS_from_MQbrain_656, human; PT_from_MQbrain_656, chimp
ccaggtgggctggcagtgccccgggtgcaccttcatcaacaagcccacgcggcctggctgtgagatgtgctgccgggcgcgccccgaggcctaccagg

SEQ ID NO: 3086 - DNA, 92 bp, Artificial
  Hairpin sequence HS_from_MQbrain_658, human
cacaatgtctgagcttggatgtcttttatagatttttaaattattttagtgattattattttattaaaggggtctgggctcactgcctggtg

SEQ ID NO: 3087 - DNA, 81 bp, Artificial
  Hairpin sequence HS_from_MQbrain_659, human
tgcccccggaggtttggggagctggagctgtggtcacaactagggcctgggctcatgcattgaactgatctggctgaggca

SEQ ID NO: 3088 - DNA, 98 bp, Artificial
  Hairpin sequence HS_from_MQbrain_660, human
tgtcggggtgctgccagcgtcccttggtcctgtgcctttggagcctcgggctcctggggtgcagggtgcttgggggtggctgttggagcccaccgacg

SEQ ID NO: 3089 - DNA, 70 bp, Artificial
  Hairpin sequence HS_from_MQbrain_661, human
ggagacggtgagtagtggcgcgcggcggctcggagtacctctgccgccgcgcgcatcggctcagcatgcc

SEQ ID NO: 3090 - DNA, 82 bp, Artificial
  Hairpin sequence HS_from_MQbrain_663, human; PT_from_MQbrain_663, chimp
gttctgtgcttttctctaacaggcaaccattgggattgacttcttgtcaaaaaccatgtacttggaggaccgcacggtgagc

SEQ ID NO: 3091 - DNA, 72 bp, Artificial
  Hairpin sequence HS_from_MQbrain_666, human
ggctgcagcccgggcggacgcgcggagccgagcggggcacggcggcggcagcgacagcggccgggatgagtc

SEQ ID NO: 3092 - DNA, 77 bp, Artificial
  Hairpin sequence HS_from_MQbrain_669, human
ctgtgctgtggaggggagtacagtaattttcagacagagctgaaatgtttgtggctgtgtctcccagaccatgccag

SEQ ID NO: 3093 - DNA, 83 bp, Artificial
  Hairpin sequence HS_from_MQbrain_67, human
gcctgatgccgcggcctgtgattgggagttgctggagtcggtgcttcactcttaaggttccgatcacagactgcggagtgggt

SEQ ID NO: 3094 - DNA, 60 bp, Artificial
  Hairpin sequence HS_from_MQbrain_671, human
ggagacggtcccgccctggcgtcgcagccccgcctagtgcagcctgggtggagcctgacc

SEQ ID NO: 3095 - DNA, 82 bp, Artificial
  Hairpin sequence HS_from_MQbrain_672, human
cctgcctctggccctggtcctgggcggggcctgtgggtggagtagtacccccaggccctgccctgggtgacagactgggagg

SEQ ID NO: 3096 - DNA, 56 bp, Artificial
  Hairpin sequence HS_from_MQbrain_674, human
cttgcagaccggcaccacggcacgcccatgctgctggatggtgtcaagtgtgtggg

SEQ ID NO: 3097 - DNA, 68 bp, Artificial
  Hairpin sequence HS_from_MQbrain_675, human; PT_from_MQbrain_675, chimp
tccatagtctcagacaggtttcagcagagtccacgaaagtatctgtagttgcctgtcaggccaaagga

SEQ ID NO: 3098 - DNA, 64 bp, Artificial
  Hairpin sequence HS_from_MQbrain_676, human
ccccatgctggccgctgccgtccttatagccaaggaaaaccatggcagcctcaggcccaagggg

SEQ ID NO: 3099 - DNA, 85 bp, Artificial
  Hairpin sequence HS_from_MQbrain_681, human
tcgccgcggccctgaggaccccgttctgcccacgcgactgcaaaggcggccccgttgggctgagcgccgagtgcttgggaggcga

SEQ ID NO: 3100 - DNA, 75 bp, Artificial
  Hairpin sequence HS_from_MQbrain_684, human; PT_from_MQbrain_684, chimp
cggggcctgtagtgggcactgggcagtaggaccctgtggtgagccaggtctgctcaggtaacaggaaggtcgttg

SEQ ID NO: 3101 - DNA, 66 bp, Artificial
  Hairpin sequence HS_from_MQbrain_686, human
ccttcttcctggtcaatgactggctttcggtggagacggaggccaacgggggcctggtggagaagg

SEQ ID NO: 3102 - DNA, 62 bp, Artificial
  Hairpin sequence HS_from_MQbrain_687, human
acctgtcaccccgatggcagacacggggcccacacgctggccaccgtggaagccgtacaggt

SEQ ID NO: 3103 - DNA, 107 bp, Artificial
  Hairpin sequence HS_from_MQbrain_688, human
gatgtgctgtgggaggggctgttgcgaggtctggatgggcaggctctcatcggggacagatgcttgtgcaggggggcattcagaggcagccagggcctgggcaggtt

SEQ ID NO: 3104 - DNA, 119 bp, Artificial
  Hairpin sequence HS_from_MQbrain_689, human
gctgtccccacgctggccttcgcctccctgaagtggctttctgcagtgactttgtccattgatctgtttactgccttccctggggccacaagggagcctgccagggtggggcccatggt

SEQ ID NO: 3105 - DNA, 107 bp, Artificial
  Hairpin sequence HS_from_MQbrain_69, human
gtgggttcaccgcctctgctttaatcctccgtgttgtcgctaagtccctgtattaatttgctggggctgccacaacaaaggaccacaagctgggtggtttaaacaac

SEQ ID NO: 3106 - DNA, 88 bp, Artificial
  Hairpin sequence HS_from_MQbrain_691, human
gagttgcttttgccctctttggagccagggtgaattgagggtgttgggcctagtctggcttggccaaggagacaggacttaagtactt

SEQ ID NO: 3107 - DNA, 94 bp, Artificial
  Hairpin sequence HS_from_MQbrain_693, human; PT_from_MQbrain_693, chimp
gcatctccccctccagggcagctccatgggccagatggcggctcagatgggacagcttggccagatggggcagccggggctgggggcagacagc

SEQ ID NO: 3108 - DNA, 87 bp, Artificial
  Hairpin sequence HS_from_MQbrain_694, human; PT_from_MQbrain_694, chimp
cagtttttcctttagtctcctggggttagctagctggatggggcagcttccctgccagccagcagtgggcctcagtagcagaagctg

SEQ ID NO: 3109 - DNA, 79 bp, Artificial
  Hairpin sequence HS_from_MQbrain_697, human
gggcttgaggctgagtgccctgtccttgcatgctggagacagacagaggagcagagggaccgggccatgtgcctggctc

SEQ ID NO: 3110 - DNA, 91 bp, Artificial
  Hairpin sequence HS_from_MQbrain_698, human; PT_from_MQbrain_698, chimp
ggactgtgcacggagagtgagtgggggttctggggagggggctctgcccagccctgccttgccctaggccctcacctggcctccccggtct

SEQ ID NO: 3111 - DNA, 92 bp, Artificial
  Hairpin sequence HS_from_MQbrain_699, human
ggtggaagacctcttcctgggtagatgccacctcagggctacagccatatggtgggtggtgtggatgcctgggaagccaagtgtttgctgct

SEQ ID NO: 3112 - DNA, 101 bp, Artificial
  Hairpin sequence HS_from_MQbrain_70, human
aggcaggatggtggggacagcagggggctactgccatccagaagttacagttggattgggaagaagcagccagatcccccgctgttctcactcatcttctt

SEQ ID NO: 3113 - DNA, 108 bp, Artificial
  Hairpin sequence HS_from_MQbrain_701, human
ctgtggcagaggtgcaggctggcaggaatggatgtgccctgggctgctgcaagctcctgtccccaatcacatccattcatgcagcccaactgcctccaggggcctcag

SEQ ID NO: 3114 - DNA, 92 bp, Artificial
  Hairpin sequence HS_from_MQbrain_706, human
ccactcataggcaggatcctgtgaggccccagggaggagggccttggaggtcagtttccttgggtagcctcccagcagcatcctggtgaggg

SEQ ID NO: 3115 - DNA, 97 bp, Artificial
  Hairpin sequence HS_from_MQbrain_707, human
ggtctgaggcccaggctgctgctggaggggagggggctggctgtgcctcacgctgggccccctcccctccagctctgcgccgaggatgtgaaggact

SEQ ID NO: 3116 - DNA, 87 bp, Artificial
  Hairpin sequence HS_from_MQbrain_708, human; MQbrain_708, macaque
ggccgctcgtggcctccggggagcaggcgccaggggtttgtgtgcggtgggggcctgggcctgggcctggggaagctgacgccggtc

SEQ ID NO: 3117 - DNA, 70 bp, Artificial
  Hairpin sequence HS_from_MQbrain_709, human; MQbrain_709, macaque; PT_from_MQbrain_709, chimp
tggatcttggggaatcccaccagctacaggcaaacctcctggtacaggctggctggggggacctatacca

SEQ ID NO: 3118 - DNA, 77 bp, Artificial
  Hairpin sequence HS_from_MQbrain_71, human
cagcaggtgctctctacagtctctgtgcctgccccctgtggagctgtgcagggcctgggagttctgatgctttgctg

SEQ ID NO: 3119 - DNA, 108 bp, Artificial
  Hairpin sequence HS_from_MQbrain_710, human
gggtggggatggccatgtgtgcagcctgctgtgggcaggagggaaactaagggggtccttgacttgctcccctcccttagctggcagctcaagtggtcttggtcactt

SEQ ID NO: 3120 - DNA, 52 bp, Artificial
  Hairpin sequence HS_from_MQbrain_712, human; MQbrain_712, macaque
gggagaggggagcaggtgacagctcagctgcagatatgtgctcctgtctccc

SEQ ID NO: 3121 - DNA, 74 bp, Artificial
  Hairpin sequence HS_from_MQbrain_713, human
gggagctgggtgctgctggctcttggtgtccatgaggccatcttgttggagcctgacagtgcctgggacctcct

SEQ ID NO: 3122 - DNA, 95 bp, Artificial
  Hairpin sequence HS_from_MQbrain_714, human
ccccagatcccctcctcctcgccatcccattctgccccctccccaccctgggtacagaaagggactgaagtgttgggcagagagggggcttaagg

SEQ ID NO: 3123 - DNA, 119 bp, Artificial
  Hairpin sequence HS_from_MQbrain_715, human
ggttgtgttgaagtcccctggacagtgggcaggggtggcagaggacacgagcagccactgcccgtaccccctctcctctctgtaagcccatgccctgtcttcccagggacttgtgagcc

SEQ ID NO: 3124 - DNA, 61 bp, Artificial
  Hairpin sequence HS_from_MQbrain_716, human; MQbrain_716, macaque
gcgcctgtcacccatggccttccgggccctgcagggctgtggggctgtgggggaccggggt

SEQ ID NO: 3125 - DNA, 102 bp, Artificial
  Hairpin sequence HS_from_MQbrain_717, human; HS_from_PT_61, human; PT_61, chimp
ccagtgctgggcctgccccagggcctgtggtcactgctgagggactgcatccatcccttccctcacccactggcaatagcacccccttgggttccagcaagg

SEQ ID NO: 3126 - DNA, 104 bp, Artificial
  Hairpin sequence HS_from_MQbrain_719, human
ccttgggccttagctcctcccctctacatccattgcctgtctgttttctctccacagcttaactctggctactatgtatctgggagctcctcaggcttccaggg

SEQ ID NO: 3127 - DNA, 115 bp, Artificial
  Hairpin sequence HS_from_MQbrain_72, human; PT_from_MQbrain_72, chimp
gtcacctccccatgggcctctccttccgggtgctggctatgctggggtcttggggtctcttaccttcccttgactttgtgctgctcccttggacagtctttagtggaggggtgat

SEQ ID NO: 3128 - DNA, 92 bp, Artificial
  Hairpin sequence HS_from_MQbrain_721, human
gctaccctcctgtgagagtctgaaggacactattgccaaggctctgcccttttggaatgaagaaatagttccccagatcaaggaggggaagc

SEQ ID NO: 3129 - DNA, 84 bp, Artificial
  Hairpin sequence HS_from_MQbrain_722, human
aggaattcagcttcctctcaaaagccatggttgcgaggtcgcgtgtttaacctcgcactggctgctgagggaattaacaggcct

SEQ ID NO: 3130 - DNA, 59 bp, Artificial
  Hairpin sequence HS_from_MQbrain_723, human; MQbrain_723, macaque
ctggacgaccagtgcttcgtccacccctgcactggtgtgggcgagtgtcggtcttccag

SEQ ID NO: 3131 - DNA, 70 bp, Artificial
  Hairpin sequence HS_from_MQbrain_724, human
gcctgggggtggtgagtggggtgtggggtgtgcgtgtgcatgtagatcacactgatattggccatcaggc

SEQ ID NO: 3132 - DNA, 79 bp, Artificial
  Hairpin sequence HS_from_MQbrain_728, human
gcacgatgtgtgtcctcgggccctgccccatcctggtcccaggactgctggcagcctggcagagtgggcacactcctgc

SEQ ID NO: 3133 - DNA, 70 bp, Artificial
  Hairpin sequence HS_from_MQbrain_731, human
tcctgggtggggttctcctagtggtctgagtgtgccaccaggtctgcagggaggaggaatccatgcagga

SEQ ID NO: 3134 - DNA, 87 bp, Artificial
  Hairpin sequence HS_from_MQbrain_732, human
gcctctgtcactgtggccagctgccgcgccacgcaggatgaggttctgtctgtgtctgtgagcacccagctctgccacagggccggc

SEQ ID NO: 3135 - DNA, 71 bp, Artificial
  Hairpin sequence HS_from_MQbrain_734, human
ggcgcgagcgggctggccgaggaggaggcggcggcgtggagctgcctcctgccggcgggccgggccgggcc

SEQ ID NO: 3136 - DNA, 112 bp, Artificial
  Hairpin sequence HS_from_MQbrain_736, human; PT_from_MQbrain_736, chimp
aggtggcctcattcacttttttggcaggggctgggagcataggcagggtggccaccctaggccttgccacctgcatccttcctgccccagccacagtccaggcctttttcct

SEQ ID NO: 3137 - DNA, 115 bp, Artificial
  Hairpin sequence HS_from_MQbrain_737, human
gggcacactggtccaggaagtgggtgaggcgggcacgcagggctggggccagctcatgcttggccaagctccgcaggctctcctcggctgcccggctccggcgctccagctgccc

SEQ ID NO: 3138 - DNA, 57 bp, Artificial
  Hairpin sequence HS_from_MQbrain_738, human; MQbrain_738, macaque; PT_from_MQbrain_738, chimp
gatgcctgccacttaccccagaaccagacggatgggggtgaggtggtccaggatgtc

SEQ ID NO: 3139 - DNA, 73 bp, Artificial
  Hairpin sequence HS_from_MQbrain_739, human
tggcccacctcaggtgcctactgccacctctgcactgtccctggagctgcaggaagtggagcccctggggcta

SEQ ID NO: 3140 - DNA, 99 bp, Artificial
  Hairpin sequence HS_from_MQbrain_74, human
tctgtcttctgcatttcagacctatgagcagaggaaaatcgtggagttcacctgccacacagccttcttcgtcagtatcgtggtggtgcagtgggccga

SEQ ID NO: 3141 - DNA, 112 bp, Artificial
  Hairpin sequence HS_from_MQbrain_740, human
gagcagtcttttcattagagcacacttggtctaaatgagtttggagtggttgtaatagccattcctgcactgttatttataaaggtgaaatctgatgtgagtatttttgttc

SEQ ID NO: 3142 - DNA, 117 bp, Artificial
  Hairpin sequence HS_from_MQbrain_741, human; PT_from_MQbrain_741, chimp
aattgttaaagtcaggtttctttctgttactgactctaggtctatccagatggcattcggcacatacgagcagacaagagagtcaatgagtggaagacccctggaaagaaaacaatt

SEQ ID NO: 3143 - DNA, 66 bp, Artificial
  Hairpin sequence HS_from_MQbrain_743, human; PT_from_MQbrain_743, chimp
ggcagcctaggaaggcccctgacctcacagatactgggaggggcagggagtgtgctgggggcttcc

SEQ ID NO: 3144 - DNA, 95 bp, Artificial
  Hairpin sequence HS_from_MQbrain_744, human
gcatttgaaggaattagagggttatgtggaatgaaaatgtaagtaaagaaagattatatgttctgttacagcagcctagagaattcagcaggtgc

SEQ ID NO: 3145 - DNA, 96 bp, Artificial
  Hairpin sequence HS_from_MQbrain_745, human; PT_from_MQbrain_745, chimp
tggttgttctctcccctgcatcctccaggagagcgaagaggaactttactcctcctgtcgccagctgaggaggcggcaagaagaactgaacaacca

SEQ ID NO: 3146 - DNA, 71 bp, Artificial
  Hairpin sequence HS_from_MQbrain_747, human; PT_from_MQbrain_747, chimp
cagtcctcaggccaccagctgaggggaggggacatttgtgatgtcttctgaaagctggtgttggagagctg

SEQ ID NO: 3147 - DNA, 68 bp, Artificial
  Hairpin sequence HS_from_MQbrain_748, human
gagtttggtaacactgggttccctgccgtcccagactcccggggcagcccacagagcttatcagactt

SEQ ID NO: 3148 - DNA, 100 bp, Artificial
  Hairpin sequence HS_from_MQbrain_750, human
gggctgctgaccgggagaccagccagagcacgagggggtcagggctgtgtgggttttggcctgattctgcatttggttgtttctgggggccatgtagcct

SEQ ID NO: 3149 - DNA, 110 bp, Artificial
  Hairpin sequence HS_from_MQbrain_751, human
ccgtgggtaccgatggatgtggccgagagccctgaacgggatcctcactctccagaggatgaagagcagccacagggactctcggacgatgacattctgagggacagcgg

SEQ ID NO: 3150 - DNA, 100 bp, Artificial
  Hairpin sequence HS_from_MQbrain_753, human
agctcaccactcgtgctcaggccagggcttagggtggagccccagcccgtgtgattcacctgctcctcccacaatccggccacaggacaagtgagaagct

SEQ ID NO: 3151 - DNA, 70 bp, Artificial
  Hairpin sequence HS_from_MQbrain_755, human; PT_from_MQbrain_755, chimp
ctgcccgagggccgctcttctccaaccccagccctgaggggggattggcaggagaagcagcccagcccag

SEQ ID NO: 3152 - DNA, 63 bp, Artificial
  Hairpin sequence HS_from_MQbrain_756, human
cctccccctggcagcctgctgggtgccctcctcgcgtccccaaccaggttgcagcgggtgggg

SEQ ID NO: 3153 - DNA, 70 bp, Artificial
  Hairpin sequence HS_from_MQbrain_759, human
ggcccgtccacaggcccggctctgggccacgtgccccggaagcaggtgtgtccagagtcagctgagggct

SEQ ID NO: 3154 - DNA, 79 bp, Artificial
  Hairpin sequence HS_from_MQbrain_76, human; PT_from_MQbrain_76, chimp
tgtggatttgaggggaaagggctcttaaggtgcctggggtgcaccccctgaggcactggagcccagccttctgttcccg

SEQ ID NO: 3155 - DNA, 91 bp, Artificial
  Hairpin sequence HS_from_MQbrain_760, human
cctcggtgctgcccttgacctgccccgtccctactgctgcaggcctatgaaggggtgctgcagctggtggaggctcgcgggcgctacgagg

SEQ ID NO: 3156 - DNA, 78 bp, Artificial
  Hairpin sequence HS_from_MQbrain_765, human
agcaggagaagacagagaaggctgcaggaggcctttgttgctcagcaggggactctgccctccctccttccttttgct

SEQ ID NO: 3157 - DNA, 109 bp, Artificial
  Hairpin sequence HS_from_MQbrain_766, human
tgcgcctgcaccaggagacagacacagaaggtggcaggaggcctttgttgctcagcaggaggctctgcccttgctccttccttcttgcttctcatagccccagtgtgca

SEQ ID NO: 3158 - DNA, 85 bp, Artificial
  Hairpin sequence HS_from_MQbrain_768, human
gaatgatctttggtgccaagctgtgttggatttgaaatgtcctgtcaagtttcagattcacagcttgacatttatatggttattt

SEQ ID NO: 3159 - DNA, 89 bp, Artificial
  Hairpin sequence HS_from_MQbrain_769, human; PT_from_MQbrain_769, chimp
cgcagcttctcatttgacagtaactcgatgcaattcactttgtggaaccaagccacaaagtgaaaagcatcgaattgcagagaacagtg

SEQ ID NO: 3160 - DNA, 101 bp, Artificial
  Hairpin sequence HS_from_MQbrain_77, human
agctccagttgcagctggaacaactgaccatcctgggggctgtgttgctggtcaccttcagcatggcagcgccaggaatttccagccaggccgactttgct

SEQ ID NO: 3161 - DNA, 73 bp, Artificial
  Hairpin sequence HS_from_MQbrain_770, human
tttcacatctctgggctgggggtccacagggcactgacgtgtcctgggatttgaaagccccatctatgtctga

SEQ ID NO: 3162 - DNA, 98 bp, Artificial
  Hairpin sequence HS_from_MQbrain_771, human
tgctgcagggggcttgtccttttaactctcccacaggatggatgtaggcagtgtcacattcattatgctgagagtgaaggttcatcactcctgtatca

SEQ ID NO: 3163 - DNA, 91 bp, Artificial
  Hairpin sequence HS_from_MQbrain_772, human; PT_from_MQbrain_772, chimp
caaaaaataactcatacaaggcattccctggtagtttcatggatcttttcatgagactaccagggaatgccttgtatgagttatttttttg

SEQ ID NO: 3164 - DNA, 70 bp, Artificial
  Hairpin sequence HS_from_MQbrain_774, human; PT_from_MQbrain_774, chimp
aatttgttttgcagctctccaaggaccagttgtttctcaaataactggtccttggggagctcagtggatt

SEQ ID NO: 3165 - DNA, 99 bp, Artificial
  Hairpin sequence HS_from_MQbrain_776, human
cccgggccgtcccccgggctcccagctctgtccagccgcccgcgaccgctgcaggcgcctggacagctcctcctggggaccggggaaagcgctcttggg

SEQ ID NO: 3166 - DNA, 100 bp, Artificial
  Hairpin sequence HS_from_MQbrain_777, human
gttgtgttgggttaagacagttttcagtgtaccgtaaatgttgtgttttcagaaaaagacaaaacgatggtgctgactggttttctgtatattgcacaac

SEQ ID NO: 3167 - DNA, 84 bp, Artificial
  Hairpin sequence HS_from_MQbrain_778, human; PT_from_MQbrain_778, chimp
gagcagcccataggccagggccggattcgggtggggacccagctccgggtgctgggccctgaggacgacctggctggcatgttc

SEQ ID NO: 3168 - DNA, 93 bp, Artificial
  Hairpin sequence HS_from_MQbrain_779, human
tcctaggatgaaaaagccaggccctgtcttttttccttgtctaagcaccatccttgcttaggagagacacggctgtggctctcaggctgtggg

SEQ ID NO: 3169 - DNA, 120 bp, Artificial
  Hairpin sequence HS_from_MQbrain_78, human
tccagtcaggttcttgttttacagaggcgtacactgagaaccagatctttgatttgatttgcttgggtcctaaaatctggttctcagtgtctacatatgtaaaacaacatggtactgtga

SEQ ID NO: 3170 - DNA, 82 bp, Artificial
  Hairpin sequence HS_from_MQbrain_782, human
ttccttcctctccccaccctgcctctgtcccgcaggcgagcgaggacaaagtgaggcagctggtgaaggagatcggccggga

SEQ ID NO: 3171 - DNA, 91 bp, Artificial
  Hairpin sequence HS_from_MQbrain_783, human
gccctccagacataaggaggccagaggctgcaaggagcggggtcgtgaccgcttacaccccttctccacagcccggcccgacctggagggc

SEQ ID NO: 3172 - DNA, 105 bp, Artificial
  Hairpin sequence HS_from_MQbrain_785, human
ggagaaggggcggagagcaagtccagccaggagtgggggctgtggccgaccctcagtcatgccctgccctcacttggttcctacctcgacccgctccctttctcc

SEQ ID NO: 3173 - DNA, 88 bp, Artificial
  Hairpin sequence HS_from_MQbrain_787, human
ccctgggtgtcctctaagccagctgggagacaacagcctgagtccgtgtctgcttctgtattttgtgtggttttagaggatccctggg

SEQ ID NO: 3174 - DNA, 67 bp, Artificial
  Hairpin sequence HS_from_MQbrain_788, human
gcatgtgcatgcatgcgtgttcctgtgcacgttgtgggagtgtgcatgtgcgtgtgtctgcatgtgt

SEQ ID NO: 3175 - DNA, 83 bp, Artificial
  Hairpin sequence HS_from_MQbrain_789, human
tggtcttacggatattgggagtggtgggtctggcctcgaggggttttccaggggccctgcccccactcccccttctcgagcca

SEQ ID NO: 3176 - DNA, 102 bp, Artificial
  Hairpin sequence HS_from_MQbrain_79, human
aggcaagggctgcttgtggttcagagggccctgattaaaaagacttgcagttggaggttttgtttggaatttaaggatcctggtgaacttgtggttgtgttt

SEQ ID NO: 3177 - DNA, 105 bp, Artificial
  Hairpin sequence HS_from_MQbrain_790, human
cgggaggctctcagccaactccgggtgctctgctgtgagtggctgaggcccgagctgcacacgaaggagcagatcctggagctgctggtgctggagcagttcctg

SEQ ID NO: 3178 - DNA, 119 bp, Artificial
  Hairpin sequence HS_from_MQbrain_791, human
caggggagggagtgtggacagtatctggaagttctgggattcaggttgttattaaaataataataataattaaaaactctgaagaaacttgaatttggaggttgacatctcgttcgttg

SEQ ID NO: 3179 - DNA, 99 bp, Artificial
  Hairpin sequence HS_from_MQbrain_792, human
ggaggggggtctggcaagccctcagcctagcccatcagtctctctcttcccccttaccagctgctccgagggccgagggcccacaactccattttctcc

SEQ ID NO: 3180 - DNA, 120 bp, Artificial
  Hairpin sequence HS_from_MQbrain_796, human
ggggaccttccaggccccatgccagcttggctcctccccagaccccaggatcttcatctattagtgaagtctcctgggctgtggggaggggcccgcagttgccggggcactgagatcctt

SEQ ID NO: 3181 - DNA, 74 bp, Artificial
  Hairpin sequence HS_from_MQbrain_797, human; PT_from_MQbrain_797, chimp
cgggcggcgtcggaggatgctgcgggcccggagccgagaggaaagtgctggcccagccctctgagcgctcctcg

SEQ ID NO: 3182 - DNA, 64 bp, Artificial
  Hairpin sequence HS_from_MQbrain_799, human; HS_from_MQbrain_832, human; HS_from_MQbrain_952, human
ttgagccctcgggcgaggttcactggtccgcagggggagggccagggaagtcgcgctgtgccaa

SEQ ID NO: 3183 - DNA, 87 bp, Artificial
  Hairpin sequence HS_from_MQbrain_8, human; PT_from_MQbrain_8, chimp
ctgtggcttctccttaggtgctggtgtttgtccactcccggaaggagactggaaagacagccagggccatccgggacatgtgcctag

SEQ ID NO: 3184 - DNA, 89 bp, Artificial
  Hairpin sequence HS_from_MQbrain_80, human; PT_from_MQbrain_80, chimp
ttaatgatgctggcgaccagggaaattccaaactgctggacttcctatgcaggaaaccaggagctggaccctgggacccttaatcttgg

SEQ ID NO: 3185 - DNA, 85 bp, Artificial
  Hairpin sequence HS_from_MQbrain_801, human; PT_from_MQbrain_801, chimp
gaagaggcagaggaggcaggggaggctctccaggctttggggccgtgacagcagcttgggtctctcctgcttccacaggtacttc

SEQ ID NO: 3186 - DNA, 66 bp, Artificial
  Hairpin sequence HS_from_MQbrain_802, human
aggggcctggagctgcaggatcccaggggaggggtctctctctgcatcccaagccattcagccctt

SEQ ID NO: 3187 - DNA, 83 bp, Artificial
  Hairpin sequence HS_from_MQbrain_804, human
cctttgcagtgggtcagctttgggctgctgagacgggcggcgtgaaggccggcttccagagccctggctggcctttgtagtgg

SEQ ID NO: 3188 - DNA, 67 bp, Artificial
  Hairpin sequence HS_from_MQbrain_806, human
gctttacaccccagaggtcatgctgggtgggtaccacttggcgtatggttcctctggtggtgggggt

SEQ ID NO: 3189 - DNA, 97 bp, Artificial
  Hairpin sequence HS_from_MQbrain_807, human
agcacagtgagtgtgaaggacatccaggcgcacctggctcagggccatgtggccatcgtgctggtgaactcgggggtgctgcactgtgacctgtgct

SEQ ID NO: 3190 - DNA, 115 bp, Artificial
  Hairpin sequence HS_from_MQbrain_81, human
agtgccatgtagatgtggaggaggggaagggaagaccaggcccagtcacaagaaggctggtcactgccttgtgggtgggtttggactaggctttcaggggtccaggtctgggatt

SEQ ID NO: 3191 - DNA, 76 bp, Artificial
  Hairpin sequence HS_from_MQbrain_810, human
caggctggcttctctggggatagaaggaggctggggagtgtcttcacagctccatcctctcctgtgcatgggcgtg

SEQ ID NO: 3192 - DNA, 103 bp, Artificial
  Hairpin sequence HS_from_MQbrain_811, human
ggggtcacatttgatggatatgagaacacccccataaggagctgcaggaccttatctgatccagcctcctgggggaggtctcatcccatgcagagggggcccc

SEQ ID NO: 3193 - DNA, 113 bp, Artificial
  Hairpin sequence HS_from_MQbrain_812, human
gtaattgaagctgtcggtaggctaatagttgataatactagtgtagctcctccaattaaatgcattagtaggtggccagctgtattgttggctgttaatcgtacagctagtgc

SEQ ID NO: 3194 - DNA, 58 bp, Artificial
  Hairpin sequence HS_from_MQbrain_813, human
gcatgctggctccgtccccagggcagtagctctgccctgctttgctgtcagtcactgc

SEQ ID NO: 3195 - DNA, 114 bp, Artificial
  Hairpin sequence HS_from_MQbrain_814, human; PT_from_MQbrain_814, chimp
ccagcctcctgatctgccagggtctgctctgggtgggcactgaccagggtgtcatcgtcctgctgcccgtgcctcggctggaaggcatccccaagatcacaggtgaggctttgg

SEQ ID NO: 3196 - DNA, 97 bp, Artificial
  Hairpin sequence HS_from_MQbrain_816, human
tctcaggaaaagcagcaacctgcagctgggttctaaataagatttccagttttgtccattccatcccagatgcacccaggtgctctcttccttcaga

SEQ ID NO: 3197 - DNA, 70 bp, Artificial
  Hairpin sequence HS_from_MQbrain_817, human
gcaggtcccaaagctgagtgtctctggggctccagggtgggggccccaagcccagttagtcatggcctgt

SEQ ID NO: 3198 - DNA, 95 bp, Artificial
  Hairpin sequence HS_from_MQbrain_818, human
gtcagaagagggagaggaggggctgggggtgaggggccaggccatggccaaggggccagctgcccctcatttatcactctgaccttcacagggac

SEQ ID NO: 3199 - DNA, 94 bp, Artificial
  Hairpin sequence HS_from_MQbrain_819, human; MQbrain_819, macaque; PT_from_MQbrain_819, chimp
ccagttcatctgcccgggacaagccaagtgggtgcggcagaatggcatcgtgttgctgctgccccatggcatggagggcatggtgagcctctgg

SEQ ID NO: 3200 - DNA, 59 bp, Artificial
  Hairpin sequence HS_from_MQbrain_82, human
caggtgctcacctggtgttggcctcagcactggggcagtcagcactgaggtggcttctg

SEQ ID NO: 3201 - DNA, 103 bp, Artificial
  Hairpin sequence HS_from_MQbrain_820, human; PT_from_MQbrain_820, chimp
agaggcctcacggtggggaccgctgtgctgtcgtcacaccctgtggcagcagattgttgcccaggagggtgctgcttcagttgctggtttctgcccttcctct

SEQ ID NO: 3202 - DNA, 90 bp, Artificial
  Hairpin sequence HS_from_MQbrain_822, human; HS_from_MQbrain_823, human
gctgggtcaatttcaggcacagcccagccgagtcaggcgaggtccagaaaggcctgactcgcctggcagcctcaacggtcttgtccccgc

SEQ ID NO: 3203 - DNA, 85 bp, Artificial
  Hairpin sequence HS_from_MQbrain_824, human
aaggctgaccctgcccaccttcctggacctctagccccagccccctaggtggatgcccgggtccgcgaagggcagggttcacctt

SEQ ID NO: 3204 - DNA, 113 bp, Artificial
  Hairpin sequence HS_from_MQbrain_825, human; PT_from_MQbrain_825, chimp
accggagagaccaaggagccaggggctgccggggctgtgagccggaggggcaagctccacactcacccttcaggcacagcttctgtggctgctctggctctgtttcctttggt

SEQ ID NO: 3205 - DNA, 111 bp, Artificial
  Hairpin sequence HS_from_MQbrain_827, human
cggcagtgtcagctggcagcagcagctggctgtgcctgagcctaatgttctccattaagggaacatctgttggctggggcatgggccagacgcagccatgctccacggccg

SEQ ID NO: 3206 - DNA, 108 bp, Artificial
  Hairpin sequence HS_from_MQbrain_828, human
caggagctgccttcattcaggcgggtagctgcactgggcatggggtggtggtgggagcttaccgccacctattcaagctctcagctactcctgaaacgggcagagatg

SEQ ID NO: 3207 - DNA, 47 bp, Artificial
  Hairpin sequence HS_from_MQbrain_829, human
ggcagggtcctcgcggcccatgctggccgctggggacccgcgcagcc

SEQ ID NO: 3208 - DNA, 92 bp, Artificial
  Hairpin sequence HS_from_MQbrain_83, human
ccctctcccgccgcaggctctgggatggtcttggagagtcggaacctcgcccccggcctccatccactgcgcgggcctgcggggagggaggg

SEQ ID NO: 3209 - DNA, 117 bp, Artificial
  Hairpin sequence HS_from_MQbrain_830, human; MQbrain_830, macaque
ctttgagcaagcccttagcgtctctggggcccttctggagagggaaggctacacttttcagcaaaatgccctctctcagcagcaggctcccaatggacacaatggcgactcccaaag

SEQ ID NO: 3210 - DNA, 81 bp, Artificial
  Hairpin sequence HS_from_MQbrain_833, human
ggccttcgggcggttggtctcgttctaccagagcttgctgtcggaagagagaaatggtggaatgacaagccacgtctggcc

SEQ ID NO: 3211 - DNA, 114 bp, Artificial
  Hairpin sequence HS_from_MQbrain_834, human; PT_from_MQbrain_834, chimp
ctggaggtggagcgtcgcttccacctggtgctccttcaagagtacttcgacgagtcgctggtgctgctgaaggacctgctgtgctgggagctggaggacgtgctctacttcaag

SEQ ID NO: 3212 - DNA, 92 bp, Artificial
  Hairpin sequence HS_from_MQbrain_835, human
gacccctcatgctctctggctgggccagtgggcagccctcgcttcccttggatggagctgccctgctggtgcctggtcagagaagaggcctc

SEQ ID NO: 3213 - DNA, 64 bp, Artificial
  Hairpin sequence HS_from_MQbrain_836, human
ccggacagtccccaggggagttctgggttcaaccagcaagagctcttcctcctggctgatctgg

SEQ ID NO: 3214 - DNA, 72 bp, Artificial
  Hairpin sequence HS_from_MQbrain_838, human
agtgtagagctttatgctgaagaggtggccactaggggtctgtgtgccattgcccaggcagagtctctgcct

SEQ ID NO: 3215 - DNA, 103 bp, Artificial
  Hairpin sequence HS_from_MQbrain_84, human
aggcatttcctgggctgggtgggttttctcctgccctggtgtgagcttccttagggaggatccagagcaaggcttagagctcacagcaggctagaaaaggcct

SEQ ID NO: 3216 - DNA, 98 bp, Artificial
  Hairpin sequence HS_from_MQbrain_840, human
gggtctggcgtgcaaaggagggtggttctttggctaatggtggacttgctcctaggcctatcccagagtccctcagctctcctagcaaacaaaatccc

SEQ ID NO: 3217 - DNA, 99 bp, Artificial
  Hairpin sequence HS_from_MQbrain_841, human
ggtcaggaaacagccagcgagagttaggggccttagggcacagggcagttgctccactgaagcagactctggccctggcccttacttgcttcctcaacc

SEQ ID NO: 3218 - DNA, 116 bp, Artificial
  Hairpin sequence HS_from_MQbrain_842, human
ggcttccacggaggttttggcagtggcatccagaaccggggtcgcggccatggacggggctggggccaaggccctggagatcgcggaggcaaggccaaggataaggagtggatgcc

SEQ ID NO: 3219 - DNA, 58 bp, Artificial
  Hairpin sequence HS_from_MQbrain_843, human
ggggaatgcgaggctgcttcccttctgcgtaatcagggtacgcagcctccagttctct

SEQ ID NO: 3220 - DNA, 64 bp, Artificial
  Hairpin sequence HS_from_MQbrain_845, human; MQbrain_845, macaque; PT_from_MQbrain_845, chimp
gtggcctgcggctctgtgctttctgagggatcaccacttactgagcaagaggagagcagtccat

SEQ ID NO: 3221 - DNA, 114 bp, Artificial
  Hairpin sequence HS_from_MQbrain_848, human
cttatactcttcccaccaaagcttccacccttcagtctacgtagatcattgttctgtatccccttgatctatatccttggttgaggaatggaagttctgtggccagcagatagg

SEQ ID NO: 3222 - DNA, 69 bp, Artificial
  Hairpin sequence HS_from_MQbrain_85, human; PT_from_MQbrain_85, chimp
tctgggatgcctgggcttttctggccacagccatacactgacagggccagaagggctgagatgctggga

SEQ ID NO: 3223 - DNA, 110 bp, Artificial
  Hairpin sequence HS_from_MQbrain_850, human; PT_from_MQbrain_850, chimp
catggggcagctcagctgcatacgcaagaagtgaaggagacagacgcggtcgaatgtgacttctttttctttattcttgaaagtggttagtgagggcttggcagctcgtg

SEQ ID NO: 3224 - DNA, 70 bp, Artificial
  Hairpin sequence HS_from_MQbrain_852, human; MQbrain_852, macaque
ggccgctgccgccgccgccgccgcggtttgtcgccagaaggaagatggcggatctggaggagcagttgtc

SEQ ID NO: 3225 - DNA, 88 bp, Artificial
  Hairpin sequence HS_from_MQbrain_854, human
tgcttgactggaggaagtgggtgacttttggctgcttcggtgacccattgtagacgcctcgttacccttcttccttccgcttcaagta

SEQ ID NO: 3226 - DNA, 58 bp, Artificial
  Hairpin sequence HS_from_MQbrain_855, human
gcagcctgccagcagcatgtgcacttggtgcagcgctacctggctgacggcaggctgt

SEQ ID NO: 3227 - DNA, 92 bp, Artificial
  Hairpin sequence HS_from_MQbrain_859, human; MQbrain_859, macaque
ttccctgagatcaggcctggctccttccatggcctgagctccctcaagaagctctgggtcatgaactcacaggtcagcctgattgagcggaa

SEQ ID NO: 3228 - DNA, 90 bp, Artificial
  Hairpin sequence HS_from_MQbrain_86, human
gaagttacggcagggtcacagtgggcagggaggggtgcaggggtgtttggagagcatctctcccttccacttgtgggtggctgaggtatc

SEQ ID NO: 3229 - DNA, 90 bp, Artificial
  Hairpin sequence HS_from_MQbrain_861, human; PT_from_MQbrain_861, chimp
ggccaagcatgggttcctgagggagggacacgcagagcatgggagccctgtctgtctgcacagccctaggaatccgtcagtggagtagcc

SEQ ID NO: 3230 - DNA, 94 bp, Artificial
  Hairpin sequence HS_from_MQbrain_862, human
gggggtctgggtctgctcaggatcatgttttgtagcacctcctgttggaggggtggagggatgttcccctgagccaggctgagactagaacccc

SEQ ID NO: 3231 - DNA, 106 bp, Artificial
  Hairpin sequence HS_from_MQbrain_863, human; PT_from_MQbrain_863, chimp
gcccaggcaacgagcgtgtccccagagccctggctcctttccactctccctcccctggtgtgggaagggtgtcctgggacttgcgggagcccgctttcctccaggc

SEQ ID NO: 3232 - DNA, 108 bp, Artificial
  Hairpin sequence HS_from_MQbrain_864, human
tttgttgaagtgccctccaggatggaggccagcagtccaagttgcaatgccttggcaatgtagcactcacagctggtgcaatctggaggatgattggcacccaacaaa

SEQ ID NO: 3233 - DNA, 87 bp, Artificial
  Hairpin sequence HS_from_MQbrain_866, human
ggaggtaaagatgtgcaagttgtggaaacgctcattctgcagggggtggggagggagagtcctgcagctgaggcatcccttggctcc

SEQ ID NO: 3234 - DNA, 118 bp, Artificial
  Hairpin sequence HS_from_MQbrain_867, human; PT_from_MQbrain_867, chimp
ctagctcataaactccgacttaaaagccagtctcagttactctccctggtacttggaggtcccagtgccagagagagtgactgaggctagcttataagtcggagtttctccaggctgg

SEQ ID NO: 3235 - DNA, 114 bp, Artificial
  Hairpin sequence HS_from_MQbrain_868, human; PT_from_MQbrain_868, chimp
acctgcctctctgccacctctctggggttggctcagcctccaaccgcagctactctgctgatggcaagggcactgagagccacccgccagaggacagctggctcaagttcaggt

SEQ ID NO: 3236 - DNA, 80 bp, Artificial
  Hairpin sequence HS_from_MQbrain_869, human
ggccctctggacccaggagaggagtctgcaggcctcggctgggccggattccgcagattctggcctaggtcctgaatgcc

SEQ ID NO: 3237 - DNA, 84 bp, Artificial
  Hairpin sequence HS_from_MQbrain_87, human; PT_from_MQbrain_87, chimp
ctagtggagtgcagggggctgtttgggtggctcagctgctctctcagtcctgagcttactcaccagctatgcacagccacccag

SEQ ID NO: 3238 - DNA, 73 bp, Artificial
  Hairpin sequence HS_from_MQbrain_870, human
ctcaagggtgaaatgagctggatggctacggtcggaggtgctctgtggctgcacggctcattcataaaacgag

SEQ ID NO: 3239 - DNA, 93 bp, Artificial
  Hairpin sequence HS_from_MQbrain_872, human; PT_from_MQbrain_872, chimp
tgacctaagaacaggatatggtgaggatgtcatggaagagaagagctctttccgtggtattctttggcaagagccatgtctactaagaggtta

SEQ ID NO: 3240 - DNA, 118 bp, Artificial
  Hairpin sequence HS_from_MQbrain_873, human
cgccccgccacgcgtgcgcttaggcgccgctgagcgctgactgggtgcgagtggggaagctgctaacccgacccggattggcgctgaggtggcccgtggggcaggtgagtgcggggcg

SEQ ID NO: 3241 - DNA, 100 bp, Artificial
  Hairpin sequence HS_from_MQbrain_874, human
tccttggttttgtataagcattaaatctcagcagaggtggatatttaaggtggtgagtagtagcagctctgcaggggaagagaaaggcaagatggggaga

SEQ ID NO: 3242 - DNA, 91 bp, Artificial
  Hairpin sequence HS_from_MQbrain_876, human
agaggagaaaggtattatcagtccacgaaactgccttgtgagtcagacctagcaaagtaatttcctgggaatgtgccttactttttccttt

SEQ ID NO: 3243 - DNA, 72 bp, Artificial
  Hairpin sequence HS_from_MQbrain_877, human
cctaaagaaaactgaggagaggggctaagatgaagaggagaccttgaccctgcttgcccctcccctcttagg

SEQ ID NO: 3244 - DNA, 108 bp, Artificial
  Hairpin sequence HS_from_MQbrain_878, human
agcagctgggtgggaggcagggccatgctgagaaggaagtcctgggtggaaggaggctctgatttaccctcttctatttcagtacactctcctgccctgccctgctct

SEQ ID NO: 3245 - DNA, 69 bp, Artificial
  Hairpin sequence HS_from_MQbrain_881, human; PT_from_MQbrain_881, chimp
cagccatgttgagctgcagaggaggccttgtggaaaagttccaggaggtcatcccgcagctgctgcctg

SEQ ID NO: 3246 - DNA, 117 bp, Artificial
  Hairpin sequence HS_from_MQbrain_882, human
catcgacatggtggccgccatccccttcgacctgctcatcttcggctctggctctgaggaggtggggtcagcaaggaggcaggtggtgtagggagaggagaggccaggaatgtggtg

SEQ ID NO: 3247 - DNA, 70 bp, Artificial
  Hairpin sequence HS_from_MQbrain_883, human; PT_from_MQbrain_883, chimp
tcctgggcctgggtttttccaggcactggtggatggcacttctgtgcctggaggaggttttggttaaaga

SEQ ID NO: 3248 - DNA, 103 bp, Artificial
  Hairpin sequence HS_from_MQbrain_884, human
ttaataagaatggatatcggttcctctagctacgtatttcatgtctcctcttatcgggggatggcatgtattatcaggaggagcagtggtctgtgtctgttaa

SEQ ID NO: 3249 - DNA, 108 bp, Artificial
  Hairpin sequence HS_from_MQbrain_885, human
gtgacggccgtggcagcggcttccaagggaccaagctcctgcacgaagtgaggcggcggctgggcttgctggaggagaaggaccagatggaggccgtgcggtgagcac

SEQ ID NO: 3250 - DNA, 91 bp, Artificial
  Hairpin sequence HS_from_MQbrain_886, human
ttgactgcccgcactggcgcctgtctgtgccctggagcattctgcccaggctacgtgggttcaggcaggtggcagcttcccaagtattcga

SEQ ID NO: 3251 - DNA, 77 bp, Artificial
  Hairpin sequence HS_from_MQbrain_889, human
gttggaatggtgacaccatgctggagccaagtgctaacatgccttggttcaagggatggaaagtcactcataaagat

SEQ ID NO: 3252 - DNA, 69 bp, Artificial
  Hairpin sequence HS_from_MQbrain_89, human
catgcagtgcaagtcccgcagtctgacaccatcttggcaattcaggctgatgggacagtggcaggtctg

SEQ ID NO: 3253 - DNA, 73 bp, Artificial
  Hairpin sequence HS_from_MQbrain_890, human
gggtgggacccagggtctccaggtcttgtgaggcttcactcctggcccgaagaccccagacccatcgctgccc

SEQ ID NO: 3254 - DNA, 72 bp, Artificial
  Hairpin sequence HS_from_MQbrain_893, human
ggcatcagcggaggccatgattgagggcggagatgagacattggatcgctcttgtgtggcttccgcatggcc

SEQ ID NO: 3255 - DNA, 57 bp, Artificial
  Hairpin sequence HS_from_MQbrain_894, human
ggggtgagggggaggaacaggaagacttcagtcccagttcctctgacgcatcacccc

SEQ ID NO: 3256 - DNA, 73 bp, Artificial
  Hairpin sequence HS_from_MQbrain_897, human
tctgtagctggcccatggcctgtgctctgttagctggtgcccatggatggcacagtgctcatggagtgacgga

SEQ ID NO: 3257 - DNA, 79 bp, Artificial
  Hairpin sequence HS_from_MQbrain_899, human
cctgtggaggcctgcagggaacaggacttctaaaaggaaatatgtctggaaggctgtggtccaaggccatttttactgg

SEQ ID NO: 3258 - DNA, 78 bp, Artificial
  Hairpin sequence HS_from_MQbrain_9, human
agagcctgtgtttccagagtcagtgcccttgttagcctgcatgtgcaggctggctgatgtgtgaggcatttgtgttct

SEQ ID NO: 3259 - DNA, 75 bp, Artificial
  Hairpin sequence HS_from_MQbrain_90, human; MQbrain_90, macaque
caggtgagacttgccccagcagtctcactcctctttcagaggagtggtggattgggatgaggaggttctaatctg

SEQ ID NO: 3260 - DNA, 108 bp, Artificial
  Hairpin sequence HS_from_MQbrain_900, human; PT_from_MQbrain_900, chimp
tgcagccaatggtttatcttctggagtaggtggtggaggtggcaagatgagacgagaaagaacacgctttgttgcttctaaacctctggaggaggaggtagggttgta

SEQ ID NO: 3261 - DNA, 89 bp, Artificial
  Hairpin sequence HS_from_MQbrain_901, human
gccttcctgagcatgtaacggtgcaggtggtggtcgtgcgggtgagtataaccgagtggtcggcctgcctgtaactccgccagagaggc

SEQ ID NO: 3262 - DNA, 117 bp, Artificial
  Hairpin sequence HS_from_MQbrain_902, human
gatgaggagagaggtacatacctactaatccccagttctcctctcccaccctggctgcctaaggtaggagagaagaactgggaatcagtaggtgtgtacccagactccgaacccatc

SEQ ID NO: 3263 - DNA, 67 bp, Artificial
  Hairpin sequence HS_from_MQbrain_903, human
ccacctttctgtataatgggcttgtttctcagagctgagagtggctgggttgtgctaggaggagtgg

SEQ ID NO: 3264 - DNA, 120 bp, Artificial
  Hairpin sequence HS_from_MQbrain_904, human
gagttttgatgatgctgggaaaagtgactgcgattctgaagaaccgctgccttgcaaggtcaaggacattcagtggttgctggggtccgcagactactgccacccactcaccatcaactc

SEQ ID NO: 3265 - DNA, 98 bp, Artificial
  Hairpin sequence HS_from_MQbrain_906, human
cctgtgctctgtgacagtctgtcctcggcaagctcagtctcctgtgaagaattagatatgggcatctgtgctgtggtaaatactctcacagaggctgg

SEQ ID NO: 3266 - DNA, 89 bp, Artificial
  Hairpin sequence HS_from_MQbrain_907, human
cacagcctttgtacccaacgacggttgcttaaactttattgaggaaaatgatgaagttctggttgctggatttggtcgcaaaggtcatg

SEQ ID NO: 3267 - DNA, 90 bp, Artificial
  Hairpin sequence HS_from_MQbrain_91, human; MQbrain_91, macaque
caggcacagccaccgtgagggtcagcatcctcaaccagaatgaacacagtccccgcttgtctgaggatcccaccttcctggctgtggctg

SEQ ID NO: 3268 - DNA, 77 bp, Artificial
  Hairpin sequence HS_from_MQbrain_910, human
ggagaacaagaaagctcagctggtggtgattgcacatgatgtagatcccatcaagctggttgtcttcttgcctgtcc

SEQ ID NO: 3269 - DNA, 91 bp, Artificial
  Hairpin sequence HS_from_MQbrain_911, human; PT_from_MQbrain_911, chimp
taccccttttccttctgccgtcatgattctccttggcagcagcgttagcagccgcctgagggtgaaaatgtgggtgatggggaagttggta

SEQ ID NO: 3270 - DNA, 93 bp, Artificial
  Hairpin sequence HS_from_MQbrain_912, human
aaggaggtggcagagctgagggcagacccagtttgggagattccaaaacctgtctctgcaatgccatcctcgagcttggacagtcacctcctt

SEQ ID NO: 3271 - DNA, 114 bp, Artificial
  Hairpin sequence HS_from_MQbrain_913, human
gtctttggaaaggccagcttctcacagatctaagggatgcaatttgctggcaaatctttagttggccagtcttgactacatctgatcaaagttgggaagtgagctgctggagac

SEQ ID NO: 3272 - DNA, 58 bp, Artificial
  Hairpin sequence HS_from_MQbrain_914, human
gggctcagaggctgccctgtgctccttctccaggggggcagggctggaccatgagccc

SEQ ID NO: 3273 - DNA, 120 bp, Artificial
  Hairpin sequence HS_from_MQbrain_915, human; PT_from_MQbrain_915, chimp
cactggcagagacctgggacttcttcttcagtgacgtgctgcccatgctgcaggccatcttctacccggtgcaggtgggcagcccagccctggggagggaagcccagtgcccctgctgtg

SEQ ID NO: 3274 - DNA, 119 bp, Artificial
  Hairpin sequence HS_from_MQbrain_917, human
accctatcaagatcatccttatgcctggctgcagctctgtctccacgctggtggctgaggctgctaggatgtggaacctcattgtggtaagcagggctatgggggtcagaagatggggt

SEQ ID NO: 3275 - DNA, 69 bp, Artificial
  Hairpin sequence HS_from_MQbrain_918, human; MQbrain_918, macaque; PT_from_MQbrain_918, chimp
gctctggacggagcccgggtggatttccggtgtgaccccgacttccatctggtgggcagctcccggagc

SEQ ID NO: 3276 - DNA, 111 bp, Artificial
  Hairpin sequence HS_from_MQbrain_919, human
gaggagttcaggacctacctggagggcgagtgcctggagttgctccgcagatacttggagaatgggaaggagacgctacagcgcgcaggtaccaggggccatgggcgcctt

SEQ ID NO: 3277 - DNA, 104 bp, Artificial
  Hairpin sequence HS_from_MQbrain_92, human
gccggagcccccggactcctttggatgggcctggtgctggcgctggcgctggcgctggcgctggcgctggctctgtctgactctcgggttctctgggctccggc

SEQ ID NO: 3278 - DNA, 93 bp, Artificial
  Hairpin sequence HS_from_MQbrain_920, human; PT_from_MQbrain_920, chimp
cagtggctatgtggagatggagtttgagtttgaccggctgagggccttccaggctatgcaggtgagtgagtccggctctcgaggagggctctg

SEQ ID NO: 3279 - DNA, 72 bp, Artificial
  Hairpin sequence HS_from_MQbrain_921, human; PT_from_MQbrain_921, chimp
gaggggtgccatctcgccggggccgaggaggagggaggccccctcctcaagtttgcccaggctggagccctc

SEQ ID NO: 3280 - DNA, 111 bp, Artificial
  Hairpin sequence HS_from_MQbrain_922, human
gcacctcgccgggcagctgccaagtctcctgatctgtcaaaccagaactcagaccaagccaatgaggaatgggagactgcatcagagagcagtgacttcaccagtgagcgc

SEQ ID NO: 3281 - DNA, 62 bp, Artificial
  Hairpin sequence HS_from_MQbrain_923, human
tccagcagttccaggggatgatcagcagagatgcagaccttcccagttgctggggcgctgga

SEQ ID NO: 3282 - DNA, 76 bp, Artificial
  Hairpin sequence HS_from_MQbrain_924, human; PT_from_MQbrain_924, chimp
ggtcttctgtccccactgtggggaggatgcttctgaagctcaagaggtgaccatcccccggggtgacggggtgacc

SEQ ID NO: 3283 - DNA, 71 bp, Artificial
  Hairpin sequence HS_from_MQbrain_925, human
tctgggcaggggcttattgtaggagtctctgaagagagctgtggactgacctgctttaacccttccccagg

SEQ ID NO: 3284 - DNA, 119 bp, Artificial
  Hairpin sequence HS_from_MQbrain_927, human
gtgattcagactcaggctaaggggtcaggccagatggggcaggaaggctccgcaggaccggacccctagaccaccctgccccacctgccccttccccctttgctgtgacacttcttcat

SEQ ID NO: 3285 - DNA, 79 bp, Artificial
  Hairpin sequence HS_from_MQbrain_928, human
aggaagatttttgcagcactctctggagctgaggggagtgaaatttggtccagagaaggcggaaggaaatagttttcct

SEQ ID NO: 3286 - DNA, 55 bp, Artificial
  Hairpin sequence HS_from_MQbrain_93, human
ccttttgggactggcctttgaagctctggccagggatggggtgggggccaaaagg

SEQ ID NO: 3287 - DNA, 101 bp, Artificial
  Hairpin sequence HS_from_MQbrain_930, human; MQbrain_930, macaque
cctcctcgccctggtatgatgccagcaccccatatggggggccctcccatgatgccaatgatgggccctcctcctcctgggatgatgccagtgggacctgg

SEQ ID NO: 3288 - DNA, 74 bp, Artificial
  Hairpin sequence HS_from_MQbrain_931, human; PT_from_MQbrain_931, chimp
ggcctcgtggagccttcctgcggtcctgccatttgccccatcctgtagacagggctgcaggaagcagcccagcc

SEQ ID NO: 3289 - DNA, 66 bp, Artificial
  Hairpin sequence HS_from_MQbrain_932, human
ggcaggcacctgcctgtccacctctgagtccgggtgtcaggatcaaggtgggagtgcagggccgcc

SEQ ID NO: 3290 - DNA, 68 bp, Artificial
  Hairpin sequence HS_from_MQbrain_933, human; PT_from_MQbrain_933, chimp
cagaacagagctgctggaggacagggacctggaccaagtggcctccattgtcctctgggagctttctg

SEQ ID NO: 3291 - DNA, 112 bp, Artificial
  Hairpin sequence HS_from_MQbrain_934, human
ggtggtggtggtgcactgatgtgttgggctttagctttggccgttagggatgtaggagtgtgtccttcctttggagagaagctcagtttgtcaggattgtcctgctcccacc

SEQ ID NO: 3292 - DNA, 96 bp, Artificial
  Hairpin sequence HS_from_MQbrain_935, human; MQbrain_935, macaque; PT_from_MQbrain_935, chimp
ggcactcacctgcccgagtcacccaaattggaagacttttaccgcttctcctgggaagacggtgagaggcctggatgggtggggaggagaggggcc

SEQ ID NO: 3293 - DNA, 83 bp, Artificial
  Hairpin sequence HS_from_MQbrain_936, human; PT_from_MQbrain_936, chimp
ggtctggactggggagtctcatctttctgaccacccaggaacctgtgtggagagagtggctgggccactgtccagccagcgcc

SEQ ID NO: 3294 - DNA, 107 bp, Artificial
  Hairpin sequence HS_from_MQbrain_938, human
ccgtagggagctgcgcactgcggagccctcgcccccgagcgagcctgtctcggactcccaaccgtcagcctcgttccgggccgcggaggccggagcagctcccccgg

SEQ ID NO: 3295 - DNA, 86 bp, Artificial
  Hairpin sequence HS_from_MQbrain_940, human; PT_from_MQbrain_940, chimp
gttccttctggtcctcccatccactgccaccttccattttgtccatctcatgctggccttggtggatgggatggctgtatctagac

SEQ ID NO: 3296 - DNA, 77 bp, Artificial
  Hairpin sequence HS_from_MQbrain_941, human
agtgttggggaagatgggaggttgtgggtgaggcctctaaaggtcctctcccaaactgaccaggctgatgtcaacct

SEQ ID NO: 3297 - DNA, 98 bp, Artificial
  Hairpin sequence HS_from_MQbrain_943, human
ctctggtgcttttctgtgggggtgtgggggaagaggagagaggacagaagttcctggatccttgtttctccctcccaggcttccacaaggtcatggag

SEQ ID NO: 3298 - DNA, 92 bp, Artificial
  Hairpin sequence HS_from_MQbrain_945, human; PT_from_MQbrain_945, chimp
agccaagcactccccctgccaaccagggaggccagcttgctgacctcaggcaaaaagcctctctggttggtcaacagaaagagaggacggct

SEQ ID NO: 3299 - DNA, 78 bp, Artificial
  Hairpin sequence HS_from_MQbrain_946, human; MQbrain_946, macaque; PT_from_MQbrain_946, chimp
agcttcgaggatatgggtgagctgcatcagcgcctgcgcgaggaagaagtagacgctgatgcagctgatgcagctgct

SEQ ID NO: 3300 - DNA, 106 bp, Artificial
  Hairpin sequence HS_from_MQbrain_947, human
cctgcctgcctagaaccgcccctcctgtgctccctggccttggaaggggtatgaaatttccgtcccctttcctccttggggcccaggaggagtggagggtcccggg

SEQ ID NO: 3301 - DNA, 90 bp, Artificial
  Hairpin sequence HS_from_MQbrain_948, human
cccagcctggccaacccttgcagccatgtcttggcctcaagtggaacaagggctccttgaggccagcagggttgggggagttggggtggg

SEQ ID NO: 3302 - DNA, 93 bp, Artificial
  Hairpin sequence HS_from_MQbrain_949, human
gccagcagggttgggggagttggggtgggcctgagcctctttcctgctagagctcttggtcctccctgcctccaccacccatccctgctctgc

SEQ ID NO: 3303 - DNA, 73 bp, Artificial
  Hairpin sequence HS_from_MQbrain_951, human; PT_from_MQbrain_951, chimp
cagagctcctgctcaactgccaatcacaataaattgtggactttggtcagtgagcagacacaggagaatgctg

SEQ ID NO: 3304 - DNA, 82 bp, Artificial
  Hairpin sequence HS_from_MQbrain_954, human
ccagtgcttgggtgctgctgtggcaagggaaacctgccctggggaagggttggtttctcttggctgtgtctcagttgcttgg

SEQ ID NO: 3305 - DNA, 96 bp, Artificial
  Hairpin sequence HS_from_MQbrain_955, human; PT_from_MQbrain_955, chimp
tgcctgtggtgatggaataagaaaagccatatagaggggtgaggaaaagcttttcttaccaagtgtgtgagctgagttttggaggatgattaggca

SEQ ID NO: 3306 - DNA, 100 bp, Artificial
  Hairpin sequence HS_from_MQbrain_957, human
tagtttagataaagctcttcattcagctggaatagattctggtttcataatttttggagctaacctgagtaatccactgaatatgcttttgcctttacta

SEQ ID NO: 3307 - DNA, 74 bp, Artificial
  Hairpin sequence HS_from_MQbrain_96, human; PT_from_MQbrain_96, chimp
ctactttaggggggcatgtttgctgggcagctgaccaaggtgggcatgcagcaaatgtttgccttgggagagag

SEQ ID NO: 3308 - DNA, 96 bp, Artificial
  Hairpin sequence HS_from_MQbrain_960, human
gggagaaagagagagagaaggaaagagagagtggcagagagtgttaacagtgtagtcagatctcaattcttcctcttctactccatctctttcctt

SEQ ID NO: 3309 - DNA, 94 bp, Artificial
  Hairpin sequence HS_from_MQbrain_961, human
ggcaacatttatcggtgctgagatgcaggtctccctgtagataacctaagtggtttctgtgacctagttccctctctaccatgtaaatctggcc

SEQ ID NO: 3310 - DNA, 113 bp, Artificial
  Hairpin sequence HS_from_MQbrain_965, human
ggagatgggtgtatccaggaggccaatggaggaaggagaggaaggttttctgggaagccagctgacatgtcatgctttgtcagtggggcctctgcatggattccctccactcc

SEQ ID NO: 3311 - DNA, 72 bp, Artificial
  Hairpin sequence HS_from_MQbrain_967, human
ttgatcctcactgagaaggccccagggcagcggtcttctccatctccgctgttttggggtcttagggtacag

SEQ ID NO: 3312 - DNA, 93 bp, Artificial
  Hairpin sequence HS_from_MQbrain_968, human
ctttccattctctggtctctgcctttctcagatgcaaggcttaagaaagccttacaagtccggctataacagggccagggagcacgtgggcag

SEQ ID NO: 3313 - DNA, 110 bp, Artificial
  Hairpin sequence HS_from_MQbrain_969, human
gacttctggcctaggacccctcgccttcaggagaatctacacgcatgtatgcatgcacaaacatgtgtgtacatgtgcttgccatgtgtaggagtctgggcacaagtgtc

SEQ ID NO: 3314 - DNA, 93 bp, Artificial
  Hairpin sequence HS_from_MQbrain_97, human
gctgccagaaccgagtccttgtcctgagccctgacacgctgcagctggaggtagcagggggtgggggaatggaattggtgccatgggatgagc

SEQ ID NO: 3315 - DNA, 94 bp, Artificial
  Hairpin sequence HS_from_MQbrain_970, human
cattgtgtccaggaaactctgaggacagagggctaaatccatgaagtttgtgaatggcctgatgatccacagctgggaccctgttaatactatg

SEQ ID NO: 3316 - DNA, 104 bp, Artificial
  Hairpin sequence HS_from_MQbrain_974, human
agcccccaaactgggcatgctggcggggaaggagaaggcagtgtggcccagggtcagcaggcccaccacacaggcctctccatcccctcggcgcctggtgggct

SEQ ID NO: 3317 - DNA, 120 bp, Artificial
  Hairpin sequence HS_from_MQbrain_979, human
actgtttttggctcttgctgctatggaaggacaggagtgagctcccgctcttgacaggaaactctccaggagcagaagctgtaacttcctcatctttgcatcatcagcacccagcccagt

SEQ ID NO: 3318 - DNA, 114 bp, Artificial
  Hairpin sequence HS_from_MQbrain_981, human
ctgagaatttggaattggaatggggtgtgtacggtgtgtgtcggaagggctggaagcgagtttgattttgacacgcggcctgtcaccgcctcagaacgagatcgatgagctgag

SEQ ID NO: 3319 - DNA, 83 bp, Artificial
  Hairpin sequence HS_from_MQbrain_984, human; MQbrain_984, macaque; PT_from_MQbrain_984, chimp
ctcacctcctggatgtcctggtgcagcgtgtctgggttttcattgagctccaggcgagctttctccagggtctcaggggagag

SEQ ID NO: 3320 - DNA, 100 bp, Artificial
  Hairpin sequence HS_from_MQbrain_986, human; MQbrain_986, macaque; PT_from_MQbrain_986, chimp
tgctctgagtccacgtacaggaatgcttggagtgtcttttctgttatttatagggattctcttaaggcacaccagctgcctgttttgcatggtatttgca

SEQ ID NO: 3321 - DNA, 73 bp, Artificial
  Hairpin sequence HS_from_MQbrain_99, human
ctggctgtgcggcccccgctgcttgccaagcttgggaatccagagaggggcagtagtagagtgggccagttgg

SEQ ID NO: 3322 - DNA, 100 bp, Artificial
  Hairpin sequence HS_from_MQbrain_991, human
acgtctccttcatgggcacctgggctccttcttctgtttcagggctccaaggtcctggccaagaaagagctggcctatgtcccaattatcggctggatgt

SEQ ID NO: 3323 - DNA, 114 bp, Artificial
  Hairpin sequence HS_from_MQbrain_992, human
ttctacagtgtgaccctgtgaactaggcttttctacagtgtgactcctgtgaactaggcttttctacagtgtgacttctgtgaactaggcttttctacagtgtgaccctgtgaa

SEQ ID NO: 3324 - DNA, 85 bp, Artificial
  Hairpin sequence HS_from_MQbrain_995, human
gttcctggaggagtgaagaccattgaagccaatgggaagatggtgatccctggaggcatcgatgtccatactcacttccagatgc

SEQ ID NO: 3325 - DNA, 79 bp, Artificial
  Hairpin sequence HS_from_MQbrain_996, human
gggatctgcagcaaagggtggaggaggaagctgggaagaaagcttcacttctctcagctgcctcatctgcagcgctccc

SEQ ID NO: 3326 - DNA, 112 bp, Artificial
  Hairpin sequence HS_from_MQbrain_997, human
cttctgccaaattctaagcatctggatggctgggtttaagttgcatctctgtgtccttcagaccatatgccatagtgccttgtgcctcacggtgacttgtattttgcagaag

SEQ ID NO: 3327 - DNA, 91 bp, Artificial
  Hairpin sequence HS_from_MQbrain_999, human
ggctgggaaccaggcagtgggcggggagggggccaggagagcccagagcaagcaccctgccccaccccaccacacagaacgaccaccagct

SEQ ID NO: 3328 - DNA, 82 bp, Artificial
  Hairpin sequence HS_from_PT_1, human
gtggcagctgaagcgggacaagccagtgaccgtggtgcagtccattggcacagaggtcatcggcaccctgcggcctgactat

SEQ ID NO: 3329 - DNA, 59 bp, Artificial
  Hairpin sequence HS_from_PT_101, human
ccaggggagggaaggggagccgaggtcaacgctgcgcctcggtccctaaccccctccgg

SEQ ID NO: 3330 - DNA, 73 bp, Artificial
  Hairpin sequence HS_from_PT_102, human
gagctggaggggggtctcattctacaaagagagaggtggcccccctttcttgacctcctcctccttcaagctc

SEQ ID NO: 3331 - DNA, 112 bp, Artificial
  Hairpin sequence HS_from_PT_103, human; HSbrain_2, human; MM_from_HSbrain_2, mouse; MM_from_PT_103, mouse; MQ_from_PT_103, macaque; MQbrain_2270, macaque; PT_103, chimp; PT_from_HSbrain_2, chimp
acaattgtctaactttttatttttggtctggctgttgtggtgtgcaaaactccgtacattgctattttgccacactgcaacaccttacagatgtggaagatgtgaaatttgt

SEQ ID NO: 3332 - DNA, 87 bp, Artificial
  Hairpin sequence HS_from_PT_104, human
ctccgggaggcgggcttagaacgccaccgacttgaggaagcccagtacatttcaagttggtcgcggcttgggctccgctttggggag

SEQ ID NO: 3333 - DNA, 88 bp, Artificial
  Hairpin sequence HS_from_PT_105, human
tctaggctctggggggtgccagagcctgaccgtgcagggtcttctctctccctccaccctgactgtgctctgtccccccagggctgga

SEQ ID NO: 3334 - DNA, 80 bp, Artificial
  Hairpin sequence HS_from_PT_108, human
gttggggcaggagtgggctaaggaaacctgctctatgataaatacaggacaggttctcttagctcactcccgcaaatagc

SEQ ID NO: 3335 - DNA, 57 bp, Artificial
  Hairpin sequence HS_from_PT_112, human
ggaagggggtctggcgggatggcagcacattgctgctgtgcccctagcccaccggct

SEQ ID NO: 3336 - DNA, 115 bp, Artificial
  Hairpin sequence HS_from_PT_113, human; PT_113, chimp
cctgtatgagggacgcaaccctggcttctatgtagaggcaaaccctatgccaactttcaaggtacagctcaggcctctgggcataggaagctggggagggtccccagctgcttgg

SEQ ID NO: 3337 - DNA, 89 bp, Artificial
  Hairpin sequence HS_from_PT_114, human; PT_114, chimp
ctggcatatatgatgacttagcttttttccccgacagatcgactatgttgatctaacttttctaagccagtttctgtctgatatgccag

SEQ ID NO: 3338 - DNA, 101 bp, Artificial
  Hairpin sequence HS_from_PT_115, human
ctctgtggggggacagagggctggacgcaagaggtggccaggtggccagatggtgctggccccatggtcatgtctgggtgcttgcctgtccctgtgcagag

SEQ ID NO: 3339 - DNA, 72 bp, Artificial
  Hairpin sequence HS_from_PT_117, human; PT_117, chimp
cttttatatcaggatcaggatctgcagagttattagtatagtgctctgcagatcctggtcctagtatagcag

SEQ ID NO: 3340 - DNA, 106 bp, Artificial
  Hairpin sequence HS_from_PT_118, human; PT_118, chimp
gggcagtgtgtgggaaaagctgcggtgtcatctccatgccagtggctgctcgggccactcacagggtccacatggaagtgatgccgctcttcgccgggtatctccc

SEQ ID NO: 3341 - DNA, 119 bp, Artificial
  Hairpin sequence HS_from_PT_121, human
ctgagcctctgcccccagcagggccactcggaatctgagcctctgcacccagcagggccacttggaatggcatgcgggaggggagcagaagagggccctgtggggcacagcaggcctgg

SEQ ID NO: 3342 - DNA, 119 bp, Artificial
  Hairpin sequence HS_from_PT_122, human
ctggccttcatggggcccctctgtatcccaggagctgatgctgcagatgaacctgctggaactcatccggaagctgcagcagaggggctgctgggcagggaaggcagccctggggctag

SEQ ID NO: 3343 - DNA, 109 bp, Artificial
  Hairpin sequence HS_from_PT_123, human
tcaaatgggagccctccagacataaggaggccagaggctgcaaggagcggggtcgtgaccgcttacaccccttctccacagcccggcccgacctggagggcccccgggg

SEQ ID NO: 3344 - DNA, 76 bp, Artificial
  Hairpin sequence HS_from_PT_125, human; PT_125, chimp
ccctgatccccttgattctgaccctggccgtgaagtcagaagcccagggtcagatatcagggcacaaggcccaggg

SEQ ID NO: 3345 - DNA, 78 bp, Artificial
  Hairpin sequence HS_from_PT_126, human
gtgtcctctggggactcagcttgctctggctgctggattgaattagctgcaggaccaagatgagcccttggtggagac

SEQ ID NO: 3346 - DNA, 72 bp, Artificial
  Hairpin sequence HS_from_PT_128, human
gggcggcttgctcctgccagccatgccttcagggtaggctctgagcaagctggcgaacagccctggctgctc

SEQ ID NO: 3347 - DNA, 71 bp, Artificial
  Hairpin sequence HS_from_PT_13, human
tctctggtttcaatgggtacgattattgtaagcaggatccattcaataatcggacccatttaaaccggaga

SEQ ID NO: 3348 - DNA, 69 bp, Artificial
  Hairpin sequence HS_from_PT_130, human; PT_130, chimp
gcagagcactgctttagagcctctgcgtgtctggctgtggcctcaggggtctagcagcagtgctagagc

SEQ ID NO: 3349 - DNA, 111 bp, Artificial
  Hairpin sequence HS_from_PT_134, human
gttccatgaggcaggacggggttggtggggtcgggcaggagggccggggattggaaggttggccagctctacctcctgcccttcccaccgcaccccaaacttagccttgac

SEQ ID NO: 3350 - DNA, 85 bp, Artificial
  Hairpin sequence HS_from_PT_135, human
gtgccgacaccagaattgggaggaatgaccgtctcaatccaactttaagtcagtcggtcattcttcctggtggtttggtgtccat

SEQ ID NO: 3351 - DNA, 114 bp, Artificial
  Hairpin sequence HS_from_PT_136, human
gggaagggcaggtcagcaaggccggagtgggtccgcagcgtctggaggaaatcttcaagatttcccagattgccgcagacctagtctggagttgtttggaatcctgggcttctc

SEQ ID NO: 3352 - DNA, 108 bp, Artificial
  Hairpin sequence HS_from_PT_138, human
tagcctatggtgttctgcctctgagtgtgtcagagcaggagagggagcagccctggcttccccagcctctcctgccaggcccacctcagaggatgaacacagcagctg

SEQ ID NO: 3353 - DNA, 78 bp, Artificial
  Hairpin sequence HS_from_PT_139, human
acacttcaggtggggatcacatccctttgtcaagcttcatggttccgaggacagggttggggcctccaccctctgtgt

SEQ ID NO: 3354 - DNA, 69 bp, Artificial
  Hairpin sequence HS_from_PT_140, human
ccaggtaccttcagactcagccgtccacttgggtcaccttcccagtgggtggctgtgttgcctgcctgg

SEQ ID NO: 3355 - DNA, 118 bp, Artificial
  Hairpin sequence HS_from_PT_143, human
cagggagtggagaaatgagaaatgaactttgaggctgaatatctgaaaatgcagaattaggattcaaactcagatattcagcctcaaagttcatttctcatttctttattgaattctg

SEQ ID NO: 3356 - DNA, 91 bp, Artificial
  Hairpin sequence HS_from_PT_146, human
gtgctggccagtgccagggggtcaggctcaaggaccagcccaaaggccaggcctgacccttgagcctgatccctagcactgatcccagcat

SEQ ID NO: 3357 - DNA, 111 bp, Artificial
  Hairpin sequence HS_from_PT_147, human
aggtaattccagctgtgttgaagatatccaaaactcacttcctttttctggggtaggaggaaaaaggaagtgagttttggatatcttcttcaacacagctagaattttcct

SEQ ID NO: 3358 - DNA, 75 bp, Artificial
  Hairpin sequence HS_from_PT_148, human; PT_148, chimp
tcagaggaggtcctaggtggggaaagaaacgtggggaaaaggctgcttttccagacctgggacccgattatctga

SEQ ID NO: 3359 - DNA, 95 bp, Artificial
  Hairpin sequence HS_from_PT_149, human; HS_from_PT_150, human
ttctattctttcctgttctatggatgtcattgaacataatggttaagccaactgtccatggtttaatgacatccacagaacagaacagaatagaa

SEQ ID NO: 3360 - DNA, 115 bp, Artificial
  Hairpin sequence HS_from_PT_151, human
tgtggttctgaaatgaattttaatgttgatgcctctgatcagtccatgacttacgagtcacaaggacctgatgagaaaatggtgaaatatattgattcagaagataagagctgtg

SEQ ID NO: 3361 - DNA, 110 bp, Artificial
  Hairpin sequence HS_from_PT_154, human; PT_154, chimp
ggaagaaaggtgaaacccctataatatacaacagatgagacatacctaaatcattgctagcttaggtgtgtctgatctgttgtatattgcaggggtttgccggaacttcc

SEQ ID NO: 3362 - DNA, 104 bp, Artificial
  Hairpin sequence HS_from_PT_155, human
gttctgccgccccacccaccaggatctcatgctgcggcacggctggcgcacaggcgccatcatccccgagctggagcgtgagatccgcatcatcaacacggagc

SEQ ID NO: 3363 - DNA, 74 bp, Artificial
  Hairpin sequence HS_from_PT_156, human
gccccccgggcattgtcaagcatctggagggcctctctgaagaggctatcatggagctgaacctgcccactggt

SEQ ID NO: 3364 - DNA, 79 bp, Artificial
  Hairpin sequence HS_from_PT_157, human
ttcctgcgtgctggatagggaggcctgaaacccagaatctactagatctgtgctccttgggcttccctgtccttaggaa

SEQ ID NO: 3365 - DNA, 86 bp, Artificial
  Hairpin sequence HS_from_PT_158, human
ggccttggaggctccctggagatggtgagggcagggagtgtgctgagtcatgccttgccctctccctctaggacctcagcatggcc

SEQ ID NO: 3366 - DNA, 99 bp, Artificial
  Hairpin sequence HS_from_PT_161, human; HS_from_PT_262, human; HS_from_PT_280, human; PT_280, chimp
gtcccaaaaggccaaactgggaactctagccgtggtccaggagacggagggaacaaagaccactggaaggagtcagataggaaagatggcaaaaaggat

SEQ ID NO: 3367 - DNA, 68 bp, Artificial
  Hairpin sequence HS_from_PT_162, human; PT_162, chimp
ctttgaagtaactgaccctgtgcccttatggactaagtaagggtacagaatgcagttctgttttgaag

SEQ ID NO: 3368 - DNA, 76 bp, Artificial
  Hairpin sequence HS_from_PT_163, human
ggcttcgcattccttcattgaaccagctgtgctaacccagggcttggctggagagatgaaagaccaaggctcagcc

SEQ ID NO: 3369 - DNA, 86 bp, Artificial
  Hairpin sequence HS_from_PT_165, human
ttatgccaaaataagaaaacataccttaaaattaaaatcaatgtggtttgattttaattttaaggtatgtttccttatttcaataa

SEQ ID NO: 3370 - DNA, 60 bp, Artificial
  Hairpin sequence HS_from_PT_168, human
tgtgactggacctctggtcctcattcacattctgtgggaaacacaccagaggtcatcaca

SEQ ID NO: 3371 - DNA, 90 bp, Artificial
  Hairpin sequence HS_from_PT_170, human; PT_170, chimp
aggggtgatgataacagtggtgggagagctggtgaagaaacaaggcactggtacttgaagacttgctctcagctcctggaacaggctcct

SEQ ID NO: 3372 - DNA, 115 bp, Artificial
  Hairpin sequence HS_from_PT_172, human
ccatttgatctttaaaaatatatgttttaatagtgtattttaagtctctatatttttgttattagaatatatagaggctataacctactaccaagcataacagacgtcactatgg

SEQ ID NO: 3373 - DNA, 102 bp, Artificial
  Hairpin sequence HS_from_PT_174, human
tctgaattaagttataagataaaaccaagatttggatgacaatgacaatattgtccatcattgttatccaaatcctggttttatcttataactggttttagg

SEQ ID NO: 3374 - DNA, 75 bp, Artificial
  Hairpin sequence HS_from_PT_176, human; HSbrain_223, human
ggggtagagcagccctcggcggcccggggggcgggcggcggtgcccgtcccggggctgcgcgaggcacaggcgcc

SEQ ID NO: 3375 - DNA, 120 bp, Artificial
  Hairpin sequence HS_from_PT_177, human
gagtccttgagtgagcattaggggagatactcatgaatcagattagccctgaggattagcctctaacagcccagggtcctgcttttatgaacccactccccccaacaagtcagtcaactc

SEQ ID NO: 3376 - DNA, 91 bp, Artificial
  Hairpin sequence HS_from_PT_178, human
cgcgctggtctcttcggtggtcagggatggcgcggaagtcgaacttgcctgtgcttctcgtgccgtttctgctctgccaggccctagtgcg

SEQ ID NO: 3377 - DNA, 115 bp, Artificial
  Hairpin sequence HS_from_PT_18, human; PT_18, chimp
caaagacatagaggacattaaaaagcagaaggttcggatagaggggtcgctgtggtggacgtacaccagcagcatctttttccgaatcatctttgaagcagcctttatgtatgtg

SEQ ID NO: 3378 - DNA, 105 bp, Artificial
  Hairpin sequence HS_from_PT_180, human
ctggtggacaggcccacagcacccagggcaagactgggccactttcagagcctgaaataggaagaggcccactctggcctcagcgtgctttctgcccctctctag

SEQ ID NO: 3379 - DNA, 119 bp, Artificial
  Hairpin sequence HS_from_PT_182, human; PT_182, chimp
gcaattgttgatgctgagtggaacattctctatgacaagttagcaaggatccatcattctggagccaaagttgtcttgtccaaactctccaatggggatgtggtcactcagtactttgc

SEQ ID NO: 3380 - DNA, 68 bp, Artificial
  Hairpin sequence HS_from_PT_185, human; PT_185, chimp
gcttggccgggacctgtatcccaacctggctgaagagaggtctcggtgggagaaggagctggctgggc

SEQ ID NO: 3381 - DNA, 117 bp, Artificial
  Hairpin sequence HS_from_PT_187, human
taggtatttaccatgagatggttgtggtcagttgcacctgataccatgtatccctgaatcatgtgtatttttattagtaatgcagccactaccattgctgatggggtctgtgtccta

SEQ ID NO: 3382 - DNA, 98 bp, Artificial
  Hairpin sequence HS_from_PT_190, human
ggtgagaatgtgcgcctgtgttgaggaggctgggggaggtggatggagcattcggctccacggccttggatgcgcagacttgtggggcctttctcact

SEQ ID NO: 3383 - DNA, 116 bp, Artificial
  Hairpin sequence HS_from_PT_191, human; PT_191, chimp
ctcagctggatgagaggctgagatgggtggccagcttgtacaccagtccctgaactgagctgtttacaggactggggaggctccacccagaaggctttcatttgtactctgctggg

SEQ ID NO: 3384 - DNA, 79 bp, Artificial
  Hairpin sequence HS_from_PT_193, human; PT_193, chimp
tccaaaggccgaggaaagggcgtggcccttcgaacaaacccctcgaattaccacgccccctcctcctggctttgaagga

SEQ ID NO: 3385 - DNA, 68 bp, Artificial
  Hairpin sequence HS_from_PT_194, human
ggtgccccaggacctgggcctgcagggctgcagacatctcccgagctggccccagctcctctggtatc

SEQ ID NO: 3386 - DNA, 57 bp, Artificial
  Hairpin sequence HS_from_PT_195, human; PT_195, chimp
ccagctggggttgctgccctgaacgaactgcgtgtggggccggcacatcctagcagg

SEQ ID NO: 3387 - DNA, 74 bp, Artificial
  Hairpin sequence HS_from_PT_196, human
aggagcctcctctctcagcatggaagtgcttgggtccgctcagaccccagaacatccattgtttgggggttttt

SEQ ID NO: 3388 - DNA, 87 bp, Artificial
  Hairpin sequence HS_from_PT_197, human
ggtctggggaatcgtgggcaagaggtactggggaggacagccatgacaggaagtggaactcacccgcttcgctgcccttcccagatt

SEQ ID NO: 3389 - DNA, 114 bp, Artificial
  Hairpin sequence HS_from_PT_20, human
agaggcaacttggtgagttatagagattgactgggtgcttgacatgtggtgctgctccattaaaacagtgggcagttggtactggggaggtttaggagaatttaagttgtcttt

SEQ ID NO: 3390 - DNA, 113 bp, Artificial
  Hairpin sequence HS_from_PT_201, human
ggtagggacagcagggatggctgtggctctctgcccagtgtataacaagtccctttttttcagggaaagtgctggtgcttcagagtcattggcagacattccatgtttctgct

SEQ ID NO: 3391 - DNA, 107 bp, Artificial
  Hairpin sequence HS_from_PT_203, human; PT_203, chimp
atgtctcaatgcctccattcccaggccagggccccattctgtctgtgggactgtgggttctcagtggaattgttgcctttcttgtcgtggagaaatttgtgagacat

SEQ ID NO: 3392 - DNA, 110 bp, Artificial
  Hairpin sequence HS_from_PT_204, human; PT_204, chimp
gagggtatcagtatcattcattctctctcccctcactggtatgggttcagagcaatgcctagggcccctctctgctcccctgcctagtggggtggtagtggctacctctc

SEQ ID NO: 3393 - DNA, 66 bp, Artificial
  Hairpin sequence HS_from_PT_205, human
ttgagcacttgaatggcctgtttgtctatgggcttgcaaaggacaagcagagttcacagagctcag

SEQ ID NO: 3394 - DNA, 95 bp, Artificial
  Hairpin sequence HS_from_PT_206, human; MQ_from_PT_206, macaque; PT_206, chimp
gcctggagcccagctggaaatgttctagccaaaaaagtttgccaagaaccattgtgtctttttttttgctggaacatttctggttgtgcttctgc

SEQ ID NO: 3395 - DNA, 69 bp, Artificial
  Hairpin sequence HS_from_PT_207, human
actcgcctggctcccttctctccgtctgcctcctggccgcggggcccggagagctgggagccagagggt

SEQ ID NO: 3396 - DNA, 82 bp, Artificial
  Hairpin sequence HS_from_PT_208, human
gggcggcaggagatcttcctgcagcgccatggacccctatctgtccacatggcctgcctctccttcttcttcctggctgcct

SEQ ID NO: 3397 - DNA, 107 bp, Artificial
  Hairpin sequence HS_from_PT_21, human
catcctaaagcatacaggtcctggcatcttgtccatggcaaatgctgggcccaaaacaaatggttcccagtttgtcatctgcactgccaagactgagtggttggatg

SEQ ID NO: 3398 - DNA, 50 bp, Artificial
  Hairpin sequence HS_from_PT_210, human; HSbrain_869, human; PT_210, chimp; PT_from_HSbrain_869, chimp
ccttctcttctcagttcttccccaagttaggaaaagctgagttgagaggg

SEQ ID NO: 3399 - DNA, 85 bp, Artificial
  Hairpin sequence HS_from_PT_211, human
caggtgttggccatcagaagacacactggagcgcatgggcctcttcactgtgtgccaagctcagtcacctctgattcagcccctg

SEQ ID NO: 3400 - DNA, 119 bp, Artificial
  Hairpin sequence HS_from_PT_214, human
ccccttccagccaggctgtcaaggccccaactctggggcagaggcagtggcagggcagccagggttgcgccagagcctgagcagggtgaggtggggtcagacagggctgggagtcaggg

SEQ ID NO: 3401 - DNA, 107 bp, Artificial
  Hairpin sequence HS_from_PT_216, human
tcgtggggggtgcctccccctcctgcgatggtggtcctaagagccagagggggaagaggggctggctctgagtctccgcctcgcgggggttgcctccccccctgcga

SEQ ID NO: 3402 - DNA, 67 bp, Artificial
  Hairpin sequence HS_from_PT_217, human
ctggctctcagtccccgcctcgcagggggtgcctccccccccccgcgttgggggtcctaagagccag

SEQ ID NO: 3403 - DNA, 97 bp, Artificial
  Hairpin sequence HS_from_PT_218, human
tttaggaaggctttctactaatggaattcctggccttgagaggatgttactttagaaggaaaggatttttttgttattaaaaggtaagattcctgga

SEQ ID NO: 3404 - DNA, 110 bp, Artificial
  Hairpin sequence HS_from_PT_219, human; HS_from_PT_220, human
gcagtgtcaggggctgcccagtggtggtgagagcgcagcgtgggtgcagccctggtgaagggcctgggactcacagctctgtgctctgatcatgggctggcccgcgctgt

SEQ ID NO: 3405 - DNA, 69 bp, Artificial
  Hairpin sequence HS_from_PT_22, human; MQ_from_PT_156, macaque; MQ_from_PT_22, macaque
ccggggcattgtcaagcatctggagggtctctctgaagaggctatcatggagctgaacctgccgactgg

SEQ ID NO: 3406 - DNA, 117 bp, Artificial
  Hairpin sequence HS_from_PT_221, human; PT_221, chimp
gcggctggttgacatggcccccaggccatgggagcccaggggaggccctgtggatggaagtgcagacgtgggcatgggtcctgtggagctctggtcccggggggcatggtcagctgc

SEQ ID NO: 3407 - DNA, 112 bp, Artificial
  Hairpin sequence HS_from_PT_224, human
ctacagaatgcacttttgctttcagatagcagccttcacctcttcttacagagccatctgaattcagaagacattgaggcgtgtgtttctgggcagactaagtactctgtgg

SEQ ID NO: 3408 - DNA, 75 bp, Artificial
  Hairpin sequence HS_from_PT_229, human; PT_229, chimp
ggcaggggggctgctcaggggtgagaggtcaggagacacagctccagggtcccctcagcccctgcccacctagcc

SEQ ID NO: 3409 - DNA, 87 bp, Artificial
  Hairpin sequence HS_from_PT_231, human
cctacctaactgggttagggccctggctccatctcctttaggaaaaccttctgtggggagtggggcttcgaccctaacccaggtggg

SEQ ID NO: 3410 - DNA, 103 bp, Artificial
  Hairpin sequence HS_from_PT_234, human
agatatcactagattgtgagcatcttgttggcagaagtgatgttcctggagtctagtaccaggcacatcatttgtgttctctgaatgcttatggaggaaattt

SEQ ID NO: 3411 - DNA, 99 bp, Artificial
  Hairpin sequence HS_from_PT_235, human
gtcccaaaaggccaaactgggaactctagccgtggtccaggagactgagggaacagagaccactggaaggagtcagataggaaagatggcaaaaaggat

SEQ ID NO: 3412 - DNA, 79 bp, Artificial
  Hairpin sequence HS_from_PT_237, human
ccccgcgtttctccccacccccgccaggcgcagcaccccctccctcggctgcgcccggaggggagcagagcggacgggg

SEQ ID NO: 3413 - DNA, 82 bp, Artificial
  Hairpin sequence HS_from_PT_238, human; PT_238, chimp
cggggtgtgggggagaagggcagacagaccctgtggttcattcttacccaggggctgtcaggcctcatgccagggcctcccg

SEQ ID NO: 3414 - DNA, 98 bp, Artificial
  Hairpin sequence HS_from_PT_242, human
gctcttgcttctctccagctactccctgtgaaaggctgctgtgtccctcatgagttcacagtggctaaagtgttgtggcagtggaggagaaagagagt

SEQ ID NO: 3415 - DNA, 114 bp, Artificial
  Hairpin sequence HS_from_PT_247, human; PT_247, chimp
gttaaacacagatgagtaacatgtaagagtcagtgtggaggatcttaacagtgtttattgaataagtagtccagtgatactgctaaagaattacagaactcatgtttgtttaat

SEQ ID NO: 3416 - DNA, 59 bp, Artificial
  Hairpin sequence HS_from_PT_248, human; PT_248, chimp
gcctggtattgggcagttctaggggctctggcaccgaggccctggactcccacccaggc

SEQ ID NO: 3417 - DNA, 81 bp, Artificial
  Hairpin sequence HS_from_PT_250, human
tgtgcccggtgtctctcccaggcacacttgcccctcctgcccattaggggctggggaggctgcccgggagagacggggcca

SEQ ID NO: 3418 - DNA, 95 bp, Artificial
  Hairpin sequence HS_from_PT_251, human
gctgggccttggctgtaggcagctgggcttactgccgggccctgcatacacagcgcctccagtgggagtgacagttggatacagccaggcagggt

SEQ ID NO: 3419 - DNA, 108 bp, Artificial
  Hairpin sequence HS_from_PT_253, human
gccagcaagacaaaaggaacaggggacacttgtaatggagaacactaagctatggactgctatggactgctagtgctctccgttacaagtatcccctgttaccttggc

SEQ ID NO: 3420 - DNA, 82 bp, Artificial
  Hairpin sequence HS_from_PT_254, human; PT_254, chimp
gtggctttttctctgacatttttgcccttctcacaatactgcaaatgtctgcagggtgagcccaactgttagaaatagccac

SEQ ID NO: 3421 - DNA, 57 bp, Artificial
  Hairpin sequence HS_from_PT_255, human
gcccagagaagtggggaagtcctcgcagaaaggactgtttccactgggtgcgtgggc

SEQ ID NO: 3422 - DNA, 117 bp, Artificial
  Hairpin sequence HS_from_PT_256, human; PT_256, chimp
agcttctgtgtacctgcattagaggatcagtttgggcggaactggaaatctgtcttctggctttctgttcagtcctcctgacgctgtttttttctgatgtatgtgtgcttaaaggct

SEQ ID NO: 3423 - DNA, 90 bp, Artificial
  Hairpin sequence HS_from_PT_257, human
caacctagtggacaggagagtatgtgtagatttcatgtaatggtgaaagggcaaataacatgaaatctacaagggatcagtcatgggctg

SEQ ID NO: 3424 - DNA, 73 bp, Artificial
  Hairpin sequence HS_from_PT_258, human
ggggctactatggggactgaggggagctgggctggtaaagcctgaaaaccccatcatcagccagagtagtttt

SEQ ID NO: 3425 - DNA, 86 bp, Artificial
  Hairpin sequence HS_from_PT_26, human
agtaactgcggagtcaggcgcggaggggaacagcgtctctaaccacggcgaccctgttcttctctgggcgcttccactgagttatt

SEQ ID NO: 3426 - DNA, 92 bp, Artificial
  Hairpin sequence HS_from_PT_268, human
gcagcaaagcacacactgcccacagactgatggtgaagttaaatttcaaatattgatcgagcttaggaccattaaggcaggaagtgtgctgc

SEQ ID NO: 3427 - DNA, 91 bp, Artificial
  Hairpin sequence HS_from_PT_269, human; PT_269, chimp
ggcagaggtagggagtttggggagcatcaggatcaagatgcctgaaggatcctgaccctgctcttgctctcaggtattgcctgcctgtgct

SEQ ID NO: 3428 - DNA, 86 bp, Artificial
  Hairpin sequence HS_from_PT_27, human
gcctgggactgcctagctcatgcctacagctccatgccttcaggatatggctgggggctgagggagaagctcaaggagggcttggc

SEQ ID NO: 3429 - DNA, 108 bp, Artificial
  Hairpin sequence HS_from_PT_271, human
gcgctgtggtcgtttggaggtgagccctgaagccccttccactggtaggtgctatccctgcctttgttggggtgctctccttttgcctttccaacacgactgcattgc

SEQ ID NO: 3430 - DNA, 96 bp, Artificial
  Hairpin sequence HS_from_PT_272, human; MQ_from_PT_272, macaque; PT_272, chimp
ggctcagtgttgttgcgagaactggcttgcgcaggcaatgttgctgatgctaccctctcagcccaggccacacctctgctgcatgcactcactgct

SEQ ID NO: 3431 - DNA, 119 bp, Artificial
  Hairpin sequence HS_from_PT_28, human; PT_28, chimp
gccatcatagctacgctggggaacatcgtggtggtgggcgtggtgtatgccttcaccttctgaggacggcacaccctgcaccaccatggggtgaggcttggcacgtagctctgacttgc

SEQ ID NO: 3432 - DNA, 83 bp, Artificial
  Hairpin sequence HS_from_PT_282, human; HSbrain_432, human
gctcggcatctgctgagtaccgccatgtctgttgggcatccacagtctcccaccaggcattgtggtctccgctgacgctttgc

SEQ ID NO: 3433 - DNA, 91 bp, Artificial
  Hairpin sequence HS_from_PT_283, human
tgctgagcccggggcaggggaattgcatctgcaggaaagagatgcagcatgctcctcactcctgagtgcccacctgtcctgcttctctgca

SEQ ID NO: 3434 - DNA, 63 bp, Artificial
  Hairpin sequence HS_from_PT_284, human
gagaaaaggggtgactgtccctcagccaggctccctggcctggggcagcatccacatttcatc

SEQ ID NO: 3435 - DNA, 75 bp, Artificial
  Hairpin sequence HS_from_PT_286, human; PT_286, chimp; PT_from_MQbrain_29, chimp
ggtaaaggggcagggacgggtggccccaggaagaagggcctggtggagccgctcttctccctgcccacagagact

SEQ ID NO: 3436 - DNA, 119 bp, Artificial
  Hairpin sequence HS_from_PT_287, human; HS_from_PT_288, human
gcaggcgagtgtaaactgcacgggcgcgtgtgctcaccgtgtgcgcaggcgagtgtaaacagtgcacgggtgcgtgtgctcactgtgcgcaggcgtctgtaaacagtgcacgggcgtgt

SEQ ID NO: 3437 - DNA, 82 bp, Artificial
  Hairpin sequence HS_from_PT_291, human; PT_291, chimp
gctggtgaagcggcggctgcagcagggcaaggtgaccattgcggagctcatccagccggctgcacgcagccaggtacccagc

SEQ ID NO: 3438 - DNA, 116 bp, Artificial
  Hairpin sequence HS_from_PT_292, human; PT_292, chimp
ggattgggggctggtgccagccttcctctgcagctgacctctgttgtcctccccttgggcggctgagagccccagctgacatggaaatacagttgttggcctccggcctcccctct

SEQ ID NO: 3439 - DNA, 110 bp, Artificial
  Hairpin sequence HS_from_PT_294, human; HSbrain_330, human
taggtggcgtgtatgagtggagacgggcctgggtcttggggactggagggcaggggtccttctgccctggggtcccagggtgctctgcctgctcagccaggcctctcctg

SEQ ID NO: 3440 - DNA, 70 bp, Artificial
  Hairpin sequence HS_from_PT_295, human
gcccagacagaggacagggaagtgtgcaagggtggggaccccctcatcacagcccttgactctgtaaggc

SEQ ID NO: 3441 - DNA, 112 bp, Artificial
  Hairpin sequence HS_from_PT_299, human
ccacccagaggcctgggagggactttgatctggagggtctcctgctgtcaggccttgcctagggctccgcaccctccctccagcccttgagccctccaccttcctcaggtgg

SEQ ID NO: 3442 - DNA, 91 bp, Artificial
  Hairpin sequence HS_from_PT_3, human; PT_3, chimp
gcaaaggggtctctccatcagacctaagtctttcaaagtgttatatatgaattgggatcctggagagtttggaggagggaccaatatatgt

SEQ ID NO: 3443 - DNA, 117 bp, Artificial
  Hairpin sequence HS_from_PT_300, human
cctagtagctgagaaatacattaatatggaagggagaagagctttaatgctctgaaaatgactccaatcattaaagctcttctcccttccatattaataaatttcgcactcaagagg

SEQ ID NO: 3444 - DNA, 91 bp, Artificial
  Hairpin sequence HS_from_PT_301, human; PT_301, chimp
aagaaattggaggccacaggctggacacctgattggaacaagagctatagcctgagcgtccaggtgtccagccaagttcccaacccatctt

SEQ ID NO: 3445 - DNA, 84 bp, Artificial
  Hairpin sequence HS_from_PT_303, human
gctggcgtcggtgctggggagcggcccccgggtgggcctctgctctggcccctcctggggcccgcactctcgctctgggcccgc

SEQ ID NO: 3446 - DNA, 59 bp, Artificial
  Hairpin sequence HS_from_PT_305, human; PT_305, chimp
gtgagctgggagggcagggccaggcaggcaggcaggggcccctgtggtccatggttcat

SEQ ID NO: 3447 - DNA, 69 bp, Artificial
  Hairpin sequence HS_from_PT_308, human
ctgcggggctggccctggcctggctgctgctgcctgcagcccccagctcaggctccctccacctcacag

SEQ ID NO: 3448 - DNA, 73 bp, Artificial
  Hairpin sequence HS_from_PT_309, human; PT_309, chimp
aggatcacaccaccgtgtccaccattaaaggggaaattctttaatggtggacacagtggtgtccctgaatcct

SEQ ID NO: 3449 - DNA, 64 bp, Artificial
  Hairpin sequence HS_from_PT_31, human
gtctccttccatctcctgcacagtgctcctgctccagggagggctgtgttgagagggtagagac

SEQ ID NO: 3450 - DNA, 78 bp, Artificial
  Hairpin sequence HS_from_PT_310, human
agattaatggggatgaggcagagtaactcacaatagaacaaacagttttgagttactttgccttatccccattaattt

SEQ ID NO: 3451 - DNA, 76 bp, Artificial
  Hairpin sequence HS_from_PT_315, human
cgtaaagatgttaggtcaaggtgtagcccatgagctggcaagaaatgggctacattttctacttcagaaaactacg

SEQ ID NO: 3452 - DNA, 120 bp, Artificial
  Hairpin sequence HS_from_PT_320, human; PT_320, chimp
ggtgaatcctaaacagagagaattcgaggttgcctgaaagctgggtgtccttgctccttttcctggagccaatatacccagtttttactcagtttgatttatattctgggcaaggaagct

SEQ ID NO: 3453 - DNA, 99 bp, Artificial
  Hairpin sequence HS_from_PT_321, human; HSbrain_799, human; PT_321, chimp; PT_from_HSbrain_799, chimp
ctggacttggctctaggatgtgctcattgcatgggctgtgtatagtattattcaatacccagagcatgcagtgtgaacataatagagattgaaagacag

SEQ ID NO: 3454 - DNA, 86 bp, Artificial
  Hairpin sequence HS_from_PT_325, human
gggccagcttccctgccctgcctgttttctcctttgtgattttatgagaacaaaggaggaaataggcaggccagggaaacgatctc

SEQ ID NO: 3455 - DNA, 114 bp, Artificial
  Hairpin sequence HS_from_PT_328, human; PT_328, chimp
gctgagccctccagggtaagtggaaagatggtgggccgcagaacatgtgctgagttcgtgccatatgtctgctgaccatcacctttagaagccccctttcgctgaggagccagc

SEQ ID NO: 3456 - DNA, 108 bp, Artificial
  Hairpin sequence HS_from_PT_332, human
ccgcgtgtgtctgtgagtacacggcagggtctcagcctcggccgcgtgtgtctgtgagtacacggcagggtctcagcctcggccgtgtgtcctcgagtacacatcagg

SEQ ID NO: 3457 - DNA, 80 bp, Artificial
  Hairpin sequence HS_from_PT_338, human
gtggctctggtccatttccctgccattcccttggcttcaatttactcccagggctggcagtgacatgggtcaaggctcac

SEQ ID NO: 3458 - DNA, 104 bp, Artificial
  Hairpin sequence HS_from_PT_339, human
tcagtgagttccaagctgggattgagaagggagcagtgaagggaccgggaggttatactttcctctgatgacttcctgttagtgccacgtgtctgggccactga

SEQ ID NO: 3459 - DNA, 111 bp, Artificial
  Hairpin sequence HS_from_PT_34, human
caggaaatgctcaggccacattccccgtttcccgcctctcgccccccaaactcaggtctgggcttggggggcgagaggcgggaaatggggaacaaaagtcggcagtgcctg

SEQ ID NO: 3460 - DNA, 94 bp, Artificial
  Hairpin sequence HS_from_PT_340, human
aggtgatcttagtgctgtacatgatgacaactggctccctctactgaactgccatgaggaaactgccatgtcacccttctgattacagccacct

SEQ ID NO: 3461 - DNA, 118 bp, Artificial
  Hairpin sequence HS_from_PT_35, human
ctgcctcgtggggggtgcctccccctcctgcgatggtggtcctaagagccagagggggaagaggggctggctctgagtctccgcctcgcgggggttgcctccccccctgcgatggggg

SEQ ID NO: 3462 - DNA, 102 bp, Artificial
  Hairpin sequence HS_from_PT_36, human
tggcttgctgggttcagagcactgggcaccaagtctgtgtcttggtgtcattgctattcacacagacattgtgtccaggttcctgcatccagaaacattcca

SEQ ID NO: 3463 - DNA, 98 bp, Artificial
  Hairpin sequence HS_from_PT_37, human
cctctcctacattgagcacatctttgagatctcccgccgtcctgacctactcactatggtggttgactacagaacccgtgtgctgaagatctctgagg

SEQ ID NO: 3464 - DNA, 101 bp, Artificial
  Hairpin sequence HS_from_PT_38, human
ccttcgcctctagaccccagcttggttgctttcttgagatctcacagccacacgcaagagcaaacaggagagacagcctctgaggagcagaggccaggagg

SEQ ID NO: 3465 - DNA, 73 bp, Artificial
  Hairpin sequence HS_from_PT_4, human
accccactatgcttagccctaaactccaatagttaacaacttcaactattggatttcggttagggattagggt

SEQ ID NO: 3466 - DNA, 93 bp, Artificial
  Hairpin sequence HS_from_PT_40, human
agggggcctgaggaatggctcctctgtttacaacacacccaacaggaatctgggatcattgtgacgagaggtaccaaaacttgtaggcttcct

SEQ ID NO: 3467 - DNA, 90 bp, Artificial
  Hairpin sequence HS_from_PT_41, human
gccctgcctcggcggcgcctggcgcgtctggaatgcggggcctccctccgcccctctccccacgccgcctcgccccgctcccgctagggc

SEQ ID NO: 3468 - DNA, 61 bp, Artificial
  Hairpin sequence HS_from_PT_43, human
cacggagtgagtgaggtgccctgggcggtgtggatgcctctgggcctctgactcacacgtg

SEQ ID NO: 3469 - DNA, 78 bp, Artificial
  Hairpin sequence HS_from_PT_44, human
gtgaggtggagtggggttggggtgggagttgggggaaggatccctgagctctcgctggaccctggatctccacttcac

SEQ ID NO: 3470 - DNA, 118 bp, Artificial
  Hairpin sequence HS_from_PT_48, human; HSbrain_645, human; MQ_from_PT_48, macaque; MQbrain_2696, macaque; PT_48, chimp; PT_from_HSbrain_645, chimp
actgagctcttattggctggaaaggaagaagcattctttcattggttggtgtgtattgccttgtcaaccaataagaggatgccatttatccttttctgactagctgagtgagcagggt

SEQ ID NO: 3471 - DNA, 106 bp, Artificial
  Hairpin sequence HS_from_PT_50, human
ggtggcaggcctttgttatctagctgtcacagtactgggtgggctcatcctgagtggatgcccttgcctcttcttctgggacttcttagtggtagcacctgctccc

SEQ ID NO: 3472 - DNA, 82 bp, Artificial
  Hairpin sequence HS_from_PT_55, human; HSbrain_666, human; HSbrain_667, human; HSbrain_672, human; HSbrain_674, human; HSbrain_681, human
cttcagatgccagaagggcagagggaatcccacacgggctggtggatcatgtgtgtgcatttctctcccttctagtctgagg

SEQ ID NO: 3473 - DNA, 101 bp, Artificial
  Hairpin sequence HS_from_PT_56, human
taggcttgaggcagggttagccttggttccagcgcagtctccagcaagtgattaccagcctggaggggagcctgggaccactggctttccaccttctcctg

SEQ ID NO: 3474 - DNA, 89 bp, Artificial
  Hairpin sequence HS_from_PT_60, human; HSbrain_690, human
ctggcactggagcctgggtcaggggagctcaggggcttacctgttgataagctcctctgtcctctccctttcccaggcttcagggaaag

SEQ ID NO: 3475 - DNA, 114 bp, Artificial
  Hairpin sequence HS_from_PT_63, human
cctcccagcctcctactacttctgtttccaaagggagatctctgtggccctctgttgtgccctccgctttgtcattgatctctccatggtgactgatgtgagtggggtgggggg

SEQ ID NO: 3476 - DNA, 98 bp, Artificial
  Hairpin sequence HS_from_PT_64, human; PT_64, chimp
gctggcggctggggcttctcagcctctattccctggctgtcccctttgtttgaagctccagtgagggagcagtggctggggtggcccagcttcaaagt

SEQ ID NO: 3477 - DNA, 87 bp, Artificial
  Hairpin sequence HS_from_PT_66, human
tccctggttctgtgtgctccaagtgccatcaaggccctggggacctcagctcccccaccccctggcttctgggccactccccagtga

SEQ ID NO: 3478 - DNA, 62 bp, Artificial
  Hairpin sequence HS_from_PT_70, human
ctccactttgccctttgggtacaaagaaggaatagaagattccgtggccttgggggcaggag

SEQ ID NO: 3479 - DNA, 87 bp, Artificial
  Hairpin sequence HS_from_PT_71, human
ggagggtgtgagtgaaggaggtggggccttgaggggttgtctgcagctctgcccccctcccctctatgcccccttcctcttctctct

SEQ ID NO: 3480 - DNA, 117 bp, Artificial
  Hairpin sequence HS_from_PT_72, human
tcttgctttagctgtgctttcctgggatgagaagatcttggtgtatttaacacataagctttgttagaaatcacctctgaagatcatttcattttctcactttgggttgttgcaaga

SEQ ID NO: 3481 - DNA, 80 bp, Artificial
  Hairpin sequence HS_from_PT_73, human; HSbrain_4, human
tctttggaacgatagcagcatgaacctgtctcactgcagaattattttgagacaggcttatgctgctatccttcaaaaga

SEQ ID NO: 3482 - DNA, 63 bp, Artificial
  Hairpin sequence HS_from_PT_74, human
tcaacctttagtacgtgtggcttggtcacttcgtggctaaggtaagaacgtgcttgtggaaga

SEQ ID NO: 3483 - DNA, 82 bp, Artificial
  Hairpin sequence HS_from_PT_84, human
aaatatctaggattgatggcatcgaaccaggtgccaggatgatgcctggcacctggtttgatgccatcattcccagatgttt

SEQ ID NO: 3484 - DNA, 72 bp, Artificial
  Hairpin sequence HS_from_PT_89, human
tggggctgaggctgggggcagggtggagccttgcctgtggtgagagtccctctctctgtcccccctacccca

SEQ ID NO: 3485 - DNA, 112 bp, Artificial
  Hairpin sequence HS_from_PT_91, human
ccccaccccttccaggactcagattcagactctgagggaggagccgctggtggagaagcagacagtgagtatcttcctggagggacagggagcagggttctggggggcgggg

SEQ ID NO: 3486 - DNA, 83 bp, Artificial
  Hairpin sequence HS_from_PT_92, human
tgggaggctgcagggaggtgtggggagaaggtccgctttagagcttggtccctctgtgctcacctcccagccccaagccccca

SEQ ID NO: 3487 - DNA, 93 bp, Artificial
  Hairpin sequence HS_from_PT_94, human
gggctggggtcactgactctgcttcccctgccctgcatggtgtccccacagggacagcatggacagtgtcaagcagagtgcggccctgtgcct

SEQ ID NO: 3488 - DNA, 77 bp, Artificial
  Hairpin sequence HS_from_PT_95, human
gccacctgggccagccccttgtcctctgccttctgctggcagaggagcagctggactggggcctttggcacagcagc

SEQ ID NO: 3489 - DNA, 60 bp, Artificial
  Hairpin sequence HS_from_PT_99, human
ctgggtttggaaagggccctgttggccacttcactgcaggctgcaccctttctttcccag

SEQ ID NO: 3490 - DNA, 64 bp, Artificial
  Hairpin sequence HSbrain_1, human
tgtgcttgcgcataactggggccgcctggcctcccgcgggcggcctttttaaccgcgagcgaca

SEQ ID NO: 3491 - DNA, 106 bp, Artificial
  Hairpin sequence HSbrain_10, human
agagactcaggcttggaggggtgggggtggggttgtcagggccaaggcaaaacctctggcccttagagagctcctgagccaccctgccccccaacccaaggactct

SEQ ID NO: 3492 - DNA, 119 bp, Artificial
  Hairpin sequence HSbrain_100, human; HSbrain_99, human
gtctcggtcagtagccctgcgcttctccttcactctcggcggttcaggaggctctgccgcagccggggccctcctgtgacctgcatgtactgggggattcgcagggaggatgtcgggac

SEQ ID NO: 3493 - DNA, 117 bp, Artificial
  Hairpin sequence HSbrain_101, human
tctttttaattttctgggttccaggtctcttgtttttggggtttggcaggggtacatttacctaggttgatggtaaagtcagagatgggggatagggggtttgtggatttaatcgga

SEQ ID NO: 3494 - DNA, 67 bp, Artificial
  Hairpin sequence HSbrain_102, human
ccccgcctgcccccagcgggccctccaggtgtctgcagggccctaggtgctggctggccaggtgggg

SEQ ID NO: 3495 - DNA, 88 bp, Artificial
  Hairpin sequence HSbrain_103, human
gtccaccttccagcagatgtggatcagcaagcaggagtatgatgagtcaggcccctccattgtccaccgcaaatgcttgtaggtggac

SEQ ID NO: 3496 - DNA, 98 bp, Artificial
  Hairpin sequence HSbrain_104, human; HSbrain_105, human; HSbrain_107, human; HSbrain_108, human
tcgctgtccaccttccagcagatgtggatcagcaagcaggagtatgatgagtcaggcccctccattgtccaccgcaaatgcttctaggtggactctga

SEQ ID NO: 3497 - DNA, 108 bp, Artificial
  Hairpin sequence HSbrain_106, human; PT_from_HSbrain_106, chimp
aagtcattctgctgacatggccaggccctcctcaggcccacaaggtgtgtgctcagcacgcctctgtctgtgtggccttggagggatcatgtctctgcaccttttctt

SEQ ID NO: 3498 - DNA, 82 bp, Artificial
  Hairpin sequence HSbrain_109, human
ggccccacgtggtgaggatatggcagggaaggggagtttccctctattcccttccccccagtaatcttcatcatgcggtgtc

SEQ ID NO: 3499 - DNA, 104 bp, Artificial
  Hairpin sequence HSbrain_11, human; HSbrain_406, human
gatcaaaaggaagatgttttcttcaaaggcaatttttttacttgcttttttccccctgcaggttgaaattctgcctctgagaagctaacagtcttcctgtggtc

SEQ ID NO: 3500 - DNA, 114 bp, Artificial
  Hairpin sequence HSbrain_110, human
gtttttcttaacacaggtccatgaaagtttggcttcctggtttgatgtctgttgcgtggcctggaaaccagggagcagcaactattgagatggtttctgtgttcagtgaaaaat

SEQ ID NO: 3501 - DNA, 79 bp, Artificial
  Hairpin sequence HSbrain_111, human; HSbrain_16, human; HSbrain_214, human; HSbrain_238, human; HSbrain_706, human
cggctgcatttcttcatgcccggctttgccccactgaccagccggggcagccagcagtaccgggccttgactgtggctg

SEQ ID NO: 3502 - DNA, 108 bp, Artificial
  Hairpin sequence HSbrain_112, human; PT_from_HSbrain_112, chimp
agtgttagaatactgtgaaggcaatgacttggatttctatctgaagcaacacaagttaatgtcagagaaagaagctcggtctattgtaatgcagattgtaaatgcact

SEQ ID NO: 3503 - DNA, 62 bp, Artificial
  Hairpin sequence HSbrain_113, human
ggagctcagctcctgcctttgcagggaaagtttgctatttttgcaggcggtagttgaggttt

SEQ ID NO: 3504 - DNA, 77 bp, Artificial
  Hairpin sequence HSbrain_114, human; PT_from_HSbrain_114, chimp
gagagatgggggacgggtggaagaatggctcagaatattctgctgaaacactcttcggtacctttcccttttctctc

SEQ ID NO: 3505 - DNA, 94 bp, Artificial
  Hairpin sequence HSbrain_115, human
cccttcctgcgatcctgtttaggcttctctcctggatcctggataatgtttccagggtgttgggaaggcctgcgtctcaggtcacagttgtggg

SEQ ID NO: 3506 - DNA, 77 bp, Artificial
  Hairpin sequence HSbrain_116, human
gctgtgtacccacgccagccaggaagaaagtaagaactctaaccttactttgtttttcttctggttggcttgtcagc

SEQ ID NO: 3507 - DNA, 118 bp, Artificial
  Hairpin sequence HSbrain_117, human; PT_from_HSbrain_117, chimp
caccttcctgtggatccgggtgcagcagttcacgtctcggcgggtggagctgctcatcttctcccacctgcacgagctctcactgcgctggcacctggggcgccgcacaggggaggtg

SEQ ID NO: 3508 - DNA, 96 bp, Artificial
  Hairpin sequence HSbrain_118, human; PT_from_HSbrain_118, chimp
tcagccctaagctctgtgtctggctcccagcagatgcggctctgcagaggctggccgctgtgctggcgggctatggggtagagctgcgtcagctga

SEQ ID NO: 3509 - DNA, 101 bp, Artificial
  Hairpin sequence HSbrain_119, human; PT_from_HSbrain_119, chimp
gtgtcactgctgcattggtgtggcagcaagtgaccaaatgctacaggtcttactatggacaccaggtcaggtgcaaccacacaaaacaaagccagttccat

SEQ ID NO: 3510 - DNA, 113 bp, Artificial
  Hairpin sequence HSbrain_12, human; PT_from_HSbrain_12, chimp
cctgtcccgctggcctggcaggtgacggtgctggatgtggcctttttgccttttctaaaggccacattttccagcccattcaaccttccagagccctctgaagtggccacagg

SEQ ID NO: 3511 - DNA, 79 bp, Artificial
  Hairpin sequence HSbrain_120, human
gccggcacccgagatagcccagcagccagtgcctgagatagcccagcagctggcacctgagccatctctggcagccggt

SEQ ID NO: 3512 - DNA, 60 bp, Artificial
  Hairpin sequence HSbrain_121, human
tgtctgcagccacgctggcctctctgggtgggacttcctctcggagaggcagcggagaca

SEQ ID NO: 3513 - DNA, 80 bp, Artificial
  Hairpin sequence HSbrain_122, human
tggagactgcctggctgtgtcctctcagccaggtgccgtgttggccttggctaggacccagagccacactgcagcctccg

SEQ ID NO: 3514 - DNA, 89 bp, Artificial
  Hairpin sequence HSbrain_123, human
tccggccactgaggacatgcagtctgcagggtccaggcccgtccagggcctgggaaatgctgggggcaaggatggaaggtggcagtggg

SEQ ID NO: 3515 - DNA, 67 bp, Artificial
  Hairpin sequence HSbrain_1236, human
tcgctgcagccgctgcagtccgagccgactaagggcgggaggcagctcgggtggcggggcgtggcga

SEQ ID NO: 3516 - DNA, 98 bp, Artificial
  Hairpin sequence HSbrain_124, human
tctgttctttcttgaggccaggctgtggctgtggagtgcacgggaggctccaggggcctatgctgttcagtgacaaactggcccacgtggacttcaga

SEQ ID NO: 3517 - DNA, 78 bp, Artificial
  Hairpin sequence HSbrain_125, human; PT_from_HSbrain_125, chimp
tgcccattccattcacccctcactgtacctgccctagaacctgggcctaggccacaggggcagggagaagagaaggca

SEQ ID NO: 3518 - DNA, 116 bp, Artificial
  Hairpin sequence HSbrain_126, human; PT_from_HSbrain_126, chimp
ggccatgtgctgagcggctggatctgcggggaggaggccctcgtcatggagaagtgtgatgacgaggcagtggccgagatctgcacggagatgctgcgtcagttcacaggtgcgcc

SEQ ID NO: 3519 - DNA, 73 bp, Artificial
  Hairpin sequence HSbrain_127, human
actgagtattagaagcaatgatgatacagtttttcaattaaagctgtttatgttgcttctgatgtcatacagt

SEQ ID NO: 3520 - DNA, 95 bp, Artificial
  Hairpin sequence HSbrain_128, human; MQbrain_2363, macaque; PT_from_HSbrain_128, chimp
cttccctttgctgaaggtctgtaccacttttatcacaatggccttgcaaaggccaagagaagacgcagcctacaccacaagcagcagctggagag

SEQ ID NO: 3521 - DNA, 116 bp, Artificial
  Hairpin sequence HSbrain_129, human
tcaaaaggagtctactcttcatcttgtgttgagacttcgtggtggtgctaagaaaaggaagaagtcttacaccactcccaagaagaataagcacaagaggaagaagattaagctgg

SEQ ID NO: 3522 - DNA, 115 bp, Artificial
  Hairpin sequence HSbrain_13, human
gagggctctgtcccctaggtatggaatcttgcggcatccacgagaccaccttcaactccatcatgaagtgtgacgtggacatccgcaaagacctgtacgccaacacggtgctgtc

SEQ ID NO: 3523 - DNA, 86 bp, Artificial
  Hairpin sequence HSbrain_130, human; PT_from_HSbrain_130, chimp
cagaggaagggattctgggaggttgtagcagtggaaaaagttcttttcttcctctgatcgccctctcagctctttccttctgactg

SEQ ID NO: 3524 - DNA, 118 bp, Artificial
  Hairpin sequence HSbrain_131, human; PT_from_HSbrain_131, chimp
gcttcctccagtccgtcggagaagcgctctttgattggccagtggacagcgccgtggcatgacgcgctggggcgctggccaatcggttgagagctgagctggacttggcggtgggagc

SEQ ID NO: 3525 - DNA, 117 bp, Artificial
  Hairpin sequence HSbrain_132, human
ggcagctgccctcactgaggtgtcattcccacagctacctcgggctcgggctgatgtcggcacgcctggcgatcctgggcggcgtggaggggcagcctggtgagtggacatgttgcc

SEQ ID NO: 3526 - DNA, 71 bp, Artificial
  Hairpin sequence HSbrain_133, human
agccttttattgagtggggcaagtgctgggctgtggtcgtgccctgacagcatcttccccaggcagcggct

SEQ ID NO: 3527 - DNA, 75 bp, Artificial
  Hairpin sequence HSbrain_134, human
ggtgacggggggagagcgagggttccgccggccaccgcggtggtggccgagcgcggctcgtcgcctactgtggcc

SEQ ID NO: 3528 - DNA, 79 bp, Artificial
  Hairpin sequence HSbrain_135, human
cctgtggcatctttgccttgggctgctcctcatggtgggttcaggggactcagccctgaggtgaaagggagctatcagg

SEQ ID NO: 3529 - DNA, 83 bp, Artificial
  Hairpin sequence HSbrain_136, human; MQbrain_2338, macaque; PT_from_HSbrain_136, chimp
gaggacctggcagctctggaggaagcttctccaagcccaacctcccatgggtcaggggagccttcggagctcagggagccctt

SEQ ID NO: 3530 - DNA, 115 bp, Artificial
  Hairpin sequence HSbrain_137, human
cggagctgcagctgctggagaaggtgcccacgctggagcggctgcgggctgcccagaagcgccgggcccagcagctgaagaaatgggcacagtacgagcaggacttgcagcaccg

SEQ ID NO: 3531 - DNA, 79 bp, Artificial
  Hairpin sequence HSbrain_138, human
gcaggagttggcatgggggtggctgatggctggtagctgtccacagccatgagccagtgtgtcatgtccacagctttgt

SEQ ID NO: 3532 - DNA, 83 bp, Artificial
  Hairpin sequence HSbrain_139, human; PT_from_HSbrain_139, chimp
cggaatgaggatggggtgagatggggaggagcagccagtcctgtctcaccgctcttcccctgaccccaggttcccagtctctg

SEQ ID NO: 3533 - DNA, 118 bp, Artificial
  Hairpin sequence HSbrain_14, human
gcttctcgaggctccggcggctcagctcactggcttctcgaggctccggcggctcagttcactggcttctcgaggcttctggaggcttcggtggctcagctcactggcttctcgaggc

SEQ ID NO: 3534 - DNA, 72 bp, Artificial
  Hairpin sequence HSbrain_140, human; PT_from_HSbrain_140, chimp
tgccccacgacctggacatgctgctgagggccacctactttgggagcattgtcctgctggtgagtgctggcg

SEQ ID NO: 3535 - DNA, 55 bp, Artificial
  Hairpin sequence HSbrain_141, human
ctttttactctgttgtctcagccgcactggggcggaggcggtcaagggtgagaag

SEQ ID NO: 3536 - DNA, 105 bp, Artificial
  Hairpin sequence HSbrain_1410, human; PT_from_HSbrain_1410, chimp
gggttaattgtgctccaaccaatggctcaaggttcaagaaggccaatgttgtgagcacaggccttctcgagccttgagtgtgctggtgagcacaaagactgtccc

SEQ ID NO: 3537 - DNA, 111 bp, Artificial
  Hairpin sequence HSbrain_142, human
gctgggtgcggctggggccgtgaccctaggggccggtttgcgccgggagccggggcacggttccggccgtactcacggcgccgcgcggtgactccccaggcgcagcccagc

SEQ ID NO: 3538 - DNA, 118 bp, Artificial
  Hairpin sequence HSbrain_1420, human
aggggagagcgagaccagttttaaggggaggaccggtgcgagtgaggcagccccgaggctctgctcgcccaccacccaatcctcgcctcccttctgctccaccttctctctctgccct

SEQ ID NO: 3539 - DNA, 115 bp, Artificial
  Hairpin sequence HSbrain_1423, human
cttggtgctgattcctgggctctgacctgagacctctgggttctgagctgtgatgttgctctcgagctgggatctccggggtcttggttcagggccggggcctctgggttccaag

SEQ ID NO: 3540 - DNA, 120 bp, Artificial
  Hairpin sequence HSbrain_1424, human; MQ_from_PT_313, macaque; MQbrain_2672, macaque; PT_from_HSbrain_1424, chimp
gctggcaggtgaactggcaggccaggaagaggaggaagccctggaggggctggaggtgatggatgttttcctccggttctcagggctccacctctttcgggccgtagagccagggctggt

SEQ ID NO: 3541 - DNA, 80 bp, Artificial
  Hairpin sequence HSbrain_143, human
ctgtgagggtagagaagggccctgggctgggtcaggctgaaatgggtccgtctccccagcccttggctctgtcatcatgg

SEQ ID NO: 3542 - DNA, 86 bp, Artificial
  Hairpin sequence HSbrain_144, human
ggtcccttgggctcgagctccacatcagccctgagctgctggcaagcacccctggcctgcagccagggagagccagagcctttgcc

SEQ ID NO: 3543 - DNA, 118 bp, Artificial
  Hairpin sequence HSbrain_145, human
agcctgggctgctcctcctgctctggggagtctaggccgtggggactgttctggggaggctcatgctgtctccatgacgtctgtggcaggagtccctgaggacgggagctgcctagct

SEQ ID NO: 3544 - DNA, 76 bp, Artificial
  Hairpin sequence HSbrain_146, human; PT_from_HSbrain_146, chimp
tgctccagggcctgcttcgcatcatcccgtacctttcctttggagaggtggagaaaatgcagatcttggtggagcg

SEQ ID NO: 3545 - DNA, 89 bp, Artificial
  Hairpin sequence HSbrain_147, human; PT_from_HSbrain_147, chimp
gagaaggcttctgaggatcccgcccgtggggaggatgggccgccaggccacttcctctccatcgccgcctcgatccccatggtcgtctc

SEQ ID NO: 3546 - DNA, 81 bp, Artificial
  Hairpin sequence HSbrain_148, human
gactgggtgtgcctctcctttccctctcctccttccagatcttctctttggagctgatggctggagaactgatgtccagtt

SEQ ID NO: 3547 - DNA, 111 bp, Artificial
  Hairpin sequence HSbrain_149, human
ctagggccgattggctcactcctgggttccaccagcctagaggctgtgccctgatgccctgggcagccttttgggctgagttttcacaggtgaaccaagtcccagccttgg

SEQ ID NO: 3548 - DNA, 116 bp, Artificial
  Hairpin sequence HSbrain_15, human
ctggcttctcgaggccccggcggctcagctgactggcttctcgaggctccggtggctcaccgcactggcttctcgaggctccggcggctcagctcactggcttctcgaggctccgg

SEQ ID NO: 3549 - DNA, 107 bp, Artificial
  Hairpin sequence HSbrain_150, human
ctggttcaagcagtgttctttctctattaggcctggcggctgttgtgtggggctccccaaggtgagaggcagccctgggccagtgggttggaagacagggtgaccag

SEQ ID NO: 3550 - DNA, 90 bp, Artificial
  Hairpin sequence HSbrain_151, human
ctggtgtgagggaagagggaagggaaggacacattgaacgatcccagtggcttgtctcatggtgacctctcccttcctgccctggcctgg

SEQ ID NO: 3551 - DNA, 68 bp, Artificial
  Hairpin sequence HSbrain_152, human
gtgtgtgtgggcacacaggcaggcaggaggcacacggaggcctgcccgcttgctgtgcccatagacgc

SEQ ID NO: 3552 - DNA, 95 bp, Artificial
  Hairpin sequence HSbrain_153, human
tcgctgtccaccttccagcagatgtggatcagcaagcaggagtatgagtcaggcccctccattgtccaccgcaaatgcttctaggtggacgctga

SEQ ID NO: 3553 - DNA, 105 bp, Artificial
  Hairpin sequence HSbrain_154, human; PT_from_HSbrain_154, chimp
gatctgaactatatcctgggttccagaaaaggcagaggttcttaccgaaagcaggtaagtgtcttgtctgtctgcatcaagctcagagttggtaggaaaagactc

SEQ ID NO: 3554 - DNA, 64 bp, Artificial
  Hairpin sequence HSbrain_155, human
gggggcggtgtgggctgcaggaggctgctgtccctggagcttcccagttccagaccaggacccc

SEQ ID NO: 3555 - DNA, 71 bp, Artificial
  Hairpin sequence HSbrain_156, human; PT_from_HSbrain_156, chimp
ttgggaacccccagggtctggtctgagtcattctgggtgcccagatgggtcctgggaccctgtgggtacaa

SEQ ID NO: 3556 - DNA, 98 bp, Artificial
  Hairpin sequence HSbrain_157, human
cctcctggacccctgccctccctgcccggccttccaaggcccggcagcctcagtccactgctgggcctggaacacggagcagtggctgccctgcgagg

SEQ ID NO: 3557 - DNA, 63 bp, Artificial
  Hairpin sequence HSbrain_158, human; PT_from_HSbrain_158, chimp
tggcactgtggcagtttccaggggataccagacagggtgtccccgaggctcctgccacaacca

SEQ ID NO: 3558 - DNA, 80 bp, Artificial
  Hairpin sequence HSbrain_159, human
ggggaacccagctggcccaggatttgtggattgcttagaaagatccttttgggcagcctgaagactggggagggttttcc

SEQ ID NO: 3559 - DNA, 73 bp, Artificial
  Hairpin sequence HSbrain_160, human; PT_from_HSbrain_160, chimp
gttagggtgcctggaggggggtacacttggggcttgcctggccccaggttcccagtccttaatgctccttaac

SEQ ID NO: 3560 - DNA, 118 bp, Artificial
  Hairpin sequence HSbrain_161, human; MQbrain_2551, macaque; PT_from_HSbrain_161, chimp
ttttgagattagatgtttcacattcattctttctcttcctagttcccattctgtgatggggctcacacaaaacataacgaagagactggagacaatgtgggccctctgatcatcaaga

SEQ ID NO: 3561 - DNA, 85 bp, Artificial
  Hairpin sequence HSbrain_162, human
cccttaggggatagagtgcaagggaaatgggacagaaggggtgtttttcctcctgtcttcctcttcccattctcctcttttgggg

SEQ ID NO: 3562 - DNA, 79 bp, Artificial
  Hairpin sequence HSbrain_163, human
ctgcccaggcccgagggccgccggccgtcctcatgctggcagcaagggcagctggcgggatcggaagccagcgtggcgg

SEQ ID NO: 3563 - DNA, 120 bp, Artificial
  Hairpin sequence HSbrain_164, human
caggtgtagagtcggcacctggccagaggagaggataggggttgcttcctcgaggccagcgtggtctgcactgctgcctgggccctctgccttccttctggccagggtgggaggcagctg

SEQ ID NO: 3564 - DNA, 114 bp, Artificial
  Hairpin sequence HSbrain_165, human; PT_from_HSbrain_165, chimp
gcaaggggcaggccaggccccactcacaaaagtcagggactctgggtgcagccagtgatgagaggctgggacacagaccccctgacggtggcgagtggggttagagctctgggc

SEQ ID NO: 3565 - DNA, 59 bp, Artificial
  Hairpin sequence HSbrain_166, human
ggctctcctggttgaggagggaggggcctggctgacccctccagcttcagcctccagct

SEQ ID NO: 3566 - DNA, 119 bp, Artificial
  Hairpin sequence HSbrain_167, human
gctggagccagttggggagcacggttctgggagctctgcaaaatcagtagcaagtgctggaaaaggcacatgccgaagatactcaagagctcccaagatttgcttgaggctagcccagt

SEQ ID NO: 3567 - DNA, 85 bp, Artificial
  Hairpin sequence HSbrain_168, human
gcacggtcatgggtgctgaaatctggcatattcttgtcacactgggtgagaagatgacagaggaagaagtagacatgctaggggc

SEQ ID NO: 3568 - DNA, 119 bp, Artificial
  Hairpin sequence HSbrain_169, human
ctgcagctttgaggctggcggggtctgctcctgggaatggggtgggagccacagggacgacccggggcgggctgatgtcttcttgggggcagaccagagagctcaagtttcagagtcag

SEQ ID NO: 3569 - DNA, 111 bp, Artificial
  Hairpin sequence HSbrain_17, human
acgggtcatggcacagagcatccttgtgaacccagaatctatctctcacatgtgtggggtacagagggcaagagggagggtcgccttggatgctctgctacaagtctgcgt

SEQ ID NO: 3570 - DNA, 74 bp, Artificial
  Hairpin sequence HSbrain_170, human; PT_from_HSbrain_170, chimp
cctgagtgtgtttgagatggacgttcagtctctgatctccagagaagagtgtttgtgtcacagcatgatccagg

SEQ ID NO: 3571 - DNA, 119 bp, Artificial
  Hairpin sequence HSbrain_171, human
aggatagctgtgtttgcacaccatgctccatgttcattcggagccaggaggggttctcagtggagcctggcttagggaacagggagcgatggaagaatgccaacattagcgttggtctt

SEQ ID NO: 3572 - DNA, 104 bp, Artificial
  Hairpin sequence HSbrain_172, human
gagccagcaagacatgggccccagtttccagaccctgacacctctcatttaaccagaagacgtggaggggtgagttggagacgggggcttgactggggggtatc

SEQ ID NO: 3573 - DNA, 78 bp, Artificial
  Hairpin sequence HSbrain_173, human; PT_from_HSbrain_173, chimp
ccctctgtcctgatgtgggacactttatttcaggtctggaggcttgatgagaagtgggtctccaggaacttagatggg

SEQ ID NO: 3574 - DNA, 112 bp, Artificial
  Hairpin sequence HSbrain_174, human
ggcattgtgggtctttgaagttgctgggataaattaatataattaaataaaagactgaatttaattgcataaattgtattaggtggcaattaacaaaaggacccagatggct

SEQ ID NO: 3575 - DNA, 88 bp, Artificial
  Hairpin sequence HSbrain_175, human; PT_from_HSbrain_175, chimp
ttttccaggtatgggaggacatggctatggtggagctggtgatgcaagttcaggttttcatggtggtcatttcgtacatatgagaggg

SEQ ID NO: 3576 - DNA, 66 bp, Artificial
  Hairpin sequence HSbrain_176, human; PT_from_HSbrain_176, chimp
ctttagagtcctgaggggaaatgaaatgggtgtgacttcatttcatttcctcttgatactaacaag

SEQ ID NO: 3577 - DNA, 81 bp, Artificial
  Hairpin sequence HSbrain_177, human
tgggcgccactgctgcctgccatcctcagacagcatcagcttggctgacatctggatgagatgaggctcaggagcaaaccg

SEQ ID NO: 3578 - DNA, 99 bp, Artificial
  Hairpin sequence HSbrain_178, human; PT_from_HSbrain_178, chimp
ggcgggctcgggctgcggcgcggcgctgcagttgcggtggcagaaggcctcgctgtcgcgcagcaagcggtgcagccgcaggctgatctccaggtagcc

SEQ ID NO: 3579 - DNA, 65 bp, Artificial
  Hairpin sequence HSbrain_179, human
ccttccaggaagcctgcagcgttcacgaagtgacattgatgtgaatgctgctgcaggtgccaagg

SEQ ID NO: 3580 - DNA, 78 bp, Artificial
  Hairpin sequence HSbrain_18, human
tggccgtggcggctggtgtggggttgagtcagttgtgggacccggagctgctgacccagcgggtggcccaccgaaccg

SEQ ID NO: 3581 - DNA, 77 bp, Artificial
  Hairpin sequence HSbrain_180, human; PT_from_HSbrain_180, chimp
gaagagagtacccacctttaaaatggaaaatcagagctattacccaaggttttttcattttaaaggtgggtttcttc

SEQ ID NO: 3582 - DNA, 110 bp, Artificial
  Hairpin sequence HSbrain_181, human
ttcagaaatactgtactgtgagtggccacaactgtgaagctaggaaagctctgtgaaagcaagagatggctcgtgcttcaaccagccaaagaggtcgaagtggttctgga

SEQ ID NO: 3583 - DNA, 61 bp, Artificial
  Hairpin sequence HSbrain_182, human
ggccttctctgtttaattgcaccctctagtggaggagaaggtgaaggagcagctggaggcc

SEQ ID NO: 3584 - DNA, 110 bp, Artificial
  Hairpin sequence HSbrain_183, human; PT_from_HSbrain_183, chimp
ccttcctcttttgctgtcctcctgctatgtccaggactccccgatcaacaaacttctgtatgcacgggacattccccggtacaagcggatggtggaaaggtactggaggg

SEQ ID NO: 3585 - DNA, 54 bp, Artificial
  Hairpin sequence HSbrain_184, human
ctccctcctgcttgggccgactctgccttttgagcttggccccagccttgggag

SEQ ID NO: 3586 - DNA, 81 bp, Artificial
  Hairpin sequence HSbrain_185, human; PT_from_HSbrain_185, chimp
gggagactcatcctaaaagctgggttgaggggacaggatttggcatccagatcccctccccagcaggccagatagattccc

SEQ ID NO: 3587 - DNA, 84 bp, Artificial
  Hairpin sequence HSbrain_186, human; PT_from_HSbrain_186, chimp
ggctgagacagccagggccacctcagtgccggggcctgcccaagcagctgcccctccagaggtggggagggtgtctcctcagcc

SEQ ID NO: 3588 - DNA, 99 bp, Artificial
  Hairpin sequence HSbrain_187, human; PT_from_HSbrain_187, chimp
cagccacagacactgccacccccggggctgcaggtggggccacagctgcagctgcgagtggagctacctcagcccctgagggtgatgctgctcgtgctg

SEQ ID NO: 3589 - DNA, 81 bp, Artificial
  Hairpin sequence HSbrain_188, human
cgtcacagccatcatcttctgcgtagccttgagcgcctatgacttggtgctagctgaggacgaggagatggtgagaggatg

SEQ ID NO: 3590 - DNA, 74 bp, Artificial
  Hairpin sequence HSbrain_189, human; PT_from_HSbrain_189, chimp
acttctgggagcaagctgacccagctgaagatcgcccagcgccttcgactggaccagcccaagcttgacgaggt

SEQ ID NO: 3591 - DNA, 88 bp, Artificial
  Hairpin sequence HSbrain_19, human
ggggcggctgtgtgagtcccacatcctgggcagagggcctggtggagtcccttgctaggagaagggaagacacctgagatgctgcttc

SEQ ID NO: 3592 - DNA, 62 bp, Artificial
  Hairpin sequence HSbrain_190, human; PT_from_HSbrain_190, chimp
tattgtagcattgctgtctgcaagggagcccctagcccctggcagacatagctgcttcagtg

SEQ ID NO: 3593 - DNA, 97 bp, Artificial
  Hairpin sequence HSbrain_191, human; PT_from_HSbrain_191, chimp
ttgggaaaaactcaagaagcttggtggagaagagggagaaggatctggaggtctacctccagaagctcctggctgccttccctggcgtgacccccag

SEQ ID NO: 3594 - DNA, 68 bp, Artificial
  Hairpin sequence HSbrain_192, human
gggacctggagggggctgggtggaatgctctgcaggcagaacaagccacagcctggactccagtttcc

SEQ ID NO: 3595 - DNA, 78 bp, Artificial
  Hairpin sequence HSbrain_193, human
gcccagggctaccagcgggccatgtgcatcagtcgcaagaagctggagcacaggtgagaggtttggggaggtgggagc

SEQ ID NO: 3596 - DNA, 111 bp, Artificial
  Hairpin sequence HSbrain_194, human
ggactgtgggctcttgggtgacaaggttggaaaagcttccctgtatcctactctggcaggggagctagtctgggtcctcaggtgtaacacccaagttttcctttctggttt

SEQ ID NO: 3597 - DNA, 103 bp, Artificial
  Hairpin sequence HSbrain_195, human
gttggggtgtggggtgctagaggccttgctgctgaggaaagttgccatggttaccagcaccgtggctctcggaaggaggaggctagcatgttagcacctcagc

SEQ ID NO: 3598 - DNA, 100 bp, Artificial
  Hairpin sequence HSbrain_196, human; HSbrain_462, human; MQbrain_2430, macaque; MQbrain_2530, macaque; PT_from_HSbrain_196, chimp; PT_from_HSbrain_462, chimp
cttctctgctctgagaagcacagctacctgccttcactgaaatatacctcaggctgaaatttggggtgggatagcaggtcagttgatcttctgcaggaag

SEQ ID NO: 3599 - DNA, 97 bp, Artificial
  Hairpin sequence HSbrain_197, human; MQbrain_2417, macaque; PT_from_HSbrain_197, chimp
gtcctctcttttttcctaggctgctgagtgtgcagggaagctctttctattccatacatccctgcccattgcagaggccccagggaaactgaagaac

SEQ ID NO: 3600 - DNA, 95 bp, Artificial
  Hairpin sequence HSbrain_198, human
tgagtccagtggctctggtccatttccctgccattcccttggcttcaatttactcccagggctggcagtgacatgggtcaaggctcacaccttca

SEQ ID NO: 3601 - DNA, 78 bp, Artificial
  Hairpin sequence HSbrain_199, human
gaaacaggaaggtctccaagtgtcaactcccagtgaaagaatgatgaaccacttggagatcctaagcagccctgtttt

SEQ ID NO: 3602 - DNA, 119 bp, Artificial
  Hairpin sequence HSbrain_20, human; PT_from_HSbrain_20, chimp
agccacctggaggaccctgcggtgacatcagggcccagtccctgctgtcatgccccaggtgacgtgctgggctgacagcagggctggccgctaacgtcactgtcctggcttctaacgct

SEQ ID NO: 3603 - DNA, 117 bp, Artificial
  Hairpin sequence HSbrain_200, human
tttcataaaggtctatttcattattggtgggtagcgcatttaacagttaaatacatttaaataatgtataggtgactgcaggactgcagcattggtaactagataaccaactagaaa

SEQ ID NO: 3604 - DNA, 92 bp, Artificial
  Hairpin sequence HSbrain_201, human
ggaaaatgatactctagcacagaattcagtggaatccttagggcccatgcccaaatctttccattgcttctcaggttagaatgatcttcacc

SEQ ID NO: 3605 - DNA, 87 bp, Artificial
  Hairpin sequence HSbrain_202, human
tctctttccctgaaaagccttgaagggggttgagggtacaggcaaccttgtgttctctgtgccctcagggactggcagagcaagagg

SEQ ID NO: 3606 - DNA, 75 bp, Artificial
  Hairpin sequence HSbrain_204, human; MQ_from_HSbrain_204, macaque; PT_from_HSbrain_204, chimp
ggtcagcgctctggtgaagctgcccatttctgggaattgtgcagaagggaagggcagctcctggaatgcagagcc

SEQ ID NO: 3607 - DNA, 103 bp, Artificial
  Hairpin sequence HSbrain_205, human; PT_from_HSbrain_205, chimp
atatagtggctaccctgggccccaggtcagctacccacccccaccagccggccattcaggtcctggcccagctggctttcctgtcccaaatcagccagtgtat

SEQ ID NO: 3608 - DNA, 78 bp, Artificial
  Hairpin sequence HSbrain_206, human; MQbrain_2378,MQbrain_2544, macaque; PT_from_HSbrain_206, chimp
gcagttcaagtgctaccaccacgaggaccggcagatgaacaccaactggcccgcctcggtgcaggtcagcgtgaacgc

SEQ ID NO: 3609 - DNA, 115 bp, Artificial
  Hairpin sequence HSbrain_207, human; PT_from_HSbrain_207, chimp
tgctggggctggctgggcattagtaaagtcctcccaggattgggttcctattgatctggaacttggggatggagtaggattttgctaggctgggatagtggtcagtttgtaggca

SEQ ID NO: 3610 - DNA, 75 bp, Artificial
  Hairpin sequence HSbrain_208, human
tggtgtagttaagctctgcccccgtggtggatagagccataccacggggaagccaagagcttgccacttttatta

SEQ ID NO: 3611 - DNA, 103 bp, Artificial
  Hairpin sequence HSbrain_209, human; PT_from_HSbrain_209, chimp
ccctggttaggtaccagttgggggccagggatggcctgtaacctcctgttttccttctggttggtagcatttctggggaccaacagctggccgaggctcaggg

SEQ ID NO: 3612 - DNA, 118 bp, Artificial
  Hairpin sequence HSbrain_21, human
gaggcagaggagaggcaaggccggtggcccccggcttccagggacctggcagccaccactgaggcccacctgcttgtccctcagccgggtgctcactggcagccacactcccggtctc

SEQ ID NO: 3613 - DNA, 78 bp, Artificial
  Hairpin sequence HSbrain_210, human; PT_from_HSbrain_210, chimp
actctgagtgtgagagaaggacggggctggagggctccctctcagctcctgagtccttccacctgttctgtccagagt

SEQ ID NO: 3614 - DNA, 71 bp, Artificial
  Hairpin sequence HSbrain_211, human; PT_from_HSbrain_211, chimp
gcactagattgtaaagactggggtggacctctttcttaatgtccaatgtcctttgtcttaagatttggtgc

SEQ ID NO: 3615 - DNA, 79 bp, Artificial
  Hairpin sequence HSbrain_212, human
ccccaaccagggtgtggatgggactggggatgcgtcacagtgtggctcatcccagagtccgtgctcaggatttttgggg

SEQ ID NO: 3616 - DNA, 117 bp, Artificial
  Hairpin sequence HSbrain_213, human
gtccatagtgtttgcagaaaaatccgactcagaagacagagtgccacttactgaaaggttttttctctcagtaagtggcactctgtcttctgagttggtacctgtggaccactggat

SEQ ID NO: 3617 - DNA, 104 bp, Artificial
  Hairpin sequence HSbrain_215, human; PT_from_HSbrain_215, chimp
tgtacttggaggaaaagcattcagaagtcctattcaacctgggctccaaggttctcaggcagtacctggatgctctgaagacgctgagcttgtccctgagtgca

SEQ ID NO: 3618 - DNA, 96 bp, Artificial
  Hairpin sequence HSbrain_216, human
cttagcactggggccaccaactgccttctgcattcctgcgtgtgctgtgggagctgcggggacagcagggaggacgtggtggagcgtctgcgggag

SEQ ID NO: 3619 - DNA, 118 bp, Artificial
  Hairpin sequence HSbrain_217, human
agagagagcaggggtgggtggggtccgcaggaggccaaggcaggaagtgagcaggaccgtcccatcctcactccctgccaggcctcctgctgacccagcgtgcccactgcagctccct

SEQ ID NO: 3620 - DNA, 113 bp, Artificial
  Hairpin sequence HSbrain_218, human
gtgcctcttagtggccacggtgggcgccctgccctgttcctccaccttgtgctgaggaagctttgacgtgggtgacagggcatgcaaccccatgtggcccacgtgactggtac

SEQ ID NO: 3621 - DNA, 113 bp, Artificial
  Hairpin sequence HSbrain_219, human
cttcgttcccaggagcggccattgtccctgtgggcccttcttcaggctgtcagatgtgtctacctttccttctgttcctgaccggggcctggtggctggccctggagatgagg

SEQ ID NO: 3622 - DNA, 81 bp, Artificial
  Hairpin sequence HSbrain_22, human
ctgctgcggaagctgtgttcgccaatggcatccacccctacccaggtaagcacatctgtcagcacttatttccgtatgcag

SEQ ID NO: 3623 - DNA, 88 bp, Artificial
  Hairpin sequence HSbrain_220, human
tcgctctgcttggtggcttcaggagtgtggccctccccaggactccacttcatcctgggcttgcaccctccttgagccaatgcactga

SEQ ID NO: 3624 - DNA, 75 bp, Artificial
  Hairpin sequence HSbrain_221, human
cggaggaactggagcaggcggcagaggggaaggaagtcaggttccaggcctctctgccgctgaccaggatcgatg

SEQ ID NO: 3625 - DNA, 89 bp, Artificial
  Hairpin sequence HSbrain_222, human
ttgattatatcagctgagctagggatatctcctgagaatgtctcctccctattctcaggaaaaatccctagcttggttgatgtcatcag

SEQ ID NO: 3626 - DNA, 113 bp, Artificial
  Hairpin sequence HSbrain_224, human; PT_from_HSbrain_224, chimp
gattgccttttggttatctagctggcacttcgtagctgcagataaatagttgctgctcttgctactcctgcagctgttgattgtgaagttagactacatgggccaggcaaatc

SEQ ID NO: 3627 - DNA, 112 bp, Artificial
  Hairpin sequence HSbrain_225, human
gccctaatacgtgaccagtcctgaaattgtgtgcccaggatttagccaagtggttctcactctttccttccacttagctaggtcctgacatatttcttactcctgcgatggc

SEQ ID NO: 3628 - DNA, 75 bp, Artificial
  Hairpin sequence HSbrain_226, human; PT_from_HSbrain_226, chimp
tgcctcccctctcctcccttttctccgccctcaggtctggttccagaaccgccggaccaagtggaggaagaagca

SEQ ID NO: 3629 - DNA, 119 bp, Artificial
  Hairpin sequence HSbrain_227, human
cttctctagtggcttcctaaaggtgtgtggtggcaaagtacttgagctcttccagccttcagaactgagggctatgatggtggggaacagcaactacaactgggaagaactggaagagg

SEQ ID NO: 3630 - DNA, 117 bp, Artificial
  Hairpin sequence HSbrain_228, human
ctgcacttacctttctgctctgagaagcacagctacctgccttcactgaaatatacctcaggctgagagatttggggtgggagagcaggtcagttcatcttctgcaggaaggtgcag

SEQ ID NO: 3631 - DNA, 115 bp, Artificial
  Hairpin sequence HSbrain_229, human; PT_from_HSbrain_229, chimp
agattggttgactctgtactcttttattttattcctgtaactgggccagtttctgcccttaactaaaactggatcaattataggagtgaaataaaggtccatctcctgcctattt

SEQ ID NO: 3632 - DNA, 117 bp, Artificial
  Hairpin sequence HSbrain_23, human
ctgaccttttcaatattctaatctttgctttgctgacctctcaggcctcttcctggcaacagttaggcttttgagaggagagagagctgagactgttgggtaagtgaacagagtgag

SEQ ID NO: 3633 - DNA, 115 bp, Artificial
  Hairpin sequence HSbrain_230, human
ctgtcgaaatgcaccatgaagctttgagtgaagctcttcctggggacaatgtgggcttcgatgtcaagaatgtgtctgtcaaggaggttcatcatggcaatgttgctggtgacag

SEQ ID NO: 3634 - DNA, 55 bp, Artificial
  Hairpin sequence HSbrain_231, human
ctcgggcccgctggggccaggaggagccgccactgtcccccgagtggagccgggg

SEQ ID NO: 3635 - DNA, 81 bp, Artificial
  Hairpin sequence HSbrain_232, human
gtaggggattcctggagaagctgcagtgtggggatgctctagaccgagtactgcccccagtgtctttccacctcctcctgc

SEQ ID NO: 3636 - DNA, 120 bp, Artificial
  Hairpin sequence HSbrain_233, human
gtctgtgtgaccgtcatgcaggcctgtctatgtgaccatcaggaggcctgtctgtgtgaccgtcaggaggcctgtctgtgtgatcgtcaggaggcctgtctgtgtgaccgtcatgcaggc

SEQ ID NO: 3637 - DNA, 112 bp, Artificial
  Hairpin sequence HSbrain_234, human
caggaggcctgtctgttcgaccatcaggaggcctgtctgtgtgaccgtcatgcaggcctgtctgtgtgaccatcaggaggcctgtctgtgtgaccgtcaggaggcctgtctg

SEQ ID NO: 3638 - DNA, 118 bp, Artificial
  Hairpin sequence HSbrain_235, human
cctgtctgttcgaccatcaggaggcctgtctgtgtgaccgtcatgcaggcctgtctgtgcgaccgtcaggaggcctgtctgtgtgatcgtcaggaggcctgtctgtgtgatcgtcagg

SEQ ID NO: 3639 - DNA, 119 bp, Artificial
  Hairpin sequence HSbrain_236, human
gtctgtgtgaccatcaggaggcctgtctgtgtgaccgtcatgcaggcctgtctgtgcgaccgtcaggaggcctgtctgtgtgatcgtcaggaggcctgtctgtgtgatcgtcaggaggc

SEQ ID NO: 3640 - DNA, 81 bp, Artificial
  Hairpin sequence HSbrain_237, human
atttatttatttcatggtttagccaccctatcaatatttcccttaattgataggatggctgaaccacgaaataaattaaat

SEQ ID NO: 3641 - DNA, 86 bp, Artificial
  Hairpin sequence HSbrain_239, human
tgggatcagtgttgggcctctgagccaaagcaggccaggctgtaggctggccagcaaagtggctggcaggaagagatgagatgtca

SEQ ID NO: 3642 - DNA, 99 bp, Artificial
  Hairpin sequence HSbrain_24, human; PT_from_HSbrain_24, chimp
tgctgcttttgcccagttcggttctgacctcgatgctgccactcaacaacttttgagtcgtggcgtgcgtctaactgagttgctgaagcaaggacagta

SEQ ID NO: 3643 - DNA, 117 bp, Artificial
  Hairpin sequence HSbrain_240, human
agatgcaaagttttctttttcttttggtgaggacaggagggtgggagtctttacagtgacaaattttggctcccactctcctgtccccaccaaaagaaaaataaaacctgtgcatct

SEQ ID NO: 3644 - DNA, 65 bp, Artificial
  Hairpin sequence HSbrain_241, human
gcagacaaagagctgtggtagaaagtaaggttgcaaatcactttctaccacagctctttgtttgc

SEQ ID NO: 3645 - DNA, 114 bp, Artificial
  Hairpin sequence HSbrain_242, human
acatggttcaataagagtttatagtaagaagaattggcctactcaggtgtcagcaaagccttcctctctgaataggtcaattcccctcactataaactctttttcagcacaagt

SEQ ID NO: 3646 - DNA, 93 bp, Artificial
  Hairpin sequence HSbrain_243, human; PT_from_HSbrain_243, chimp
ccagcttcagtggccagattcttgccggggagcttgacaactgtgtgagcagtatcccggacttccccatgcatttggcctgccctgaggagg

SEQ ID NO: 3647 - DNA, 75 bp, Artificial
  Hairpin sequence HSbrain_244, human; PT_from_HSbrain_244, chimp
gagggcctcccggcctagggcccgaccgcgccggacgcggtgtccggggcagggcagggctggggcctgggcctc

SEQ ID NO: 3648 - DNA, 84 bp, Artificial
  Hairpin sequence HSbrain_245, human; MQbrain_2553, macaque; PT_from_HSbrain_245, chimp
cccagggcttgtcctgttcccttcctgcagtggcttggatgaggtcatcttctcctatgtgcttggggtcctggaggacctggg

SEQ ID NO: 3649 - DNA, 76 bp, Artificial
  Hairpin sequence HSbrain_246, human
cttcttctctctgccattgacccattattgatttcttgggagagatcaataatgggccaatggcagagagaaggag

SEQ ID NO: 3650 - DNA, 79 bp, Artificial
  Hairpin sequence HSbrain_247, human
atagtcgtgcctgtttgcttagcattcctattgacaactcttctgggagtgctgttctgctttaataagcgagacctgt

SEQ ID NO: 3651 - DNA, 94 bp, Artificial
  Hairpin sequence HSbrain_248, human
tggtcgacaaggctgcagaggctggtggtgccgaggagcagtatggattcctcaccacaccaaccaagcaactaggagcccagtctcctggccg

SEQ ID NO: 3652 - DNA, 120 bp, Artificial
  Hairpin sequence HSbrain_249, human; PT_from_HSbrain_249, chimp
gtactagaagctgatctgattggtccaacagtttgatgctgagtcatgcgtgttgaatcccacttcagtgcacctgtggcctctcagtcaaacaagttgtgcctttcacagcttctttac

SEQ ID NO: 3653 - DNA, 81 bp, Artificial
  Hairpin sequence HSbrain_25, human; PT_from_HSbrain_25, chimp
caaaaggcatgcgctcactgcttgcttgtcagaaacactgaagccatttgccccagtgtggtcaagcagccatgctttctg

SEQ ID NO: 3654 - DNA, 89 bp, Artificial
  Hairpin sequence HSbrain_250, human; PT_from_HSbrain_250, chimp
tagccgcatgatgtggaggactgagaaggtgaggcagttttgccccgtgctgccttccaccggttaagacctccaaaatcgaagggctg

SEQ ID NO: 3655 - DNA, 113 bp, Artificial
  Hairpin sequence HSbrain_251, human
ggcaccagggcgtgatggtgggcatgggtcagaaggattcctatgtgggcgacgaggcccagagcaagagaggcatcctcaccctgaagtaccccattgagcacggcattgtc

SEQ ID NO: 3656 - DNA, 89 bp, Artificial
  Hairpin sequence HSbrain_252, human; PT_from_HSbrain_252, chimp; PT_from_MQbrain_2669, chimp
gtggattggaggctccatcctggcctcgctgtccaccttccagcagatgtggatcagcaagcaggagtatgaggagtctggccctccat

SEQ ID NO: 3657 - DNA, 117 bp, Artificial
  Hairpin sequence HSbrain_253, human
gctatcacttggaggtgaacagcctcttttgccggtattcagtgaagaaagcaagtctaaatatgcagttctctcactggagtgaaagatgttttgttcatttctaatcaactatgc

SEQ ID NO: 3658 - DNA, 93 bp, Artificial
  Hairpin sequence HSbrain_254, human
gaattcatccatgcctgggactggaacacatatatatggttttggagaaaaccccaagagcatatacatgtgctccagtccccatctgttttt

SEQ ID NO: 3659 - DNA, 78 bp, Artificial
  Hairpin sequence HSbrain_255, human
caagaagctaagtgccaggatagctgcgtggctaaggagaaacacatagcttgtggctatctttcagcactcctcttg

SEQ ID NO: 3660 - DNA, 110 bp, Artificial
  Hairpin sequence HSbrain_256, human; PT_from_HSbrain_256, chimp
gctgttgattggtcacagtcactgataaatggttttggatcttcttcagagggttcctcagagaagcaatcaaactccactctttcttttgactggagccaaccaagtgt

SEQ ID NO: 3661 - DNA, 101 bp, Artificial
  Hairpin sequence HSbrain_257, human; MQbrain_2477, macaque; PT_from_HSbrain_257, chimp
ccggggcagccgggcagggcggggtgtcctggagagccgcggatgggcctcacacccaggctgggccaggacaccccgtccttggccgaggcccaaaccgg

SEQ ID NO: 3662 - DNA, 104 bp, Artificial
  Hairpin sequence HSbrain_258, human
ggtaacgcttttgctcgctttctacgctgtcacgtctccatcctgcaacactgaatacgtagatggaacgtggatcagctaataactgcagcaaaataaaaact

SEQ ID NO: 3663 - DNA, 66 bp, Artificial
  Hairpin sequence HSbrain_259, human
ggcccaggccgaggccgacttgctcaccgtctacctggtggtggcgttggcctcggtgtcttcgct

SEQ ID NO: 3664 - DNA, 98 bp, Artificial
  Hairpin sequence HSbrain_26, human; PT_from_HSbrain_26, chimp
tgctgtgcccctcagctgccattagagtccccatggggtccctcctgcctgtgtctccacaagagggaccccatgggaactctactgagagccctgca

SEQ ID NO: 3665 - DNA, 97 bp, Artificial
  Hairpin sequence HSbrain_260, human; PT_from_HSbrain_260, chimp
gggagcaggaaggtttgctcagggggtggctgggtgctgctcccgatatagggggcctgcatcctgccccctccctgccctctcaacccccagcccc

SEQ ID NO: 3666 - DNA, 116 bp, Artificial
  Hairpin sequence HSbrain_261, human
tttgtgggtcgggatgattttgatgatgctgaccagctgaggataggaaatgatgggattttcatgttaacttttttcagtaagtatgtatgcatatcagaaccaccccctacaaa

SEQ ID NO: 3667 - DNA, 105 bp, Artificial
  Hairpin sequence HSbrain_262, human; PT_from_HSbrain_262, chimp
tatcacaggtaataaaggcaattggatgatatctgtaggaggaaaacaatgactaatttcttccttttgaaatctttcattgatgcacatttattatgtaagatg

SEQ ID NO: 3668 - DNA, 106 bp, Artificial
  Hairpin sequence HSbrain_263, human; PT_from_HSbrain_263, chimp
tatgaagtacattggatttgagacggtgaatggtgatatattcatctgtacccaaaaagcagccaggaatatgtcataccagggctttaccaaagacaatggcgtg

SEQ ID NO: 3669 - DNA, 55 bp, Artificial
  Hairpin sequence HSbrain_264, human; PT_from_HSbrain_264, chimp
aggggcttgctctgagcctgcactgaattgtgctggctcaattcagcaaggacct

SEQ ID NO: 3670 - DNA, 66 bp, Artificial
  Hairpin sequence HSbrain_265, human
ccttgctgcccaggcccaggggcaggctcttggcctgccccaggcccagagggcttcccagtaagg

SEQ ID NO: 3671 - DNA, 90 bp, Artificial
  Hairpin sequence HSbrain_266, human; PT_from_HSbrain_266, chimp
ctgagcccacgtcacagctctgggaggtgggcagggcaggagtcagcacactccttccacctgccagggctgccctcccacaaggctgag

SEQ ID NO: 3672 - DNA, 93 bp, Artificial
  Hairpin sequence HSbrain_267, human; PT_from_HSbrain_267, chimp
ccatttcacccattcttctccctcaattccaggtatctgtgggagctaatcctgtccaggtggaagtaggagaatttgatgatggtgcagagg

SEQ ID NO: 3673 - DNA, 101 bp, Artificial
  Hairpin sequence HSbrain_268, human
tggtgtgttggagcctgcagggcaggtcaggctggttcagaggcccatgctgaggggtgggtgctctgaagtggagtgaagcctcaagcccatgaatgcca

SEQ ID NO: 3674 - DNA, 85 bp, Artificial
  Hairpin sequence HSbrain_269, human
cacccctccgtttgcaccagttgcctgcaggttggatggaacacagtgccccacttttctgcaagtagctggcttgtaaagggtg

SEQ ID NO: 3675 - DNA, 75 bp, Artificial
  Hairpin sequence HSbrain_27, human; PT_from_HSbrain_27, chimp
cagccctgggagatgttttttgtattgctcagtcataccgggcagagcagtccagaacacgaaggcacctggctg

SEQ ID NO: 3676 - DNA, 86 bp, Artificial
  Hairpin sequence HSbrain_270, human
gcactcggggctgggtggctctccctaagcttgctctgacaaaagagttttgagttggtcttttggctgagcctgcccaggaaggc

SEQ ID NO: 3677 - DNA, 91 bp, Artificial
  Hairpin sequence HSbrain_271, human
cctggagaacttctatgctgactactataccacggccagcatcgcgctggtgtcctgcctggccatgtgcgtggtggtccgattcctcggg

SEQ ID NO: 3678 - DNA, 88 bp, Artificial
  Hairpin sequence HSbrain_272, human
ccagccacaacaatggtcttcctcagtccctcggccaaaaagacctttggcacagtgagctgagaatgactcatccccagtgccctgg

SEQ ID NO: 3679 - DNA, 72 bp, Artificial
  Hairpin sequence HSbrain_273, human
cctgccctcaaaccttgcctgccacctccccattcaggcctggtggcaggaagggacaagctgtggagctgg

SEQ ID NO: 3680 - DNA, 63 bp, Artificial
  Hairpin sequence HSbrain_274, human
ttcctaggggtctttttagcatgtatatgtgtaaatacttacatattgaaaggctcctgggga

SEQ ID NO: 3681 - DNA, 70 bp, Artificial
  Hairpin sequence HSbrain_275, human
ggcatggagggcccgggaaggcggcctagggacgcaggcaggctcggccgcctcttcaggccacggagcc

SEQ ID NO: 3682 - DNA, 85 bp, Artificial
  Hairpin sequence HSbrain_276, human
cccgtcctcaccctcttgggtgacatttgcagatgtctctgtatcttgacatttacacgtgtcactcgggacgatgcgtgtcggg

SEQ ID NO: 3683 - DNA, 59 bp, Artificial
  Hairpin sequence HSbrain_277, human; PT_from_HSbrain_277, chimp
gcttcagcacctcagctggagagtcctgggtgccgccctcccgctgaagtgctgacagc

SEQ ID NO: 3684 - DNA, 110 bp, Artificial
  Hairpin sequence HSbrain_278, human
ccagtgcagtggggctccgctgatgctcaggatcaccagcgtgcagcggggactccactgatgcctgggattgattgccagcatgcagcggggactccactgatgcctgg

SEQ ID NO: 3685 - DNA, 65 bp, Artificial
  Hairpin sequence HSbrain_279, human; PT_from_HSbrain_279, chimp
gcccgggtggggtggccactgccgcttctggttgtgatggcggcaggggtggctccggtgtgggc

SEQ ID NO: 3686 - DNA, 69 bp, Artificial
  Hairpin sequence HSbrain_28, human; PT_from_HSbrain_28, chimp
gcccgcgggcgtccaggtccccgccgggcctcagacagtgatgggcccgggcctggcgcccatgctggc

SEQ ID NO: 3687 - DNA, 95 bp, Artificial
  Hairpin sequence HSbrain_280, human
cactgtgggctgggccagggagcagctggtgggtgggaagtaagatctgacctggactccatcccacccaccccctgtttcctggcccacaggtg

SEQ ID NO: 3688 - DNA, 106 bp, Artificial
  Hairpin sequence HSbrain_281, human
gaatggattccctcaagtgggaccagcctatctctagcactcaagagtctgggagactggaggctggaggggccagtcccaaactcagatgggatcatgtggattc

SEQ ID NO: 3689 - DNA, 118 bp, Artificial
  Hairpin sequence HSbrain_282, human
catttcgtgctggagtggagcagcctctagaacgagctggaggattctgcctaccgatacagagccttcgagtcgtccggggccgccattacaatccacctccatccgcttggaaatg

SEQ ID NO: 3690 - DNA, 115 bp, Artificial
  Hairpin sequence HSbrain_283, human; PT_from_HSbrain_283, chimp
ggcttatgtgagtctccaggggatgggagagagaagggctggttctggattgttgggaaactccacagtacttgaccttgactctccctcaccaggcactgggggccacagtgct

SEQ ID NO: 3691 - DNA, 82 bp, Artificial
  Hairpin sequence HSbrain_284, human; MQbrain_2401, macaque
tctcggaggttctagggcagggaagtggggaggggaggttccctgagatctctgtctttgagtttggagtttgtctctgaga

SEQ ID NO: 3692 - DNA, 58 bp, Artificial
  Hairpin sequence HSbrain_285, human
ggcttgggctggtggtgggcccggctgcccctttgcctgctcctcagcctttacggcc

SEQ ID NO: 3693 - DNA, 82 bp, Artificial
  Hairpin sequence HSbrain_286, human; PT_from_HSbrain_286, chimp
gaaatgggctagaagacatttgggggttagggcctgactgcttccaggtcctggacagatgttaccttctgtgcctgtagtc

SEQ ID NO: 3694 - DNA, 104 bp, Artificial
  Hairpin sequence HSbrain_287, human; PT_from_HSbrain_287, chimp
gcacggggagcaatgatggagggagcccctgagagggaatctggtgagggaatccagactcccttctctcaaggggaggctcaacagaacattgacctgggggc

SEQ ID NO: 3695 - DNA, 117 bp, Artificial
  Hairpin sequence HSbrain_288, human
agagagcaagaatggggctccctagtggagatctgtcgaggggcaccaccagggctagcactgtaccgctaccgctggtggtggctctcgacctgcgctggccccttagggctccct

SEQ ID NO: 3696 - DNA, 62 bp, Artificial
  Hairpin sequence HSbrain_289, human
tgcccgtggaggatggagcatctgtatctgctcccgaaggtgcagatgcccagacctcggca

SEQ ID NO: 3697 - DNA, 61 bp, Artificial
  Hairpin sequence HSbrain_29, human; HSbrain_368, human; HSbrain_445, human; PT_from_HSbrain_29, chimp; PT_from_HSbrain_368, chimp; PT_from_HSbrain_445, chimp
gctgagggagctttgccctggttcctttgtgtccccacggtgccacgggaggctccctggc

SEQ ID NO: 3698 - DNA, 99 bp, Artificial
  Hairpin sequence HSbrain_290, human
gctgctttcccaggagggtgaagatggtgctgtgctgaggaaaggggatgcagagccctgcccagcaccaccacctcctatgctcctggatccctaggc

SEQ ID NO: 3699 - DNA, 88 bp, Artificial
  Hairpin sequence HSbrain_291, human; PT_from_HSbrain_291, chimp
gtgcaatgttcaccagtcagtgtttgaaggagaagagagcaaggtaagctgcctttttctgttcctaaaacatggggagatatggcat

SEQ ID NO: 3700 - DNA, 74 bp, Artificial
  Hairpin sequence HSbrain_292, human
gtgggggagggacagcgctgaccccggaggatgcaggcggcgtctgcaagggggtcaacgccttcctccccggc

SEQ ID NO: 3701 - DNA, 79 bp, Artificial
  Hairpin sequence HSbrain_293, human
tggattggctactccatcctggcctccacgtccaccttccagcagatgtggatcagcaagcaggagtaggacgagtccg

SEQ ID NO: 3702 - DNA, 110 bp, Artificial
  Hairpin sequence HSbrain_294, human; MQbrain_2410, macaque; PT_from_HSbrain_294, chimp
gaggcagatattttcaaagcaatgtgtgacaggtacagggacaaatcccgttaataagtaagaggatttgtgcttggctctgtcacatgccactttgaaaacctaccctc

SEQ ID NO: 3703 - DNA, 76 bp, Artificial
  Hairpin sequence HSbrain_295, human
ctcttttatgtagttacatcaccacttactgaaatgttgagatttcagtaagtggagatgtaactacatataagag

SEQ ID NO: 3704 - DNA, 89 bp, Artificial
  Hairpin sequence HSbrain_296, human; PT_from_HSbrain_296, chimp
tgctggcacaagcagtgactgtttggcagcttcaagtttagagctgtgaagacaggctgccattcacagtattttgctttttgacagta

SEQ ID NO: 3705 - DNA, 106 bp, Artificial
  Hairpin sequence HSbrain_297, human
agtctactcttcatcttgtgttgagacttcgtggtggtgataagaaaaggaagaagtcttacaccactcccaagaagaataagcacaagagaaagaaggttaagct

SEQ ID NO: 3706 - DNA, 119 bp, Artificial
  Hairpin sequence HSbrain_298, human
ttatgaggactttttctctgcccttcgtcaatatgcagcctgtgaacagcgtctgggaaagtagtggtcattggttgcataatttgatttgaggcttgtggaggaaaggaaccaagtga

SEQ ID NO: 3707 - DNA, 119 bp, Artificial
  Hairpin sequence HSbrain_299, human
cggggcagtgctgcccgggccaggcggagcagggaggacgtggtggggtgtttggaaggcggagcaagaacctaataaatgtgagccctggactctgaggccgggcagcgaatgttctg

SEQ ID NO: 3708 - DNA, 67 bp, Artificial
  Hairpin sequence HSbrain_3, human; HSbrain_405, human; PT_from_HSbrain_3, chimp; PT_from_HSbrain_405, chimp
ggctgtggtagatggaggtgccatcccagcattcatttctctgttggcatctccccatgctcacatc

SEQ ID NO: 3709 - DNA, 87 bp, Artificial
  Hairpin sequence HSbrain_30, human
gggaacagccctcctgcgggaggccggggatgggggcgggcctgcggttccaggctcctctctctcaccctcctgtcagggcctccc

SEQ ID NO: 3710 - DNA, 116 bp, Artificial
  Hairpin sequence HSbrain_300, human; HSbrain_403, human
ggtgagcgcacactgggacactatgatgaggctaggtgaacacacactgggacactataatgaggctcggtgtgtgcacacgggggcactatgatgaggctaggtgagcgcacact

SEQ ID NO: 3711 - DNA, 116 bp, Artificial
  Hairpin sequence HSbrain_301, human
ggtgagcgcacactgggacactatgatgaggctaggtgaacacacactgggacactataatgaggctcggtgtgtgcacacgggggcactatgatgaggctaggtgagtgcacact

SEQ ID NO: 3712 - DNA, 80 bp, Artificial
  Hairpin sequence HSbrain_302, human; PT_from_HSbrain_302, chimp
tggtgacacacctgtgtaggaggccaagacttggcagaggatgtagtctaggtgtcctggtatatataaatggtcactca

SEQ ID NO: 3713 - DNA, 119 bp, Artificial
  Hairpin sequence HSbrain_303, human
atccctgcctctactggcactgccaaggctgtgggcaaggtcatccctgagctgaacgggaagctcactggcatggccttctgtgtccccactgccaatgtgtcagtcgtggacctgat

SEQ ID NO: 3714 - DNA, 71 bp, Artificial
  Hairpin sequence HSbrain_304, human
ctacctcccggcagaggaggctgcagaggctggctttccaaaactctgccccctccgctgctgccaagtgg

SEQ ID NO: 3715 - DNA, 118 bp, Artificial
  Hairpin sequence HSbrain_305, human
ctgacagaggaggggtgctggtctgccttctctgtgagctgtgccttgggtactgcaccatcctgctttgcgtgaggctgctgacggaggaggggtgctggtctgccttctctgtgag

SEQ ID NO: 3716 - DNA, 118 bp, Artificial
  Hairpin sequence HSbrain_306, human
ctgacggaggaggggtgctggtctgccttctctgtgagctgtgccttgggtactgcaccatcctgctttgcgtgaggctgctgacggaggaggagtgctggtctgccttctctgtgag

SEQ ID NO: 3717 - DNA, 118 bp, Artificial
  Hairpin sequence HSbrain_307, human
ctgacggaggaggggtgctggtctgccttctctgtgagctgagctttgggtactgcaccatcctgctttgtatgaggctgctgacggaggaggggtgctggtttgccctccctgtgag

SEQ ID NO: 3718 - DNA, 77 bp, Artificial
  Hairpin sequence HSbrain_308, human; PT_from_HSbrain_308, chimp
ggcccaggtgaggccatccgggcttcttcctccctccccagggcaaaggtcaggcccaggtgccctcgttccgtccc

SEQ ID NO: 3719 - DNA, 115 bp, Artificial
  Hairpin sequence HSbrain_309, human
ctgccctgttctccatcctgggcctcaccggagctttgccacagcagcacttgagccgggggccatagtgcttgtggacaaggacggcgaggccaaggagagccagcagcagcag

SEQ ID NO: 3720 - DNA, 118 bp, Artificial
  Hairpin sequence HSbrain_31, human
cctgggcttcagtattcgggggtcctgggggccggggtgggcaggggtgacttggagagagtgacttgcgggggacaccctctcacccggcccctcgtgccccaggaagagcagcggg

SEQ ID NO: 3721 - DNA, 61 bp, Artificial
  Hairpin sequence HSbrain_310, human; PT_from_HSbrain_310, chimp
ggctgctagggcagcagctggctcagggcacactctctcgtgccagcttctgccaccagcc

SEQ ID NO: 3722 - DNA, 95 bp, Artificial
  Hairpin sequence HSbrain_311, human; PT_from_HSbrain_311, chimp
cgtgtggatcggcggctccatcctggcctcgctgtccaccttccagcagatgtggatcagcaagcaggagtatgacgagtccggcccctccatcg

SEQ ID NO: 3723 - DNA, 107 bp, Artificial
  Hairpin sequence HSbrain_312, human
ctgcttttctcttgttctctccctgtagttactggggcttccggatgcagatgacgatgcgtttgaagagtacagtgctgacgtggaagaagaggagccagaggcgg

SEQ ID NO: 3724 - DNA, 88 bp, Artificial
  Hairpin sequence HSbrain_313, human
ctgattcctctcatttccagcttctcagtttctgcctgggcaatggccaggggccaggagtggggagagttgtgatggaggggagagg

SEQ ID NO: 3725 - DNA, 107 bp, Artificial
  Hairpin sequence HSbrain_314, human
tctcagctccaccccactgtttcttggtcagcctcagtgatggcctgaccccagctgtgaggccttgtgagctaaggctgaagagaccttgcctgtgggagctgggg

SEQ ID NO: 3726 - DNA, 119 bp, Artificial
  Hairpin sequence HSbrain_315, human
gcttcagtctggggtggtgggtgaggggctgcgtgagagagggaggctgggggaggattactcttcgggtggccccaccctcactcattcccattccctcatccttctaggacagaagt

SEQ ID NO: 3727 - DNA, 109 bp, Artificial
  Hairpin sequence HSbrain_316, human
cagtgctttgacctggagtcgtacctgcagctcaactgtgagcgggggacttggaggtgtcctgtgtgcaagtgagtctcagatgcagcgtgtgatggaggaggggctg

SEQ ID NO: 3728 - DNA, 79 bp, Artificial
  Hairpin sequence HSbrain_317, human
ctggaggtgccatgctgggtgttgtgtgtctgcaggtctgaggcccttcatccctgagaaggacagccagcacttcgag

SEQ ID NO: 3729 - DNA, 117 bp, Artificial
  Hairpin sequence HSbrain_318, human
ggcacccaggaccctggtcagtccatggaagggcctgggaggatgtgggccagacagagggaactccttgggctgtgtccccagcagccctacgtggtgagcagagtcccgagtccc

SEQ ID NO: 3730 - DNA, 103 bp, Artificial
  Hairpin sequence HSbrain_319, human
agctctgtcagggccccattcccagcagaggcttcaggtgctttgtgtagagtccagggcagctggagctttgttggggagacttctggacccaaagggagct

SEQ ID NO: 3731 - DNA, 98 bp, Artificial
  Hairpin sequence HSbrain_32, human
gaggtgagccggtcccagaggcagggcgagggggaagcgggagtggggtccgcagcggacccagccctgcctcccccctgcaggagatcgtcaacttc

SEQ ID NO: 3732 - DNA, 104 bp, Artificial
  Hairpin sequence HSbrain_320, human
tttaatttgtacatattttattgctataaaacaggtattggcaagctgcctaaactgcagtgaaggcctttgattcctgtgactctgtgataaaacaaactgag

SEQ ID NO: 3733 - DNA, 59 bp, Artificial
  Hairpin sequence HSbrain_321, human
ggactcctatgctttggcccaggtttggcctcagataaatgaggccctgggaggtgtct

SEQ ID NO: 3734 - DNA, 113 bp, Artificial
  Hairpin sequence HSbrain_322, human
tgccgccaacactgtctgaggcctctcctgcccgcttcccatgcagaagaaaatcatgatcatcatctgctgtgtgatcctgggcatcgtcatcgcctccactgttgggggca

SEQ ID NO: 3735 - DNA, 117 bp, Artificial
  Hairpin sequence HSbrain_323, human; PT_from_HSbrain_323, chimp
agatgtctgtgctgagccctggaggcacccgtggtggggggcaggggcagggaacccctcccggggctcagccctgctcctctgtcctccgcccggcccaggcttcgtgcagtttct

SEQ ID NO: 3736 - DNA, 67 bp, Artificial
  Hairpin sequence HSbrain_324, human
ggctgtggtagacggaggtgccatcccagcattcatttttctgttggcatctccccatgctcacatc

SEQ ID NO: 3737 - DNA, 81 bp, Artificial
  Hairpin sequence HSbrain_325, human
tttttttgtcacgtcagaatgggatagaaaaacatctcctgagagagacgtttgaggattccaatctgatacccaaagaga

SEQ ID NO: 3738 - DNA, 100 bp, Artificial
  Hairpin sequence HSbrain_326, human
gtccctttaacggcgcggcccgaggggcgcaggcgggagggcggcggggctgagcgcgccctccgtgctgcgtccctcgcgccgctcccgggccgggggc

SEQ ID NO: 3739 - DNA, 106 bp, Artificial
  Hairpin sequence HSbrain_327, human
ttgtttctgggctcctaggcctgtatgaactcaatctcaccaccgatagccctgccaccacgggagcggtggtgaccatctcggccagcctggtggccaaggacaa

SEQ ID NO: 3740 - DNA, 83 bp, Artificial
  Hairpin sequence HSbrain_328, human
ggctgctgaagatggcggaggggcaggtcctggtgcttgatggtcgaggccatctcctgggccgcctggcggccatcgtggct

SEQ ID NO: 3741 - DNA, 59 bp, Artificial
  Hairpin sequence HSbrain_329, human; MM_from_HSbrain_329, mouse; MQbrain_2384, macaque; PT_from_HSbrain_329, chimp
tttgctaatgagtggtggtcctgcccccctggctggcaggcccacccttcttcagcaag

SEQ ID NO: 3742 - DNA, 115 bp, Artificial
  Hairpin sequence HSbrain_33, human
tcacaatgatcttcatgggttaccagaacgtggaggatgaggccgagaccaagaaggtgctgggccttcaagataccatcacggcggagctggtggtcatcgaagacgcggctga

SEQ ID NO: 3743 - DNA, 75 bp, Artificial
  Hairpin sequence HSbrain_332, human
cctcagcgcccaggagctgcggtccggagccgacaccgagctgggcccaggtcgcaggctcctcaggccaaaagg

SEQ ID NO: 3744 - DNA, 74 bp, Artificial
  Hairpin sequence HSbrain_333, human; PT_from_HSbrain_333, chimp
cctcctcgatgctgaggggcatgaagaggggtggcctgaacttggccgcccactgccagccactcttgaggtgg

SEQ ID NO: 3745 - DNA, 79 bp, Artificial
  Hairpin sequence HSbrain_334, human
taagaaacggtggcggcggtggtggtggtggatggggggcggctctcactaccttgcccaggctggtctcaaactcttg

SEQ ID NO: 3746 - DNA, 77 bp, Artificial
  Hairpin sequence HSbrain_335, human
tggctctggcttgggactggactggggctggccggataactccgcagccgctctcagctcagtcctaggtggaaacg

SEQ ID NO: 3747 - DNA, 83 bp, Artificial
  Hairpin sequence HSbrain_336, human; HSbrain_339, human; PT_from_HSbrain_336, chimp; PT_from_HSbrain_339, chimp
tccatttctatgcctgtgaagatgtgatgagcaagccttggaagcctcagttcctcagactcttccaggcatggggccatgga

SEQ ID NO: 3748 - DNA, 119 bp, Artificial
  Hairpin sequence HSbrain_337, human; PT_from_HSbrain_337, chimp
gccttgattccagaagaaggagctctctgaatatgggtttactagttggtggtgaattcatgagtcgccaactattaggcctttatgtccagatattatcctaatttatggagtaaggt

SEQ ID NO: 3749 - DNA, 94 bp, Artificial
  Hairpin sequence HSbrain_338, human; PT_from_HSbrain_338, chimp
gcccaagtcgaggccaagccagatgagctgaaggtgacagtcaagctgaagcctcggctaagagctgtccatggtgggtttgaagattgcaggc

SEQ ID NO: 3750 - DNA, 71 bp, Artificial
  Hairpin sequence HSbrain_34, human; PT_from_HSbrain_34, chimp
ttggctttggacaaccaggccccaacttggtccctgccctagggacctccagcctggtgcccagtgctcag

SEQ ID NO: 3751 - DNA, 106 bp, Artificial
  Hairpin sequence HSbrain_340, human; PT_from_HSbrain_340, chimp
agcttactcttcatcttgtgttgagacttcgtggtggtgctaagaaaaggaaggagtcttaccccactcccaagaagaataagcgcaagagaaagaaggggaagct

SEQ ID NO: 3752 - DNA, 95 bp, Artificial
  Hairpin sequence HSbrain_341, human
ctgtacacatctgcattgctctcatggcagctatgtggaggttgtgttcccatacacatctgcattgctctcatgatagctgtgtggaggttgag

SEQ ID NO: 3753 - DNA, 102 bp, Artificial
  Hairpin sequence HSbrain_342, human
caggcagagagatgagctagagaggaagacagagaaagagtgagtgttctttactgaactcactctttctctgtctgagttttcaaggtctttaaaatcctg

SEQ ID NO: 3754 - DNA, 111 bp, Artificial
  Hairpin sequence HSbrain_343, human; PT_from_HSbrain_343, chimp; PT_from_HSbrain_344, chimp
gtagagagtgcattctgcaggatgagtgaaaaggcatttatgattcttgggggcagatgttctacagttgcctgtgctagttcatgtctttctgcagatcacattcttaac

SEQ ID NO: 3755 - DNA, 111 bp, Artificial
  Hairpin sequence HSbrain_344, human
gtagagagtgcattctacaggatgagtgaaaaggcatttatgattcttgggggcagatgttctacagttgcctgtgctagttcatgtctttctgcagatcacattcttaac

SEQ ID NO: 3756 - DNA, 104 bp, Artificial
  Hairpin sequence HSbrain_345, human; PT_from_HSbrain_345, chimp
actatagattcagctgtgggatctggttctgtagctgagagcacatcgctaaacatagatgtgcagtctgaggcttcagataccacggtaagcggctttttggt

SEQ ID NO: 3757 - DNA, 65 bp, Artificial
  Hairpin sequence HSbrain_346, human; PT_from_HSbrain_346, chimp
gagggacaggtggacaacggtcacctatctgtagccaggggcagttgtgtggccagctgtctctc

SEQ ID NO: 3758 - DNA, 119 bp, Artificial
  Hairpin sequence HSbrain_347, human; PT_from_HSbrain_347, chimp
gggggcgagggagagatgagcggaaggtggaggtgggtagcccaggttcagggagctggctttctctctcctgcccccctgctccctccactctgcccagctgccctcccctcgcccct

SEQ ID NO: 3759 - DNA, 86 bp, Artificial
  Hairpin sequence HSbrain_348, human; PT_from_HSbrain_348, chimp
gcagggagctgactctgcagaagggtgacattgtctacatccacaaggaggtggacaagaactggctggagggagagcaccacggc

SEQ ID NO: 3760 - DNA, 94 bp, Artificial
  Hairpin sequence HSbrain_349, human; PT_from_HSbrain_349, chimp
actttgtgactgtctttgagtgacctagtctgggacccattcattggtgggttctaaggttagaagctcatccaggatattttcaatattaagt

SEQ ID NO: 3761 - DNA, 98 bp, Artificial
  Hairpin sequence HSbrain_35, human
gcagctgatttctgagaccatggtccgatgggctcaggagtctgtcattgaagaccccgagctggtgagggccatgtttgtgttgctccatcggcagt

SEQ ID NO: 3762 - DNA, 90 bp, Artificial
  Hairpin sequence HSbrain_350, human
gcctgctcgctgcctttgaccagtggagggaatgggccgacagcaagtcctgctgtgactactctctgcatgtggacatcagtgagtggc

SEQ ID NO: 3763 - DNA, 118 bp, Artificial
  Hairpin sequence HSbrain_351, human
gtgcagtggtgtgatcatagccaatagagggtgcacaggcacgggagctcaggtgaggcagggagctgagctcacctgacctcccatgcctgtgcaccctctattatatcactcgtat

SEQ ID NO: 3764 - DNA, 110 bp, Artificial
  Hairpin sequence HSbrain_352, human; PT_from_HSbrain_352, chimp
tggttcttccatgtgaagttgtctcgggctctgggctgacgagagaacacctggtaaccaggttagccctctgtcagtcacccagggcagggcagcatggtgcggattca

SEQ ID NO: 3765 - DNA, 71 bp, Artificial
  Hairpin sequence HSbrain_353, human; PT_from_HSbrain_353, chimp
gcttcccgactcccaggagctcaagccaagcccagaggcagtggctggggtccctgcaggtcatgaggggc

SEQ ID NO: 3766 - DNA, 82 bp, Artificial
  Hairpin sequence HSbrain_354, human
tataaatgcaagtaaaacaggtttgaacttcttaacttccagaagataggaggatgggacctgtgatactgtgctgctggtg

SEQ ID NO: 3767 - DNA, 114 bp, Artificial
  Hairpin sequence HSbrain_355, human
aggactctgaggagtactcttgctccacagattaaactctcagcagcaacttcaagaatcatttttctataggggtctgggaggaattctggaggagagtaaagtcgaagttct

SEQ ID NO: 3768 - DNA, 119 bp, Artificial
  Hairpin sequence HSbrain_356, human
ataatggtttgtggaatggctagcacaggatttcaacaaagttaagggacttaatacaattcttacaaagtcccttaactttgttgaaatcctgtgctagccattccacaaaccattat

SEQ ID NO: 3769 - DNA, 119 bp, Artificial
  Hairpin sequence HSbrain_357, human
ataatggtttgtggaatggctagcacaggatttcaacaaagttaagggactttgtaagaattgtattaagtcccttaactttgttgaaatcctgtgctagccattccacaaaccattat

SEQ ID NO: 3770 - DNA, 54 bp, Artificial
  Hairpin sequence HSbrain_358, human
gcctctgaagcctcatggaggacatgtggtcagtcctccttgagattctcaggc

SEQ ID NO: 3771 - DNA, 99 bp, Artificial
  Hairpin sequence HSbrain_359, human
gaggagtgaggggaagcaggccaacctcgacgatctcctcagcacctgaacgccaaggctggggagatcctcgaggttggcctgctttccctccttttc

SEQ ID NO: 3772 - DNA, 55 bp, Artificial
  Hairpin sequence HSbrain_36, human
gcctccagaagctgttgtctcctctctggggacagcagctcctgcctttggaggc

SEQ ID NO: 3773 - DNA, 68 bp, Artificial
  Hairpin sequence HSbrain_360, human; PT_from_HSbrain_360, chimp
ggctactgtcacatccctcgcccaatccgtttacttgttttaaagcaaaggttagtgtgacggtagct

SEQ ID NO: 3774 - DNA, 82 bp, Artificial
  Hairpin sequence HSbrain_361, human
tttggggtgatgggtggggcaatgggatcaggtgcctcaaagggcatcccacctgatcccacagcccacctgtcaccccaaa

SEQ ID NO: 3775 - DNA, 111 bp, Artificial
  Hairpin sequence HSbrain_362, human; PT_from_HSbrain_362, chimp
gatcattctgttctgcttgctgctctacttctacaaggagaagaacgccaacaacattgtcgtgattcttctcttggtggcgttacttggtaagttggcatctggatgatt

SEQ ID NO: 3776 - DNA, 117 bp, Artificial
  Hairpin sequence HSbrain_363, human; PT_from_HSbrain_363, chimp
ctgtggattgcggcactcctgcagctgtgcagagacctagctgggtgtctcccttgcagaaggctgtgggggacccgggcgggggtcagtaccctgtagactgcggcactcctgcag

SEQ ID NO: 3777 - DNA, 106 bp, Artificial
  Hairpin sequence HSbrain_364, human
tgcaggtggggagaggccctcctacacagcctcttttcctgcagcattctggatggccactgtggtgtgaaaggaggaatatgaggaggtgcatagtcatcatgca

SEQ ID NO: 3778 - DNA, 108 bp, Artificial
  Hairpin sequence HSbrain_365, human
cctgggttccagacaccccgaccccccaccaggcccacagtgtgaatcctgcacccatcagggaggcagggataggtgggccaccggggtgtgggtgctgggctgggg

SEQ ID NO: 3779 - DNA, 73 bp, Artificial
  Hairpin sequence HSbrain_366, human
cggctgactgtggatgaggctgtgcggaagggcctcgtggggcccgagctgcacgaccgcctgctctcggctg

SEQ ID NO: 3780 - DNA, 79 bp, Artificial
  Hairpin sequence HSbrain_367, human; HSbrain_404, human
ggcgccggaggccccgcggctcctgcgccgccacagctcagccctgtgcaggcctagggcggcggggcctcccccagcc

SEQ ID NO: 3781 - DNA, 99 bp, Artificial
  Hairpin sequence HSbrain_369, human
tgatcgtgtaatctttcttagctgagaacgttacggaacaaaggcccgcaagggcctggcagttgagacacttcagggcagttaagaaaattcatttca

SEQ ID NO: 3782 - DNA, 103 bp, Artificial
  Hairpin sequence HSbrain_37, human
ggcacgtttaactggcagaaggaagatgtgaaaatattttgaatcctttgtacacaaagagaaaatgaatcttttcagttatttccaagccaggaaactcgct

SEQ ID NO: 3783 - DNA, 106 bp, Artificial
  Hairpin sequence HSbrain_370, human; PT_from_HSbrain_370, chimp
ggaacatcacaggctggcatttgcctaccttgttagtctcatgatcagacacaaatatggctctttgtggctggtcatgaggctaacaaggtaggcacctggaacc

SEQ ID NO: 3784 - DNA, 106 bp, Artificial
  Hairpin sequence HSbrain_371, human
caggtgctcagatcattcagggaggaggtggtactaggggccagcaacctgattacccctctttggccctttgtacccctccagtctccgtccactgagtcgcctg

SEQ ID NO: 3785 - DNA, 69 bp, Artificial
  Hairpin sequence HSbrain_372, human; MQbrain_2241, macaque; PT_from_HSbrain_372, chimp
gtttagctggagtggggagcaggagccccaggaacaggggtgttggctgagccccattctgggtcaggc

SEQ ID NO: 3786 - DNA, 96 bp, Artificial
  Hairpin sequence HSbrain_373, human
ctgaggagagggcagtcagggcatgaagctgcagccgccaccgctgcttctacaaaatctaagcactgggctgcagccatgtcctactgccagcag

SEQ ID NO: 3787 - DNA, 107 bp, Artificial
  Hairpin sequence HSbrain_374, human
agttgaagtgttattttggaaactgagatggggttcctggagtcttgatcttctcactttacctactctcatactcccaccccctccaccccaccccacacttgact

SEQ ID NO: 3788 - DNA, 117 bp, Artificial
  Hairpin sequence HSbrain_375, human
ctcgctggctgcttcgctcgcgctctacgcgctcagtccccggcggtagcaggagcctggacccaggcgccgccggcgggcgtgaggcgccggagcccgggtgagcagcgcagatag

SEQ ID NO: 3789 - DNA, 109 bp, Artificial
  Hairpin sequence HSbrain_376, human
aagaatgaggggtgggagggatttatagttagaaacgacagtgcaggaaggggtattttcttgttgtcagggctggaatgaatcactgctgctcaagtcaaaggttctt

SEQ ID NO: 3790 - DNA, 87 bp, Artificial
  Hairpin sequence HSbrain_377, human
gggccatagcaatcctgtgatttatgcatggaggctgcttctcctcagcagctgccatagcccggtcgctggtacatgattcttcct

SEQ ID NO: 3791 - DNA, 116 bp, Artificial
  Hairpin sequence HSbrain_378, human
ttcagttttgaggctcctgtcctcaggcagtgtggactcaggccctgggagtcatgtggatgccagtagcctgggcccacagagctgctgggatgtggggggcatatcaagttgaa

SEQ ID NO: 3792 - DNA, 92 bp, Artificial
  Hairpin sequence HSbrain_379, human
ggctcggctcgggccttgctgggactcgggctcccagggtctgctcggtctctctcggggcactcgggtctttgctgggcccggcgccggcc

SEQ ID NO: 3793 - DNA, 77 bp, Artificial
  Hairpin sequence HSbrain_38, human
cgggactttgtggaggcgccgtcgcagatgctggagaactgggtgtgggagcaggagccgctgctgcggatgtcgcg

SEQ ID NO: 3794 - DNA, 106 bp, Artificial
  Hairpin sequence HSbrain_380, human
cggagcagcccttgcccctcagagcacactccctccatcaccccagcagcggctctcctgatattggtattggcgagtgtgtgcgtgccaggcgcagcgtgctctg

SEQ ID NO: 3795 - DNA, 87 bp, Artificial
  Hairpin sequence HSbrain_381, human
cctgagaaattggtgaggtatctttctctcagagtcttttttatgaagtctgatgttgagaggttcttccaggttggagttctcagg

SEQ ID NO: 3796 - DNA, 59 bp, Artificial
  Hairpin sequence HSbrain_382, human; PT_from_HSbrain_382, chimp
gagcctgttggtggcccactccctggactctgtgtgcagggccctgtgggagcaggctt

SEQ ID NO: 3797 - DNA, 119 bp, Artificial
  Hairpin sequence HSbrain_383, human
tttcttagatctagtttaaaaaaaaaaaaaaccacataacaattctttgaagaaaggaagggattaaataatttttttccctaacactttcttgaaggtcaggggctttatctatgaaa

SEQ ID NO: 3798 - DNA, 46 bp, Artificial
  Hairpin sequence HSbrain_384, human; PT_from_HSbrain_384, chimp
tccagcccagtccccggagaccacccctctttgggcgactgctgga

SEQ ID NO: 3799 - DNA, 92 bp, Artificial
  Hairpin sequence HSbrain_385, human
ctgagttcccgggagctgggccctgcctgcagccagggctggggttgccagaggccctggagggaaggacagtccctgctggggaagaacag

SEQ ID NO: 3800 - DNA, 120 bp, Artificial
  Hairpin sequence HSbrain_386, human
ccggcctcccaaaatgttgggattataggtgtgggatgacaggtgtgagccaccgcgcccggcccgcgtgcctgtcgttttcagcctgtcagtcagtcagtcctgcaagtgggggcatgg

SEQ ID NO: 3801 - DNA, 74 bp, Artificial
  Hairpin sequence HSbrain_387, human
ggggttcgttctctccctgaagcacttgttcaactcctgttaaagccgcgtgcctcaaggggaggctggacccc

SEQ ID NO: 3802 - DNA, 95 bp, Artificial
  Hairpin sequence HSbrain_388, human; PT_from_HSbrain_388, chimp
ggctccaaggagtactggtttgtgctgactgctgagaatctgtcctggtacaaggatgatgaggtgagtcaagggccagtggtcatcaaggggct

SEQ ID NO: 3803 - DNA, 70 bp, Artificial
  Hairpin sequence HSbrain_389, human; PT_from_HSbrain_389, chimp
ctgacccactgcccctgcctgagaacgccatctcggctcccgggcacagctgatggggtttggggattag

SEQ ID NO: 3804 - DNA, 86 bp, Artificial
  Hairpin sequence HSbrain_39, human
ctttaaacatcagctgcggcctccaggatcctgacagcgcctggcccgtggggctcagcagtccagggggttgcagggacataaag

SEQ ID NO: 3805 - DNA, 99 bp, Artificial
  Hairpin sequence HSbrain_390, human
ccagcaaggcccctcctcccggccctgctcctgcctctttgtaggaaccgaaagattcctgttcagaggcaggagctggggctatttttggcactgtgg

SEQ ID NO: 3806 - DNA, 100 bp, Artificial
  Hairpin sequence HSbrain_391, human
gtgggcaccaacctgcagaggggtgtgggtgctgggctgggattcgcagccccccgaggctgcccaagcccatccttcccaccagcagggcacagcctac

SEQ ID NO: 3807 - DNA, 105 bp, Artificial
  Hairpin sequence HSbrain_392, human; PT_from_HSbrain_392, chimp
ccccggggaggggcagggcctggagcttcccactaaaaacatgttttgatgctgtgtgcttttggctgggcctcgggctccaggccctgggaccccttgccaggg

SEQ ID NO: 3808 - DNA, 98 bp, Artificial
  Hairpin sequence HSbrain_393, human; MQ_from_HSbrain_393, macaque; PT_from_HSbrain_393, chimp
cctgcgtggccaccctccatctcatactcccacccccaggtcatccctaatgacaggaagatcatctggccaggcggagagacagagaagcctcgagg

SEQ ID NO: 3809 - DNA, 71 bp, Artificial
  Hairpin sequence HSbrain_394, human; PT_from_HSbrain_394, chimp
gcacttcttcatgcccggctttgccccactgaccagccggggcagccagcagtaccgggcgctgaccgtgc

SEQ ID NO: 3810 - DNA, 71 bp, Artificial
  Hairpin sequence HSbrain_395, human
atggctgcctgcgacccccgccatggccgctacctgacggttgccgccgtgttcaggggccgcatgtccat

SEQ ID NO: 3811 - DNA, 95 bp, Artificial
  Hairpin sequence HSbrain_396, human; PT_from_HSbrain_396, chimp
cggcaggagcggggccggtcccaggagcggaggcagccctcatcctcctcctcggagaagcagcgcttctactcctgcgaccgctttgggggccg

SEQ ID NO: 3812 - DNA, 79 bp, Artificial
  Hairpin sequence HSbrain_397, human
agaaccacagccatttccccaggcagtgttgggtcgagaatccacttttctaaacccacacagcctagctggcttgtct

SEQ ID NO: 3813 - DNA, 119 bp, Artificial
  Hairpin sequence HSbrain_398, human; HSbrain_500, human
gccctgcggggcccggcgctcagaagtgatgaattgatcagatagacgaggccgggcttgtccccggccactgattatcgaggcgattctgatctgggcacggccaccgggctgcgggc

SEQ ID NO: 3814 - DNA, 101 bp, Artificial
  Hairpin sequence HSbrain_399, human; HSbrain_507, human; MQbrain_2216,MQbrain_2218, macaque; MQbrain_2360, macaque; PT_from_HSbrain_399, chimp; PT_from_HSbrain_507, chimp
tcttgggtcctctttaatggcctaacttcttcaaaccatgattttcttttagcttgtcaaggtggctttggagaaaagtctggcaactgtggagacccaga

SEQ ID NO: 3815 - DNA, 61 bp, Artificial
  Hairpin sequence HSbrain_40, human; PT_from_HSbrain_40, chimp
ccctgcatccagccatgggggcctctgcgattgccggaaggttgcatggctggtcccaggg

SEQ ID NO: 3816 - DNA, 73 bp, Artificial
  Hairpin sequence HSbrain_400, human; HSbrain_508, human
tccagacagatccctctgtcctcactctctgatttcattgaggatcttgggtgagagagagggacctgcagga

SEQ ID NO: 3817 - DNA, 67 bp, Artificial
  Hairpin sequence HSbrain_401, human
cctcaagacgtcctgtggtctgcctcttggcaacaaagaagcctgcagtgccataggagccctgagg

SEQ ID NO: 3818 - DNA, 77 bp, Artificial
  Hairpin sequence HSbrain_402, human; PT_from_HSbrain_402, chimp
gcggctgccgaagatggcggaggtgcaggtcgaggccatctcctgggcctcctggtagccatcgtggctaagcaggt

SEQ ID NO: 3819 - DNA, 68 bp, Artificial
  Hairpin sequence HSbrain_407, human
gccatcctgcctggcactggctgatgggcacctctgttggttccatcagccagagctctgccaaaggc

SEQ ID NO: 3820 - DNA, 92 bp, Artificial
  Hairpin sequence HSbrain_408, human
gtctcttgatttctgtaattcttctgctgatctgtgagtagggcactgccctgctcccaatcaaacttagtctttttatgagaaacctggac

SEQ ID NO: 3821 - DNA, 107 bp, Artificial
  Hairpin sequence HSbrain_409, human
catggcttgtatctctgccaaccaagccatgaccacaggtgttggtttgattgcttctggccagtgtgatgtgatcatggcaggtggtgtcgagttgatgttccatg

SEQ ID NO: 3822 - DNA, 92 bp, Artificial
  Hairpin sequence HSbrain_41, human; PT_from_HSbrain_41, chimp
gatgaaatccacgatgggatgaacctggagctttattatcaatagatgagaatcctcatcttcctgccccgctttcctctcccatcctcatc

SEQ ID NO: 3823 - DNA, 112 bp, Artificial
  Hairpin sequence HSbrain_410, human; PT_from_HSbrain_410, chimp
agttctcattgcctctgcactgcttctgtgaacagtctttgtctcctccccacctttggtgggaagtgtgaggcagtcctggccaagacactcatgctctggcaatgtggct

SEQ ID NO: 3824 - DNA, 113 bp, Artificial
  Hairpin sequence HSbrain_411, human
acattgagtgactttccaggtgtcacacagtgagtggcataatcagagtacaatttgagtcatgcccatacatcacattgccagtgattacccaaggaaagtgacgtacatgt

SEQ ID NO: 3825 - DNA, 66 bp, Artificial
  Hairpin sequence HSbrain_412, human
aatggggtaggcagcgggggtgccctcaactagaagagtgatggcacacctgagctgcaccttgtt

SEQ ID NO: 3826 - DNA, 110 bp, Artificial
  Hairpin sequence HSbrain_413, human
tgatgacccagattcagttgtaatccaagatgttattgaggacgttgttatagaagatgttcagtgcccagatatcatggaagaagcagatgtgtctgaaacggtcatca

SEQ ID NO: 3827 - DNA, 106 bp, Artificial
  Hairpin sequence HSbrain_414, human
ctgcaccagcttaacatgtgggtgtgatttgaaagttaggttttcagtttggattctttctggatgagctgttctgtctgcccacacctgtagtgctgaaatacag

SEQ ID NO: 3828 - DNA, 70 bp, Artificial
  Hairpin sequence HSbrain_415, human; PT_from_HSbrain_415, chimp
gctcatcaacgagaggggagagctcaagctggctgactttggtaccactggcctcccctttcttattggc

SEQ ID NO: 3829 - DNA, 111 bp, Artificial
  Hairpin sequence HSbrain_416, human
tgaggactttttctctgcccttcgtcaatatgcagcctgtgaacagcgtctgggaaagtagtggtcattggttgcgtaatttgatttgaggcttgtggaggaaaggaccca

SEQ ID NO: 3830 - DNA, 84 bp, Artificial
  Hairpin sequence HSbrain_417, human
tccatccgtattgaggatgaggacacctctgaactcacagagcaggctgtgagtttagagctgtctgctctaaactcaggtgga

SEQ ID NO: 3831 - DNA, 82 bp, Artificial
  Hairpin sequence HSbrain_418, human
gcatagcccgggatcggggaccacctccggggctgcctccggttcttgaggccccccggagcggccctgagaccactgtcgc

SEQ ID NO: 3832 - DNA, 91 bp, Artificial
  Hairpin sequence HSbrain_419, human
agggcagaggccaccagggagtggggatcctgagggaaggggcagggatttctccttcttcttggtcctggctcccaagggcttctgtctt

SEQ ID NO: 3833 - DNA, 77 bp, Artificial
  Hairpin sequence HSbrain_42, human
ggtgcagaggagcctcccgggcgccggttacaacaacaccttcccctactcctggggcggcttctccgacatggact

SEQ ID NO: 3834 - DNA, 118 bp, Artificial
  Hairpin sequence HSbrain_420, human
gcagccttgccgctcacctccctgtacctccaacaaccccaccccttccccactgtttctctcctcagctggtggctgggggtcagttccgggtggtcaaggagcccctcggctttgt

SEQ ID NO: 3835 - DNA, 116 bp, Artificial
  Hairpin sequence HSbrain_421, human
ggctccgccgacggcgtccccgccccgctcctgcccggacttggagcagccccgcctccctgcgcggcggccatgttgactccgggcgagcgggatgggggtcgccgctcggcgcc

SEQ ID NO: 3836 - DNA, 89 bp, Artificial
  Hairpin sequence HSbrain_422, human; PT_from_HSbrain_422, chimp
ttgggcatggaatcctgcggcatccacaagaccaccttcaactccatcatgaagtgtgacgtggacatccgcaaagacctgtacgccaa

SEQ ID NO: 3837 - DNA, 92 bp, Artificial
  Hairpin sequence HSbrain_423, human; PT_from_HSbrain_423, chimp
gccaggctcagcccgccccattcctgagcctttggtacagttagctgtagacaagggctaccggattgcagagggaaatgaaccgccttggt

SEQ ID NO: 3838 - DNA, 116 bp, Artificial
  Hairpin sequence HSbrain_424, human
ctccgactgggttgcattttagtctcttgtttttggggtttggcaagggtacatttacctaggttgatggtaaagtcagagatggggggaggagggatttgcagattcaatcggag

SEQ ID NO: 3839 - DNA, 85 bp, Artificial
  Hairpin sequence HSbrain_425, human
gtgcctcttccccctttgctaggagttatgtgggaagagagggtggcctctgtgttctgggttgtcagtggaggggaaggggtat

SEQ ID NO: 3840 - DNA, 95 bp, Artificial
  Hairpin sequence HSbrain_426, human
cctctcccaacatggtggcctcagcaaaaaagaagaagaaggagaagactctccctaacatactttctggctgaggatgggaggattggtggagg

SEQ ID NO: 3841 - DNA, 85 bp, Artificial
  Hairpin sequence HSbrain_427, human; PT_from_HSbrain_427, chimp
ctctgtccaaatgcgtctggaacagagactccgagatggacaggaagatggctctgtgatcgaacgccaggtgggcacctttgag

SEQ ID NO: 3842 - DNA, 94 bp, Artificial
  Hairpin sequence HSbrain_428, human; PT_from_HSbrain_428, chimp
gtggcaggagtcggctttgagtcaaagcctgggactgaggaggaagaaatcactgttgggtcctggttctggcctgaagaagaagccagtatac

SEQ ID NO: 3843 - DNA, 96 bp, Artificial
  Hairpin sequence HSbrain_429, human
ggagatttcactcccaaggctgggaatgagtccaccagctccacatgtaaaaatgaggctggtactgatgcctggttctgggctggggaagaggcc

SEQ ID NO: 3844 - DNA, 109 bp, Artificial
  Hairpin sequence HSbrain_43, human
gcccagcgtagccaggtgagcccagggctgggggctggggctggggctggacacgttccctgcctggtcccctgcttactgctcccacctctgccacctcctgccaggc

SEQ ID NO: 3845 - DNA, 119 bp, Artificial
  Hairpin sequence HSbrain_430, human; PT_from_HSbrain_430, chimp
cctttcccctcttcctctgcctgccagccacctttctcttttctggcctggtccctgtgttaggccctatgggggaaaaaggtctggggagggctggacggcggaaaggagggccttgg

SEQ ID NO: 3846 - DNA, 61 bp, Artificial
  Hairpin sequence HSbrain_431, human
cagggcttggggagcaggaggggagggcaccaagtgctcttactctcctgagctccttttg

SEQ ID NO: 3847 - DNA, 73 bp, Artificial
  Hairpin sequence HSbrain_433, human; MQbrain_2575, macaque; PT_from_HSbrain_433, chimp
ctgcaagcaagtcatcgggactggaagcttcttccctaaaggggaggacttctactgcgtgacttgccatgag

SEQ ID NO: 3848 - DNA, 114 bp, Artificial
  Hairpin sequence HSbrain_434, human
ttaagtgttctattcttcatgtggtactcttctcaagagggaggcaatcatgtgtaattagatatgattgacacctctgtgagtggagtaacacatgatatatacatcatatga

SEQ ID NO: 3849 - DNA, 95 bp, Artificial
  Hairpin sequence HSbrain_435, human; PT_from_HSbrain_435, chimp
gcctctgcctccatgctcctagtcccttccttgaagcggtcggataatcacatgacgagcctcaagcaagggacttcaagctggtggcttccagc

SEQ ID NO: 3850 - DNA, 61 bp, Artificial
  Hairpin sequence HSbrain_436, human; PT_from_HSbrain_436, chimp
ggtgctgagtgtcccagcgggtaccaccatcgtgaagaccatggctgtgacacctggcact

SEQ ID NO: 3851 - DNA, 119 bp, Artificial
  Hairpin sequence HSbrain_437, human; HSbrain_438, human
gcttctgcagcaggttcccaggtccaccccgagggactcctggccagtgttcccaacagtgtctgagtgctggcctcagtccctggccatggattttggggaaccccgctctgaggggc

SEQ ID NO: 3852 - DNA, 116 bp, Artificial
  Hairpin sequence HSbrain_439, human
cgttggaggttgatttgctgttttgtttcttgtctttgtgttctgtggtacttgctgagagaaaagaaaagtgagccaagcagaaggaggtgggaaaacggacccaaaccccagtg

SEQ ID NO: 3853 - DNA, 118 bp, Artificial
  Hairpin sequence HSbrain_44, human
ggctgggcagagcctgtcccctccccccttctccaggagccagggggtgactggagagacagacccacccccaagcagggctcctctccccagggtgagcacaggacctctgtaagct

SEQ ID NO: 3854 - DNA, 74 bp, Artificial
  Hairpin sequence HSbrain_440, human
ggagttgtggagctgtgagggtggaggagagcccagctgatggctctgtccctccctcagatgccccttctgcc

SEQ ID NO: 3855 - DNA, 77 bp, Artificial
  Hairpin sequence HSbrain_441, human
cagacttgaggcccagggtgctgagggtggtcacacatccatcagccacctccagctcttccagggcattctagatg

SEQ ID NO: 3856 - DNA, 69 bp, Artificial
  Hairpin sequence HSbrain_442, human; PT_from_HSbrain_442, chimp
gcagcagaagctgaggctgcagctggccaccagcagctgtggtggccagagctgcattccttcccctgc

SEQ ID NO: 3857 - DNA, 114 bp, Artificial
  Hairpin sequence HSbrain_443, human
tatttatctgtgtttttgaaatattaaaccctggatcagtcctttgatcagtataattttttaaagttactttgtcagaggcacaaaagggtttaaactgattcataataaata

SEQ ID NO: 3858 - DNA, 72 bp, Artificial
  Hairpin sequence HSbrain_444, human
gtgtgtacctatatataaaggacaagtgtgatatgtgtgtatatgtatatacatacatacatgtccgcacac

SEQ ID NO: 3859 - DNA, 102 bp, Artificial
  Hairpin sequence HSbrain_446, human; PT_from_HSbrain_446, chimp
gatacaagtgagcaaaagttggtcagcttggctatggagtggtggcaataatctctaaacattccaaaagaccatgagctgaacctaaactcccttggaatc

SEQ ID NO: 3860 - DNA, 117 bp, Artificial
  Hairpin sequence HSbrain_447, human
gttacaactgaagggaagtctgttgaaatgcatcatgaagctttgagtgaagctcttcctggggacaatgtgggcttcgatgtcaagaatgtgtctgtcaaagatgttcgttgtggc

SEQ ID NO: 3861 - DNA, 96 bp, Artificial
  Hairpin sequence HSbrain_448, human; MQbrain_2453, macaque; PT_from_HSbrain_448, chimp
tacaccctgtagaattgtgggctgtagcgttactctgattttctgtctagtatcagagaatgctggtagcttaaaatttttattttaggacttgta

SEQ ID NO: 3862 - DNA, 107 bp, Artificial
  Hairpin sequence HSbrain_449, human; PT_from_HSbrain_449, chimp
gcacagcacagaggtggtcaccccagggacagccaggcacctgctcctcttgcccttcctgggggaagggagctgccttctgtccctgtaactgctttccttatggc

SEQ ID NO: 3863 - DNA, 81 bp, Artificial
  Hairpin sequence HSbrain_45, human; PT_from_HSbrain_45, chimp
caccccatccagcttctacagggctggcctcaccccagcccttcagggagggtgagctggccaggaggaggttgagggctg

SEQ ID NO: 3864 - DNA, 101 bp, Artificial
  Hairpin sequence HSbrain_450, human; PT_from_HSbrain_450, chimp
gctggaagatgtagagtgggaggactgggagtgagggagccagagggagcagctcccccacccatggcatctctcgcctccctcgctcgtctcagcccagc

SEQ ID NO: 3865 - DNA, 66 bp, Artificial
  Hairpin sequence HSbrain_451, human; PT_from_HSbrain_451, chimp
cttcactgtgctctggccaagcgcgtgcgacttcctgtcacaccttaggcctgagcgcttattaag

SEQ ID NO: 3866 - DNA, 83 bp, Artificial
  Hairpin sequence HSbrain_452, human
caggctttattctgcctgggccaccacagctctgaggatacttctgttctcctcactcccagtccagggctcaccccagcctg

SEQ ID NO: 3867 - DNA, 71 bp, Artificial
  Hairpin sequence HSbrain_453, human; PT_from_HSbrain_453, chimp
ccagggaggccatctcgagaggctgactgctcacacctgggcagcactctgtctcctcccctcctgcctgg

SEQ ID NO: 3868 - DNA, 66 bp, Artificial
  Hairpin sequence HSbrain_455, human; PT_from_HSbrain_455, chimp
gcgccagcgagaggccaggcccagcccgggcggtacaatagggttgggccgaggccgggactgggc

SEQ ID NO: 3869 - DNA, 112 bp, Artificial
  Hairpin sequence HSbrain_456, human
ttaccttgcttgctctgtgtggttttggaggggtgtggaaagaggcagaacattcgttcactttcctgccttcctctgcaccagctaaaaagtttgcagagacccaacctaa

SEQ ID NO: 3870 - DNA, 109 bp, Artificial
  Hairpin sequence HSbrain_457, human
aaattcagcagttcagagtggtgtgtgggtgggaaggactggatttgaaatggtcccactcctgacgatcctgtccctgtctcctacagacctcttcttgggtgaattt

SEQ ID NO: 3871 - DNA, 119 bp, Artificial
  Hairpin sequence HSbrain_458, human
ttctagagtaaggagttttgctggcctcaagccttccaggagaaatggagaccctatacatacctgtttccatgcctcctagaagttccgaagccagggtaagagttctcattctagaa

SEQ ID NO: 3872 - DNA, 87 bp, Artificial
  Hairpin sequence HSbrain_459, human
tgttcacaattattcttgcatttgaacctcagtgcgcacagaacccttctgtgcgcgggagaaacagggccggagtctcttgggata

SEQ ID NO: 3873 - DNA, 68 bp, Artificial
  Hairpin sequence HSbrain_46, human; MQ_from_HSbrain_46, macaque; PT_from_HSbrain_46, chimp
cagaaggtcatgacccacgtcagcaacggctgtcagctgctgcttggggtcaagggacacgccttctg

SEQ ID NO: 3874 - DNA, 74 bp, Artificial
  Hairpin sequence HSbrain_460, human; PT_from_HSbrain_460, chimp
caggtgctggggccggggccgggtggaagggggccacaggacctttctctcgcctctgctgcagattatgtctg

SEQ ID NO: 3875 - DNA, 102 bp, Artificial
  Hairpin sequence HSbrain_461, human; PT_from_HSbrain_461, chimp
gggcctcagctggagctcaggattctggaaggagggactggggccaggtcacctgagccctcttcctctcttctgcctcctcctcagcatcatcaatggctt

SEQ ID NO: 3876 - DNA, 90 bp, Artificial
  Hairpin sequence HSbrain_463, human; PT_from_HSbrain_463, chimp
ctgttacggttgggattggtggggtgggtttaggtaattgtttagtttatgattgcagataaactcatgccagagaacttaaagtcttag

SEQ ID NO: 3877 - DNA, 111 bp, Artificial
  Hairpin sequence HSbrain_464, human
ccacacctgagaacacggcaggtgagcaggcgaggctgggctgaacccgtgggtgaggagtgcagcccagctgaggcctctgctgtcttatctgtctcctacaggcaatgg

SEQ ID NO: 3878 - DNA, 97 bp, Artificial
  Hairpin sequence HSbrain_465, human
cttggccactctctgcttccaggcctcgtatctggtggcctgctgcctggctgggcaacctacggtgctgacccccttgatccacggactggcccag

SEQ ID NO: 3879 - DNA, 85 bp, Artificial
  Hairpin sequence HSbrain_466, human; PT_from_HSbrain_466, chimp; PT_from_HSbrain_58, chimp
gcaaactgctacgaggaggtcaaggaccgctgcaccctggcagagaagctggggggcagtgccgtcatctccctggagggcaagc

SEQ ID NO: 3880 - DNA, 77 bp, Artificial
  Hairpin sequence HSbrain_467, human
gtatttcagaaggtgggtcctggcgtggcccgatgggaaaagctgctggccaggtcaggcctgccctgaccaggtac

SEQ ID NO: 3881 - DNA, 79 bp, Artificial
  Hairpin sequence HSbrain_468, human; PT_from_HSbrain_468, chimp
gggctccatcgaggcccacaagaggggctcccgcttctggatccaggacaaaggccccatcgtggagaggtgaggcgcc

SEQ ID NO: 3882 - DNA, 96 bp, Artificial
  Hairpin sequence HSbrain_469, human; PT_from_HSbrain_469, chimp
cttcctggagtccccaaagtcttcgtgcctcgtccttcccaggtctccttgaagcccacagaagaggcacacaagaaggagaggaagccccagaag

SEQ ID NO: 3883 - DNA, 113 bp, Artificial
  Hairpin sequence HSbrain_47, human; PT_from_HSbrain_47, chimp
tggagtgcctggtgagggggctgggcatgggtaggggtgggttggtagaccctgggagcctgtggtgagcccactcctgccctgcctcaggaattcaaccccgaggagttcta

SEQ ID NO: 3884 - DNA, 91 bp, Artificial
  Hairpin sequence HSbrain_470, human; PT_from_HSbrain_470, chimp
gagatgtgagaacttgaggggagaatgaggtggagaagcccaggttctgaatccccttccctcactcttctctcaggtgatctttattctc

SEQ ID NO: 3885 - DNA, 111 bp, Artificial
  Hairpin sequence HSbrain_471, human; PT_from_HSbrain_471, chimp
ggggtactcggccagccatcaggtggatcctgtggggaagatggactggaggccttgcctcccttggctctctctgcacctcttccaggattccctgactgtgccagccct

SEQ ID NO: 3886 - DNA, 75 bp, Artificial
  Hairpin sequence HSbrain_472, human; PT_from_HSbrain_472, chimp
gcattgattgcccctcccgtcccccacagattctgtacaatgggcagagtgtggaggtggacgggcactcgatgc

SEQ ID NO: 3887 - DNA, 113 bp, Artificial
  Hairpin sequence HSbrain_473, human
cttcagtctatccgtctttaatactaacctgcaaccttagaacttactcatttctttggaaatgagttttgttgagaatgctaattgttatttaagacctcaaggactaggag

SEQ ID NO: 3888 - DNA, 81 bp, Artificial
  Hairpin sequence HSbrain_474, human; PT_from_HSbrain_474, chimp
gcccaggaagccaggctggagttacctttaggggagcctagagtcctctccttggggtaactccagcctggctttctgggc

SEQ ID NO: 3889 - DNA, 86 bp, Artificial
  Hairpin sequence HSbrain_475, human
cccttcacaggggttccatcagaccccagaacttggccaggtagaacaaggagggcaaagttagatggaggacagattgtggaggg

SEQ ID NO: 3890 - DNA, 95 bp, Artificial
  Hairpin sequence HSbrain_476, human
tggccgtccccgttcagtgccttttgcacacgtgcatttgcgtacacgcatgtgggtgtgtctgtggcatctcggcacctgtgcgtggattctca

SEQ ID NO: 3891 - DNA, 118 bp, Artificial
  Hairpin sequence HSbrain_477, human; PT_from_HSbrain_477, chimp
actctgtgcaactgtcgtatatggtcccgtgggctgaccgctttgtacatgagaataaatctatttctttctaccagtcctcccccatggggctgtttgcagactttgtgcttggggt

SEQ ID NO: 3892 - DNA, 98 bp, Artificial
  Hairpin sequence HSbrain_478, human; MQbrain_2583, macaque
aggttgtaaccaaataacctttggcatataaagataaacatgtaaataattttctacatgcaggccttatcttaatatgccaagtcttggtccagctt

SEQ ID NO: 3893 - DNA, 98 bp, Artificial
  Hairpin sequence HSbrain_479, human
cattgggagccatgaagttgtcttgttgataggtctagggcagctgttggcagctgctggccttgtggatggtaagctgactgtgttggcatttaatg

SEQ ID NO: 3894 - DNA, 119 bp, Artificial
  Hairpin sequence HSbrain_48, human
ggtctggttgtggtgggctgggcagggcagggggcacttctttgtccagtaagccagatgttggactacctggggaaggcagcccctcccttcctccctccctccccgcaaccgaggcc

SEQ ID NO: 3895 - DNA, 113 bp, Artificial
  Hairpin sequence HSbrain_480, human
ttcttaaatatttgttgaattttaaaataaaagttgttcagcacttaggtgaaatgctgaacgacttcacataagtgctgcacgacccttttctttaaaaaacaaagagagag

SEQ ID NO: 3896 - DNA, 91 bp, Artificial
  Hairpin sequence HSbrain_481, human
cagatggtgaaatgtgaccctcgccatggtaaatacatggcttgctgcctattgtgccatggtgatgtggttcccaaagatgccaatgctg

SEQ ID NO: 3897 - DNA, 93 bp, Artificial
  Hairpin sequence HSbrain_482, human
ggccttcagctgctcgggactggcgagcgcggcgcagcggttcattctgcgccacgtgggcgagctgggcgccgagcagctggagcggctgcc

SEQ ID NO: 3898 - DNA, 75 bp, Artificial
  Hairpin sequence HSbrain_483, human
gaaccgagccagggagtttaggataattgggagagttgaaaatctccgaggtgccctgagctgtgctcatggttc

SEQ ID NO: 3899 - DNA, 114 bp, Artificial
  Hairpin sequence HSbrain_484, human
gggctgggaagggaggggtagacagaggagcttgaggagagagtggagggaagccaatttcctctgttcttcttttcactgtgtccatgattgaaggctggcttttctgagtct

SEQ ID NO: 3900 - DNA, 101 bp, Artificial
  Hairpin sequence HSbrain_485, human
ggtccaggccaacctgcaaagctcagccaaagccccccaagtgagcaagtgagattgcagctggggaggcaaagggcgatgcgggtccaggcactctgacc

SEQ ID NO: 3901 - DNA, 107 bp, Artificial
  Hairpin sequence HSbrain_486, human
gagatcacaggtgagctgcggtcctggaaaaggtggcagggtaggggcctcctggcatctgcagggctcctccctccttctgctagtcccatcagccaccccatctc

SEQ ID NO: 3902 - DNA, 113 bp, Artificial
  Hairpin sequence HSbrain_487, human
gcaaatgaagcagcagccctgaacttggagcatcttcatgaagtagcagccctgagagaggcagcgacatcggaggagggagaggctgagggtggggtggctgtgagtgatgt

SEQ ID NO: 3903 - DNA, 93 bp, Artificial
  Hairpin sequence HSbrain_488, human; PT_from_HSbrain_488, chimp
ccttggggcccagggtggctgaggtcctggaaggcaaaggagcagggaagaaaggctgttttcagggcaagaccaccaagttgagccagcggg

SEQ ID NO: 3904 - DNA, 117 bp, Artificial
  Hairpin sequence HSbrain_489, human
agatggtgtcataaagcagcacatctggttttttctcatcatgcacagttccgcagattccctccaggatgccatgagacatgagtaccaagaatgtgctgtcagaggacttgtgct

SEQ ID NO: 3905 - DNA, 79 bp, Artificial
  Hairpin sequence HSbrain_49, human; PT_from_HSbrain_49, chimp
gccggcggctgtgcagccccagtctttccagcagatcctcagcttctgctacacgggccggctgagcatgaacgtgggc

SEQ ID NO: 3906 - DNA, 79 bp, Artificial
  Hairpin sequence HSbrain_490, human
tggatcagtggctccatcctggccttgctgtccaccttccagcagatgtggatcagcaagcaggaatacaattagtcca

SEQ ID NO: 3907 - DNA, 78 bp, Artificial
  Hairpin sequence HSbrain_491, human
tcatgtactgcagttgcctttttgttcccatgctgtttaagcctagcataggcaccaaaaagcaacaacagtatgtga

SEQ ID NO: 3908 - DNA, 117 bp, Artificial
  Hairpin sequence HSbrain_492, human; PT_from_HSbrain_492, chimp
ggcagctgggtttgggctctggccatgtctcaactttgtgctaggagtaaaacatggagcaagtggagactagcacaagtggacaaggccagccccagccctttgttactggctccc

SEQ ID NO: 3909 - DNA, 90 bp, Artificial
  Hairpin sequence HSbrain_493, human; PT_from_HSbrain_493, chimp
atctatgaaggccaagtggaggtgactggtgatgaatacaatgtggaaagcattgatggtcagccaggtgccttcacctgctatttggat

SEQ ID NO: 3910 - DNA, 54 bp, Artificial
  Hairpin sequence HSbrain_494, human
gcacacacacacagatggtcatttctccttagatgaccatctgtgtgtgtgtgt

SEQ ID NO: 3911 - DNA, 82 bp, Artificial
  Hairpin sequence HSbrain_495, human
tagggtcaggatgagggtcaaacagccctaaaagcacatttcccaccgattggcacttggggtgcagactctcatcactcta

SEQ ID NO: 3912 - DNA, 74 bp, Artificial
  Hairpin sequence HSbrain_496, human; PT_from_HSbrain_496, chimp
cctaagtgttcagagcagctaactactggcagctaactagtgacactagtagtttgttgccccgaacacatagg

SEQ ID NO: 3913 - DNA, 71 bp, Artificial
  Hairpin sequence HSbrain_497, human; MQ_from_HSbrain_497, macaque
ctgtccccagacgccatggagttggtgctggtcttcctctgcagcctgctggcccccatggtcctggccag

SEQ ID NO: 3914 - DNA, 117 bp, Artificial
  Hairpin sequence HSbrain_498, human
agatggaaggggctgtcccagaagtgggcaggaagaaccaggctgttatgccatgtgggcatgtggcacaacagcctcgttcttcctgcccacttctggggcaccttgtttccctct

SEQ ID NO: 3915 - DNA, 80 bp, Artificial
  Hairpin sequence HSbrain_499, human
gtacctgggtttgggggcatgcagagtatgcccatggaggtgcccatgaatgccatgcagaggcccgtgagaccaggcat

SEQ ID NO: 3916 - DNA, 116 bp, Artificial
  Hairpin sequence HSbrain_5, human
ccctagcctaggcaagcttgttgagtgaggcatgacaccatcacagcccagatgtggtggcaaagggctgtgatggtgtcaggcctcaaaaagctcaggaaggcctcacactgggg

SEQ ID NO: 3917 - DNA, 64 bp, Artificial
  Hairpin sequence HSbrain_50, human
ctctgccgagacagagggtggcagacccttccagctgtgccatcctctttgtccctggccagag

SEQ ID NO: 3918 - DNA, 104 bp, Artificial
  Hairpin sequence HSbrain_501, human; PT_from_HSbrain_501, chimp
gtgattttggctactaccgtccagaaaatgactccaagtgtgtggaacagccagaactgaagggccacgacctggagttttgtctgtacggaagagaagaacac

SEQ ID NO: 3919 - DNA, 95 bp, Artificial
  Hairpin sequence HSbrain_502, human
cccagatagcagtgagaatggggcactgaggcccgggatgtaggcactggacagcagcaacccaggcatctgtgccccacaaaccagttaatggg

SEQ ID NO: 3920 - DNA, 115 bp, Artificial
  Hairpin sequence HSbrain_503, human
gctcggagctgctgttctggttctcttgtggccgccgtcgctgtccggctgccttgggctgccgaacagacaaggcgtgggccacagcacctcagaagccgacgcagctcgacgc

SEQ ID NO: 3921 - DNA, 94 bp, Artificial
  Hairpin sequence HSbrain_504, human; PT_from_HSbrain_504, chimp
cctgccatctccctggctgacagcacagacctcaggtgaggcgagcagcaagcctgggctcctgagcgttagtcagagatgagatcagagcagg

SEQ ID NO: 3922 - DNA, 74 bp, Artificial
  Hairpin sequence HSbrain_505, human
gaattcttaatctggggtccagggaatccgtggatgttttcatgggatccttgatctcccagatattatatttc

SEQ ID NO: 3923 - DNA, 116 bp, Artificial
  Hairpin sequence HSbrain_506, human
tggccaatgaaaggacactggaatggaagccaggaatcctgctgtggtggagaggcatagactcatgagtccaccacaatcggatacttgcttctttttaacagccctatcagccg

SEQ ID NO: 3924 - DNA, 117 bp, Artificial
  Hairpin sequence HSbrain_509, human; PT_from_HSbrain_509, chimp
gcaggagtgattagttcgggttaaagcaaaagtgtgtcatgaacttggattccctgaagtcagttttgtcaggttcatggcccactttgctacagcatcagagtgaagcacgcctgt

SEQ ID NO: 3925 - DNA, 68 bp, Artificial
  Hairpin sequence HSbrain_51, human
gcctggacacaatgcccaagtttgccttctcatcagaggatgagggggtaggcccaggccctgcaggc

SEQ ID NO: 3926 - DNA, 100 bp, Artificial
  Hairpin sequence HSbrain_510, human
gggtgcagggcagagggagaggatctgtgggtctcctgggtgtggttttaatctgtctccccctgcccagttcctccagctcctccatcctgccgtctcc

SEQ ID NO: 3927 - DNA, 60 bp, Artificial
  Hairpin sequence HSbrain_511, human
agatccctctgtcctcactctctgatgtcattaagggtcttgggtgagagagagggacct

SEQ ID NO: 3928 - DNA, 118 bp, Artificial
  Hairpin sequence HSbrain_512, human
gttctcttgtgtgtgtctcccatttagaggcagatggggccagagtgttctagagatccagactctagagctccgatcccatccacccctcagctgtggtcacacaccaacgcggagc

SEQ ID NO: 3929 - DNA, 83 bp, Artificial
  Hairpin sequence HSbrain_513, human
ccagagctcagagcaatcaagcccaacagtattcggggataaccctgagcaaggctggtgagtgagagtgctttagggtaagg

SEQ ID NO: 3930 - DNA, 113 bp, Artificial
  Hairpin sequence HSbrain_514, human
aagagtgaaggaacaagagaaatatataattgggtggagactggtgtggaagaagctaatcttcctccggtcactccagaatgattgtgtagagttactagaatgtcagtctt

SEQ ID NO: 3931 - DNA, 102 bp, Artificial
  Hairpin sequence HSbrain_515, human
ggagaaagtgccacagtcaagcctttgtgtccccttctccttcttgctgtgtgatctgcagaggaggggataaaaggctcatctgaggtcctggctggctct

SEQ ID NO: 3932 - DNA, 98 bp, Artificial
  Hairpin sequence HSbrain_516, human; PT_from_HSbrain_516, chimp
gaggctgcttgcctggggcgcccttccctccccgcggggcaccgtcacgcgtggggagggacgcagggcgcccgcaggctcaactccccggctccctc

SEQ ID NO: 3933 - DNA, 80 bp, Artificial
  Hairpin sequence HSbrain_517, human
ttctttcagttcatctcactggagcacagccaagatggacatgtttatggacagtgctctagatgtgaaaacagatagaa

SEQ ID NO: 3934 - DNA, 94 bp, Artificial
  Hairpin sequence HSbrain_518, human
tgcaggttgaagacaggattggggaagaggccatgggagctgtggaagcgaccaaagtcttccaggctggtccttagcccaagtgcatcctgca

SEQ ID NO: 3935 - DNA, 69 bp, Artificial
  Hairpin sequence HSbrain_519, human; PT_from_HSbrain_519, chimp
ctgacctcttttccatctttgtgccctggtgttggtgcagcatacctagggccaaaatggaaaatgtag

SEQ ID NO: 3936 - DNA, 65 bp, Artificial
  Hairpin sequence HSbrain_52, human
gctctgccttggcctggccttgtccagtctaccctggacaagatgccgtgtgtttgaggcccagc

SEQ ID NO: 3937 - DNA, 80 bp, Artificial
  Hairpin sequence HSbrain_520, human
gccctaaggggcctggcctggggtgacgtggccaggcagactgtctgccccactccttcacacaagcccagctcctctgc

SEQ ID NO: 3938 - DNA, 70 bp, Artificial
  Hairpin sequence HSbrain_521, human; PT_from_HSbrain_521, chimp
ggcgtcgcgccgtgccctcgagagggacgacttcgagatcgtcgttatcctcgagggcatggtggaagcc

SEQ ID NO: 3939 - DNA, 94 bp, Artificial
  Hairpin sequence HSbrain_522, human; PT_from_HSbrain_522, chimp
ggaggggagggctggctgctggaagaaggaagaagccagactggttagacagtactcttaactcctagcccagcctagcgtgccctgcccctct

SEQ ID NO: 3940 - DNA, 62 bp, Artificial
  Hairpin sequence HSbrain_523, human; PT_from_HSbrain_523, chimp
ctctccaagataatcccagactgctctatggagagcaccaagtctggccaggtcatggaaag

SEQ ID NO: 3941 - DNA, 115 bp, Artificial
  Hairpin sequence HSbrain_524, human
gtgcagatcgtgggatgaaacgcatgggccatcgcacctgcctttggaatgatcagctttacctggttgggggttttggtgaggatggcaggacagccagtccacaggtttgcat

SEQ ID NO: 3942 - DNA, 107 bp, Artificial
  Hairpin sequence HSbrain_525, human
gggctggcagagggattgctgcctgtgactgggatgggaggtggtgaggctgactttcccatcttcccaacatcccatcccagcagacaggacgtcctcacaggtcc

SEQ ID NO: 3943 - DNA, 119 bp, Artificial
  Hairpin sequence HSbrain_526, human
gctccactgcagacctgcccttctgcagggagagccctggccacccggccttgagtggaagaagaggaaagggtgtacgggggcaaaaccctggacagggagcaggataagaagggggc

SEQ ID NO: 3944 - DNA, 63 bp, Artificial
  Hairpin sequence HSbrain_527, human
tcgaggaccccccctgcctggccttcgagtctggagggaggccaggaggaggaggtcctgtga

SEQ ID NO: 3945 - DNA, 87 bp, Artificial
  Hairpin sequence HSbrain_528, human; PT_from_HSbrain_528, chimp
ggtagtttttttccaataactgggctttccctcttccttgcccaggcgaggaggaggtgactgctgtggatggttatgagacagacc

SEQ ID NO: 3946 - DNA, 85 bp, Artificial
  Hairpin sequence HSbrain_529, human; PT_from_HSbrain_529, chimp
gaagggtcaatgcattttggggtgagctctgggtttaggggccccctccatccctcagctaccctggatctttgcccacctcttc

SEQ ID NO: 3947 - DNA, 76 bp, Artificial
  Hairpin sequence HSbrain_53, human; PT_from_HSbrain_53, chimp
cacagcaatgaggggacgggatggaggaacagagaaagctaagggtagcctctgccctcctactccccaggctgtg

SEQ ID NO: 3948 - DNA, 111 bp, Artificial
  Hairpin sequence HSbrain_530, human; PT_from_HSbrain_530, chimp
gtagagaatacattctgcaggatgagtgaaaaggcatttatgattcttgggggcagatgttctacagttgcctgtgctagttcatgtctttctgcagatcacattcttaac

SEQ ID NO: 3949 - DNA, 117 bp, Artificial
  Hairpin sequence HSbrain_531, human; PT_from_HSbrain_531, chimp
atgtcacatgacatccacatgcacatgtattctgttggccagcacgttctccagactctagatgtttagatgaggttgagctatgatatgtgcttgtgtgtatgtctatgtgtatat

SEQ ID NO: 3950 - DNA, 108 bp, Artificial
  Hairpin sequence HSbrain_532, human; PT_from_HSbrain_532, chimp
agagctctatttatttgtgttcctaggcttaatgagaattctgggcttagaacatcaacgattaatacccagaattctttgttttgagaatattatggagaatgctct

SEQ ID NO: 3951 - DNA, 78 bp, Artificial
  Hairpin sequence HSbrain_533, human
gtttcccccgctacatttcttcatgcctggctttgccccactgaccagccggggcagccagcagtaccgggccctgac

SEQ ID NO: 3952 - DNA, 38 bp, Artificial
  Hairpin sequence HSbrain_534, human; MQbrain_2455, macaque
ggtagatgcagcggagtctgagctctgctgcatctgtc

SEQ ID NO: 3953 - DNA, 91 bp, Artificial
  Hairpin sequence HSbrain_535, human
gctctggagtctttctatggagtatgacatgatcagtatcctctcaggatagtatatgatcacatcctattccgcagaaaggtctttgagc

SEQ ID NO: 3954 - DNA, 96 bp, Artificial
  Hairpin sequence HSbrain_536, human; PT_from_HSbrain_536, chimp
ttttggcatttgatggccaggtcaatcctcctctttacatgccagatgggtttctgggcaagagccaggggaaggaaaaggtcatggaggccaagg

SEQ ID NO: 3955 - DNA, 115 bp, Artificial
  Hairpin sequence HSbrain_537, human
ttccctcttatccgcacttccaagccttggccaccacacctaccccttgtgaatgtcgggcaatgggtgatgggtgtggtgtccacaggcaacaggggagaaggaggagatggag

SEQ ID NO: 3956 - DNA, 101 bp, Artificial
  Hairpin sequence HSbrain_538, human
ggcctcctcttgctgtcctaactgactttaaggacctggtcttgagtcttcccataggatctctaggtccttaaggtatgggttttggctctcatggtgcc

SEQ ID NO: 3957 - DNA, 111 bp, Artificial
  Hairpin sequence HSbrain_539, human; HSbrain_542, human; PT_from_HSbrain_539, chimp; PT_from_HSbrain_542, chimp
tcccactgtggtgcctggtggagacctggccaaggtacagagagctgtgtgcatgctgagcaacaccacagccattgctgaggcctgggctcgcctggaccacaagtttga

SEQ ID NO: 3958 - DNA, 96 bp, Artificial
  Hairpin sequence HSbrain_54, human
tgaatgggcgcggcggacttgggaggcggactactcagtccccccgggaaggagggagctggggtccagatctttgctctgaaggagcctagggca

SEQ ID NO: 3959 - DNA, 91 bp, Artificial
  Hairpin sequence HSbrain_540, human; HSbrain_543, human; PT_from_HSbrain_481, chimp; PT_from_HSbrain_540, chimp; PT_from_HSbrain_543, chimp; PT_from_HSbrain_546, chimp
cagatggtgaaatgtgaccctcgccatggtaaatacatggcttgctgcctgttgtaccgtggtgacgtggttcccaaagatgtcaatgctg

SEQ ID NO: 3960 - DNA, 91 bp, Artificial
  Hairpin sequence HSbrain_541, human; HSbrain_544, human
ctggccacatatgcccctgtcatctctgctgagaaagcctaccatgaacagctttctgtagcagagatcaccaatgcttgctttgagccag

SEQ ID NO: 3961 - DNA, 91 bp, Artificial
  Hairpin sequence HSbrain_545, human
ctggccacatatgcccctgtcatctctgctgagaaagcctaccacgaacagcttactgtagcagagatcaccaatgcttgctttgagccag

SEQ ID NO: 3962 - DNA, 91 bp, Artificial
  Hairpin sequence HSbrain_546, human
cagatggtgaaatgtgaccctcgccatggtaaatacatggcttgctgcctgttataccgtggtgacgtggttcccaaagatgtcaatgctg

SEQ ID NO: 3963 - DNA, 88 bp, Artificial
  Hairpin sequence HSbrain_547, human
cctatggctccttcggtatcacctggggaagccccggaatcttagttcttccattccctactcttccttccgagggagtcaggatggg

SEQ ID NO: 3964 - DNA, 72 bp, Artificial
  Hairpin sequence HSbrain_548, human; PT_from_HSbrain_548, chimp
ctgccttgggaagggagacgaggtgtgctgttccttcccagccccatccctccccacccttcctactcccag

SEQ ID NO: 3965 - DNA, 83 bp, Artificial
  Hairpin sequence HSbrain_549, human; PT_from_HSbrain_549, chimp
ggcttctggcagcccagctctgcccagctcactgtgccttggaggcggtggtggtggtggacgcagccccgctggcagaggcc

SEQ ID NO: 3966 - DNA, 73 bp, Artificial
  Hairpin sequence HSbrain_55, human
tgggtgtcaggcaaggcgccagacaccccttgcaggctggaggacggggtggctggacctttgcacacacaca

SEQ ID NO: 3967 - DNA, 73 bp, Artificial
  Hairpin sequence HSbrain_550, human
atgcccacaggttccccaattctctcacatggaaagaatacctagtatgtgtgaggagagggtggaggggtat

SEQ ID NO: 3968 - DNA, 85 bp, Artificial
  Hairpin sequence HSbrain_551, human
gggtgtctggtcccagcctggagggaagggggaagccctgggaagcagggcctcctgttctgggggcagggctgggtgtgtgcct

SEQ ID NO: 3969 - DNA, 108 bp, Artificial
  Hairpin sequence HSbrain_552, human
cactggccttgctatccccagggcggaccaggcactggccactcttaccatgcggaaattctgcgaggacaaggtggccacagaactgcagccctcccagcgtcggtg

SEQ ID NO: 3970 - DNA, 65 bp, Artificial
  Hairpin sequence HSbrain_553, human
gagtgtatggtgggtgtcctgaattcgttcatgtgaatacaggactcaggcttcccaccccactc

SEQ ID NO: 3971 - DNA, 67 bp, Artificial
  Hairpin sequence HSbrain_554, human; PT_from_HSbrain_554, chimp
ttggggtggctggttctggggctgggattggaactgtgtttgggagcctcatcattggttatgccag

SEQ ID NO: 3972 - DNA, 71 bp, Artificial
  Hairpin sequence HSbrain_555, human
ctgctcttgctggctgcagccgtgggcctctgctcaccgtgccgctgctgctgcctgcgaaatgacggcgg

SEQ ID NO: 3973 - DNA, 119 bp, Artificial
  Hairpin sequence HSbrain_556, human; PT_from_HSbrain_556, chimp
gttggggtggggacctgggggttccccatgtacagctatgtatattcaggggtgttctccgtctggtacccgctgtgggcatctatgtgtgtgtgaacctccccttccccatgccctgc

SEQ ID NO: 3974 - DNA, 116 bp, Artificial
  Hairpin sequence HSbrain_557, human
ggtggctccagccttctgcagccttgacccaggttgggcaagggcggaggtgaggaatctttgaggaccaagcccagtggtctgggaatcgggaggtagagagggaagggtctgcc

SEQ ID NO: 3975 - DNA, 76 bp, Artificial
  Hairpin sequence HSbrain_558, human; PT_from_HSbrain_558, chimp
ggcaggtcctagtgctcgatggccgaggtcacctcctgggctgcctggcggccatcgtggctaagcaggtgctgct

SEQ ID NO: 3976 - DNA, 112 bp, Artificial
  Hairpin sequence HSbrain_559, human
tgggcctgcgaggcgtgccgcttctggaatgggagacagaggtggaaatggacaagtaaggccatgattttgctcatgtcctagtttcagaatgtataagctctgaggccta

SEQ ID NO: 3977 - DNA, 78 bp, Artificial
  Hairpin sequence HSbrain_56, human
gccagctggaggctggaacatggcagagggcatactaggggttaacctcctgccctttctcatgtccccccagtgtgc

SEQ ID NO: 3978 - DNA, 61 bp, Artificial
  Hairpin sequence HSbrain_560, human; PT_from_HSbrain_560, chimp
tctggggtgaggggagaatgaggtggggaagaaaccctacttctctgatcgagattccagg

SEQ ID NO: 3979 - DNA, 90 bp, Artificial
  Hairpin sequence HSbrain_561, human
agaaaagaggacattttgcccagatccgtggcctattcagaaatgtggcctgtgattaggccgcagatctgggtgaaatgtcctccttct

SEQ ID NO: 3980 - DNA, 85 bp, Artificial
  Hairpin sequence HSbrain_562, human
acttgaggctgcaccccgggcaagtccccagggtggtgctcagccgagaggggggcttggcgccccgaaggggtgtgtgtagggt

SEQ ID NO: 3981 - DNA, 104 bp, Artificial
  Hairpin sequence HSbrain_563, human; MM_326, mouse; MM_from_HSbrain_563, mouse; MQ_from_MM_326, macaque; MQbrain_2283, macaque; PT_from_HSbrain_563, chimp; PT_from_MM_326, chimp
tttaccagctcagaatgtggtaggagctatcagaacttagtgatcaagtgaagtcgtagttactaatttctgatgctcttcccctgcagaagagagctgtggga

SEQ ID NO: 3982 - DNA, 117 bp, Artificial
  Hairpin sequence HSbrain_564, human; MQbrain_2476, macaque
gttgtcatcaattcagaatctttttgataagcattttctttctttccaaatagtttgtggagaagtttctgttggggaggaagaaggtgaaggtgaaactggttggattgaaggagc

SEQ ID NO: 3983 - DNA, 69 bp, Artificial
  Hairpin sequence HSbrain_565, human
ccgcagccttccacccaggccttgctgctgcagcctctgccagagccagctcctggtggacccatgtgg

SEQ ID NO: 3984 - DNA, 76 bp, Artificial
  Hairpin sequence HSbrain_566, human
cgtgtttacctcgcaggagacgcctcggcagtcctcaacttgtgtgcgccggtggccctctcctgtgggacttgcg

SEQ ID NO: 3985 - DNA, 115 bp, Artificial
  Hairpin sequence HSbrain_567, human
gagtccagatgatgctcataccaatggcttcagtgatggcggtgactgaaccgaaatgggtctcggtctggagccgcttcctctgggtgacgctgctgagcatggtgctggggtc

SEQ ID NO: 3986 - DNA, 113 bp, Artificial
  Hairpin sequence HSbrain_568, human
gggctccatccttacctggctgggtttgcgtgcaggtcacatgaggtttaaaaatagtaccatccttcattccttggcctgagattgcttaagaccaggccagggcacagcct

SEQ ID NO: 3987 - DNA, 57 bp, Artificial
  Hairpin sequence HSbrain_569, human
cgccgcagtttcctccgccgctgtcgggcgtgcggcgctgagggacccgggcgagcg

SEQ ID NO: 3988 - DNA, 92 bp, Artificial
  Hairpin sequence HSbrain_57, human; PT_from_HSbrain_57, chimp
gctgcaggcgcagacggcggcgctgccgctggagccggcgagcaaggagctggtgggtgagcggcagaacgcggtgggcgagcgcctggtgc

SEQ ID NO: 3989 - DNA, 98 bp, Artificial
  Hairpin sequence HSbrain_570, human
gcgaagagccggggccatggagcagcctgtgtagacggggacctgccctgcatgggcaccccctcactggctgcttcccttggtctccaggaaggcgt

SEQ ID NO: 3990 - DNA, 91 bp, Artificial
  Hairpin sequence HSbrain_571, human; PT_from_HSbrain_571, chimp
tcactgcttcacttgctgcctccctttgctacagcagcccagtgtcctagccttgctgcttttgtgattctttgcagcaattctagtagga

SEQ ID NO: 3991 - DNA, 73 bp, Artificial
  Hairpin sequence HSbrain_572, human; PT_from_HSbrain_572, chimp
ttggttggtttgcccatcctctttaggagataaagaagaagaaaggcatcaaagaggaggtgcagctgaccag

SEQ ID NO: 3992 - DNA, 114 bp, Artificial
  Hairpin sequence HSbrain_573, human; PT_from_HSbrain_573, chimp
agtccagatcaaaaatggcggtagttggtgtgtcctcggtttctcggctgctgggtcggtcccgcccacagctggggcggcctatgtcgagtggcgcccatggcgaagagggct

SEQ ID NO: 3993 - DNA, 76 bp, Artificial
  Hairpin sequence HSbrain_574, human; PT_from_HSbrain_574, chimp
gggcccgcgtgtgcccactgtgctccagacaatagcacacgctgtgggagctgcaacccgggctatgtgctggccc

SEQ ID NO: 3994 - DNA, 59 bp, Artificial
  Hairpin sequence HSbrain_575, human
gcaggggcctggggtcagagctggggtcctcctgaggcctcactcctccttcctcctgc

SEQ ID NO: 3995 - DNA, 118 bp, Artificial
  Hairpin sequence HSbrain_576, human
gaggcagaggagaggcaaggccggtggcccccggcgtccagggacctggcagccaccactgaggcccacctgcttgtccctcagccgggtgctcactggcagccacactcccggtctc

SEQ ID NO: 3996 - DNA, 111 bp, Artificial
  Hairpin sequence HSbrain_577, human
tggggactttttctctgcccttcgtcattatgcagcctgtgaacagcgtctgggaaagtggtggtcattggttgcataatttgatctgaggcttatggaggaaaggaccca

SEQ ID NO: 3997 - DNA, 89 bp, Artificial
  Hairpin sequence HSbrain_578, human; PT_from_HSbrain_578, chimp
gtgttcttccagtccgccctctgtcaccttgcagacggctttctctccgaatgtctgcaagtgtcagaggcgaggagtggcagctgcat

SEQ ID NO: 3998 - DNA, 111 bp, Artificial
  Hairpin sequence HSbrain_579, human
tgaggactttttctctgcccttcgtcattatgcagcctgtgaacagcgtctgggaaagtcgtggtcattggttgcataattccatttgaggcttatggaggaaaggaccca

SEQ ID NO: 3999 - DNA, 85 bp, Artificial
  Hairpin sequence HSbrain_58, human
gcaaactgctacgaggaggtcaaggaccgctgcaccctggcagagaaggtggggggcagtgccttcatccccctggagggcaagc

SEQ ID NO: 4000 - DNA, 97 bp, Artificial
  Hairpin sequence HSbrain_580, human; MQ_from_HSbrain_580, macaque; PT_from_HSbrain_580, chimp
cttttcctttcccttctgtttagtttgttgcccagcccaattgtcaacagctgctggcatctcgctggtacgatgagtttccaggctggaggagaag

SEQ ID NO: 4001 - DNA, 76 bp, Artificial
  Hairpin sequence HSbrain_581, human
cggcattttttccttttctccagcggcctcaggttcttgttacaactgagtccgggttggaggaggtgtggggccg

SEQ ID NO: 4002 - DNA, 106 bp, Artificial
  Hairpin sequence HSbrain_582, human; MQbrain_2284, macaque
gtgcaattaagatggttgggtttggattgttgtacttttttttttgttcgttgcatttttaggaacaaaaaaaaaagcccaacccttcacaccacttcatccgcat

SEQ ID NO: 4003 - DNA, 104 bp, Artificial
  Hairpin sequence HSbrain_583, human
ttggcttgctgggttcagagcactgggcaccaagtctgtgtcttggtgtcattgctattcacacagacattgtgtccaggttcctgcatccagaaacattccag

SEQ ID NO: 4004 - DNA, 115 bp, Artificial
  Hairpin sequence HSbrain_584, human; PT_from_HSbrain_584, chimp
ctttatttgcttcaaatattcatcacttttattcctcgccaaggttttcttttctagatgaagaggactgggaggcagggctattggaaggagatgctgaatagaaagaaaagag

SEQ ID NO: 4005 - DNA, 84 bp, Artificial
  Hairpin sequence HSbrain_585, human
ggccttaaagtgggaaatgatagaagggtcacttaggagcctgcagtggcatggtgaccagtctgttattactcatagatgacc

SEQ ID NO: 4006 - DNA, 107 bp, Artificial
  Hairpin sequence HSbrain_586, human; PT_from_HSbrain_586, chimp
cggcttggagacaaaggggcctgagagggaagctgcttcctagtgccgagccccagaagaggtggataggcccgaggggcgccttccctaggccttatctcttcccg

SEQ ID NO: 4007 - DNA, 89 bp, Artificial
  Hairpin sequence HSbrain_587, human
gggacaccagtccacggggtccggatccaagtgcactgttatcctcaaatccagtccacagggtccagatccgagtgcgctgttatcct

SEQ ID NO: 4008 - DNA, 78 bp, Artificial
  Hairpin sequence HSbrain_588, human; PT_from_HSbrain_588, chimp
gccgaagatggcggaggtgcaggtcttggtgcttgatggtcgaggccatctcctgggccgcctggcggccattgtggc

SEQ ID NO: 4009 - DNA, 109 bp, Artificial
  Hairpin sequence HSbrain_589, human
agtctactcttcatcttgtgttgagacttcgtggtggtgctaagaaaaggaagaagaagtcttacaccactcccaggaagaataagcacaagagaaagaaggttaagct

SEQ ID NO: 4010 - DNA, 89 bp, Artificial
  Hairpin sequence HSbrain_59, human; MQbrain_2322, macaque; PT_from_HSbrain_59, chimp
cacctttgtccaggggtgagctttaatctgagggaacttgaactccgtgtagttggggttcatctctcggatttgttcccgggttggtg

SEQ ID NO: 4011 - DNA, 79 bp, Artificial
  Hairpin sequence HSbrain_590, human
cacaggtcctgtggtaggtcttcaggaaggtgctccccaggtgggcatggggtggcacattgaggccatgggactggtg

SEQ ID NO: 4012 - DNA, 91 bp, Artificial
  Hairpin sequence HSbrain_591, human
ggctgcggaagatggcagaggtgcaggtcctggtgctcgatggtcaaggccatctcctgggccgcctggcggccatcgtggctaagtagtt

SEQ ID NO: 4013 - DNA, 118 bp, Artificial
  Hairpin sequence HSbrain_592, human
tgaagggctgctcaggaaaacatgcacctgagccagtggccctggggctctcagcctgcctgggagctgggagccgggagccactgtagtttggtttttgtgtgggagttgcctttta

SEQ ID NO: 4014 - DNA, 60 bp, Artificial
  Hairpin sequence HSbrain_593, human; PT_from_HSbrain_593, chimp
accagttctactggggttcctgcccaccgtcccaaggtgggcgaggcctaggaagagggt

SEQ ID NO: 4015 - DNA, 97 bp, Artificial
  Hairpin sequence HSbrain_594, human; PT_from_HSbrain_594, chimp
tgaaattgctacggggagcggggaggaagtgggcgctgcttctgcgttatctggaaggagcagcccactcctgtcctgggctctgtggtgattgcca

SEQ ID NO: 4016 - DNA, 93 bp, Artificial
  Hairpin sequence HSbrain_595, human
ttgggcgttcctgcttggctgctgccctcttctgtcccttttcctatattgggagggatgaagggggaacccagcgctggacgtggcgcttag

SEQ ID NO: 4017 - DNA, 111 bp, Artificial
  Hairpin sequence HSbrain_596, human; PT_from_HSbrain_596, chimp
tgtatctctcacatgactcactgcccctgtctttcacatgggctgtaatttagttcaattcagaactgcagatagtacagcttccacaggagcaagggatgtctgagcaca

SEQ ID NO: 4018 - DNA, 117 bp, Artificial
  Hairpin sequence HSbrain_597, human
ggtgcagcctcagatcccctgttcatctgggaagcctcctgccacagcttaggacagaactgggcccagggcaaaggcctctccccagaggatggactagaaggcctgggccacact

SEQ ID NO: 4019 - DNA, 117 bp, Artificial
  Hairpin sequence HSbrain_598, human
gttacaactgaaataaagtctgttgaaatgcaccatgaagctttgagtgaagctcttcctggggacagcatgggcttcaatatcaagaatgtgtctgtcaaagatgttcgttgtggc

SEQ ID NO: 4020 - DNA, 99 bp, Artificial
  Hairpin sequence HSbrain_599, human; PT_from_HSbrain_599, chimp
gggcctgacttctgctgggacagctggagaggagtctcatgggctgggatgctgttgtggctttgactttggccagtgcttctgacagaggcggagcct

SEQ ID NO: 4021 - DNA, 100 bp, Artificial
  Hairpin sequence HSbrain_6, human
ttcccagagagtttgttcatttatttctcttctctatattctcagaaattctttctgtctcagagatgttagggaagaggttggggcatgctgatgggag

SEQ ID NO: 4022 - DNA, 109 bp, Artificial
  Hairpin sequence HSbrain_60, human
gatggtactttagaatgctgacatctacaggattctagaatccagaaggctttagaatcttgacacctttaaagttctagaaccgtgatggtgttagcatgctagcatc

SEQ ID NO: 4023 - DNA, 80 bp, Artificial
  Hairpin sequence HSbrain_600, human
ttgtctttatgctggtactctgtgggagttaagtgtcaactttctcctgttttctcctatggagtatccgtccaaggcaa

SEQ ID NO: 4024 - DNA, 113 bp, Artificial
  Hairpin sequence HSbrain_601, human
ttacaatatcctgtgctggttcctttttattgttactttcctctgaatgtggaaacttcttgattcagatatttagaggacagttttgtgggataggagtcaggatgttgtga

SEQ ID NO: 4025 - DNA, 87 bp, Artificial
  Hairpin sequence HSbrain_602, human
gggagcgctctatggtagttctgcctgtgatgaatgctaagtggaaacaagcaagaaaaattaacaggcggctgcttctgtccacct

SEQ ID NO: 4026 - DNA, 102 bp, Artificial
  Hairpin sequence HSbrain_603, human
catgaactgggagctctagcacatgaatagtgggtaatgatgggaagtagccacattcccgttattaacccctgccttccctgttagcttcctgcttacatg

SEQ ID NO: 4027 - DNA, 99 bp, Artificial
  Hairpin sequence HSbrain_604, human
gtaagaatagtatgccagcaatccctgattctctctctgcttggtgttctctggcagcactaagacaaaggaacagggactaggagtttacgtgcttat

SEQ ID NO: 4028 - DNA, 90 bp, Artificial
  Hairpin sequence HSbrain_605, human; PT_from_HSbrain_605, chimp
tgacaggaaggctctctatacctggctccccagtgttctgcccctggcactgagcatgaggagccaggctttggggagactttgcaatca

SEQ ID NO: 4029 - DNA, 95 bp, Artificial
  Hairpin sequence HSbrain_606, human
agagctgcctggctcagctgggacgctgtgggctaaggcagctggcacttccttggcccacagtgtcccagcttggctctggctttcttggctct

SEQ ID NO: 4030 - DNA, 119 bp, Artificial
  Hairpin sequence HSbrain_607, human
ttgggccagaggaggcggtcctggtagggagtgcgtagcagggtggagtcgctgtccggtcgcgcttcacttctgctccgccctccctgctccccataacagacccctccctccactaa

SEQ ID NO: 4031 - DNA, 106 bp, Artificial
  Hairpin sequence HSbrain_608, human
cctcaccactcactcctcctccatcacagcaccccggccctccctgtccctggcctccctggctggggcatttgggggtccgctgggaggagtgcatcgctgaagg

SEQ ID NO: 4032 - DNA, 60 bp, Artificial
  Hairpin sequence HSbrain_609, human
gctggccggcttggtcctgcggtcccttctctgggaggcccgaccccggccgcgcccagc

SEQ ID NO: 4033 - DNA, 69 bp, Artificial
  Hairpin sequence HSbrain_61, human; PT_from_HSbrain_61, chimp
ccagcatcttgttcttttccctcatcccagagcccaacctgggggaggacgatgaggacaaagacttgg

SEQ ID NO: 4034 - DNA, 101 bp, Artificial
  Hairpin sequence HSbrain_610, human
gccactggagatttcagtcccgaggctgggaatgagtccaccagctccacatgtaaaaatggggctggtattgatgcctgggtctgggctgaggaagaggc

SEQ ID NO: 4035 - DNA, 101 bp, Artificial
  Hairpin sequence HSbrain_611, human
gggcagagggatctacgccagcaggtggaggcttgtcagggggtggcggctttcagccctctggcttggcctttgcttcacacgtgtaaatatccctcccc

SEQ ID NO: 4036 - DNA, 66 bp, Artificial
  Hairpin sequence HSbrain_612, human; PT_from_HSbrain_612, chimp
ggtggaggggaggccagtgtacatgtaaatgcccacagcccagcattgggtttccctcccaaggcc

SEQ ID NO: 4037 - DNA, 92 bp, Artificial
  Hairpin sequence HSbrain_613, human
gtgatggaaggctgttgtcttggtgtatcccttgcctcatagtcaatatattttttttttggcgagtcaccagtgacccgagccctccacac

SEQ ID NO: 4038 - DNA, 104 bp, Artificial
  Hairpin sequence HSbrain_614, human
ggcagcacttctgtgagccccgagggggtgggagtccaggcagaggggagtcatggcctgagcgttctgccagtgtctcctcccacggggctccggcatgcttc

SEQ ID NO: 4039 - DNA, 96 bp, Artificial
  Hairpin sequence HSbrain_615, human
ggctgcggttccgttctccgagccaatttcctcatcgtcttcctcactgcctgttgtgaatttgatgaggtcattggcactggtcttggcgcaccc

SEQ ID NO: 4040 - DNA, 75 bp, Artificial
  Hairpin sequence HSbrain_616, human; MQ_from_HSbrain_616, macaque
ggtacaggacttgaaatacgcgaccttggccacagtgtcgcgctgcggcatggtctggttcagtgaggatgtgct

SEQ ID NO: 4041 - DNA, 81 bp, Artificial
  Hairpin sequence HSbrain_617, human
ggacgtatgcagagccgctcactgctgccatggtggagttctacaccatgtctcaggtacgcagagtttctttgctcttcc

SEQ ID NO: 4042 - DNA, 105 bp, Artificial
  Hairpin sequence HSbrain_618, human
ctgcatgtttctcgtctctgagtgtgggctttgctctttaggtagaagaactgcgtcgtgacttgaggataaagagccaagagctggaggtgaagaatgcagcag

SEQ ID NO: 4043 - DNA, 107 bp, Artificial
  Hairpin sequence HSbrain_619, human
tatgtctagtgtgaagactgtggtgaggaaagcgaacttcaggagagggaacggtgtccccagctgaagggtcgtttaaaagcgttagtattgcacagacaggcata

SEQ ID NO: 4044 - DNA, 94 bp, Artificial
  Hairpin sequence HSbrain_62, human; PT_from_HSbrain_62, chimp
gatcccagctctacaggaggtccagattcaccaccctcaaccttctgtggggacagtggcttctctggatccagctcctatggtcgcctgggtc

SEQ ID NO: 4045 - DNA, 103 bp, Artificial
  Hairpin sequence HSbrain_620, human
ggatgcccactggggaggctgctgtgcccaaatccctggcagggaccacgtgactgcagtccctcccctctaagcagcacagcctcctaccccactgtgctct

SEQ ID NO: 4046 - DNA, 68 bp, Artificial
  Hairpin sequence HSbrain_621, human; MQ_from_HSbrain_621, macaque; PT_from_HSbrain_621, chimp
tgggggagggcatagcagtcaaccccacagcacctgtggacagaggtccagtgacatgtctgccccca

SEQ ID NO: 4047 - DNA, 104 bp, Artificial
  Hairpin sequence HSbrain_622, human
catccaaggaccctccaaggctggcagtgtggtgttgctactattaaggaaacaggcttggggcagccccactgctggtccaagtgtgtggagggctgagtgtg

SEQ ID NO: 4048 - DNA, 118 bp, Artificial
  Hairpin sequence HSbrain_623, human
gaggcagaggagaggcaaagccggtggccccctgcgtccagggacctggcagccaccactgaggcccacctgcttgtccctcagccgggtgcccactggcagccacactccaggtctc

SEQ ID NO: 4049 - DNA, 73 bp, Artificial
  Hairpin sequence HSbrain_624, human; PT_from_HSbrain_624, chimp
cactgtttcccaggggcagggcacattggtggcttttccctgagtccccattcttgccttgtgtctttcagtg

SEQ ID NO: 4050 - DNA, 61 bp, Artificial
  Hairpin sequence HSbrain_625, human; PT_from_HSbrain_625, chimp
cttttcacggcctgttctgtgaagcaacatggtgcttcacagatcctggccctttgcaagg

SEQ ID NO: 4051 - DNA, 76 bp, Artificial
  Hairpin sequence HSbrain_626, human
gtgggaggccagggcacggcagggggagctacagagccatcagaggggccccagaatctgagccctgtcctcccgc

SEQ ID NO: 4052 - DNA, 64 bp, Artificial
  Hairpin sequence HSbrain_627, human; PT_from_HSbrain_627, chimp; PT_from_HSbrain_77, chimp
tggcttctcctggcaaagcctcctcacagaggaagactgaaggggatttgcaaggagatcacca

SEQ ID NO: 4053 - DNA, 109 bp, Artificial
  Hairpin sequence HSbrain_628, human
ctggacctttttctgtcctcaggccccagctggaggccttctccccaggctcactatggggtgggggcttttcctggctgcaggatgagctgacagtggaggggaccag

SEQ ID NO: 4054 - DNA, 50 bp, Artificial
  Hairpin sequence HSbrain_629, human; PT_from_HSbrain_629, chimp
gggcatggagggtgaagggagaagagaattcttctttctcctccatgccc

SEQ ID NO: 4055 - DNA, 87 bp, Artificial
  Hairpin sequence HSbrain_63, human; PT_from_HSbrain_63, chimp
tcgatgaggcagcagagggatgaagggggaacccagccagtgacaggtctggttgggatgcccaactccacctcctgcccccacaga

SEQ ID NO: 4056 - DNA, 80 bp, Artificial
  Hairpin sequence HSbrain_630, human
acaatgggtgctactggaaagcaaagggtgcattgggacacagcctactcatgttccttttgcctttctaggcctagagt

SEQ ID NO: 4057 - DNA, 95 bp, Artificial
  Hairpin sequence HSbrain_631, human
gtgtggatcggcagctccatcctggcctggctgtccaccgtccagcagatgtggatcagcaagcaggaatatgatgagtcaggcacctccatcat

SEQ ID NO: 4058 - DNA, 63 bp, Artificial
  Hairpin sequence HSbrain_632, human
tgtggaggctgctcagcctaccccttctcataattctgggaggggctgggtttggtctcaaca

SEQ ID NO: 4059 - DNA, 81 bp, Artificial
  Hairpin sequence HSbrain_633, human
gtactgggtggttggttcgtgcttccgagttaagtaaaacataaggcttaacagggtcacagggaccagccacgcaatggc

SEQ ID NO: 4060 - DNA, 104 bp, Artificial
  Hairpin sequence HSbrain_634, human; PT_from_HSbrain_634, chimp
agggtcctcgaggcccagcccggcggtgggggcgcggccggcaggagctccctccctgctccaggagccggctgagcgcgccccgcggggggctccgcagccct

SEQ ID NO: 4061 - DNA, 92 bp, Artificial
  Hairpin sequence HSbrain_635, human
tgccccttgtgagctggatagacttgggatggggagggagggagttttgtctgtctccctcccctctcagaacatactgattgggaggtgcg

SEQ ID NO: 4062 - DNA, 52 bp, Artificial
  Hairpin sequence HSbrain_636, human
gactcgcgagccgggccaaggggccttgtcttggctgggtttgtcagaggtc

SEQ ID NO: 4063 - DNA, 87 bp, Artificial
  Hairpin sequence HSbrain_637, human
tttggggaggggtatgccatcctgcctgcagagaggctgagaccagctcttctccctcaggaggacctctccatgcccctgatcgaa

SEQ ID NO: 4064 - DNA, 102 bp, Artificial
  Hairpin sequence HSbrain_638, human
taatctcctggttaggtcgcggccttcccagccggcgctgaccctgagagtaagggctgcgtcccagcttggaggcccctgcttagcgcaggaccttggttg

SEQ ID NO: 4065 - DNA, 90 bp, Artificial
  Hairpin sequence HSbrain_639, human
tgccactctctagcatcctggacactctggtaaccaggccttaaggccttcttcacacttaagagttctagggtgatggagcaacggaca

SEQ ID NO: 4066 - DNA, 114 bp, Artificial
  Hairpin sequence HSbrain_64, human
cccttcctcccgcctcagcctctaggctggttcgggccgagccgccattttgtgtcaattcctgattgcggcgggggccgggcagccggggcacccagggcgggcagagaaggg

SEQ ID NO: 4067 - DNA, 101 bp, Artificial
  Hairpin sequence HSbrain_640, human; PT_from_HSbrain_640, chimp
aaggctgagtgtcccagttttatctgctcctgagactgagcccagatccccaaatctaatctgatttacagttcaaggaagctgatggggagctgggcctt

SEQ ID NO: 4068 - DNA, 73 bp, Artificial
  Hairpin sequence HSbrain_641, human
agcttacctcctgaaagaggcaagcttgtcaaccctagctgaccccacttgagccctctcctcaggagatgct

SEQ ID NO: 4069 - DNA, 117 bp, Artificial
  Hairpin sequence HSbrain_642, human; PT_from_HSbrain_642, chimp
gcacgacccggagctcctgacccaggagcggaaggctgcagccaacatcatcaggtaaaggcagtacctggttcctggctcagaactgcctgctgggacaggagccctgccttctgc

SEQ ID NO: 4070 - DNA, 79 bp, Artificial
  Hairpin sequence HSbrain_643, human; PT_from_HSbrain_643, chimp
gatgcatgcagtgttcactccaacctcagaggctttcttgcttctggggaaatggcaggtggttgaaaccctgcacatc

SEQ ID NO: 4071 - DNA, 92 bp, Artificial
  Hairpin sequence HSbrain_644, human
ggactggagctgtgtgcagggccagcgcggagcccgagcagccgcggtgaagcgcctgtgctctgccgagactgccgtgcccattgctcgcc

SEQ ID NO: 4072 - DNA, 88 bp, Artificial
  Hairpin sequence HSbrain_646, human; PT_from_HSbrain_646, chimp
agtttgtgttctgaaagcctccgtgctgctggatctttggggggaaatacaggatccttcagcactgaggtgtttaagatttgcaact

SEQ ID NO: 4073 - DNA, 90 bp, Artificial
  Hairpin sequence HSbrain_647, human; PT_from_HSbrain_647, chimp
gcctcatgtgccacatgccaggggccggccctgacagactgcctcagctgccccagccacgcctccttggaccctgtggagcagacttgc

SEQ ID NO: 4074 - DNA, 81 bp, Artificial
  Hairpin sequence HSbrain_648, human
ttctggtttcctggggctgcggcccatttcggcggacccagcgctgaggcggcggcggcggcgaggcccaagaaataagaa

SEQ ID NO: 4075 - DNA, 92 bp, Artificial
  Hairpin sequence HSbrain_649, human
ggtacccggtggagacctggccaaggtacagagagctgtgtgtatgctgagcaacaccattgccattgctgaggcctgggctcacctggacc

SEQ ID NO: 4076 - DNA, 106 bp, Artificial
  Hairpin sequence HSbrain_65, human
cctggggacgccgctctggggtcacctgtctggccagctacgtccccacggcccttgtcagtgtggaaggtagacggccagagaggtgaccccgggggtggtcagg

SEQ ID NO: 4077 - DNA, 77 bp, Artificial
  Hairpin sequence HSbrain_650, human
cataatcacctcagaggtcctgagccagagtccagagattctttctgagattctggcaaggccccggggtactgatg

SEQ ID NO: 4078 - DNA, 109 bp, Artificial
  Hairpin sequence HSbrain_651, human; PT_from_HSbrain_651, chimp
gggggaccggccagcatggccactgtcaaccagtgcttcttcacggacaaggccctgtacgtggtggtctggaacctggcgctgggggaggaggccgtggccaacctcc

SEQ ID NO: 4079 - DNA, 99 bp, Artificial
  Hairpin sequence HSbrain_652, human
tggttctcttcaagaaggtaggtcaggcccaggtgtgggttggggtccggctgcagcgcccgctaacccacctgctgctgtccagtttgatgaggggcg

SEQ ID NO: 4080 - DNA, 93 bp, Artificial
  Hairpin sequence HSbrain_653, human
tgctctgcgtctggctggcatcggcggcttgctgagtccagcctggcatctcgctggcatcggcggctcgctgggtccagcctggcgctgaca

SEQ ID NO: 4081 - DNA, 114 bp, Artificial
  Hairpin sequence HSbrain_654, human
tctggaccagggctgtcccctgggccgtgagtgccgggcgtggagagctggtgtagatgacatttgtagctccacatgccctggcctgggcgccaaggacagccgcagagaaga

SEQ ID NO: 4082 - DNA, 119 bp, Artificial
  Hairpin sequence HSbrain_655, human
ggccacatgtgtgccgtcaccacgtgccatgtgtacacacgtgccaggcgctgtcttgagacattcgcgcagtgcacggcactggggacacgtggcactggctgaactgccacacagcc

SEQ ID NO: 4083 - DNA, 74 bp, Artificial
  Hairpin sequence HSbrain_656, human
ggcgcgggtgggcccagcctcgagctcttcagcacagtgatggtgacggggcagcggtggcggcacagccagcc

SEQ ID NO: 4084 - DNA, 87 bp, Artificial
  Hairpin sequence HSbrain_657, human
tctgtccccaccccagctgtcccctgcccagggagctggcataaaagcacgaggcccggctccctggggcagctgcttgagaacaga

SEQ ID NO: 4085 - DNA, 53 bp, Artificial
  Hairpin sequence HSbrain_658, human
ggacactgtcctttctggaggggatggccccaccccacagacaaggcaggccc

SEQ ID NO: 4086 - DNA, 66 bp, Artificial
  Hairpin sequence HSbrain_659, human; PT_from_HSbrain_659, chimp
gccagcttcctggcctcattcctcggctgggagccactgaaggtgagggggctgccaggggtaggc

SEQ ID NO: 4087 - DNA, 70 bp, Artificial
  Hairpin sequence HSbrain_66, human; PT_from_HSbrain_66, chimp
agccccccagtgcccgtcttcctgtcccatctgctcagagagaggtggggccgagacttgctggagagct

SEQ ID NO: 4088 - DNA, 96 bp, Artificial
  Hairpin sequence HSbrain_660, human
gcgagcccggaggcagcttcgtggcggccgggtcctctgtgcccttttgggggcagctggccacgggcaccaatgtgagctggtgctgggctgtgc

SEQ ID NO: 4089 - DNA, 98 bp, Artificial
  Hairpin sequence HSbrain_661, human
tggcgcttatggcctccaccccctcctagggaacctggaatgcctgtgtcacacactgccctcccagtccctggggcttgggttttccattcaagtca

SEQ ID NO: 4090 - DNA, 85 bp, Artificial
  Hairpin sequence HSbrain_662, human
actctggccctcagaactctcaggtatagaagcccaggatgtctaataccctgtcccagtgcccgagagctgcctggtgtcaggt

SEQ ID NO: 4091 - DNA, 69 bp, Artificial
  Hairpin sequence HSbrain_663, human
cagaatgtattaggcaccttctgtagccagagccaaaaaaactctggctacaggagaaacctggcactg

SEQ ID NO: 4092 - DNA, 63 bp, Artificial
  Hairpin sequence HSbrain_664, human
gtaggggctcctggaagctgtgcccagctgccctgggcagggtacaagggaacgaatttctgc

SEQ ID NO: 4093 - DNA, 83 bp, Artificial
  Hairpin sequence HSbrain_665, human; PT_from_HSbrain_665, chimp
ggaggggaggggactgttgaggttctgtcttttttcttcttttcctcttccctcttcacatcacttggcttcctttcctctct

SEQ ID NO: 4094 - DNA, 80 bp, Artificial
  Hairpin sequence HSbrain_668, human; HSbrain_688, human
ctgggaagttcgggtggggggagtctgggcttcaggctgggatggggtctgtggagctgaggcggccccctgcccaccag

SEQ ID NO: 4095 - DNA, 114 bp, Artificial
  Hairpin sequence HSbrain_669, human; HSbrain_677, human; HSbrain_687, human
gctgttggagactctgcctacaggtgggtgccgtaggggtcgggacagcctcttcctgcccagcccttcctgcccctcagcctcacctgtgtggcctcctctcctccacacagc

SEQ ID NO: 4096 - DNA, 75 bp, Artificial
  Hairpin sequence HSbrain_67, human
ggctcttaagacggcggtgctagggggtgagaggtaacatcttccaccccttacacctgccctagtgctggagct

SEQ ID NO: 4097 - DNA, 82 bp, Artificial
  Hairpin sequence HSbrain_670, human; HSbrain_678, human; HSbrain_683, human; HSbrain_686, human
cttcagatgccagaagggcagagggaatcccacacgtgctggtggatcatgtgtgtgcatttctctcccttctagtctgagg

SEQ ID NO: 4098 - DNA, 89 bp, Artificial
  Hairpin sequence HSbrain_671, human
tgagcctcaagacacctgcggagtgtctgctctatccccttccaccctcagcggatgataatctcaagacacctccgagtgtctgctca

SEQ ID NO: 4099 - DNA, 114 bp, Artificial
  Hairpin sequence HSbrain_673, human; HSbrain_680, human; HSbrain_684, human
gctgttggtgactctgcctacaggtgggtgccgtaggggtcgggacagcctcttcctgcccagcccttcctgcccctcagcctcacctgtgtggcctcctctcctccacacagc

SEQ ID NO: 4100 - DNA, 76 bp, Artificial
  Hairpin sequence HSbrain_675, human; PT_from_HSbrain_675, chimp
gatccgcggtgctggagggatgctgcggtttgtcctcttggataactctgcttttctcttcgccagcgccacgatc

SEQ ID NO: 4101 - DNA, 82 bp, Artificial
  Hairpin sequence HSbrain_676, human; HSbrain_679, human; HSbrain_685, human
cctgcgaagttcgggtggggggagtctgggcttcaggctgggatggggtctgtggagctgaggcggccccctgcccaccagg

SEQ ID NO: 4102 - DNA, 117 bp, Artificial
  Hairpin sequence HSbrain_68, human; MQbrain_2326, macaque; PT_from_HSbrain_68, chimp
gggggctgggggcctggacttccgagtctctggctcttgctgtcccgcagccttctggagaagcggcaggaaggcgcggagacgctggagctgagtgcggatgggcgcccggtgacc

SEQ ID NO: 4103 - DNA, 95 bp, Artificial
  Hairpin sequence HSbrain_682, human
cagggaggacaagatcaacaggcttattagaaaaatgaaccaaggtgtctaccatgattatttttctaagctggttggttaataaacagtacctg

SEQ ID NO: 4104 - DNA, 75 bp, Artificial
  Hairpin sequence HSbrain_689, human; PT_from_HSbrain_689, chimp
gtctcaaggctgatttgaagaaggacagccccttgtcctcagacttgctgtccctcttcaaaccagacttgatgc

SEQ ID NO: 4105 - DNA, 103 bp, Artificial
  Hairpin sequence HSbrain_69, human
cgagtgccggcctctgagcaagacagtgcgcttcaacgtgctcaaggtcaccaaggctgccggcaccaagaagcagttccagaagttctgaggctggacatcg

SEQ ID NO: 4106 - DNA, 98 bp, Artificial
  Hairpin sequence HSbrain_691, human
ggggaccgtcagcagcaccttagctacaatcgttcagctattctcggaagagagaagggagagggaggaggccggggcgggagtgggggctgtcaccc

SEQ ID NO: 4107 - DNA, 93 bp, Artificial
  Hairpin sequence HSbrain_692, human; PT_from_HSbrain_692, chimp
cctgggccctgaccttctcctacggccgagccctgcaggcctctgccctgaaggcctggggcgggaagaaggagaacctgaaggctgcgcagg

SEQ ID NO: 4108 - DNA, 115 bp, Artificial
  Hairpin sequence HSbrain_693, human; PT_from_HSbrain_693, chimp
tcccaaggtctggggctggaggcacgggagggcagtggggtgagcatgagcctcaactgagcatgtctgccatcctgccccacagcctcgggcccccacggcgccttcaatggga

SEQ ID NO: 4109 - DNA, 76 bp, Artificial
  Hairpin sequence HSbrain_694, human
ggctctgcctcagggaactcgggtttggggaaatgtctatttcagaagtactggagtggccagtgtggcagtggcc

SEQ ID NO: 4110 - DNA, 119 bp, Artificial
  Hairpin sequence HSbrain_695, human
ccatgccccacccgctgcctctaccacctgcctcagccagggccacagggaactgagcctgaagtaactccctgacctcaaggctgagccaggccaggttgggtgaacagggccattgg

SEQ ID NO: 4111 - DNA, 65 bp, Artificial
  Hairpin sequence HSbrain_696, human; PT_from_HSbrain_696, chimp
agaggcagcagctggaagtggagggattgaaggaacccctcatctgaccagctgctcaattttct

SEQ ID NO: 4112 - DNA, 63 bp, Artificial
  Hairpin sequence HSbrain_697, human
tggaacgacgtggccgggctggagggggccaaggaggccctcaaagaagctgtcattttgcca

SEQ ID NO: 4113 - DNA, 118 bp, Artificial
  Hairpin sequence HSbrain_698, human
tcaaggagcaaaacttgggcgtaaaaggaacgggcagtggggctagccggctgtctggaggtctgggtgacctggcagcacggctgcttctcccccgccaccccgccccactccttga

SEQ ID NO: 4114 - DNA, 105 bp, Artificial
  Hairpin sequence HSbrain_699, human
ggagccattttgggtagctgatcttgcattttctacgactcttcttggtcattttctagaagacatggaagcatatgctgaggtgagtatatagaaagctgtttc

SEQ ID NO: 4115 - DNA, 119 bp, Artificial
  Hairpin sequence HSbrain_7, human; PT_from_HSbrain_7, chimp
taaaattttagtgcgtttctgctgctgccggctagaggctggtaattatagacgagagtttcgctttctctttattgttttttaatctctctgtgctgtggctctccgacaatatttta

SEQ ID NO: 4116 - DNA, 104 bp, Artificial
  Hairpin sequence HSbrain_70, human
ggggccgggcctgagggatggaggggagcccatcagggctcagggattggatggaggtgatgggggcaggggatgggtctcaccctcccttcttcctgggccct

SEQ ID NO: 4117 - DNA, 110 bp, Artificial
  Hairpin sequence HSbrain_700, human
ttttcctctcctatctagttgttgtggaattataagctgaacctaactacagatcccaaatttgaatctgtggccagagaggtttgcaaatctactataacagaggtaag

SEQ ID NO: 4118 - DNA, 82 bp, Artificial
  Hairpin sequence HSbrain_701, human; PT_from_HSbrain_701, chimp
gctcagattcacttggctcagagagggcggagtcagagtgacccaggtggtcactgctccccttcttgtccatcaaatcagc

SEQ ID NO: 4119 - DNA, 86 bp, Artificial
  Hairpin sequence HSbrain_702, human
aagaactggcccttgttgtagaagaatggcacagggcacatggtaaaatggccctggccattcctttagacattttgtttgtactt

SEQ ID NO: 4120 - DNA, 75 bp, Artificial
  Hairpin sequence HSbrain_703, human
gctgagcagggagacaggagacaggcaagaggcgctgtgagaagcgtgggctgagtgacctgctccttggtgagt

SEQ ID NO: 4121 - DNA, 91 bp, Artificial
  Hairpin sequence HSbrain_704, human; PT_from_HSbrain_704, chimp
tttagcctagttggcaagcgagcaatttccacctctgtgtgtgtacgagctcatggtaagtgtgacttttcttacttttaaataggctgaa

SEQ ID NO: 4122 - DNA, 103 bp, Artificial
  Hairpin sequence HSbrain_705, human; PT_from_HSbrain_705, chimp
gagtgcttcagctgccctaagctgcaccagcgctttgccaagatgggatggggagggggtatgagaactggcagagcctcggtgcagcagggctgaagggctt

SEQ ID NO: 4123 - DNA, 73 bp, Artificial
  Hairpin sequence HSbrain_707, human
gtttgatttgcagcgtcatctccagcagtattcagctgctggttcaggatctggatgctgcctgtgatcctgc

SEQ ID NO: 4124 - DNA, 72 bp, Artificial
  Hairpin sequence HSbrain_708, human
gccattcagtggacacgggagcagggggtttagtgggaacacagggcttcttgagccctgtcctgaagcagc

SEQ ID NO: 4125 - DNA, 70 bp, Artificial
  Hairpin sequence HSbrain_709, human; PT_from_HSbrain_709, chimp
ctgggcacggtggtggtggattaccgcggctaccgggtcacggcccagtccatcatccccggcatcctgg

SEQ ID NO: 4126 - DNA, 113 bp, Artificial
  Hairpin sequence HSbrain_71, human; PT_94, chimp; PT_from_HSbrain_71, chimp
tgtgcagggctggggtcactgactctgcttcccctgccctgcatggtgtccccacagggacagcatggacagtgtcaagcagagtgcggccctgtgcctccttcgactgtaca

SEQ ID NO: 4127 - DNA, 90 bp, Artificial
  Hairpin sequence HSbrain_710, human
ctgctccttagcatgcgtgcagctctctcctgttttgggtgttccccttggacactccagctcggggactgctggcgtgtgaatgtgcag

SEQ ID NO: 4128 - DNA, 77 bp, Artificial
  Hairpin sequence HSbrain_711, human
gcccccgacgtttccctgttcttcaggcgtctgcaaccctcctgggttgcggcgtctgctcgcccttctgcgtccgc

SEQ ID NO: 4129 - DNA, 82 bp, Artificial
  Hairpin sequence HSbrain_712, human
aggaagtcagcagttgtaccttggtggggggaggtggcagccttttccctacttccctccccaaccaaacactttgcttctt

SEQ ID NO: 4130 - DNA, 75 bp, Artificial
  Hairpin sequence HSbrain_713, human
tgagctggaggggggtctcattctacaaagagagaggtggcccccctttcttgacctcctcctccttcaagctca

SEQ ID NO: 4131 - DNA, 111 bp, Artificial
  Hairpin sequence HSbrain_714, human
gcggcggacaccatcttctttaaaccctcagtccgtattggtctctatggcatccatagaggccattcggctctgaggtcctcagtaaagaaacttagatggtattactgt

SEQ ID NO: 4132 - DNA, 95 bp, Artificial
  Hairpin sequence HSbrain_715, human; PT_from_HSbrain_715, chimp
atctgagcctctggcttccctgccagtgcagccctggcagtgtcctacttcccagggctgttgtctgcctggcgggaaggtcctgggcaaaggat

SEQ ID NO: 4133 - DNA, 63 bp, Artificial
  Hairpin sequence HSbrain_716, human; PT_from_HSbrain_716, chimp
ttcccagggagctctgggggaggggcggccattctggctccgtccccagtggccaccttggaa

SEQ ID NO: 4134 - DNA, 118 bp, Artificial
  Hairpin sequence HSbrain_717, human
gatcctgagtgaaatgggagctggggcagggaaaggctgatgctgtgggtcggtcacttgtcactaataagcccattttcctgccttgccttgccccatcttttagtttttcagggtt

SEQ ID NO: 4135 - DNA, 67 bp, Artificial
  Hairpin sequence HSbrain_718, human
gggagggggcttggaggccaggtacctgggagccctctggctcatcctgaccccattgtcctcttcc

SEQ ID NO: 4136 - DNA, 119 bp, Artificial
  Hairpin sequence HSbrain_719, human; PT_from_HSbrain_719, chimp
tgctttcccagagatgcctgggtttccaggagctgccacatcactcttcctcttttgcatcttaatgttggcagtgggaaagagttagaggtggattcctggacccagtctggcctgca

SEQ ID NO: 4137 - DNA, 90 bp, Artificial
  Hairpin sequence HSbrain_72, human
gccggtagccgagcctacgggggtggcgggggcagcagcgccttcaccagcttcctgcccccgcgacccctggtgcacccgctgaccggc

SEQ ID NO: 4138 - DNA, 69 bp, Artificial
  Hairpin sequence HSbrain_720, human; PT_from_HSbrain_720, chimp
gggagtccacatctggctttctcagccactgttcatcaccaggggttttaggaggaaggcttggctcct

SEQ ID NO: 4139 - DNA, 90 bp, Artificial
  Hairpin sequence HSbrain_721, human
gtatcagaacactggcccagccagaggagttgtccgaagatggagttcttcagacggctcctctgatcagtatggtgtgaaatgtagtac

SEQ ID NO: 4140 - DNA, 73 bp, Artificial
  Hairpin sequence HSbrain_722, human
cgtggcaaacgtggcatagaggtgtgccaggagcctgttggaagacttctggtacagcccaaccacagtctcg

SEQ ID NO: 4141 - DNA, 90 bp, Artificial
  Hairpin sequence HSbrain_723, human; PT_from_HSbrain_723, chimp
accagaggaacggcaacgccgcccgctcgctgacatcgctgacaagtgatgacaacctgtgggcgtgcctgcacacctcctttgcctggt

SEQ ID NO: 4142 - DNA, 69 bp, Artificial
  Hairpin sequence HSbrain_724, human
cctcccaccatgggcccctctgcccatgtttcctcccaggaagagcgggcagagtggcccagccccagg

SEQ ID NO: 4143 - DNA, 86 bp, Artificial
  Hairpin sequence HSbrain_725, human; PT_from_HSbrain_725, chimp
tctctggagcatcctcctggacctctggcagctctgccatcccccaaaccaggaggcagaggtcccagggatccgcggagcaggga

SEQ ID NO: 4144 - DNA, 113 bp, Artificial
  Hairpin sequence HSbrain_726, human
ggattggcttggccttacccgcgaggctttgcagtggctgcttggcttggcagtggtcgcttggcttggcgtggcagtgatcgcttggcttggcatttctggcttagcggtcc

SEQ ID NO: 4145 - DNA, 81 bp, Artificial
  Hairpin sequence HSbrain_727, human
tcaccctctgccttgagtccgccactccagggtctcagagccgctgagcattctggggttggtcagctctaaccttggtgg

SEQ ID NO: 4146 - DNA, 110 bp, Artificial
  Hairpin sequence HSbrain_728, human; PT_from_HSbrain_728, chimp
ctgtgggctggctcagcctgcttactccacgctcccttttgcaggtgaatgggcttgcagcccagggcaagtatgaaggcagtggagaagatggtggagcagcagcacag

SEQ ID NO: 4147 - DNA, 81 bp, Artificial
  Hairpin sequence HSbrain_729, human; PT_from_HSbrain_729, chimp
agctctgtggggatttgggataggcgttcagagaaggtaatttggtctttggtcatcttccctgttccttatttcagggct

SEQ ID NO: 4148 - DNA, 119 bp, Artificial
  Hairpin sequence HSbrain_730, human; PT_from_HSbrain_730, chimp
ccctccctcggctgcgtggttggcagttttgtgggtctgaggttgagaaaatatctggcctcctgaatctccgcctctgccccactccctgcctccagcaagatctcagctgagctggg

SEQ ID NO: 4149 - DNA, 88 bp, Artificial
  Hairpin sequence HSbrain_731, human
ggagcgggtgcgccggggagaggggagagctggcggcttgtcattgctggttcccggctccggctcggtccgcgcgtcctgcggtgcc

SEQ ID NO: 4150 - DNA, 94 bp, Artificial
  Hairpin sequence HSbrain_732, human
ggtcccagtccactccctggtcactctgagttgctcctgtgcatgttacagcatcaggatcatcacagatgagccggggagcctcctggcggcc

SEQ ID NO: 4151 - DNA, 116 bp, Artificial
  Hairpin sequence HSbrain_733, human
gtgggccttgcatgggagctgttagggaggcatgtgcacacacacgcacactcacatgtgtgtgtgttcatgggctgcctccaagagcttcgatcctgttttatgtgatggcatgc

SEQ ID NO: 4152 - DNA, 54 bp, Artificial
  Hairpin sequence HSbrain_734, human; PT_from_HSbrain_734, chimp
aatctgccagcttccacagtggcagattttcccatagtgggaagctggcagatt

SEQ ID NO: 4153 - DNA, 93 bp, Artificial
  Hairpin sequence HSbrain_735, human
ggtatggacttctcgggagctctgggaggggctgggtttggcaggacagtttccaagccctgtctcctcccatcttccagtttaccagcagcc

SEQ ID NO: 4154 - DNA, 67 bp, Artificial
  Hairpin sequence HSbrain_736, human
ggccgcgtggcctaaagggttaagtgaaacctcctacctgggcactggaggacctggccatgctgct

SEQ ID NO: 4155 - DNA, 79 bp, Artificial
  Hairpin sequence HSbrain_737, human
actaagatgaactgtcttacagatggctttgtgcttttggtcataagcaaggccatgtgaaagtacggttcagtgaagt

SEQ ID NO: 4156 - DNA, 68 bp, Artificial
  Hairpin sequence HSbrain_738, human
tgactgcacccgttttctcccggcagtcgtccctggggatgagcccagggagaagatggacttggtca

SEQ ID NO: 4157 - DNA, 86 bp, Artificial
  Hairpin sequence HSbrain_739, human; MQbrain_2609, macaque
gccggggaagacttgaaagaaaggggcaggagctcagatgaagagaaatcctaagttacctttctaggtcaaggcctgtccctggc

SEQ ID NO: 4158 - DNA, 80 bp, Artificial
  Hairpin sequence HSbrain_74, human
gggacgggagctggttggggtggcttagcagatccggacagggccctctgtccctgtgtcgtccccaaccccctcttccc

SEQ ID NO: 4159 - DNA, 88 bp, Artificial
  Hairpin sequence HSbrain_740, human; PT_from_HSbrain_740, chimp
tgccatgcttttcagtatcgtggccatcatctgttcagtaggggaggtgtacttctgtaatgggaggtggtggttatgtgtgtgtgca

SEQ ID NO: 4160 - DNA, 63 bp, Artificial
  Hairpin sequence HSbrain_741, human; PT_from_HSbrain_741, chimp
ttgggagggaagacagctggagagtatggtcacagcagcatcctcctctgttttctttcctag

SEQ ID NO: 4161 - DNA, 74 bp, Artificial
  Hairpin sequence HSbrain_742, human; PT_from_HSbrain_742, chimp
tgtaagctctggagggatcgcttccaaatctaggtcaagaccttggttttggaagcgtctcctttgaaatcacg

SEQ ID NO: 4162 - DNA, 84 bp, Artificial
  Hairpin sequence HSbrain_743, human
caggaagttggatctgggatgggaagagacccgggacactgccccattgtcccttctcttcccaccaccccccagtccctcctg

SEQ ID NO: 4163 - DNA, 87 bp, Artificial
  Hairpin sequence HSbrain_744, human; PT_from_HSbrain_744, chimp
tgtgcctctccccctttgctaggagttgggtgggaagagagggtggcctctgtgccccaggttgtcagtggaggggaaggggtgtca

SEQ ID NO: 4164 - DNA, 69 bp, Artificial
  Hairpin sequence HSbrain_745, human
gctgcggctgtgcccggccgagcgggggagggcgccgccactcagagccagggagggagccgctggagc

SEQ ID NO: 4165 - DNA, 70 bp, Artificial
  Hairpin sequence HSbrain_746, human; PT_from_HSbrain_746, chimp
cggccgtgcccactgctccctctcccaagctacgactacctgacggacgaggaggagcggcacagcgccg

SEQ ID NO: 4166 - DNA, 115 bp, Artificial
  Hairpin sequence HSbrain_747, human
gctctcaggggaccttgttttcccaggcaggctggcttctcagggaaaggactgttttctctctggttccagcctattgtcatgcctgggtggacaaatggggagccggtgaggt

SEQ ID NO: 4167 - DNA, 87 bp, Artificial
  Hairpin sequence HSbrain_748, human; PT_from_HSbrain_748, chimp
ctcagggctgacacgtccaccccagtgcacccactctgctttgactgagcagactggtgagcagactggtgggatctgtgcccagag

SEQ ID NO: 4168 - DNA, 64 bp, Artificial
  Hairpin sequence HSbrain_749, human
ctctggctggccccagggattctcaaggccaggccatggaggaaagcctggggctggcacatag

SEQ ID NO: 4169 - DNA, 68 bp, Artificial
  Hairpin sequence HSbrain_75, human
ggagcgaagtgattgggaggatgagccctggattccactagggttcacagctttgagcaaatcactcc

SEQ ID NO: 4170 - DNA, 102 bp, Artificial
  Hairpin sequence HSbrain_750, human
ggcacgtgcgggaggcggccagttatcaggaggcgctggcgcggctggaggaagaggggcagagcctcaaggacgagatggcccgccacttgcaggagtacc

SEQ ID NO: 4171 - DNA, 95 bp, Artificial
  Hairpin sequence HSbrain_751, human
gggtaatgccaggtgggttttgagagctgggtcggtactgcagacatctcttctccgttgtcgggtgccgtctctgctccttgtggttattgctc

SEQ ID NO: 4172 - DNA, 101 bp, Artificial
  Hairpin sequence HSbrain_752, human
aggccaaggaggaggccgagctagaggctgagctggagctggagatgaagaccctcagcccccagccccactcgccactgggcagccccttcctctggcct

SEQ ID NO: 4173 - DNA, 74 bp, Artificial
  Hairpin sequence HSbrain_753, human; PT_from_HSbrain_753, chimp
ggagagaaatattgtttctggctgtggcagctttcatctctgaatgttccttagcagccagagataattggtcc

SEQ ID NO: 4174 - DNA, 78 bp, Artificial
  Hairpin sequence HSbrain_754, human
ggggctaatcgcctggactgcctggagaaagcgaagctagtaccccctttctccaacagtccttagtttccaggccct

SEQ ID NO: 4175 - DNA, 73 bp, Artificial
  Hairpin sequence HSbrain_755, human; PT_from_HSbrain_755, chimp
ctgggtttaagatgactccagctcaggcaatatgggccttgcctgggtcagtgtctctcttcctttgacccag

SEQ ID NO: 4176 - DNA, 112 bp, Artificial
  Hairpin sequence HSbrain_756, human; MQbrain_2264, macaque; PT_from_HSbrain_756, chimp
ggccaccttctgccacttacggcctggcacaccctatcaggcccaagtggaggctcagctcccaccccaagggccctgggaaccaggctgggagaggctggagcagcgggct

SEQ ID NO: 4177 - DNA, 61 bp, Artificial
  Hairpin sequence HSbrain_757, human
tagatgactctccgatgtgatcctttgcacatatatatggatcacatctgagagtcattta

SEQ ID NO: 4178 - DNA, 78 bp, Artificial
  Hairpin sequence HSbrain_758, human
gcctcagcgcccaggagctgcggtccggagccggccccgagctgggcccaggtcgcaggctcctcaggccaaaggggt

SEQ ID NO: 4179 - DNA, 98 bp, Artificial
  Hairpin sequence HSbrain_759, human
acttggcgccccctctccttggtcctcctgatatctgtgatctcatgaatgggatgatgaagcagactcaggtggtgcaaggaaggcggtggctcagt

SEQ ID NO: 4180 - DNA, 102 bp, Artificial
  Hairpin sequence HSbrain_76, human
tttcttttttttatttcaagtccttgaaatattccttccagacaaaagaccgtttgtgttttgtgatggaatatgttaatgggggcgaggtgagtcaagaag

SEQ ID NO: 4181 - DNA, 94 bp, Artificial
  Hairpin sequence HSbrain_760, human
gtgggacctaggctaggggttcttagcataggaggtcttcccatgctaagaagtcctcccatgccaagaactcccagactaggagtcctcccat

SEQ ID NO: 4182 - DNA, 98 bp, Artificial
  Hairpin sequence HSbrain_761, human
caggcctgtgggggtctgatggctcgctctccttccctcccctcttcctgggaagttcgggtagggggagtctgggcttcaggctgggatggggtctg

SEQ ID NO: 4183 - DNA, 93 bp, Artificial
  Hairpin sequence HSbrain_762, human; PT_from_HSbrain_762, chimp
ctgctctctgtgccccctctaggagacgttttcatcctggtgttcagtctggacaaccgcgactccttcgaggaggtgcagcggctcaggcag

SEQ ID NO: 4184 - DNA, 81 bp, Artificial
  Hairpin sequence HSbrain_763, human; PT_from_HSbrain_763, chimp
ctgttgcactgtgcacgttccctgtcccctgcaggtcattaaggagtccaagcaggagcacaaggatgtgatgtgaggcag

SEQ ID NO: 4185 - DNA, 120 bp, Artificial
  Hairpin sequence HSbrain_764, human
ggcttctcgaggctccggcggctcagctcactggcttctcgaggctccggcggctcagttcactggcttctcgaggcttctggaggcttcggtggctcagctcactggcttctcgaggct

SEQ ID NO: 4186 - DNA, 118 bp, Artificial
  Hairpin sequence HSbrain_765, human
gcctcagccttgaggctgcagtggctcagctcactggcttctcgaggctccggtggctccgctcactggcttctcgaggctccggcggcccagctcactggcttctcgaggctccggc

SEQ ID NO: 4187 - DNA, 77 bp, Artificial
  Hairpin sequence HSbrain_766, human; PT_from_HSbrain_766, chimp
ccatggtgcagtgctttggccatatcagcggtggccacatcaaccctgcagtgactgtggccatggtgtgcaccagg

SEQ ID NO: 4188 - DNA, 76 bp, Artificial
  Hairpin sequence HSbrain_767, human; MQbrain_2296, macaque; PT_from_HSbrain_767, chimp
ctggccatgcttatttttgttctcctcagcctgggatccaccatcaactggggtggaacagaaaagcctttaccgg

SEQ ID NO: 4189 - DNA, 96 bp, Artificial
  Hairpin sequence HSbrain_768, human
aagccgtacccaaagtctcgcttctgccgaggtgtccctgatgccaagattcgcatttttgacctggggcggaaaaaggcaaaagtggatgagttt

SEQ ID NO: 4190 - DNA, 115 bp, Artificial
  Hairpin sequence HSbrain_769, human
gctgagagcgaagcagaaggggctccctgtccggcccacgtgccctttccctcgacgacagtcgagggctcgggctctgtgggactgtgggagctagggtctgcggggcgcctgc

SEQ ID NO: 4191 - DNA, 85 bp, Artificial
  Hairpin sequence HSbrain_77, human
cttcagaaactagtggcttctcctggcaaagcctcctcacagaggaatactgaagggggttgccaaggacatcaccagaaagaag

SEQ ID NO: 4192 - DNA, 112 bp, Artificial
  Hairpin sequence HSbrain_770, human
tgttgtgtctttagtgtcagcgtgatcattcgttgtgtctgtagtgtcagcgtgatcattcgttgtgtctgtagtgtcagcgtgatcattcattgtgtctgtagtgtcagcg

SEQ ID NO: 4193 - DNA, 94 bp, Artificial
  Hairpin sequence HSbrain_771, human
cttgggcctgggatggggacagggatcagcatggcacagatccaataccttctgtcccctgctcccttgttccccagtcccctgtgtcatcaag

SEQ ID NO: 4194 - DNA, 115 bp, Artificial
  Hairpin sequence HSbrain_772, human
ctgccggctgatgaccactgtggtgggatgggtagagaaggagctcagaggacggtgcgccttgtttcccttgagccctccctctctcatcccacctgtggctctaggcttccag

SEQ ID NO: 4195 - DNA, 97 bp, Artificial
  Hairpin sequence HSbrain_773, human
ccatagcagatttgaggcgctgttgaggactgaattactctccaagttgagagatgtctttgggttaaattaaaagccctacctaaaactgaggtgg

SEQ ID NO: 4196 - DNA, 80 bp, Artificial
  Hairpin sequence HSbrain_774, human; MQ_from_HSbrain_774, macaque; PT_from_HSbrain_774, chimp
tccatcccgtccgtggaccacgaggagctggagcgttccttcagcggcttcagcatctcccagtccaaggagaacctgga

SEQ ID NO: 4197 - DNA, 116 bp, Artificial
  Hairpin sequence HSbrain_775, human
tctgtgctgtggactccatagagtggactgtctgtgctgtggactccatagagtggactgtctgtgctgtggactccataaagcagactgtctgtgctgtggactccacagacagg

SEQ ID NO: 4198 - DNA, 118 bp, Artificial
  Hairpin sequence HSbrain_776, human
cgtgtggaaggtctgtccgcgtgtggaaggtccgtccgcgtgtggaaggtccgtccgcgtgtggaaggtccgtcagtgtgtggaaggtccgtccgcgtgtggaaggtccgtccgcgtg

SEQ ID NO: 4199 - DNA, 119 bp, Artificial
  Hairpin sequence HSbrain_777, human
caaatgaaatgagctccagtactctgaccagccccatagaggcatcctgggtcagcagccagaatgattccccaggtgatgccagtgaggggcctgagtacctggccattggcaacttg

SEQ ID NO: 4200 - DNA, 88 bp, Artificial
  Hairpin sequence HSbrain_778, human; PT_from_HSbrain_778, chimp
gcggtcccggctactccgagaccctgatggcagtgctgaggatgacagtcttgagcagacatcgctcatggagagctcagggaagagc

SEQ ID NO: 4201 - DNA, 120 bp, Artificial
  Hairpin sequence HSbrain_779, human
gtctgtgtgaccgtcatgcaggcctgtctgtgtgaccatcaggaggcctgtctgtgtgaccgtcaggaggcctgtctgtgtgaccgtcatgcaggcctgtctgtgtgaccgtcaggaggc

SEQ ID NO: 4202 - DNA, 60 bp, Artificial
  Hairpin sequence HSbrain_78, human
ggccatatgaatgcagtgattgtgggaagtcatctacccacagctctgcattctgtgttc

SEQ ID NO: 4203 - DNA, 120 bp, Artificial
  Hairpin sequence HSbrain_780, human
gtctgtgtgaccgtcatgcaggcctgtctgtgcgaccgtcaggaggcctgtctgtgtgatcgtcaggaggcctgtctgtgtgatcgtcaggaggcctgtctgtgtgaccgtcatgcaggc

SEQ ID NO: 4204 - DNA, 118 bp, Artificial
  Hairpin sequence HSbrain_781, human
ctgcggttctaggccgaggctgcctctcgggttccagcttcttggcctgtgtcactcgggttctaggccgaggctgcctctcgggttccagcttcttggcctgggtcactctctgcag

SEQ ID NO: 4205 - DNA, 90 bp, Artificial
  Hairpin sequence HSbrain_782, human; HSbrain_787, human; HSbrain_790, human; MQ_from_HSbrain_782, macaque; MQ_from_HSbrain_787, macaque; MQ_from_HSbrain_790, macaque; PT_from_HSbrain_782, chimp; PT_from_HSbrain_787, chimp; PT_from_HSbrain_790, chimp
cgaaatgcaccatgaagctttgagtgaagctcttcctggggacaatgtgggcttcaatgtcaagaatgtgtctgtcaaggatgttcgtcg

SEQ ID NO: 4206 - DNA, 78 bp, Artificial
  Hairpin sequence HSbrain_783, human; PT_from_HSbrain_783, chimp
gccgaagatggcggaggtgcaggtcctggtgcttgatggttgaggccatctcctgggccgcctggcggccatcgtggc

SEQ ID NO: 4207 - DNA, 65 bp, Artificial
  Hairpin sequence HSbrain_784, human
cttctcagtgatggagaacatgccagcactgagtccagtgggcatggtgactgtcattgatggag

SEQ ID NO: 4208 - DNA, 74 bp, Artificial
  Hairpin sequence HSbrain_785, human
gcaactcgcctggctcccttctctccgtctgcctcctggccgcggggcccggagagctgggagccagagggtgt

SEQ ID NO: 4209 - DNA, 67 bp, Artificial
  Hairpin sequence HSbrain_786, human; PT_from_HSbrain_786, chimp
tgtgggggcggcctttgcctccctaaacctgtgcggaggagtggagtgtgcttgtcgctcaaacaca

SEQ ID NO: 4210 - DNA, 112 bp, Artificial
  Hairpin sequence HSbrain_788, human
gtgagcggacactgggacactatgatgaggctaggtgagcgcacactgaggcactatgatgaggccgggtgagcgcacactggggcactatgatgatgccgggtgagcgcac

SEQ ID NO: 4211 - DNA, 84 bp, Artificial
  Hairpin sequence HSbrain_789, human; PT_from_HSbrain_789, chimp
ggcatggagtcctgtggcatccacgaaactaccttcaactccatcatgaagtgtgacgtggacatccgcaaagacctgtacgcc

SEQ ID NO: 4212 - DNA, 115 bp, Artificial
  Hairpin sequence HSbrain_79, human
ggccgggcacgcgcgccccgggctcccgccccccttccgagcatccgccgcctcttttctgctgggtctgggaggagggaggctgggaggccgctcggggcccagcgtgccagcc

SEQ ID NO: 4213 - DNA, 119 bp, Artificial
  Hairpin sequence HSbrain_791, human
cgctctgtccggctcagggctcgccctccgtgggacttgcgctctgtccggctcagggcttgccctccgtgggacttgcgctctgtccggctcagggctcgccctccgtgggacttgcg

SEQ ID NO: 4214 - DNA, 119 bp, Artificial
  Hairpin sequence HSbrain_792, human
cgctctgtccggctcagggctcgccctccgtgggacttgcgctctgtccggctcagggctcgccctccgtgggacttgcgctctgtccggctcagggcttgccctccgtgggacttgcg

SEQ ID NO: 4215 - DNA, 94 bp, Artificial
  Hairpin sequence HSbrain_793, human
cgtacacatctgcattgctctcatggtagctgtgtggatgttgagttcccatacacatctgcattgctctcatggtagctgtgtggaggttgcg

SEQ ID NO: 4216 - DNA, 72 bp, Artificial
  Hairpin sequence HSbrain_794, human; PT_from_HSbrain_794, chimp
gctgtggcctgagctggggggactcttgtgttttgcagctggctgagctgagaggggttcctcgtggcctgt

SEQ ID NO: 4217 - DNA, 69 bp, Artificial
  Hairpin sequence HSbrain_795, human; PT_from_HSbrain_795, chimp
agccctgggggtggtctctagccaaggctctggggtctcacccttggctggtctctgctccgcaggcct

SEQ ID NO: 4218 - DNA, 76 bp, Artificial
  Hairpin sequence HSbrain_796, human
caactgttcatcggctgagagggcgtaggaattatatccttcttgctcatcagttgatgatacgcccgagcagatg

SEQ ID NO: 4219 - DNA, 99 bp, Artificial
  Hairpin sequence HSbrain_797, human
cttgagtggagtagggctgagactggggtggggccttctatggctgaggggagtcaggggtggagacctaattgggctgatttgcctgctgctgctagg

SEQ ID NO: 4220 - DNA, 97 bp, Artificial
  Hairpin sequence HSbrain_798, human
gctcttcttccaccagctggtcggtgatcctctcaaacgctacgcccatgctctggtgtttggaatcctgctcacttgccgcctgctgattgctcgc

SEQ ID NO: 4221 - DNA, 76 bp, Artificial
  Hairpin sequence HSbrain_8, human
ggagaatctgcataagccccacgcttcttggctctgggtgactgggctgggggaaggaggggggatgtaatttacc

SEQ ID NO: 4222 - DNA, 115 bp, Artificial
  Hairpin sequence HSbrain_80, human
ccggtgtttgtctccctctgcacggtcacaggctccacggtcactggctctgtgagaacacttgctccagagccttgcctggggccctgtgtgccaggcctgagttgggtaccgg

SEQ ID NO: 4223 - DNA, 73 bp, Artificial
  Hairpin sequence HSbrain_800, human
agtcctaggaagtgaccgcagtgggagcaggactgtctgagtcctaggaagtgaccgcagtgggagcaggact

SEQ ID NO: 4224 - DNA, 66 bp, Artificial
  Hairpin sequence HSbrain_801, human; PT_from_HSbrain_801, chimp
gggcagaatgtcccctttgatgcagtggtagtggataaatccactggtgagggagtcattcgctcc

SEQ ID NO: 4225 - DNA, 78 bp, Artificial
  Hairpin sequence HSbrain_802, human; PT_from_HSbrain_802, chimp
gccgaagatggcggaggtgcaggtcctggtgcttgatggtcgaggccatctcctgggccgcctggcggccatcgtggc

SEQ ID NO: 4226 - DNA, 55 bp, Artificial
  Hairpin sequence HSbrain_803, human; MQbrain_2555, macaque; PT_from_HSbrain_803, chimp
cctgttggccagagtaatcaaggtgcagtgctgcaagataactttggccagttgg

SEQ ID NO: 4227 - DNA, 117 bp, Artificial
  Hairpin sequence HSbrain_804, human; PT_from_HSbrain_804, chimp
agctcatctcttgttcccctcatccctgccaccagtctggggcttcaggacctcatgtcagatggatgggaggaagaaagctcctgattggctggtggtggaagaaagggtggggct

SEQ ID NO: 4228 - DNA, 119 bp, Artificial
  Hairpin sequence HSbrain_805, human
cagacatggaatcgaacctcagtgctgccaggggagctctgctgagcagacatggaatcgaacctcagtgctgccaggggagctctgctgagcagacatggaatcgaacctcagtgctg

SEQ ID NO: 4229 - DNA, 110 bp, Artificial
  Hairpin sequence HSbrain_806, human
aaggcactctttccacctctctccaggcattatccccaggtgctgaaatggctgtggccccagcacctgaggcaggggtacgctacctggggtagcagtagaaaggtctt

SEQ ID NO: 4230 - DNA, 76 bp, Artificial
  Hairpin sequence HSbrain_807, human
ctgcagggcttgttctcaaactggctgtcagagtgtgcatggcaggctgcagccacttggggaactggttctgtgg

SEQ ID NO: 4231 - DNA, 78 bp, Artificial
  Hairpin sequence HSbrain_808, human
ttcttcagtgagacgggggctggcaagcatgtgccccgggcagtgtttgtagacttggaacccacagtcattggtgag

SEQ ID NO: 4232 - DNA, 114 bp, Artificial
  Hairpin sequence HSbrain_809, human
gcacactgtcctgcatccagtctgtgtcctcctgtctttctcatccaggtcaggcattgacactttgtaagaaagggggtaggggacacagctgggcaggtggagtgggtgggc

SEQ ID NO: 4233 - DNA, 116 bp, Artificial
  Hairpin sequence HSbrain_81, human; PT_from_HSbrain_81, chimp
ggagtggcgggtcccccagtggctgcgccttccgggcccgcggcgtcccggaggtcacgacggcgtccgcgagagcccgggctccaggcacagacgcgaggggacccggccgcgct

SEQ ID NO: 4234 - DNA, 78 bp, Artificial
  Hairpin sequence HSbrain_810, human; PT_from_HSbrain_810, chimp
gccgaagatggcggaggtgcaggtcctggtgcttgatggtagaggccatctcctgggccgcctggcggccatcgtggc

SEQ ID NO: 4235 - DNA, 85 bp, Artificial
  Hairpin sequence HSbrain_811, human; PT_from_HSbrain_811, chimp
ttcacgcatttgtgttttaccacctccaggagactgcccaaagactcttcagtatcatggagttggtaaagcacagatgcatgaa

SEQ ID NO: 4236 - DNA, 99 bp, Artificial
  Hairpin sequence HSbrain_812, human; PT_from_HSbrain_812, chimp
tgtgttttgcattaaaaatgaggccttctcttcccagttcttcccagagtcaggaaaagctgggttgagagggtagaaaaaaaatgatgtaggtgaata

SEQ ID NO: 4237 - DNA, 52 bp, Artificial
  Hairpin sequence HSbrain_815, human; PT_from_HSbrain_815, chimp
gccttctctttccagttcttcccagaattgggaaaagctgggttgagagggt

SEQ ID NO: 4238 - DNA, 114 bp, Artificial
  Hairpin sequence HSbrain_82, human; PT_from_HSbrain_82, chimp
cagcgctaattgaattaatttgcttttcttcaggcaggatggggaagcagaatagcaaactggcccctgaagtgatggaggacctggtgaagagcacagagtttaatgagcatg

SEQ ID NO: 4239 - DNA, 53 bp, Artificial
  Hairpin sequence HSbrain_821, human; PT_from_HSbrain_821, chimp
gccttctcttcccagttcttcctggagtcggggaaaagctgggttgagaaggt

SEQ ID NO: 4240 - DNA, 97 bp, Artificial
  Hairpin sequence HSbrain_83, human
tcaagccttgtgttccagcccgaggcctctgtgacgtcacggtgtctgcgggaggagaccatgacgtcacagaggcttcgcgctctgagaggtggga

SEQ ID NO: 4241 - DNA, 116 bp, Artificial
  Hairpin sequence HSbrain_84, human
gctctttgcccaccgactggctgaatggaaaggattccaaggccagaggaaaggcccacccttttctctggccttggaatcctttccattcagggaaggaaaagggtggaaggggc

SEQ ID NO: 4242 - DNA, 119 bp, Artificial
  Hairpin sequence HSbrain_848, human; PT_from_HSbrain_848, chimp
ggtggtggggtcccccctgctggccgcaggtgctctgacgaggttgcactactgtgctctgagaagcagtgcaatgatattgtcaaagcatctgggaccagccttggggatctccctcc

SEQ ID NO: 4243 - DNA, 106 bp, Artificial
  Hairpin sequence HSbrain_85, human
ttctgcttatttcctggaggggagcccctgaggctgtgagggggataggtcatctggttccttctttcccatggcacccatgctccttccctgttgttctgcggaa

SEQ ID NO: 4244 - DNA, 101 bp, Artificial
  Hairpin sequence HSbrain_86, human
gtgccctctagccttgctgccttggctttctgaccccttccaggcttcaggggcctgggagatctcatgcctcagcccaggaaacatttaatagggaaagc

SEQ ID NO: 4245 - DNA, 91 bp, Artificial
  Hairpin sequence HSbrain_87, human
tatgtctctgattttccctgccagggaagctaacccagagcacgcacctgtgctcatgagtgtttccgcaggataattcgttctgagcatg

SEQ ID NO: 4246 - DNA, 120 bp, Artificial
  Hairpin sequence HSbrain_88, human; MQbrain_2662,MQbrain_2674,MQbrain_2676, macaque; PT_from_HSbrain_88, chimp
acaggagtctactcttcatcttgtgttgagacttcgtggtggtgctaagaaaaggaagaagaagtcttacaccactcccaagaagaataagcacaagagaaagaaggttaagctggctgt

SEQ ID NO: 4247 - DNA, 99 bp, Artificial
  Hairpin sequence HSbrain_89, human; MQ_from_HSbrain_200, macaque; MQbrain_2545, macaque; PT_from_HSbrain_200, chimp; PT_from_HSbrain_89, chimp
ggtctatttcattattggtgggtagcgcatttaacagttaaatacatttaaataatgtataggtgactgcaggactgcagcattggtaactagataacc

SEQ ID NO: 4248 - DNA, 53 bp, Artificial
  Hairpin sequence HSbrain_892, human; PT_from_HSbrain_892, chimp
gccttctcttcccagttcttcttggagtcaggaaaagctgggttgagaggagc

SEQ ID NO: 4249 - DNA, 70 bp, Artificial
  Hairpin sequence HSbrain_9, human; PT_from_HSbrain_9, chimp
cggtatctggcagagaggcccagaatcctcccaaggtgtaggtttctagcctctctgccaagtgagactg

SEQ ID NO: 4250 - DNA, 104 bp, Artificial
  Hairpin sequence HSbrain_90, human
ccccactggcagagaatgaggggctacttgtggctgctctggaggaactggctttcaaagcaagcgagcaggtgggcctggatggctgggtagaaggtgtgggg

SEQ ID NO: 4251 - DNA, 116 bp, Artificial
  Hairpin sequence HSbrain_91, human; PT_from_HSbrain_91, chimp
ccagtaaaagagaagagtcacaggaagctcatctcctccctggattctggattaggagcttctgaatcttttccagggataggcaggtagctcactcttggtgcaatttcttgagg

SEQ ID NO: 4252 - DNA, 97 bp, Artificial
  Hairpin sequence HSbrain_92, human
gtgtgacctgtggagcaggacctctgacgtgtgcccctcctgtgttgtatccagggacagggtgccttatcggagagactgcggagcttcagcatgc

SEQ ID NO: 4253 - DNA, 101 bp, Artificial
  Hairpin sequence HSbrain_93, human; PT_146, chimp; PT_from_HSbrain_93, chimp
gcaaaatgtgctggccagtgccagggggtcaggctcaaggaccagcccaaaggccaggcctgacccttgagcctgatccctagcactgatcccagcatggc

SEQ ID NO: 4254 - DNA, 93 bp, Artificial
  Hairpin sequence HSbrain_94, human; MQbrain_2196, macaque; PT_from_HSbrain_94, chimp
aggatgactgggtatgctgtgccacccttgagggccatgaatccactgtgtggagcttggcctttgacccgagtggccagcgcctggcgtctt

SEQ ID NO: 4255 - DNA, 117 bp, Artificial
  Hairpin sequence HSbrain_95, human; PT_from_HSbrain_95, chimp
tgaggtgggcccctaggctggccaggcccatcagggcttgtggaatgggaaggagaagggacgcttccccttctgcaggcctgctgggtgtggctggacccctcgtgtgctcaccca

SEQ ID NO: 4256 - DNA, 112 bp, Artificial
  Hairpin sequence HSbrain_96, human
ccgggctggcgcagccggaccgcggcctgtgcctgaggctgggggacgcgctggcccgcgccggccgcctccccgaagccctgggcgcgttccgcggcgccgcgcggctcgg

SEQ ID NO: 4257 - DNA, 64 bp, Artificial
  Hairpin sequence HSbrain_97, human; PT_from_HSbrain_97, chimp
gagaggcaggtgctgtggctgccagagctgagcacaagcctaacagcctttgcaacctcctctt

SEQ ID NO: 4258 - DNA, 68 bp, Artificial
  Hairpin sequence HSbrain_98, human; PT_from_HSbrain_98, chimp
ggctggatagtgtggtagtgtggtggatagagtgctgcctctatccacaacgcagccatatgctgact

SEQ ID NO: 4259 - DNA, 59 bp, Artificial
  Hairpin sequence MM_1, mouse
cccatcgctcatttgcataatggatgcctttttatccattatgcaaatggtatgagagg

SEQ ID NO: 4260 - DNA, 113 bp, Artificial
  Hairpin sequence MM_101, mouse
agcatagttgtagcatgtggttgtattaatgaacgttacaggacagctttataatcatttataaatctgtaacattcaataaagaagcacatgtggcaaggattaattatgct

SEQ ID NO: 4261 - DNA, 108 bp, Artificial
  Hairpin sequence MM_102, mouse
ccttttcggtgatgaatgtatattggtaaggagggtgaagttgaaggggcagagacctctcaaatgaattgacttttctttaccaacatattcagaacacctacttgg

SEQ ID NO: 4262 - DNA, 113 bp, Artificial
  Hairpin sequence MM_104, mouse
tctttagtgaagttatggattttctttctcaattgctacggagtcaccctgaggctattaatttgggctattagctgagggtgatttcaaaatccatattgataatgctgaga

SEQ ID NO: 4263 - DNA, 100 bp, Artificial
  Hairpin sequence MM_105, mouse
caagcttgagctgaggggcctacctcaagctatggaaaaaattagggttagacaagaagcatttttttatagcctgaggaaggcccatggcaagagcatg

SEQ ID NO: 4264 - DNA, 98 bp, Artificial
  Hairpin sequence MM_106, mouse
gcccaggcagcaatttgtgtcagatttcaatctatttaagggaaaaccaatgaagtctggttgaaaaatggagagtaaattgctgtcttaatcaaggt

SEQ ID NO: 4265 - DNA, 120 bp, Artificial
  Hairpin sequence MM_107, mouse
gatggcccctatgcatgtgcctttgtgcataagtgcgtgcatgtatatgtgtgtatattttatgcatatacatacacacacctatacacacatgcacacagacatgcgagaatggccctc

SEQ ID NO: 4266 - DNA, 71 bp, Artificial
  Hairpin sequence MM_109, mouse
ggagccgctccactgacggcaccatcttggcacaaaaactagccgaggaggtgcccgtggacgtggcctct

SEQ ID NO: 4267 - DNA, 115 bp, Artificial
  Hairpin sequence MM_11, mouse
tcttttccccagcagaggtaagcctgtgagactaacagctttagcgcaggattcatctttccttcttgactgtggtttacagagtgctttacctccagctgcaaacatgaaagga

SEQ ID NO: 4268 - DNA, 76 bp, Artificial
  Hairpin sequence MM_110, mouse
caccaagaacccttcgtgtatgtcaagcccacaatgagtgatggcacatgcaaagaggagttcacagtcaatggtg

SEQ ID NO: 4269 - DNA, 76 bp, Artificial
  Hairpin sequence MM_111, mouse
ccctccttcccaacccagctcccgctcacccctgccacgtcaaaggaggcagaaggggagtcgggagcggagaggg

SEQ ID NO: 4270 - DNA, 107 bp, Artificial
  Hairpin sequence MM_112, mouse
gggcagatggggggtggggcagcttaccataggggttcatgtggtcacctggcatttggggcggcgtgaggccctgttggaaggggtcgctacttccgtaggggctc

SEQ ID NO: 4271 - DNA, 110 bp, Artificial
  Hairpin sequence MM_114, mouse
agccttatttgctgtgaaaattgcaaatgtttgcctcaagcaaatatgtgaaaatttgcaatttgttgtaggtgtggaattttgctatttttcacagtggaagaactgct

SEQ ID NO: 4272 - DNA, 75 bp, Artificial
  Hairpin sequence MM_117, mouse
gaccgaccaccagacagacagaacggacgctgcagcctctgcagggactaatctgtctgtggggatgggccagtc

SEQ ID NO: 4273 - DNA, 116 bp, Artificial
  Hairpin sequence MM_119, mouse
atggtgcgggagaatttattttcgctaggagaggaatgacccataactcacgaacggtgatgcttaaagtgagttatggaggttactctcctgtgagaggaaatggattggacgat

SEQ ID NO: 4274 - DNA, 110 bp, Artificial
  Hairpin sequence MM_12, mouse
tctaagcttttcaagtagtcaaattctggctcatggctctggaaggtgctgtaaacattgtattctcctctgctatgagactggattttgttctcactggggtgttgtga

SEQ ID NO: 4275 - DNA, 117 bp, Artificial
  Hairpin sequence MM_120, mouse
cgcctggctgttcgaggagacactatcaaagttaaggcaggggagccagttaacatccctgcagacgtgaccggcctccccatgcctaagattgagtggtccaagaatgaaaaggtg

SEQ ID NO: 4276 - DNA, 115 bp, Artificial
  Hairpin sequence MM_121, mouse
ggccgcctgtcccgagagttgctgatacaagctctacaaccattgagctggagtgggaacccccagctttcaatggtggtggggaaattatgggctactttgttgataagcagct

SEQ ID NO: 4277 - DNA, 87 bp, Artificial
  Hairpin sequence MM_122, mouse
ggccactccatctgttcaaacataatgctccaaagcaaggaatatgttccaaaccaaagagcatgatatttgacagatggagatgcc

SEQ ID NO: 4278 - DNA, 104 bp, Artificial
  Hairpin sequence MM_123, mouse
cctaccctagctttcctaagtgatgtcagcccctgcgagcttccaataggaaccaggcataaatcagggagctgaccttatccaataggaaactttattatagg

SEQ ID NO: 4279 - DNA, 120 bp, Artificial
  Hairpin sequence MM_124, mouse
tgagtgaggagggctgatgagcagttcaagctccctgcatagaaatagcctcagaatagttgtggtgttgtttctaattgcaatgggtgagcagactggctcattaatcctcctctagca

SEQ ID NO: 4280 - DNA, 101 bp, Artificial
  Hairpin sequence MM_125, mouse
ggtataaaatttctaagcagtgtgtgagaggtgtacgcagaaatcatgttggcaaaatattttgtgtaagtgcctcccacacacagctttaaaatgttacc

SEQ ID NO: 4281 - DNA, 115 bp, Artificial
  Hairpin sequence MM_126, mouse
aatgtatttttctgtatttgaggtttaggaaggcgtgataatgaggctgtgaagattcatggcctcttttctatggcttaatttaggctctatatcaaatatgtaaaataacatt

SEQ ID NO: 4282 - DNA, 118 bp, Artificial
  Hairpin sequence MM_127, mouse
gctatataaaggcttgtcagaatgaattctagggtgccaagagacattttgcatatttaagggtatgcaaagtgtctcatggcacattagaattcattctgacaggcctttatatagc

SEQ ID NO: 4283 - DNA, 77 bp, Artificial
  Hairpin sequence MM_128, mouse
cttcagagtctgaatacaggaaataagcttaggaaccacctaggtttgttgattcctgggcattcttaggcctggag

SEQ ID NO: 4284 - DNA, 111 bp, Artificial
  Hairpin sequence MM_129, mouse
gtacctatctcttttttgattagagaggtggcagggagcctggctcattaggcagaagtaatgagccaggctacatgccatctctaattagagaaaagatgcagtaggtac

SEQ ID NO: 4285 - DNA, 87 bp, Artificial
  Hairpin sequence MM_13, mouse
cagagcggcacctcccagcccctgctgatcaacatgtacctgccaggtaccagggaccagccgggggctggaggcaccaagaccctg

SEQ ID NO: 4286 - DNA, 103 bp, Artificial
  Hairpin sequence MM_130, mouse
gctagcctaacactccgcgggagtttccatggcgaccgaagccgggaccgcgcggcctggcagcgttgccatggagacaactccggagctggggctccagagc

SEQ ID NO: 4287 - DNA, 100 bp, Artificial
  Hairpin sequence MM_131, mouse
caggcaaaccctacaaatgtagcagaagcatttccgcacactggcatcaacatctagtttgtgcagaaatgtttccactagattcatagagtgttctttg

SEQ ID NO: 4288 - DNA, 119 bp, Artificial
  Hairpin sequence MM_133, mouse
tctgtgtgcgcagccttttctttggtgtgcgaatgtgagtgtgtgtaatgatgttatctatatgccgtcggggcacctgcacatttgcatattggggaagaactgaataaaacatgagg

SEQ ID NO: 4289 - DNA, 113 bp, Artificial
  Hairpin sequence MM_134, mouse
gcgggcagcagagatgggattcacatgaaccacagctgagttcacagagatgatttgtgagcctcagtatttgcacatatgtggtcatgcgggacctctctggccaggccagc

SEQ ID NO: 4290 - DNA, 112 bp, Artificial
  Hairpin sequence MM_135, mouse; MM_from_MQbrain_977, mouse
cattgccattctgtctgtgtttcctcttgcagggttacattttgccatctgcctttccagagtaagtggctctatgtgggcactgagcgaggaaacatacacattgttaatg

SEQ ID NO: 4291 - DNA, 79 bp, Artificial
  Hairpin sequence MM_137, mouse
agcatcggtttttatttaaaaggcttaattggaagtttttattactcccaattaggctttttaattaaaaggaaaagtt

SEQ ID NO: 4292 - DNA, 115 bp, Artificial
  Hairpin sequence MM_14, mouse
tgtatttttaatatcttctctgccatttgactgcatctgattgacctcactgcaacccacagcaaggcagatttagaagcaaaccagtatgacagggaaatggcccaattatgca

SEQ ID NO: 4293 - DNA, 103 bp, Artificial
  Hairpin sequence MM_140, mouse
ggaaaacaagccattccaagccactctctgatttgctgtgagtggcagaatcattcaccgtggtgaatcacagagagcgagccatgtggagtgattattttct

SEQ ID NO: 4294 - DNA, 114 bp, Artificial
  Hairpin sequence MM_141, mouse
tccatggccaagcctaagaagtcagctggaggatgatctgggtctgatgaccccacacggtgagacagtcaacagcccagtgtccctcttgatggcactttggagatggctgga

SEQ ID NO: 4295 - DNA, 113 bp, Artificial
  Hairpin sequence MM_142, mouse
gagtgtcttgggaagggcattgcttattttgtatgcttctgggttgattttggaagtgatctgtgacccagaaacgcaaaggacagtgtgggctgcctttcatcagggaattc

SEQ ID NO: 4296 - DNA, 99 bp, Artificial
  Hairpin sequence MM_143, mouse
tgtgccagatacaagtgaatttaagcccacatggattgaagctgcaagcttactttgcaatttatgtgcaagtggttttggatttattgatctggaccg

SEQ ID NO: 4297 - DNA, 86 bp, Artificial
  Hairpin sequence MM_144, mouse
cagatattttcccaagcagacaccagccacagccttcttggctgaaaggctaaatggctggctactcatgtactgttgaatgtctg

SEQ ID NO: 4298 - DNA, 79 bp, Artificial
  Hairpin sequence MM_145, mouse
cgccttgcccgctggtagggcctactaggccgccgggacatcccgggtctcaagtaggcctagtctgccagcaagggcg

SEQ ID NO: 4299 - DNA, 60 bp, Artificial
  Hairpin sequence MM_146, mouse
gggaaacagatgggtaatacccagaaagaaaattttctcggtattgcccatctgcttctc

SEQ ID NO: 4300 - DNA, 48 bp, Artificial
  Hairpin sequence MM_147, mouse
cagaggcactgggcctggcaagaggccaggcctgagtcacagctgctg

SEQ ID NO: 4301 - DNA, 119 bp, Artificial
  Hairpin sequence MM_148, mouse
ttgggaagagaagaacccagggcttcttaagggaactacaactcccagtgtacatgcaaagcagctgtgatgcacactgggagttgtagtccttgagctctcagtttggccaagtctaa

SEQ ID NO: 4302 - DNA, 64 bp, Artificial
  Hairpin sequence MM_149, mouse
ggcttgctgcctagtccgaggccagcagtgttgtgtctggcctgtaagaggcaggtagcaagcc

SEQ ID NO: 4303 - DNA, 86 bp, Artificial
  Hairpin sequence MM_15, mouse
agagatctttcagtaactgatcttctagctggcatttttatagattaggaagcaggccagctggaggtcatactaaattaaactct

SEQ ID NO: 4304 - DNA, 116 bp, Artificial
  Hairpin sequence MM_151, mouse
tccatactctgtcttttggatcatcatattcttaccaaaacatttgctctgattggtggcccggtcaacaaagactttggctgagatgacatgaccaaaagggacaaacatctgga

SEQ ID NO: 4305 - DNA, 93 bp, Artificial
  Hairpin sequence MM_152, mouse
gtcttggctctgtgtggaccagggcaggtgagggagcctggagatgttctctaggttatcctctgttgctgtgaactgggaggatccaaggac

SEQ ID NO: 4306 - DNA, 119 bp, Artificial
  Hairpin sequence MM_153, mouse
acttcagcgtgggcatagttggacgagagggcgtcttggcaggtctctgtgtttaaagagcacaggtgtgagacactgggacgcacgctttcggctcaacattgccttctggcgggggt

SEQ ID NO: 4307 - DNA, 119 bp, Artificial
  Hairpin sequence MM_154, mouse
tcattgttcctggggaaattcacatggtttgcaggagaaaaggtagggagaaggcacagggagaggctgcctgcctgcctgtctatctctgcaggtattggtgagttccttaggcatga

SEQ ID NO: 4308 - DNA, 118 bp, Artificial
  Hairpin sequence MM_156, mouse
cgatggttcagttggagcggttacatttggcagcattccttgttagcatttgataaacaattattgccaaatgttagcaaggaaacctgccaaatgttacagctcagatttaactgcg

SEQ ID NO: 4309 - DNA, 118 bp, Artificial
  Hairpin sequence MM_157, mouse
cttcaagtgaaaagtgttaaaataaatggctcatgacttatgaagtgttaaaataaacgtttatttcaacactactcatgtcataagccatttatttcgacactttttacttcagaag

SEQ ID NO: 4310 - DNA, 116 bp, Artificial
  Hairpin sequence MM_158, mouse
gcgactctgtcccctgctgcactaaattgacacttgtgcaagcaatggctctcgtcagtcactctgaagctgctgcctccagaagtgtcgatttagtgcagcgggagatgaggtgc

SEQ ID NO: 4311 - DNA, 119 bp, Artificial
  Hairpin sequence MM_159, mouse
cgggaggatgcctcggtgcggggcgcgtcgcccccctcaggccaccagagcccggatacctcagaaattcggctctgggtctgtggggagcgaaatgcaacccaaaccccgtttccccg

SEQ ID NO: 4312 - DNA, 83 bp, Artificial
  Hairpin sequence MM_16, mouse
tttcttgaagcctgactccccgcgggacttccaaggcaccataacttcaggtccagactgggctgtcaggcttttccaggaag

SEQ ID NO: 4313 - DNA, 108 bp, Artificial
  Hairpin sequence MM_161, mouse
gaacacttgtgtttatttgaatgtgtgatgaggaggtcatcaaaatgaacacgctcgttgtgtttatttgaatctcacatcgctcatgagagaatacacgccgtgttt

SEQ ID NO: 4314 - DNA, 113 bp, Artificial
  Hairpin sequence MM_162, mouse
tgcagtcacagagaaatcagctttaattaatttgagtgccagctctgtgtataattacccagcatgagagtttgcatgcaaatgcggaaatgctgattcttcaaatacttgca

SEQ ID NO: 4315 - DNA, 101 bp, Artificial
  Hairpin sequence MM_163, mouse
gcacaggaagcagcaggtagctctgtctgctgtctctttagataaaatgtatgtctggcacggagggaacagctgagaactacctgttgtgatatacgggc

SEQ ID NO: 4316 - DNA, 112 bp, Artificial
  Hairpin sequence MM_164, mouse
tgcacagcccttaactctttgactgccatggcacaaaccatgctgatgattctagattgtgaccgttgtatggttaaggttgccacagcagtcaaagggttatagcattgta

SEQ ID NO: 4317 - DNA, 80 bp, Artificial
  Hairpin sequence MM_165, mouse
tggcagctaatgacctgctggagtcgtgtgtgcccaaggcaaagcttaaggccattagtccaacaggtcattaactgaca

SEQ ID NO: 4318 - DNA, 116 bp, Artificial
  Hairpin sequence MM_166, mouse
gctgtcttgatagtgcaccagggagaacagctgatggatcacaaatctctgcatttcaccaacagaaatgaatttgaatccatcaattttattcccttatgcaaaatttaggaagt

SEQ ID NO: 4319 - DNA, 89 bp, Artificial
  Hairpin sequence MM_169, mouse
cctaggtgaggccatgactggcatctcccaaaatgccaagaatggaaatctgccggagtttggagatgccattgccacagcctccaagg

SEQ ID NO: 4320 - DNA, 104 bp, Artificial
  Hairpin sequence MM_17, mouse; MM_248, mouse; MM_250, mouse
ttcctttttcttttcttgaagcctgactccccgcgggacttccaaggcagcataacttcgggtccagactgggctgtcaggcttttccaggaaggatccaggaa

SEQ ID NO: 4321 - DNA, 113 bp, Artificial
  Hairpin sequence MM_170, mouse
ggtccactgaggattttgaaggaagcataattccttgacttcttttagaattaatttacctattaaataaaaaaaggaaagaattcatctttcatttgaagtcctctgaggct

SEQ ID NO: 4322 - DNA, 53 bp, Artificial
  Hairpin sequence MM_171, mouse
ggtgcaattggccacttgctccatcagatgaagggtaagtggttaattgaact

SEQ ID NO: 4323 - DNA, 83 bp, Artificial
  Hairpin sequence MM_172, mouse
tgtatccatttttctcagttagtgtcaggtttcattaggaaacacgggaggcctgacattaatcgcatgaaaaatgtgtctca

SEQ ID NO: 4324 - DNA, 81 bp, Artificial
  Hairpin sequence MM_174, mouse
ctgaagtggggccagttccccgcctcttccagctttgctgccaaagttggagaggggtggagtggcctggaagactgttgg

SEQ ID NO: 4325 - DNA, 101 bp, Artificial
  Hairpin sequence MM_176, mouse
actgccatcccttcatcacgttagtccatttgctcagcggcccttccacgatggacgccatcttgggagccgccaatgacaacaaacggcctgacgtcagt

SEQ ID NO: 4326 - DNA, 114 bp, Artificial
  Hairpin sequence MM_177, mouse
gccaagcctaggagataagttggagggttatctaggagtgatgtccccctgttttgtgtaacatgggggcaatcaacagcctaatgtccctcttgatggcacctagagcatggc

SEQ ID NO: 4327 - DNA, 78 bp, Artificial
  Hairpin sequence MM_178, mouse
aagcagggacttcttgccagcccttggcagcttgaggcctcccatcatcatccaccgagctggcaagaagtatggctt

SEQ ID NO: 4328 - DNA, 63 bp, Artificial
  Hairpin sequence MM_18, mouse
gcctaattagacccacaattggctaattgcatccacaattagccaattgcaggcccaattggc

SEQ ID NO: 4329 - DNA, 116 bp, Artificial
  Hairpin sequence MM_181, mouse
tgacaaatgtatgtgaatgaccagctcacgggaagtggccttcaatagtccgatagcttcctgtatcctgacattgtgaaggcccacttcctgctctgtctccgaaaatacagtca

SEQ ID NO: 4330 - DNA, 77 bp, Artificial
  Hairpin sequence MM_182, mouse
tccgtgcctcactgtttgttaaatattctgacccggtcaccctgggtcagggtgactgacctgaagggtgagcagga

SEQ ID NO: 4331 - DNA, 87 bp, Artificial
  Hairpin sequence MM_183, mouse
ggcccgtgggtgcttcaggatctgtttctgtgaacattctcttcaaaaatgagagtttcatgcagatcctagataacagtcttggtc

SEQ ID NO: 4332 - DNA, 115 bp, Artificial
  Hairpin sequence MM_185, mouse
gcttcaccttccaggtatccaccaaggacatgcccctggcactgatggcctgtgccctccgaaaaaaggccacagtgttccggcagcctctggtggagcagcctgaggaatatgc

SEQ ID NO: 4333 - DNA, 117 bp, Artificial
  Hairpin sequence MM_186, mouse
acacttgctcaaattaatgaccaaaaatgtcagatgtgtccacagctaattattcattagatgcttaattagtgtgggatgatcatgacattttaatgttattaatttttatactgt

SEQ ID NO: 4334 - DNA, 75 bp, Artificial
  Hairpin sequence MM_187, mouse
tagagattggcttcttcagaagctctgctcaccatgcttcctggtccttgcagagtcctggcctgggctgctctg

SEQ ID NO: 4335 - DNA, 116 bp, Artificial
  Hairpin sequence MM_188, mouse; MM_from_HS_306, mouse; MM_from_HSbrain_1424, mouse; MM_from_PT_313, mouse
gctggcgaactggcaggccaggaagaggaggaagccctggaggggctggaggtgatggatgttttcctccggttctcagggctccacctctttcgagccgtagagccagggctggt

SEQ ID NO: 4336 - DNA, 115 bp, Artificial
  Hairpin sequence MM_189, mouse
aaatatggagaaaatgcccgtaatgtacagtaaatgaggcccataactcattggagcctccaatgagttatgtgctaaattcatatttcacaacatggccatagttttttttttt

SEQ ID NO: 4337 - DNA, 106 bp, Artificial
  Hairpin sequence MM_190, mouse
tcatgtaccaaaggagcttttctggtctattgggtaaatatgtattaaagtaatttttaaaatacttatgtactcaataggctggaagtggtcaatggtttaatga

SEQ ID NO: 4338 - DNA, 120 bp, Artificial
  Hairpin sequence MM_191, mouse
ccatttggttaggaaagctgtcacatttggaaaggagcaaccaggcagggagaaactaaattgtttttctttgtctgcctgctgttccaagtcgttgcaggcactgccagtaaatcatgg

SEQ ID NO: 4339 - DNA, 78 bp, Artificial
  Hairpin sequence MM_192, mouse
gtgttgatgtttattggtgtctcttttctcttctagggccagcagagagaagagactccatcttccagaggttgccac

SEQ ID NO: 4340 - DNA, 111 bp, Artificial
  Hairpin sequence MM_193, mouse
gtacatgcttattttcctcctaggtaatttaattccaagacaccaggagctattttataaaaatcctgtgtttgctggagtaaggttgcctgaggtcaaagatgcagaagc

SEQ ID NO: 4341 - DNA, 115 bp, Artificial
  Hairpin sequence MM_194, mouse
ctgtggcagaggacagctggcagaaagtgttacaggtataaccctaattctccttgtttctgttggtgttgtaggagagatctgtaggcctttctgtccagcgctctgtttttgg

SEQ ID NO: 4342 - DNA, 110 bp, Artificial
  Hairpin sequence MM_195, mouse
cgagcagcgccttgcctagtcgggccgccaacaccagatccttctccttctggcggatcaccgacagcagctcgggatcctgggtaggcggcggcggcagcggcggcccg

SEQ ID NO: 4343 - DNA, 112 bp, Artificial
  Hairpin sequence MM_196, mouse
cgggccttgggggtgtgagcccctttttctgctttccagcatctttggcatttgcgcaaagttgctcagattgcaatgctggggtgcagtgggcgcgcgactcttgcacctg

SEQ ID NO: 4344 - DNA, 114 bp, Artificial
  Hairpin sequence MM_198, mouse
gtgtctctcattggccacagctgctgcgagcagcaggatgagggttgacctatatctgtcctctgtaggtcaacccccgaatttgtttgtagaagcttcagtcttctagaacgc

SEQ ID NO: 4345 - DNA, 105 bp, Artificial
  Hairpin sequence MM_2, mouse
gagtcattgtcatcgtcttggagggacatcattgtgtcactagtctgccaggttgttcagacagtccgacctgatgtcaagcaccaggatgatgacatggatatc

SEQ ID NO: 4346 - DNA, 116 bp, Artificial
  Hairpin sequence MM_20, mouse
agtgctcccagaacagggtctccttgaggggcctctgcctctatccaggattatgtttttatgaccaggaggctgaggtcccttacaggcggcctcttactctctccttgagccct

SEQ ID NO: 4347 - DNA, 114 bp, Artificial
  Hairpin sequence MM_200, mouse
ctgaggaatgaatggctttgctccttttctgcatcacttccatcagcgcacccacaattcctgaagtgggtgcgggtgttggtggtgtggactcttggccatcagacaccttgg

SEQ ID NO: 4348 - DNA, 110 bp, Artificial
  Hairpin sequence MM_203, mouse
tagaggactctgtatttaatttggctcagccgggaagattttttggctctgtgtgtgtatgtgtattctgaaaaatctttccgagcaagccccagggtcggaagcttctg

SEQ ID NO: 4349 - DNA, 89 bp, Artificial
  Hairpin sequence MM_204, mouse
cagggcactttaggctaccccagtgtgtcagtgtagagcaatgttgacaagctctgcctaactgagctgtgggtgttctagagggtatg

SEQ ID NO: 4350 - DNA, 99 bp, Artificial
  Hairpin sequence MM_205, mouse
ttttgtttttttgcattttcccttcagacacaaaacttttccagtcaatcactgttgttcctgtggtactgtaataagggagagggcaaaaaaagagaa

SEQ ID NO: 4351 - DNA, 78 bp, Artificial
  Hairpin sequence MM_206, mouse
ttacagatatatacattctattgtccctagaaggtgtattccttctagggacaatgtgttggctgtgtgagtccttga

SEQ ID NO: 4352 - DNA, 96 bp, Artificial
  Hairpin sequence MM_207, mouse
gaccccaagaaaccaaagggcaagatgtctgcttatgctttcttcatgcagacatgcagggaagaacataagaagaaaaacccagaggttccagtc

SEQ ID NO: 4353 - DNA, 89 bp, Artificial
  Hairpin sequence MM_208, mouse
cggtagcccaaggtttgcaggcctggccgaatgaccagggcaatggaaggaagtcgtggtcgtcgcgggcgtggggaatgggcttaccg

SEQ ID NO: 4354 - DNA, 119 bp, Artificial
  Hairpin sequence MM_209, mouse
tcccattttactcgggaagcagcattcaggtctctgggtcctggatgtccttggtgcacactccaaggactcctcgtccttaagttcatagtctgtattccctgagtcctatcctggga

SEQ ID NO: 4355 - DNA, 91 bp, Artificial
  Hairpin sequence MM_21, mouse
gctgtgggcaatgagccatgggccaacaatgtgagtaatggctagttttgttattttgaacttgggtagttggctgatgggtgtttattgc

SEQ ID NO: 4356 - DNA, 105 bp, Artificial
  Hairpin sequence MM_210, mouse
gttggcatagagcttcttttcccgggcgagctgcctacgggtccgctgctggcacacagccagctgggtcttggcggctttgttgctgggatagagctgcaggac

SEQ ID NO: 4357 - DNA, 119 bp, Artificial
  Hairpin sequence MM_211, mouse
atttcgggataattctccagcgttggagtcagccacggcttacctggaagattgaatgtctacttggctttcttcctgtcagccgtgggtgcctcttgctactggaagagctctgtgat

SEQ ID NO: 4358 - DNA, 100 bp, Artificial
  Hairpin sequence MM_213, mouse
tgctgaacgatcgatccccatcccagcttccttccagcccttgatgttttagtacgcacataggctagagagaggttggggatggggaaagatgagagca

SEQ ID NO: 4359 - DNA, 98 bp, Artificial
  Hairpin sequence MM_214, mouse
caagctgacgctacccatcccctccacgtgccccgagccctttgcccgcctactggagggtgagccagggccctgtggagagggtaggctcagctttg

SEQ ID NO: 4360 - DNA, 94 bp, Artificial
  Hairpin sequence MM_215, mouse
tcatggagaagggagggcaagtcaggtgaccaggtgagactcagaactcctgaggtagcctggttaccttgacattcctgtgattatgccaagg

SEQ ID NO: 4361 - DNA, 92 bp, Artificial
  Hairpin sequence MM_216, mouse; MM_from_HSbrain_1421, mouse
gtatcacaggtggtacgccctttcctctctgccccatagggtgtagctctaactaccctctagggaagagaaggttgggtgaacagccttac

SEQ ID NO: 4362 - DNA, 88 bp, Artificial
  Hairpin sequence MM_217, mouse
tccaggctggaaggatctgtcacccgatcccaggtctgtgctacagccagtcttggaatctggggcaatgtgatcctgccctgcagga

SEQ ID NO: 4363 - DNA, 117 bp, Artificial
  Hairpin sequence MM_218, mouse
tcagggccctgtgactcaggcggggtgggggaggatgttttggatgccgctctgctgacgttggtgccctctgttcttacatcctccttaatttactgcctgaggagggggccaggg

SEQ ID NO: 4364 - DNA, 78 bp, Artificial
  Hairpin sequence MM_225, mouse
ggattttcatcagtcaggctcctggctaaagttcagctttcagctgcatttagccaaagcctgactgtaagctgctcc

SEQ ID NO: 4365 - DNA, 119 bp, Artificial
  Hairpin sequence MM_226, mouse
agggccagacagatgatgagctgtcctttcccgagggagcaattattcgcatcttgaacaaagaaaaccaagatgatgatggcttctgggaaggggagttcagtggtcgaatcggtgtt

SEQ ID NO: 4366 - DNA, 113 bp, Artificial
  Hairpin sequence MM_227, mouse
ggttccaccctgctcaccctggaggccacagatgctgatggaagccgcacccatgctactgtggactacagcatcatcagtggcaatcggggccgagttttccagctggaacc

SEQ ID NO: 4367 - DNA, 75 bp, Artificial
  Hairpin sequence MM_229, mouse
gcacagaagtcctcattctctatgggggccggggtgttcttcttggctcctggagctcgggggatgagtctgtgt

SEQ ID NO: 4368 - DNA, 90 bp, Artificial
  Hairpin sequence MM_23, mouse
tcctgattctgcctgcgtggagcgggcacagctgtgagagccccctaggtacagcggggctgcagcgtgatcgcctgctcacgcacagga

SEQ ID NO: 4369 - DNA, 116 bp, Artificial
  Hairpin sequence MM_230, mouse
ccttgggcttcttccagtcatcctgaggtagatatcatacaggaatgctggggccttatggcttacagcaatccagtaatgatataaaaggtgattggaggttagatttacattgg

SEQ ID NO: 4370 - DNA, 117 bp, Artificial
  Hairpin sequence MM_233, mouse
ggccagggcaggtggcttacctggcgtgggagtaggtatgggagttcaaagacgcacacatgataagaccgatctcccctaccttttccaggctacaaggaaaatccctctttggct

SEQ ID NO: 4371 - DNA, 76 bp, Artificial
  Hairpin sequence MM_234, mouse
gcccggctccgggtctcggcccgcacggtccggccggccatgctggcggggctggggccgggacagagcccgtggc

SEQ ID NO: 4372 - DNA, 113 bp, Artificial
  Hairpin sequence MM_237, mouse
attgtctgtcttattgtgtttggctgaggcctagtaattttcaataaagcccttaatccaagtacttcactgaaaattaccaggcttctctgtggaggatgagagttgaaaat

SEQ ID NO: 4373 - DNA, 119 bp, Artificial
  Hairpin sequence MM_238, mouse
cctctcctcgatgcttgattagtcagattgatggaggaggccatatgtggccgtgtcaaaacttggctaccaggctcctttcctctctctgaaggacaggcagtaaagaggaagtctgg

SEQ ID NO: 4374 - DNA, 106 bp, Artificial
  Hairpin sequence MM_239, mouse
tcagcaaggtcttggtatggtagcgccccaggatggagtaggcagggccaaggtccttgccagtcttcaggatcttggggttcacactgtagcggggccctgggga

SEQ ID NO: 4375 - DNA, 119 bp, Artificial
  Hairpin sequence MM_24, mouse
cctttccatctagtgggtactggcctcggtgctggtggagcagtgagcacgccatacattatatctgtgacacctgccacccagcccaaggcccctaggcccacaaacttctggagggg

SEQ ID NO: 4376 - DNA, 113 bp, Artificial
  Hairpin sequence MM_240, mouse
ccagctcttgaatggcccctctgtgtggctgctgctggctcagaccccagcccaccttgggcggtgggtttgggttttggctggcacattcaccaaggggcctgacatcatgg

SEQ ID NO: 4377 - DNA, 120 bp, Artificial
  Hairpin sequence MM_242, mouse
aatgatggaggtgcaggcgtttcctggggattaatgaccagctgggaagaaccagtggccctcggctctgcctcccagccagccattaactccaaggaaatgtcttttgctgaggtcgtt

SEQ ID NO: 4378 - DNA, 99 bp, Artificial
  Hairpin sequence MM_244, mouse
cggcgggggcggggacccacgggggcgcgtccccgtggctgcgcgcccccgctgcgcatcccgggcgcgcggcgtctccgttggtcttggcctccgctg

SEQ ID NO: 4379 - DNA, 115 bp, Artificial
  Hairpin sequence MM_245, mouse
ttcttgttttgatttggttgtttgggttgttttatggtgtcctggtatgttcctcatgtttgaagatgtctaggatgctttgggaaaccttggcacttgagagttcactcaagaa

SEQ ID NO: 4380 - DNA, 104 bp, Artificial
  Hairpin sequence MM_246, mouse
ttcccttttcttttcttgaagcctgactccccgcgggacttccaaggcagcataacttcaggtccagactgggctgtcaggcttttccaggaaggatccaggaa

SEQ ID NO: 4381 - DNA, 104 bp, Artificial
  Hairpin sequence MM_247, mouse
ttcccttttcttttcttgaagcctgactccccgcgggacttccaaggcagcataacttcgggtccagactgggctgtcaggcttttccaggaaggatccaggaa

SEQ ID NO: 4382 - DNA, 104 bp, Artificial
  Hairpin sequence MM_249, mouse
ttcctttttcttttcttgaagcctgactccccgcgggacttccaaggcagcataatttcgggtccagactgggctgtcaggcttttccaggaaggatccaggaa

SEQ ID NO: 4383 - DNA, 113 bp, Artificial
  Hairpin sequence MM_251, mouse
cttcctgctaagaggctgccaggtgctggtggaaatagaggccgaagaggctggagagcagctggcaggcagctgtccaccagatgatgtaagccagcatgcctctgaggaag

SEQ ID NO: 4384 - DNA, 66 bp, Artificial
  Hairpin sequence MM_252, mouse
cgcccattcgggactggagggatgggcttcctaacggaagcgcacccttcaagtcctggaacaccg

SEQ ID NO: 4385 - DNA, 117 bp, Artificial
  Hairpin sequence MM_253, mouse
ggaccatgccccaggtgccatcaagagggacattaggctgtcgattgccctcatgttatgcagaacagagggacatcacacctagagaaccctccagctgatctcctaggcttggct

SEQ ID NO: 4386 - DNA, 105 bp, Artificial
  Hairpin sequence MM_254, mouse
tcaggcagtcgtcacctttcttccgggcactggccaagccaaagtcagtgatgatgatcttggagtcagtgcctgggtggtagtaaaggagattctcaggcttga

SEQ ID NO: 4387 - DNA, 86 bp, Artificial
  Hairpin sequence MM_256, mouse
cgaacgaggggttgaccaaagcagccatgatggcaatgtccgagtatgaagaccggttgtcatctggtctggtcagcccagccccg

SEQ ID NO: 4388 - DNA, 74 bp, Artificial
  Hairpin sequence MM_257, mouse
gcgcatgggctatggagccgccacatcttgcagcagacactgatggatgaggggctgcggctcgcccgcctcgt

SEQ ID NO: 4389 - DNA, 101 bp, Artificial
  Hairpin sequence MM_258, mouse
ttttatctactaggaatgggatacattcacaggtgtggttgttggagacatgctgcgcaaagctgtgagttaaaatctgatttctctcctaggggaaaaag

SEQ ID NO: 4390 - DNA, 69 bp, Artificial
  Hairpin sequence MM_259, mouse
gccaggcgtctggaagtcgccgtaaagagggaacacgtcctctttggggtcgccttccagagggtaggt

SEQ ID NO: 4391 - DNA, 107 bp, Artificial
  Hairpin sequence MM_260, mouse
aggcttcggctgaagaggaaccagccctgatggtgtgtccgccaagacatggaagtgagaggtgggtggaggccccattggggttggtcggctctcagcatctacct

SEQ ID NO: 4392 - DNA, 79 bp, Artificial
  Hairpin sequence MM_261, mouse
attgtctttcttatgtttcccaacagacactgagcacattgaagagctgcagtgggtgtggagaacatacttgaacaat

SEQ ID NO: 4393 - DNA, 108 bp, Artificial
  Hairpin sequence MM_262, mouse
gaggccccttctggaatttgcttgtggcgctgtttattacctaccaggcattttgctgaaggtgcaatttgcagagccattaatggcaatgaagttccagcgggtgtc

SEQ ID NO: 4394 - DNA, 92 bp, Artificial
  Hairpin sequence MM_263, mouse
taaggtccttgatttcaatgtttcccactttggtggttgatctgataataggtcttccaaccaaagctgggaagatgtgttctggaaaatta

SEQ ID NO: 4395 - DNA, 59 bp, Artificial
  Hairpin sequence MM_265, mouse
tcctggctcatggctctggaaggtgctgtaaacattgtcccctctgccatgagtctgga

SEQ ID NO: 4396 - DNA, 97 bp, Artificial
  Hairpin sequence MM_266, mouse
gatagctttctccaactgtaacaatctccacttcactgtcagttgaggtaacattaatttcttcattggcagtgacctggggagtgaaggaggcttc

SEQ ID NO: 4397 - DNA, 100 bp, Artificial
  Hairpin sequence MM_268, mouse
gctgaattgatttccgtgcataaacagtggcctagattcttgccctgtggaaatccacggaattaagaactctaggttcctggagtgataagaggtaagc

SEQ ID NO: 4398 - DNA, 110 bp, Artificial
  Hairpin sequence MM_269, mouse
gcatggccttggtgctgaagttggtatggcagcctgcaccatcccagttccctggaatgggcttggggtcaaaggttgctatcaccccaaagtcttcgcatacccgatgc

SEQ ID NO: 4399 - DNA, 112 bp, Artificial
  Hairpin sequence MM_271, mouse
tatcccagcatgccagtgggaatcataggctggagagaccttccttctgcaggagatgaaattcttgaagtagaatctgaggtattcaagcctaattccctaatgttagata

SEQ ID NO: 4400 - DNA, 104 bp, Artificial
  Hairpin sequence MM_272, mouse; MM_277, mouse
ttcctttttcttttcttgaagcctgactccccgcgggacttccaaggcagcataacttcaggtccagactgggctgtcaggcttttccaggaaggatccaggaa

SEQ ID NO: 4401 - DNA, 116 bp, Artificial
  Hairpin sequence MM_273, mouse
tggattagggaaaaggctgtaattccatcttggggtatctggtgaaccaagctgtgggtctgtggtttatgatgtcaccagaacccccagctggaattacagccttccaatgtaca

SEQ ID NO: 4402 - DNA, 102 bp, Artificial
  Hairpin sequence MM_278, mouse
gggcaatctaggagtgacgttcctgtgccacatgtgacatgaggacaatcagcagcccaatgtccctcttgatggcactttggacatggcaggcctatgccc

SEQ ID NO: 4403 - DNA, 110 bp, Artificial
  Hairpin sequence MM_279, mouse
ctggagggcagtctgggagtgatgtccctgtgtcattagtgatatgatggcaatcaacagtccaatgtccctcttgatggcactttggacatgaccctagtggcttgcag

SEQ ID NO: 4404 - DNA, 114 bp, Artificial
  Hairpin sequence MM_28, mouse
tcttgttctttcctatataccctcagagctgatctgagtgtggagattccattgacttcaaaggaagcttcatgcttggatcttctccacaggggtgctcagactaagacaaga

SEQ ID NO: 4405 - DNA, 104 bp, Artificial
  Hairpin sequence MM_280, mouse
ttcatttttcttttcttgaagcctgactccccgcgggacttccaaggcagcataacttcgggtccagactgggctgtcaggcttttccaggaaggatccaggaa

SEQ ID NO: 4406 - DNA, 105 bp, Artificial
  Hairpin sequence MM_281, mouse
tttcgtttttcttttcttgaagcctgactccccgcgggacttccaaggcagcataacttcgggtccagactgggctgtcaggcttttccaggaaggatccaggaa

SEQ ID NO: 4407 - DNA, 118 bp, Artificial
  Hairpin sequence MM_283, mouse
cttctgtgtgggtttaagtacctgtgggcagcatcagggtctgccttgcggtgggaccttttgggtttcagcgcagggtctctggtgtttcctgacaggcgatctgaagcatagctgg

SEQ ID NO: 4408 - DNA, 79 bp, Artificial
  Hairpin sequence MM_284, mouse
ggagattggctgtaggggcttctgagtctgatgcccttatatcttaagggacatgaggatagtcagtagtccaatgtcc

SEQ ID NO: 4409 - DNA, 119 bp, Artificial
  Hairpin sequence MM_285, mouse
tttcattgtttcccatgtgcctttaaggaatcactcttgatctcagtcataaaattggaaagccacacaactgacaagatgatccccccaaggcagctgaaatatggggtagattgaaa

SEQ ID NO: 4410 - DNA, 96 bp, Artificial
  Hairpin sequence MM_286, mouse
gaccccaagaaaccaaagggcaagatgtctgcttatgctttcatcgtgcagaaatgcagggaagaacataagaagaaaaacccagaggttacagtc

SEQ ID NO: 4411 - DNA, 119 bp, Artificial
  Hairpin sequence MM_287, mouse
gggttttggctctgctcgcaggcaggggatttgaggagcggttgtgtgatttgtacagctgtcattagggtaattgcacgatattttcccaaatttctcctgcagcttcaggcttgctt

SEQ ID NO: 4412 - DNA, 114 bp, Artificial
  Hairpin sequence MM_29, mouse
gtcagacggctcagaagtccatggagctgtgggccaggtagtccttgcggccaatgttgctgacctgcttggtctgcatagcttcaagtttggggcagtcagtgatccgatggc

SEQ ID NO: 4413 - DNA, 115 bp, Artificial
  Hairpin sequence MM_292, mouse
ggctaaaggtgaccccaagaaaccaaagggcaagatgtctgcttatgccttctttgtgcagacatgcagggaagaacataagaagaaaaacccagaggttcccgtcaattttgct

SEQ ID NO: 4414 - DNA, 116 bp, Artificial
  Hairpin sequence MM_294, mouse
taccattgatggcccctccaaggtgaagatggattgccaggagtgccccgagggctatcgtgtcacctatacccccatggcacctggcagctacctcatctccatcaagtatggtg

SEQ ID NO: 4415 - DNA, 115 bp, Artificial
  Hairpin sequence MM_297, mouse
agatggtgatctagccctttagttttgaggttggtgtactgtgtgtgagtatacatatttatcacacacagtcactatcttcgaaagtgagggtgcacatctttctcagccatct

SEQ ID NO: 4416 - DNA, 114 bp, Artificial
  Hairpin sequence MM_298, mouse
tttctctgtgaattaattggtcaggaaagacactttttatattgtcaagtggcacttaagccactaattcttgactgtgaaactgcttttcctgggcaatgctctttaaggaaa

SEQ ID NO: 4417 - DNA, 84 bp, Artificial
  Hairpin sequence MM_299, mouse
agctcagccttggcttcctgttcttcttcatactgttcccgcagcaggtcacagtcatggcgggaggactgaagagcatgagct

SEQ ID NO: 4418 - DNA, 105 bp, Artificial
  Hairpin sequence MM_3, mouse
gcgcctccgccgcctgggccaggcgcccgccaggtcggcgggaagaggcgcggacacgcgcaccagtcccgccgcgggggcgcgcctggctctgggcggggctgt

SEQ ID NO: 4419 - DNA, 114 bp, Artificial
  Hairpin sequence MM_30, mouse
agtatttctttccttcacaaagtacaaagggtttcagaatcaagtgtattccagcagcagcccaggcttgctgacaagatattttgaaacaacttgctattaggaaggaagtct

SEQ ID NO: 4420 - DNA, 108 bp, Artificial
  Hairpin sequence MM_300, mouse
attttcaaacaagcatttgtgtgtataaaatgggtaattgcacacacaaatgaacaattttgtatgcaattatccattttgcatacagaatcataagcttctgagggt

SEQ ID NO: 4421 - DNA, 103 bp, Artificial
  Hairpin sequence MM_302, mouse
tgcagtgtgtctcatttctgagcctttatataccctcccatattgagaattgagcaatgctgtggtgggaggttaaggatgaaggcctcaggaggctaaagca

SEQ ID NO: 4422 - DNA, 108 bp, Artificial
  Hairpin sequence MM_303, mouse
gagggacacttcacctggcgcactgggcaggaagactttattcagatccaaggaggaggctctggaatgggttttctgtggccgtggtggtggggtgggagggtcctc

SEQ ID NO: 4423 - DNA, 116 bp, Artificial
  Hairpin sequence MM_304, mouse
ggacctgtcgcagcgcgtggccgatcgcctgggcctggagctgggcaaggtggtcaccaagaagtttagcaaccaggagaccaggtgggagcctcgctggggctgaggcaggggcc

SEQ ID NO: 4424 - DNA, 104 bp, Artificial
  Hairpin sequence MM_305, mouse
ggtgtgaaagggtaggagagatgctgggggtgggggtgcttgtgttttagacccccaatattatcccagtgtcccctgccttccttcttcccctgccccatgcc

SEQ ID NO: 4425 - DNA, 101 bp, Artificial
  Hairpin sequence MM_307, mouse
tctgaattattcacctggaaactgctgaggagcacaaatgtcacaagataaatcaaacctgtgagattggcatctctcagcagcaggatgggtagctaagg

SEQ ID NO: 4426 - DNA, 83 bp, Artificial
  Hairpin sequence MM_309, mouse
gcaatctagaattgattttatattcctggtcaagttgctgaaatgtagcaattgggtcaggaagatcagttccttggacatgt

SEQ ID NO: 4427 - DNA, 118 bp, Artificial
  Hairpin sequence MM_31, mouse
gttgcttatttcccacctgaagcctaatccctgctttgctacaacacaattggttgcggtggaaatgattatgttgtcacaaacagaggattagaacttcgggtggagaataagcagc

SEQ ID NO: 4428 - DNA, 119 bp, Artificial
  Hairpin sequence MM_310, mouse; MQ_from_MM_310, macaque; PT_from_MM_310, chimp
ttgtcataataaaatgcatttcagagaatatgcattttacctttgggaatatgttaatttcaggcagcattccctatgggaaaggtgataccagctctgatatgcaaagcatatgataa

SEQ ID NO: 4429 - DNA, 106 bp, Artificial
  Hairpin sequence MM_315, mouse
agcggcccgagccggtaggccccgaggagggttgtgggcccttctttttgtgaatgaagctccacggaacatccctcctgggggtccccgggagccgcggcccgct

SEQ ID NO: 4430 - DNA, 102 bp, Artificial
  Hairpin sequence MM_317, mouse
ggctcgaaaggtcacacatgtaatgaattgtgggtgcttgcctggcttcccaggcgagaaccgtaagcaattattaaatgccattgtgtgtcaggaagggtt

SEQ ID NO: 4431 - DNA, 119 bp, Artificial
  Hairpin sequence MM_318, mouse
tctgacttgctgttgtccttggagaaatctgggcctgagacagaggagggatgtaatttgagtgctcctttgtcacaggttaccagggtgtgcttgaggggacggtagacaaaaacgga

SEQ ID NO: 4432 - DNA, 93 bp, Artificial
  Hairpin sequence MM_319, mouse
tgatgctgctgatgctggcggtgatgccgatggtgcgagctgaaaatgggctgctacgtcatcgtcgtcatcgttatcatcatcatcagcaca

SEQ ID NO: 4433 - DNA, 110 bp, Artificial
  Hairpin sequence MM_32, mouse
ggagggagggtggaggaggactgttatttaaaaggcttttaaatgatgtcactatatattcttttaacatcctctaaaagcctttgaaaaaacagtctctacctcccttc

SEQ ID NO: 4434 - DNA, 115 bp, Artificial
  Hairpin sequence MM_320, mouse
ctggagagctgcacaaggcaggatacagagctctttaaataatgcccagcatttcctggaccagcatgatatttaaagatttttgttccacctgcctgagaaatatagagtccag

SEQ ID NO: 4435 - DNA, 116 bp, Artificial
  Hairpin sequence MM_322, mouse
taaggaataactgggcaaaggctctcctaaggcaggcagacttcagtgttgcccatttctcagttctctgaagcttgcttacctccaaagggcctttgccatagccctgtaccttg

SEQ ID NO: 4436 - DNA, 114 bp, Artificial
  Hairpin sequence MM_323, mouse
aagatcaaacagcaagaggcactttgtacttctgccaggagaccatatgatatctctcagcgactctcctgcatgccaggaatacggaaccatgcctctcagctgggcctgctt

SEQ ID NO: 4437 - DNA, 84 bp, Artificial
  Hairpin sequence MM_324, mouse
agccctccaggggttaagggggcgggaccagttggttgctatggtgccagactgtttgggtctgctctctgacccttgggggct

SEQ ID NO: 4438 - DNA, 110 bp, Artificial
  Hairpin sequence MM_327, mouse
agatgcacgcatgtcacacagccggattgtccccttgctgctgctgtatacgaaggtgttgcagtggtgggggtggaactcagctgcagtgatcacctctgtgagctcct

SEQ ID NO: 4439 - DNA, 73 bp, Artificial
  Hairpin sequence MM_328, mouse
atgtgatggcccctatgtatgtgcctgtgtgcataagtgcgcgcatgtatatgcgtgtatattttatgcatat

SEQ ID NO: 4440 - DNA, 120 bp, Artificial
  Hairpin sequence MM_329, mouse
ggggtggcccccatctgggaggatgatgtcatctatctccccaaagaaaaggccacactttcctttgtggaagtccatggtgacatcacctcctgatcacatgccatttagctcttcccc

SEQ ID NO: 4441 - DNA, 94 bp, Artificial
  Hairpin sequence MM_33, mouse
cagctggagccggggattaccccctgctgctgacgtgaggacggtgaacaatccggaacgttcggtggaagggggaattcccgtccgttccctg

SEQ ID NO: 4442 - DNA, 107 bp, Artificial
  Hairpin sequence MM_330, mouse
aatactgaagcaaggaattagctctctaaatgccccacgatgactggctgacttgctggtcctctgagggcgatttgaatatctaactcctctcttccatcagtgtt

SEQ ID NO: 4443 - DNA, 108 bp, Artificial
  Hairpin sequence MM_331, mouse; MM_from_MQbrain_68, mouse
cgtggtttggaggtgggcctgacatccctgagtgtatgtggtgaacctgaacttgccctgggtttcctcatatccattcaggagtgtcagctgcctcttcgctcaacg

SEQ ID NO: 4444 - DNA, 115 bp, Artificial
  Hairpin sequence MM_332, mouse
tggagcaaatatccagggtgatggttagggatttggcagcatggccccattaacattagtgggagttagtcagctaaatcccagacatggaacagaatcctgtgtttattcttca

SEQ ID NO: 4445 - DNA, 117 bp, Artificial
  Hairpin sequence MM_333, mouse
gttggcctagtcatcaccctgagccttgcactgagatgggagtggtgtaaggctcaggtatgcacagctcccatctcagaacaaggctcgggtgtgctcagctcccatctcatcagc

SEQ ID NO: 4446 - DNA, 112 bp, Artificial
  Hairpin sequence MM_334, mouse
gccgcttttcctttaactctcagcttctatttaaaaagctaatttgggagcctgtcgatgctcccaattcagacattttaaataggaactgaaagtcaggaactgccagggc

SEQ ID NO: 4447 - DNA, 113 bp, Artificial
  Hairpin sequence MM_335, mouse
ccagattattccaaattttatgggccaaattctgccctcaattatgcacatgcaactaattgcacacatataacagagggcagaatttcgcttttggaactggaagtctttgg

SEQ ID NO: 4448 - DNA, 109 bp, Artificial
  Hairpin sequence MM_336, mouse
caagtgttgttcttaaatcaccttgaagtgtctcttgtcaaagataactccctgcattgtagaaacgtctttgacaagagaggattagggtgaaattgcaattaccttg

SEQ ID NO: 4449 - DNA, 115 bp, Artificial
  Hairpin sequence MM_337, mouse
ggcttcgggaccgagactttgaaaacgaacgagaccgagatctggatgcagatcttgagcgagaagagcgagacccagacttggatttgtttgtttttgacatcttggaagagtt

SEQ ID NO: 4450 - DNA, 78 bp, Artificial
  Hairpin sequence MM_338, mouse
ggcgcctggaggtgatgtcaaagcaggtgatcatcatgagatgggccttgcagaagttgacgcggctctccaagcgct

SEQ ID NO: 4451 - DNA, 95 bp, Artificial
  Hairpin sequence MM_339, mouse
ggccttcttagctgctctaattaggatccccttagtccctcccggtttctccggagaggacagggggctttttaattgaggctattaggagttct

SEQ ID NO: 4452 - DNA, 118 bp, Artificial
  Hairpin sequence MM_34, mouse
ctgtttattccccatttcgagtcataatccccttttgtgacatcacaattagccacttgtggtgatgattataatgtcacaaacgcaggattaggacaaggaatgggaaacaaagcgg

SEQ ID NO: 4453 - DNA, 119 bp, Artificial
  Hairpin sequence MM_340, mouse
tctggcttgctgttgtccttggagaaatctgggcctgagacagaggagggatgtaatttgaatgctcctttgtcacaggttaccagggtgtgcttgaggggacggtagacataaacgga

SEQ ID NO: 4454 - DNA, 100 bp, Artificial
  Hairpin sequence MM_342, mouse
tttggaggctaaatcattgccagtagtttccaagacattccgctaggctaagcaaattgccctaagtggtagtcagaaacgactggcatggtactgtaaa

SEQ ID NO: 4455 - DNA, 107 bp, Artificial
  Hairpin sequence MM_345, mouse
gggtggtggaggtgggtgggctgcctcccaatcctggctcaggcagggtggcctctgatctgggctccggagttgggaaagggagctgacccatggaagacaccccc

SEQ ID NO: 4456 - DNA, 119 bp, Artificial
  Hairpin sequence MM_346, mouse
tctggcttgctcttgtccttggagaaatctgggcctgagacagaggagggatgtaatgtgaatgctcctttgtcacaggttaccagggtgtgcttgaggggacggtagacataaacgga

SEQ ID NO: 4457 - DNA, 116 bp, Artificial
  Hairpin sequence MM_347, mouse
tgagcctgtgagtggccagggtggggctgggtggtgcaggcaggagagccattgatctattgtgggctctactccctgccccagccagagcaccccattggctacccacaggtaca

SEQ ID NO: 4458 - DNA, 109 bp, Artificial
  Hairpin sequence MM_349, mouse
gcaaagaagcggtttggagggctgcattcattttgagtgctgttgtaatcaattttagatacagtattccacaatggatcagtttgcatccaaacctgccttattatgt

SEQ ID NO: 4459 - DNA, 112 bp, Artificial
  Hairpin sequence MM_35, mouse
aggactgtaccagtgggcttggcctggctctgctgggacacttcacacttttgccatttttggccagaaggctctccctgctagccgggctctgttctaattatacatttct

SEQ ID NO: 4460 - DNA, 112 bp, Artificial
  Hairpin sequence MM_351, mouse
aggtgtagtgctgaggcagctgaggccatgctgtctggctcaatgaggccctcaggaacagaggagccaaagccacgggacagggcctcagatgcgatttcaggaatgtcct

SEQ ID NO: 4461 - DNA, 117 bp, Artificial
  Hairpin sequence MM_352, mouse
attgctacactttccacattttcttcgccacagaatgactcctctgagaacaaagtcattgttgacttcaaagaactctgaggaagttcagtggatggaaagaatttggctggcaat

SEQ ID NO: 4462 - DNA, 70 bp, Artificial
  Hairpin sequence MM_353, mouse
taaaagattgaaggatgctgtggcccactgccatgaggcagacaggaacacagctttacgttcaagttta

SEQ ID NO: 4463 - DNA, 81 bp, Artificial
  Hairpin sequence MM_354, mouse
aggaattaatgaccagctgaggttaatgagtccccactcagctccgggccatcaactctcccagctggccattaatcccct

SEQ ID NO: 4464 - DNA, 116 bp, Artificial
  Hairpin sequence MM_355, mouse
tcctttggcaagggagggtatggtgaggatggtggtcttggaggcggacatttatccaacagaatgctactattagacaggccgtttttacctagattcctttaaaaataacagga

SEQ ID NO: 4465 - DNA, 100 bp, Artificial
  Hairpin sequence MM_356, mouse
ggcatttcaggagattaatggtagaccgaagctaatagcctttggctgactctccagccatcagcttttcccagctgctcattaattcccagaaaatgtc

SEQ ID NO: 4466 - DNA, 118 bp, Artificial
  Hairpin sequence MM_358, mouse
tggaacaggaatgctttgcttggccttctgggagttgtagttctagaggcacccgggttgcctggctggccccggaactgtggactacagctcccaggccttctctaagcccttacca

SEQ ID NO: 4467 - DNA, 108 bp, Artificial
  Hairpin sequence MM_359, mouse
tcaacacaatctgaatcttggaggcaggtgctcacatgtcctcctccatgcttataaatacatggaggaggccatagtggcaactgtcaccatgattgatttcgttgg

SEQ ID NO: 4468 - DNA, 117 bp, Artificial
  Hairpin sequence MM_36, mouse
aaagcttaattgtatgaggttttacagctcagaggggattaggacaagagatgtgtttaaaatacgatgtgtctctctgtctctctgcagctgatggagcagttaaaattcagcttt

SEQ ID NO: 4469 - DNA, 114 bp, Artificial
  Hairpin sequence MM_360, mouse
agctttgggaccgagactttgaaagcaaacgagaccgagatctggatgcagatcttgagcgagaagagcgagacccagacttggtttgtttgtttttgacatcttggaagagtt

SEQ ID NO: 4470 - DNA, 119 bp, Artificial
  Hairpin sequence MM_361, mouse
tttcttacctcagtgtaacccatgctggctgcagcaatgagggcctgctggatggcgtggctcttcttaaacactccttgctgctggccagccattgtccagtcacactgaatcagaaa

SEQ ID NO: 4471 - DNA, 94 bp, Artificial
  Hairpin sequence MM_362, mouse; MM_from_HS_285, mouse; MM_from_HSbrain_932, mouse
gccaccttctgtgcccccagcaccacgtgtctgggccacgtgagcaacgccacgtgggcctgacgtggagctggggccgcaggggtctgatggc

SEQ ID NO: 4472 - DNA, 106 bp, Artificial
  Hairpin sequence MM_37, mouse
tttgcagcatctctccatatgctgtggcatctgtaactggcatgtaagggactcattttcctcacatatctcattaaagatgcaaagcaaaatggagggcttcaag

SEQ ID NO: 4473 - DNA, 115 bp, Artificial
  Hairpin sequence MM_38, mouse
tctaagcttttcaagtagtcaaattctggctcatggctctggaaggtgctgtaaacattgtattctcctctgctatgagactggattttgttctacaacagaaaaaaatattgga

SEQ ID NO: 4474 - DNA, 72 bp, Artificial
  Hairpin sequence MM_40, mouse
gcgcgcgagagtctagtggcgctggtcagcacctcggacagggactcgggcgccaacgggcaggtgcgctgc

SEQ ID NO: 4475 - DNA, 109 bp, Artificial
  Hairpin sequence MM_41, mouse
ggttatcactcaaacgctgtgactcaaactcggggaaattgttcctgtaatggagttctcaatttattggtcaatttcaccttgattttgtgtcactgttggttttgct

SEQ ID NO: 4476 - DNA, 118 bp, Artificial
  Hairpin sequence MM_43, mouse
gtgtaaaaggcagaaataatcatgtaatcatcttgtaattatatggtacttactatgcaattacatagtaaacacattgtaaattcaaaataattacatggttatttgcattatgcat

SEQ ID NO: 4477 - DNA, 115 bp, Artificial
  Hairpin sequence MM_44, mouse
agcagagggcattttctgcagattaataattagctagaaggagttgatggtccttggctaaaacgtgggtcattaactccagccagtcattaattgcctggaaatgtcctgggct

SEQ ID NO: 4478 - DNA, 88 bp, Artificial
  Hairpin sequence MM_45, mouse
gaggtgggggaggcgggctgtgctggtgcccggtgtataatcgggttaatccagtagacaaagaataaaccaatagccctcccacctc

SEQ ID NO: 4479 - DNA, 106 bp, Artificial
  Hairpin sequence MM_46, mouse
ctcagcaatgtggagaagcctagggcttgccctggctctctgtctcctcccctatggaggagcagagagccaaggccaaagctctgcttgttacaaagccccggag

SEQ ID NO: 4480 - DNA, 116 bp, Artificial
  Hairpin sequence MM_47, mouse
gagatgctgtagtggtcatcgttgttcaaagtgttgtgttcggggcccttccaggtgattgaggccttggggcggccacagacacgacatctaaaaacaacggtctcccctgtctc

SEQ ID NO: 4481 - DNA, 116 bp, Artificial
  Hairpin sequence MM_49, mouse
tctcccccgcccctggcagcaagctgcgcttcggaaactgttgactcagagggtggcctggcggccagcgtctgatgtcagcctggagcccggccgcgccggggaagccaaggaga

SEQ ID NO: 4482 - DNA, 119 bp, Artificial
  Hairpin sequence MM_5, mouse
gcctttccctttaagcttaggccagccgcgtcgccgcttcatgaatggaacccacgtgaccaaacatcatgtgacgtctgaggagcggcggcggcggcggattctgagcccggtccggc

SEQ ID NO: 4483 - DNA, 117 bp, Artificial
  Hairpin sequence MM_50, mouse
cggctctaggtgaatggggtaaaacccaggaggcatggaagctgccttggccctggagaagaacctgaaccaggccctcttggatctgcatgccctgggttctgcccgcgcagaccg

SEQ ID NO: 4484 - DNA, 78 bp, Artificial
  Hairpin sequence MM_51, mouse
agaaatggagatactcagtccatgttttcccaggtgggaaacaacagagcctgggacaattgctgtggtcaccagtct

SEQ ID NO: 4485 - DNA, 111 bp, Artificial
  Hairpin sequence MM_52, mouse
gatggaagacaggatagggtccttaaaataaactctctggtttccttcctttctttatctaaggggaggctaaagtgggtttgcacaaagggctcttcgtgttggctgctc

SEQ ID NO: 4486 - DNA, 101 bp, Artificial
  Hairpin sequence MM_53, mouse
cagtgattgttgctatgggagacagtgtgggtttgtgacacaagaaaaattctcttgctgttgcaaaagtggatccagactgtcccaatggatgtcttctg

SEQ ID NO: 4487 - DNA, 95 bp, Artificial
  Hairpin sequence MM_55, mouse
gggtccttattccgcatttgctccagtggacactggtgcgcacccacttcaagatacactgggctagtgtcagtctccaaggagcgcgtgcggcc

SEQ ID NO: 4488 - DNA, 114 bp, Artificial
  Hairpin sequence MM_56, mouse
gctgtggtagtagattgtattcactgtgatcctcagttatagtggtcactgtgtggtcagtgtggtcacttgtagtgtccactgtgatggtcactcagagtaattccttccagt

SEQ ID NO: 4489 - DNA, 89 bp, Artificial
  Hairpin sequence MM_57, mouse
ttcaagtgcggtggatttacacttcaaaaagtcaggcgcgacttcataattgaattgcacctgatcttttcaagtgccaggcaccggag

SEQ ID NO: 4490 - DNA, 82 bp, Artificial
  Hairpin sequence MM_59, mouse
ggcagtctggaggcttctcactgtaggagggctgacagcatgggacctcctgtctactagcctgcagtgaccttccatggcc

SEQ ID NO: 4491 - DNA, 116 bp, Artificial
  Hairpin sequence MM_6, mouse
tagacttggcatttcctggggattaatgaatggctgggtggagttaattgcctaaagtatagtctcaggccattaacctcagttggtcactaatctcaaggaatttcttttaactg

SEQ ID NO: 4492 - DNA, 111 bp, Artificial
  Hairpin sequence MM_60, mouse
tagttggagggtgatccgggtctgatgtccccatgccatgagggacatggtgagtccagtgtccctcttgatggcacttttggacatggccagggtggcctgtgggtatta

SEQ ID NO: 4493 - DNA, 106 bp, Artificial
  Hairpin sequence MM_65, mouse
ggccggagcagccggcttcatttgtgatccgggagcctggtgccagcaagacctggaatttccggtctggttggtcttgggccccgtggagccaggttgatacccc

SEQ ID NO: 4494 - DNA, 88 bp, Artificial
  Hairpin sequence MM_67, mouse
ggcgggggttcctggctgacctcactcctgtactgtttgtttgcgggcttgtagggggagaggaggacattttggaatcctttgtgtc

SEQ ID NO: 4495 - DNA, 81 bp, Artificial
  Hairpin sequence MM_7, mouse
ttccacagtgggaaggcatttatgttaatagtatactatcaggacatattttttcttattttatgtgttcctgtggtggaa

SEQ ID NO: 4496 - DNA, 110 bp, Artificial
  Hairpin sequence MM_70, mouse
taattgggtcaggatgctttgttgtctggattctcagttgcttgtattggcttttgaaaaggtcattatgagaaaagggatctgaatagcaaaaggattccagctggtta

SEQ ID NO: 4497 - DNA, 93 bp, Artificial
  Hairpin sequence MM_71, mouse
tggccagtaggtactgatttatgaaaagctgtaaaagatcaggtggaactccgtaggacatcgtttacagctgcatggattgaaacctatcta

SEQ ID NO: 4498 - DNA, 109 bp, Artificial
  Hairpin sequence MM_72, mouse
gtgatttattgagctgtaattccactgagggtttctagtgactccagcttcacacttgtggttatagtattcccagaacccctcggtggagtgatttcctgaagtgcac

SEQ ID NO: 4499 - DNA, 102 bp, Artificial
  Hairpin sequence MM_74, mouse
tgccagtatttcctgaggattaatgatcaactggaagagcctgtggtcttagggccattaactccgggtggtcattaattctgttggaaatatcttacagca

SEQ ID NO: 4500 - DNA, 114 bp, Artificial
  Hairpin sequence MM_8, mouse
ttagagccactgtaacaacgttttccttctgactgattacattacatattgctattagtgagcatcagagtgtagtgcaatcagtcaggggaaaatgagtgaaatgtgaactaa

SEQ ID NO: 4501 - DNA, 83 bp, Artificial
  Hairpin sequence MM_80, mouse
tctggaatttctattgctcaatgggaggctgatgggggagctgatctggaaagagcctccaaaaagaaataatgagttccaga

SEQ ID NO: 4502 - DNA, 106 bp, Artificial
  Hairpin sequence MM_81, mouse
agcatctgtccggaatatggttggttggtcctgagcatgttagaggaattcctgttcagcatgacatgctcagaggccacttggccagagatgagctgggagggct

SEQ ID NO: 4503 - DNA, 64 bp, Artificial
  Hairpin sequence MM_82, mouse
ccatgaggcccagatgctaagcactggaagatatttcttccaatagcagcatctggcatgctgg

SEQ ID NO: 4504 - DNA, 119 bp, Artificial
  Hairpin sequence MM_83, mouse
tggaatctgagttggtgccctgataaagccggagccctggcagataaatgctgaggtggagccaagccatttatttgaggagcagcagggctcctatcagggcgccggctctacttcca

SEQ ID NO: 4505 - DNA, 110 bp, Artificial
  Hairpin sequence MM_85, mouse
cgaaagctatcgaatttgtggcttttgctagctttgcagaaagggacttttaaaaatacttctcttgatagtgtaaaactagcgaaagccacaaatggaatgggtttttg

SEQ ID NO: 4506 - DNA, 119 bp, Artificial
  Hairpin sequence MM_87, mouse
ctggcaaccttcacagcttggcactggaaattttatttgaatcaggggagaatattatttgcgatattttcctaaatgacaaatgaatgatttaccggcagcaatgtgttgaggaacgg

SEQ ID NO: 4507 - DNA, 115 bp, Artificial
  Hairpin sequence MM_89, mouse
aggcggggcaccagctccgtcagctccagccccaggtcctgcgcgatgcggcccacaaaggtgccgtgtttggcctcctctgggacggagtagcggagctggccactcccagctt

SEQ ID NO: 4508 - DNA, 118 bp, Artificial
  Hairpin sequence MM_9, mouse
gtcagaaggtatattagcatgttaataggtctttgtgcccaaaggctttggattataaattatcaagactgcattagccagatgggcaggattaattagcatgctagcattacctggc

SEQ ID NO: 4509 - DNA, 114 bp, Artificial
  Hairpin sequence MM_90, mouse
ggcggggcaccagctccgtcagctccagccccaggtcctgcgcgatgcggcccacgaaggtgccgtgtttggcctcctctgggacggagtagcggagctggccactcccaggct

SEQ ID NO: 4510 - DNA, 108 bp, Artificial
  Hairpin sequence MM_91, mouse
ttgccctgacctctacctccactgactccctcttctccccctccatcagccaatgctgaggccttgaaggagatgctaggggacagtgaaggagaagggacggtgcag

SEQ ID NO: 4511 - DNA, 84 bp, Artificial
  Hairpin sequence MM_92, mouse
tacttgaaaggagtgtttgtaggttctagtaaagctttgtgacggagtattgcagggcctgcagacacattctcctcagaagtg

SEQ ID NO: 4512 - DNA, 113 bp, Artificial
  Hairpin sequence MM_93, mouse
cggtatgcagggtggctggggtcatacatctgtgggtaaggataagcatgcaagtattgtatgtaggactggtgctgactcatgggtgaggacacggccactcgtgtcccccg

SEQ ID NO: 4513 - DNA, 65 bp, Artificial
  Hairpin sequence MM_94, mouse
gccatagtttaggatttcatgctgatctggctgacacagttcagatcagcttgacctaccacggc

SEQ ID NO: 4514 - DNA, 73 bp, Artificial
  Hairpin sequence MM_95, mouse
tccctgttgaagtcagtccagttttcccaggagactccagtctggcttgagaaattggtgttaaaaacaggga

SEQ ID NO: 4515 - DNA, 117 bp, Artificial
  Hairpin sequence MM_96, mouse
cccttcccctcgtctggcctggctggcggcgctggctctgggcctcagacactctggaatcgccaaggtctgagctcagggcctggcccccttcccaggctaacagccggagaaggg

SEQ ID NO: 4516 - DNA, 101 bp, Artificial
  Hairpin sequence MM_97, mouse
gagagtgttccagccctgagccaccctcccaggagccccacagatccagtcttgactgtcccaatggggcagggaggaaaggtggccgctgggattttttt

SEQ ID NO: 4517 - DNA, 111 bp, Artificial
  Hairpin sequence MM_98, mouse
ggggtgctgtaaagcctttactgccacttgttaaggaagacctgtatagctcactcgtgagtaataaggcggtcaacccaaactcaggcactaaaaattttatagcacccc

SEQ ID NO: 4518 - DNA, 73 bp, Artificial
  Hairpin sequence MM_from_HS_103, mouse
ccaggcctgatggcccagatggctaccaccgcggccggtgtggctgtgggctctgcagtggggcacaccctgg

SEQ ID NO: 4519 - DNA, 61 bp, Artificial
  Hairpin sequence MM_from_HS_117, mouse
cgggcggagggggcggccccgaggtgcaatcgcaccaagaggctgcctccggggagctccg

SEQ ID NO: 4520 - DNA, 74 bp, Artificial
  Hairpin sequence MM_from_HS_120, mouse
ggggctcttattgcctacgccggttcgggagcctccacgcggagaggctcccgccgcctagagctgcggcctcc

SEQ ID NO: 4521 - DNA, 84 bp, Artificial
  Hairpin sequence MM_from_HS_123, mouse
ggtgcggtgcagccgcggatggatgctgcgggaaggggctgccatttgctgcccctgccagcggcgcgcggacctgcccgcgct

SEQ ID NO: 4522 - DNA, 91 bp, Artificial
  Hairpin sequence MM_from_HS_125, mouse; MM_from_HSbrain_1431, mouse
acacctccatgggctggagaggagtggggtgacaagggaagactgggatgggtgctctgacccttgaccctccagcccagggagaaagtgt

SEQ ID NO: 4523 - DNA, 86 bp, Artificial
  Hairpin sequence MM_from_HS_141, mouse; MM_from_HSbrain_1419, mouse
cccaactctgggaaggtgccattccgagggccaagagtctgaatatgagtcactctggctgctatggccccctcccagggcttggg

SEQ ID NO: 4524 - DNA, 55 bp, Artificial
  Hairpin sequence MM_from_HS_143, mouse
gggcgcgaagctgctcccgtggggcgacctcagccgcggcggctctttatcgccc

SEQ ID NO: 4525 - DNA, 103 bp, Artificial
  Hairpin sequence MM_from_HS_147, mouse
gtgcgggcgagtgcgcttgcagcgcggtgctgggcggccggtggcgcgcgctcttctggtgcgcgcgcaggccggccagctgcgagtaggcgctctggcacac

SEQ ID NO: 4526 - DNA, 76 bp, Artificial
  Hairpin sequence MM_from_HS_152, mouse
ggccagcgcgtataaaggggcgcagcgggctgggcgttccacaggccgagtgcgctgtgctcgaggggtgccggct

SEQ ID NO: 4527 - DNA, 66 bp, Artificial
  Hairpin sequence MM_from_HS_153, mouse
cctggctgccttgtgttgtgctctggtctaggtaatgaccagaaatctcactggcgggcaggcagg

SEQ ID NO: 4528 - DNA, 92 bp, Artificial
  Hairpin sequence MM_from_HS_165, mouse
ccatcgccgccactaccaggagcgctggcggctggagtacctcatggagctggacggctgccgacgcggcctggtgtgcatggtgtgcgggg

SEQ ID NO: 4529 - DNA, 99 bp, Artificial
  Hairpin sequence MM_from_HS_168, mouse
ttctccaggccacagaactgtccttgagggccccctgccttggacatagctttgaagaccagcagggggatttgaggaggtggatgaaggaaaagagaa

SEQ ID NO: 4530 - DNA, 112 bp, Artificial
  Hairpin sequence MM_from_HS_172, mouse; MM_from_HSbrain_1417, mouse
gagagatgaggggttaagagttcattcggctgtccagatgtacccaagtaccctgttatttggcaatacatacatctgggcaactgattgaacttttcgcttctcttgactc

SEQ ID NO: 4531 - DNA, 92 bp, Artificial
  Hairpin sequence MM_from_HS_176, mouse
gagtgtttcttcctgcgtcccaggcttcccagcggcgcccgttgccggggaacgcaggcgccgtgggaagggatggcgggagcgtacagctt

SEQ ID NO: 4532 - DNA, 99 bp, Artificial
  Hairpin sequence MM_from_HS_185, mouse; MM_from_HSbrain_1420, mouse
gaggagagccgggcagttcggagggaaggaccggtgcgagtcaggcggcccttgaggctccgctcgcccaccttccactcttctctctctctctccctc

SEQ ID NO: 4533 - DNA, 101 bp, Artificial
  Hairpin sequence MM_from_HS_191, mouse; MM_from_HSbrain_1422, mouse
tccatgggtcagctatgtggactctagctgccaaaggcgcttctccttctgaacagagcgctttgctcagccagtgtagacatggcctgataaacactgga

SEQ ID NO: 4534 - DNA, 103 bp, Artificial
  Hairpin sequence MM_from_HS_192, mouse; MM_from_PT_7, mouse
agactaatatacctgcatgctagtcttcaggttctgatggaagtgacatgcgtgatgctgtcatgtgttactgtcaggactcgactggtgtgcggacacgtct

SEQ ID NO: 4535 - DNA, 117 bp, Artificial
  Hairpin sequence MM_from_HS_202, mouse
atttaagaagggacatggctttgacagataaagcaggcatttgataaattgaaacaggttctgaattattttgttgggaatgtgcactacatctgtctgctgatttcctactgaagt

SEQ ID NO: 4536 - DNA, 114 bp, Artificial
  Hairpin sequence MM_from_HS_204, mouse
cctccgtggtatctgggtaggagagctatataatcctggaataacaggaagcttcccatatttcacatcctgttgttctggggtttgtgacttgctgccttgccataatgaagg

SEQ ID NO: 4537 - DNA, 74 bp, Artificial
  Hairpin sequence MM_from_HS_206, mouse
gcccggaagctggcagagcaggagctgttggattcgaatgagagggtccagctgctgcacacccaggtgagggc

SEQ ID NO: 4538 - DNA, 82 bp, Artificial
  Hairpin sequence MM_from_HS_208, mouse
gccatcttctgagttcctgggtatcactggagagccttacactttcctacaatggtgagcacctgaaggaacagggctgggc

SEQ ID NO: 4539 - DNA, 80 bp, Artificial
  Hairpin sequence MM_from_HS_210, mouse
gggtctccttgaggggcctctgcctctatccaggattatgtttttatgaccaggaggctgaggtcccttacaggcggcct

SEQ ID NO: 4540 - DNA, 102 bp, Artificial
  Hairpin sequence MM_from_HS_216, mouse
actcttgccaaaatcagagaagggattctgatgttggtcacactccaagagttttaaaatgagtggcgaacacagaatccatactctgcttatggcctaagt

SEQ ID NO: 4541 - DNA, 101 bp, Artificial
  Hairpin sequence MM_from_HS_231, mouse
ggggtaaatgtagagagtgtcaatcaaaggcagagctctcagagctgggaaggaggctctagatggcggctgtgccttagagagagcgcgctttgctccct

SEQ ID NO: 4542 - DNA, 70 bp, Artificial
  Hairpin sequence MM_from_HS_25, mouse
ccgcctctggtcccgctcctcctccctcccgcctggaaacccggaagtggaggaggaggaggcgcggcgg

SEQ ID NO: 4543 - DNA, 118 bp, Artificial
  Hairpin sequence MM_from_HS_251, mouse
cctttggaaataaactccagagtttctttgaaggttggagaaagtacagaatctggaacagtaatattctgtgatgttttaccaggaaaagagagtctaggatattttgttggtgtgg

SEQ ID NO: 4544 - DNA, 90 bp, Artificial
  Hairpin sequence MM_from_HS_252, mouse
ggcctcatgtgacatgcatgtggcttgccctaacctccagatcccactctgggatgtaaggaagccccatgcagctactgactcagggcc

SEQ ID NO: 4545 - DNA, 78 bp, Artificial
  Hairpin sequence MM_from_HS_258, mouse
cgctttggccatggaacgcgacggctccagtggaggggtgatccgcttggcagccattcaggagtcaggggtagagcg

SEQ ID NO: 4546 - DNA, 112 bp, Artificial
  Hairpin sequence MM_from_HS_262, mouse; MM_from_HSbrain_1406, mouse
tggaacctttctgaaagaggctggggcaggcagtgactgttcagatgtccagtttctttgggacacttctccagcgctgccttccctacctctgcctttggaatgagtctca

SEQ ID NO: 4547 - DNA, 93 bp, Artificial
  Hairpin sequence MM_from_HS_267, mouse
ccgcgctccgggcctgcggccgctgtcggttcccccagtcaccgagcgagagggaagaaacaagatggcggctgcaggcgatccggagcgggg

SEQ ID NO: 4548 - DNA, 61 bp, Artificial
  Hairpin sequence MM_from_HS_274, mouse
tgcggcccggaggtgaggggaagcgggcaggctcaggcctcctccccgcgcccggaccgca

SEQ ID NO: 4549 - DNA, 104 bp, Artificial
  Hairpin sequence MM_from_HS_281, mouse
tagaatccatataggtttttactcatgcaccatggttgtctgagcacataacatgcttgtctgctcataccctatggttcctgaagaggaatcttaactgtcta

SEQ ID NO: 4550 - DNA, 117 bp, Artificial
  Hairpin sequence MM_from_HS_284, mouse
gctaggaggaggaggtggaggccggagggaacccgcgctcggggcggcggctggaggtaacctcaagggccgagcccgaaaggcgggccgcgtcggtctgggcgccccctcggaggc

SEQ ID NO: 4551 - DNA, 71 bp, Artificial
  Hairpin sequence MM_from_HS_303, mouse; MM_from_HSbrain_1408, mouse
gtctccaccacctcccctgcaaacgtccagtgatgcagaggtaatggacgttggctctggtggtgatggac

SEQ ID NO: 4552 - DNA, 101 bp, Artificial
  Hairpin sequence MM_from_HS_305, mouse; MM_from_HSbrain_1425, mouse
gagcagccagcgaccctgcagagcggagaatgggagtagagcagagtgtctgaacagcacgctcacccatctcctctccgcctcgctctcctgacctgttc

SEQ ID NO: 4553 - DNA, 87 bp, Artificial
  Hairpin sequence MM_from_HS_307, mouse; MM_from_HSbrain_1415, mouse
ctgtcacgtgctatggatttctctgtgaatcactatatcaaatctagtgtggtagtggtttacaaagtaattcatagtgcttcacag

SEQ ID NO: 4554 - DNA, 76 bp, Artificial
  Hairpin sequence MM_from_HS_54, mouse
gcagttgctgggaaggaagggagacgcctcaaccgtggcaccgcccggtttgagcgggaccagacctcccgactgt

SEQ ID NO: 4555 - DNA, 72 bp, Artificial
  Hairpin sequence MM_from_HS_68, mouse
gccacagctagctgtgcagctgcctgggaagccacactcacttccccagcactcacactcctctggcttggc

SEQ ID NO: 4556 - DNA, 98 bp, Artificial
  Hairpin sequence MM_from_HS_78, mouse
ggcggcggcgtctgaggagcggatggctgaggaaggaggcggcggccacggcgacggcggctcctgttcggctgccggctccgctcagcgacagcccc

SEQ ID NO: 4557 - DNA, 97 bp, Artificial
  Hairpin sequence MM_from_HS_85, mouse
gtgtgggtgtgtcaggcaggcagtgcattgctagctggctgttagaactttatcccaacagttgctagctgcactaccctctgctgcactcagaagc

SEQ ID NO: 4558 - DNA, 76 bp, Artificial
  Hairpin sequence MM_from_HSbrain_1, mouse
gccataacactctgctagcgcataactggggccgcctgcccttcgcgggcggcccttttaaccgctagctacaggc

SEQ ID NO: 4559 - DNA, 61 bp, Artificial
  Hairpin sequence MM_from_HSbrain_102, mouse
cccatttcaccaagccctctgggctcctgcagaggtcccaggaaccggcggctgggtgggg

SEQ ID NO: 4560 - DNA, 114 bp, Artificial
  Hairpin sequence MM_from_HSbrain_1076, mouse
gtattatagaatccatataggtttttactcatgcaccatggttgtctgagcacataacatgcttgtctgctcataccctatggttcctgaagaggaatcttaactgtctactgc

SEQ ID NO: 4561 - DNA, 62 bp, Artificial
  Hairpin sequence MM_from_HSbrain_113, mouse
gagcgcagctattgcctttgcagagaaagtttgctattttttgcaggcggtagttgaggttt

SEQ ID NO: 4562 - DNA, 95 bp, Artificial
  Hairpin sequence MM_from_HSbrain_126, mouse
gctgagtggctggatctgtggggaggaggctcttgtcatggagaggtgcgatgacgaggctgtagctgagatctgcacagagatgcttcgacagt

SEQ ID NO: 4563 - DNA, 117 bp, Artificial
  Hairpin sequence MM_from_HSbrain_129, mouse
ggagtccacccttcatctggtgttgagacttcgtggtggtgctaagagaaggaagaagtcttacaccactcccaagaagaacaagcataagaggaagaaggttaagttggatgtgct

SEQ ID NO: 4564 - DNA, 102 bp, Artificial
  Hairpin sequence MM_from_HSbrain_13, mouse; MM_from_MQbrain_2441, mouse
cacttcctgggcatggagtcctgtggtatccacgagatcaccttcaactccatcatgaagtgtgatgtggatatccgcaaagacctgtatgccaatacagtg

SEQ ID NO: 4565 - DNA, 93 bp, Artificial
  Hairpin sequence MM_from_HSbrain_132, mouse
ctcaccaagatttgtctccacagctacctggggctgggactgatgtcggcacggctggctatcttgggcggtgtggaggggaaacctggtgag

SEQ ID NO: 4566 - DNA, 83 bp, Artificial
  Hairpin sequence MM_from_HSbrain_1331, mouse
gctcctctcagggaagctttttgctcgcgttatgtttctcatccgaatataagacgaacaaaaggtttgtctgagggctgagt

SEQ ID NO: 4567 - DNA, 86 bp, Artificial
  Hairpin sequence MM_from_HSbrain_135, mouse
gcctgtggcatctttgccttgggtgttggccacagggtcaagggactctggcctcagcccagaagtgaggggaagctatacagagc

SEQ ID NO: 4568 - DNA, 70 bp, Artificial
  Hairpin sequence MM_from_HSbrain_140, mouse
gccgagtgacctggacatgcttctgagggccacctactttgggagcattgttctcctggtgagtgttggc

SEQ ID NO: 4569 - DNA, 89 bp, Artificial
  Hairpin sequence MM_from_HSbrain_146, mouse
aaccctagcgtgctacagggcttgctgcgtatcatcccatacctgtccttcggagaggtggagaagatgcagatcctggtggagcggtt

SEQ ID NO: 4570 - DNA, 70 bp, Artificial
  Hairpin sequence MM_from_HSbrain_160, mouse
gttaggtgcctggaggtggcgcacttggggctaccccgccccaggttcccggtccttaatggtccttaat

SEQ ID NO: 4571 - DNA, 78 bp, Artificial
  Hairpin sequence MM_from_HSbrain_178, mouse
ggtgctggcgtggccgcgctgcagttgcggtggcagaaggcctcgctgtcgcgcagcagacggtgcagccgcaggctc

SEQ ID NO: 4572 - DNA, 60 bp, Artificial
  Hairpin sequence MM_from_HSbrain_182, mouse
tgcaggcctgtgttctttcgccctctagtggaggagaaggtgaaggagcagctggaggca

SEQ ID NO: 4573 - DNA, 97 bp, Artificial
  Hairpin sequence MM_from_HSbrain_187, mouse
agacgctgccactcctggggctgctggtggggccatcgctgctgcagctgcagctgcagctgcaggtggagctgcctcagcctctggggccagtgct

SEQ ID NO: 4574 - DNA, 73 bp, Artificial
  Hairpin sequence MM_from_HSbrain_188, mouse
ggccatcatcttctgtgtcgccttgagcgcttatgacttggtgctggctgaggatgaggagatggtgagagtc

SEQ ID NO: 4575 - DNA, 72 bp, Artificial
  Hairpin sequence MM_from_HSbrain_193, mouse
gctcaaggctaccagcgcgccatgtgcatcagccgcaagaagttggagcacaggtgagtgacagccaggagc

SEQ ID NO: 4576 - DNA, 77 bp, Artificial
  Hairpin sequence MM_from_HSbrain_204, mouse
tgtgggtcagcaggggggaagcatcccatttctgggaattgtgcagaagggaagggcagcccctggaatgcagagca

SEQ ID NO: 4577 - DNA, 71 bp, Artificial
  Hairpin sequence MM_from_HSbrain_211, mouse
gcactggattgcaaagactggggtggacctctttcttaatgtccagtgtcctatgtcataagattcggtgc

SEQ ID NO: 4578 - DNA, 79 bp, Artificial
  Hairpin sequence MM_from_HSbrain_223, mouse; MM_from_PT_176, mouse
aggggtagagcagttctcagcggcccgcggggcgggcggcagtgtccagcccggggctgcgcgagacacaaagtcctct

SEQ ID NO: 4579 - DNA, 62 bp, Artificial
  Hairpin sequence MM_from_HSbrain_226, mouse
gcttccctctcttggccctcaggtctggttccagaaccgcaggaccaagtggagaaagaagc

SEQ ID NO: 4580 - DNA, 118 bp, Artificial
  Hairpin sequence MM_from_HSbrain_227, mouse
cttctccagtggcttcctaaaggtgtgtggtggcaaagtcctcgagctcttccagcctgcagaactgagggccatgatggtggggaacagcaactatgactgggaagagctggaagag

SEQ ID NO: 4581 - DNA, 92 bp, Artificial
  Hairpin sequence MM_from_HSbrain_232, mouse
tcactggagggattcctggagaagctgcagtgtggggatgctctgaccgagttcagcccccagtgtctttcctcctcctcctcctgcagcga

SEQ ID NO: 4582 - DNA, 97 bp, Artificial
  Hairpin sequence MM_from_HSbrain_24, mouse
gctgcgtttgcccagtttggttctgatttggacgctgccactcaacagctcttgagtcgtggtgtgcgtctgaccgagttgctaaagcaaggacagt

SEQ ID NO: 4583 - DNA, 73 bp, Artificial
  Hairpin sequence MM_from_HSbrain_244, mouse
gagggcctcctggtccagggcccgaccgcgccggacgcggtgtccggggcagggcagggctgagccgggcctc

SEQ ID NO: 4584 - DNA, 86 bp, Artificial
  Hairpin sequence MM_from_HSbrain_250, mouse
cagcctgctatggaggactgagaaggtggagcagttctgtaccgtgctgccttccattggttaagacctccaacagtaaagggctg

SEQ ID NO: 4585 - DNA, 113 bp, Artificial
  Hairpin sequence MM_from_HSbrain_251, mouse
ggcaccagggtatgatggtgggtatgggtcagagggactcttatgtgggcgacgaggcccaaagcaagagaggcttcctgaccctgaagtaccccattgaacatggcattgtc

SEQ ID NO: 4586 - DNA, 90 bp, Artificial
  Hairpin sequence MM_from_HSbrain_252, mouse; MM_from_HSbrain_311, mouse; MM_from_HSbrain_490, mouse; MM_from_HSbrain_631, mouse; MM_from_MQbrain_2669, mouse
gtggatcggtggctccatcctggcctcactgtccaccttccagcagatgtggatcagcaagcaggagtacgatgagtccggcccctccat

SEQ ID NO: 4587 - DNA, 91 bp, Artificial
  Hairpin sequence MM_from_HSbrain_257, mouse
gggcagctgggcagggcggggtgtcctggagagccacggatgggcctcacacccaggctgggccaggacacccagtccttggctgaggccc

SEQ ID NO: 4588 - DNA, 94 bp, Artificial
  Hairpin sequence MM_from_HSbrain_267, mouse
ccctgaactcattttttttctctcccatgccaggtacctgtgggtgccaacccagtccaggtggaaatgggagaatttgaggacggtgcagagg

SEQ ID NO: 4589 - DNA, 77 bp, Artificial
  Hairpin sequence MM_from_HSbrain_270, mouse
ccggggctgggtggctcaccctaagcttgctctgacaaaagagttttgagttggttttttggctgagcctgccaagg

SEQ ID NO: 4590 - DNA, 63 bp, Artificial
  Hairpin sequence MM_from_HSbrain_279, mouse
ccccggtggggtggccgctgcctcttctgctggtgatggcggctggggtggctccggtgtggg

SEQ ID NO: 4591 - DNA, 67 bp, Artificial
  Hairpin sequence MM_from_HSbrain_28, mouse
ccagccggagtccaggtccctactgggccccagacagtgatgagccctggcctggcacccatgctgg

SEQ ID NO: 4592 - DNA, 83 bp, Artificial
  Hairpin sequence MM_from_HSbrain_293, mouse
tggacctgcggctccatcctacctcactgtccaccttccagcagatgtggatcagcaagcaggagtatgatgagtcgggccca

SEQ ID NO: 4593 - DNA, 88 bp, Artificial
  Hairpin sequence MM_from_HSbrain_296, mouse
tgcctgtctagcagtgagcactcggcagctttggtgttagagctgggaagaaaggctgccggccacagtgtttgctttttgacagaca

SEQ ID NO: 4594 - DNA, 111 bp, Artificial
  Hairpin sequence MM_from_HSbrain_297, mouse
agtccacccttcatctggtgttgagacttcgtggtggtgctaagagaaggaagaagtcttacaccactcccaagaagaacaaagcataagaggaagaaggttaagttggct

SEQ ID NO: 4595 - DNA, 106 bp, Artificial
  Hairpin sequence MM_from_HSbrain_303, mouse
atccactggtgctaccaaggctgtgggcaaggtcatcccagagctgaacgggaagctcactggcatggccttccgtgttcctacccccaatgtgtccgccgtggat

SEQ ID NO: 4596 - DNA, 110 bp, Artificial
  Hairpin sequence MM_from_HSbrain_312, mouse
ctgcttttcttgtccaatttcttctctccagttgctggggcttccagacgcagatgacgacgcgtttgaagagtacagtgcggatgtggaggaggaggagccagaggcgg

SEQ ID NO: 4597 - DNA, 61 bp, Artificial
  Hairpin sequence MM_from_HSbrain_332, mouse
cctcggcgcccaggagctgcggcacgacgccggcccgggtcgcagcctcctcgggccctgg

SEQ ID NO: 4598 - DNA, 113 bp, Artificial
  Hairpin sequence MM_from_HSbrain_340, mouse; MM_from_HSbrain_589, mouse; MM_from_HSbrain_88, mouse
agtccacccttcatcttgtgttgagccttcttggtggtgctaagaaaagaaagaagaagtcttacaccactcccaagaagaataagcataagaggaagaaggttaagttggct

SEQ ID NO: 4599 - DNA, 81 bp, Artificial
  Hairpin sequence MM_from_HSbrain_345, mouse
gtgggatctggttctgtagctgagagcacatcgctaaacgcagatgtgcagtctgaggcttcagataccacggtaagccgc

SEQ ID NO: 4600 - DNA, 102 bp, Artificial
  Hairpin sequence MM_from_HSbrain_347, mouse
agggcaggagggtgggacgtgatgtgtggcttaggtttggggacctggctttctctcccctctccctgctccctccactttgtccactaccccctcctccct

SEQ ID NO: 4601 - DNA, 95 bp, Artificial
  Hairpin sequence MM_from_HSbrain_350, mouse
cctattggctgcctttgatcagtggagggagtgggctgacagcaagtcctgctgtgactattcgctgcacgtggacatcactgagtggcacaagg

SEQ ID NO: 4602 - DNA, 92 bp, Artificial
  Hairpin sequence MM_from_HSbrain_352, mouse
ccatgtgaagctgtctctggctgtgggctgactagaggacacctggtggccaggccagccctttgtcagtcatccgggtcggggcagcatgg

SEQ ID NO: 4603 - DNA, 102 bp, Artificial
  Hairpin sequence MM_from_HSbrain_362, mouse
gtcctgttctgcctgctgctctacttctacaaggagaggaacgccaacagcatcgttgtgattctcctcctggtggccctgcttggtaagcagtgtctggac

SEQ ID NO: 4604 - DNA, 73 bp, Artificial
  Hairpin sequence MM_from_HSbrain_366, mouse
cggctgaccgtggatgaggctgtgcggaagggcctggtaggccccgagctgcatgaccgcctcctctctgccg

SEQ ID NO: 4605 - DNA, 67 bp, Artificial
  Hairpin sequence MM_from_HSbrain_372, mouse
tttagctggagtggggggcagaagccccaggagcaggggtgttagccgagccccattctaagtcggg

SEQ ID NO: 4606 - DNA, 95 bp, Artificial
  Hairpin sequence MM_from_HSbrain_377, mouse
ggatacaatgggctagaaaaaccctgtgatttatgcatgggagctgtttcttctcagcagctgccatagcccggtcattggtacattgttcttcc

SEQ ID NO: 4607 - DNA, 75 bp, Artificial
  Hairpin sequence MM_from_HSbrain_38, mouse
gggactttgtggaggcgccgtcccagatgctggagaactgggtgtgggagaaggagcccctgatgcgcatgtctc

SEQ ID NO: 4608 - DNA, 71 bp, Artificial
  Hairpin sequence MM_from_HSbrain_387, mouse
gggatctcttctttccctggagcatttgttcagccgagaaagctgagcgcctcaaggggaggctgggcccc

SEQ ID NO: 4609 - DNA, 82 bp, Artificial
  Hairpin sequence MM_from_HSbrain_395, mouse
caagaacatgatggctgcctgtgatccaagacatgggcgctacttgactgtggctgccgtgttcaggggccgcatgtctatg

SEQ ID NO: 4610 - DNA, 89 bp, Artificial
  Hairpin sequence MM_from_HSbrain_396, mouse
ggagcgaggccggtcccaggagcggaggcagccctcatcttcctcttcagagaagcagcgcttctattcctgtgaccgctttgggagcc

SEQ ID NO: 4611 - DNA, 104 bp, Artificial
  Hairpin sequence MM_from_HSbrain_409, mouse
catggcttgtatctcttcaaaccaagccatgaccacagctgttggtctgatagcttctggccagtgtgatgtcgtcgtggctggtggtgttgagttaatgtctg

SEQ ID NO: 4612 - DNA, 108 bp, Artificial
  Hairpin sequence MM_from_HSbrain_413, mouse
gatgacccagattcagttgtcatccaggatgtcattgaggatgttgttatagaagatgtccagtgtacagacatcatggacgaagcagatgtatcggaaacagtcatc

SEQ ID NO: 4613 - DNA, 81 bp, Artificial
  Hairpin sequence MM_from_HSbrain_419, mouse
ggcagagcccttggggagaagagaccctgagggaagggcaaggcttttcctttttggctctggttcccagggtcatccgcc

SEQ ID NO: 4614 - DNA, 87 bp, Artificial
  Hairpin sequence MM_from_HSbrain_422, mouse
tggtcatggagtcctgtggcatccacgagaccacctttaactccatcatgaagtgtgatgtggacatccacagaaacctgtatgcca

SEQ ID NO: 4615 - DNA, 83 bp, Artificial
  Hairpin sequence MM_from_HSbrain_425, mouse; MM_from_HSbrain_744, mouse
gtgcctctctccctttgctaggagtaggatgggatgagaaggtagtctctgccctgggttgtcagtggagttaggaggggtgc

SEQ ID NO: 4616 - DNA, 93 bp, Artificial
  Hairpin sequence MM_from_HSbrain_432, mouse; MM_from_PT_282, mouse
atcatttgctgggcatctgttgagtacagccatgtctgttgggcatctacagtcttccaccaggcattgtggtctctgctgactctctgtgat

SEQ ID NO: 4617 - DNA, 73 bp, Artificial
  Hairpin sequence MM_from_HSbrain_433, mouse
ctgcaagcaagtcattgggaccggaagcttcttcccgaaaggggaggacttctactgtgtgacttgccatgag

SEQ ID NO: 4618 - DNA, 101 bp, Artificial
  Hairpin sequence MM_from_HSbrain_439, mouse
ctggaggttgatctgttttgaatttcttttgtgttgtgttcactgagaaaaagtaatgtgagcaaagcagaaggaggtaggaaagtggatccaaaccccag

SEQ ID NO: 4619 - DNA, 94 bp, Artificial
  Hairpin sequence MM_from_HSbrain_446, mouse
caagtgagcacaagaagttggtcagcttgcctatggagtgctggcaataaactctgaacattccacaagcctgagctgaacctaggctcccttg

SEQ ID NO: 4620 - DNA, 105 bp, Artificial
  Hairpin sequence MM_from_HSbrain_447, mouse; MM_from_HSbrain_598, mouse
gtcaagtctgttgaaatgcaccatgaagctttgagtgaagctcttcctggggacaatgtgggcttcaatgtaaagaatgtgtcggtcaaagatgttagacgaggc

SEQ ID NO: 4621 - DNA, 103 bp, Artificial
  Hairpin sequence MM_from_HSbrain_450, mouse
ctggaagatgtagagtgggaggactgggaatgagagaagccagagcaagcagctcccccaccctcggcacatcccacctccctcgctcgctagtctcggccgg

SEQ ID NO: 4622 - DNA, 68 bp, Artificial
  Hairpin sequence MM_from_HSbrain_46, mouse
cagaaggtcatgacccatgtcagcaacggctgccagttgctgctaggggtcaagggacacgccttctg

SEQ ID NO: 4623 - DNA, 63 bp, Artificial
  Hairpin sequence MM_from_HSbrain_460, mouse
ggcagggcaggggcagggtggacagagaccgtgaggtctctgttctctgcctcagattatgtc

SEQ ID NO: 4624 - DNA, 103 bp, Artificial
  Hairpin sequence MM_from_HSbrain_461, mouse
gggctttggctggagctggggtttctggtaggagggactgggggcctgcttggctgagccctgctcctcttttctgtccactccaaagcatcatcaatggctt

SEQ ID NO: 4625 - DNA, 99 bp, Artificial
  Hairpin sequence MM_from_HSbrain_464, mouse
gcctgaaaatgcagcaggtaagcgggcaaagctggactgagcctgtgggtgagactgcggcccagccgagctctctgctcttatctgtttcctacaggc

SEQ ID NO: 4626 - DNA, 85 bp, Artificial
  Hairpin sequence MM_from_HSbrain_466, mouse
gctaactgctacgaggaggtcaaggaccgctgcaccctggcagagaaactaggtggcagcgccgtcatttccctggagggcaagc

SEQ ID NO: 4627 - DNA, 93 bp, Artificial
  Hairpin sequence MM_from_HSbrain_469, mouse
ctgcctggcatccctaaggtctttgtgcctcgtccctcacaggtctccctgaaacctgcagaagaggcacacaagaaagagaggaaaccgcag

SEQ ID NO: 4628 - DNA, 86 bp, Artificial
  Hairpin sequence MM_from_HSbrain_472, mouse
ttccgatcccagctgctcttccccctccccctccagatcctgtacaatgggcagagcgtggaggtggatgggcactcgatgcggaa

SEQ ID NO: 4629 - DNA, 91 bp, Artificial
  Hairpin sequence MM_from_HSbrain_481, mouse; MM_from_HSbrain_540, mouse; MM_from_HSbrain_543, mouse
cagatggtgaaatgtgaccctcgccatggtaaatacatggcttgctgcctgctgtaccgtggtgatgtggttcccaaagatgtcaatgctg

SEQ ID NO: 4630 - DNA, 106 bp, Artificial
  Hairpin sequence MM_from_HSbrain_489, mouse
ggtatcatactgtagcacatctggagttttttcactgtgcattgttccacaaatgccatgcagtgtgccatgagacattagcaccaggaatgtgctgtctgatgtc

SEQ ID NO: 4631 - DNA, 90 bp, Artificial
  Hairpin sequence MM_from_HSbrain_493, mouse
atctatgaaggccaagtggaggtgaatggaggtgaatacaatgtggaaagcattgacggtcagcctggtgccttcacttgctatctggat

SEQ ID NO: 4632 - DNA, 80 bp, Artificial
  Hairpin sequence MM_from_HSbrain_499, mouse
gtgcccggatttggaggtatgcagagtatgcccatggaagtacccatgaatgccatgcagagacctgtaaggccaggcat

SEQ ID NO: 4633 - DNA, 119 bp, Artificial
  Hairpin sequence MM_from_HSbrain_503, mouse
gctgcgtgctgttgcttctggttctgtggccgccgtcgctgtccggcaggctccggtctcggagccgacgaggcgcgcgcgcgcgggtcccagcccttcggaagcccaagcagctcggc

SEQ ID NO: 4634 - DNA, 70 bp, Artificial
  Hairpin sequence MM_from_HSbrain_521, mouse
ggcatcgcgccgcgccctcgagagggacgacttcgagatcgtagtcattctcgagggcatggtggaggcc

SEQ ID NO: 4635 - DNA, 109 bp, Artificial
  Hairpin sequence MM_from_HSbrain_524, mouse
cagaccgtggactgaagcgcgtgggccatcggacttgcctttggaatgaccagctttatttggttgggggttttggtgaggacggcaggacagctagcccacaggtttg

SEQ ID NO: 4636 - DNA, 116 bp, Artificial
  Hairpin sequence MM_from_HSbrain_525, mouse
ggactgggagaaggcctgctgcctgtggctgctggtgtaggggacaggggatggactaaagctgactctgtgtttctcgtgtccttgctcagtagacaggatggcctctcgggtcc

SEQ ID NO: 4637 - DNA, 90 bp, Artificial
  Hairpin sequence MM_from_HSbrain_528, mouse
ggtggtttttttctaataattgggctttccctcttccttgcccaggcgaggaggaggtgactgctgtggatggttatgagacagaccacc

SEQ ID NO: 4638 - DNA, 60 bp, Artificial
  Hairpin sequence MM_from_HSbrain_529, mouse
aagggttttggggaaagctctgggtttagggatctccgtccctcagctcccctgaccctt

SEQ ID NO: 4639 - DNA, 98 bp, Artificial
  Hairpin sequence MM_from_HSbrain_539, mouse; MM_from_HSbrain_542, mouse
tgtggtccctgggggagacctggccaaggtgcagcgggctgtgtgcatgctgagcaataccacggccatcgcagaggcctgggcccgcctggaccaca

SEQ ID NO: 4640 - DNA, 91 bp, Artificial
  Hairpin sequence MM_from_HSbrain_541, mouse; MM_from_HSbrain_544, mouse
ctggccacttatgcccctgtcatctctgctgagaaagcctaccatgagcagctttctgtagcagagatcaccaatgcctgctttgagccag

SEQ ID NO: 4641 - DNA, 91 bp, Artificial
  Hairpin sequence MM_from_HSbrain_545, mouse
ctggccacttatgcccctgtcatctctgctgagaaagcctaccacgagcagctttctgtagcagagatcaccaatgcctgctttgagccag

SEQ ID NO: 4642 - DNA, 91 bp, Artificial
  Hairpin sequence MM_from_HSbrain_546, mouse
cagatggtgaaatgtgaccctcgccatggtaaatacatggcttgctgcctgctataccgtggtgatgtggttcccaaagatgtcaatgctg

SEQ ID NO: 4643 - DNA, 114 bp, Artificial
  Hairpin sequence MM_from_HSbrain_556, mouse
gttgggtggggacctggggttccccatgtacagctgtgtatattcaggggtgttctctgtctggtacccgctgtgggcatctatgtgtgtgtgaaccccttccccatgccctgc

SEQ ID NO: 4644 - DNA, 118 bp, Artificial
  Hairpin sequence MM_from_HSbrain_564, mouse
cctgaaaacatccacttggtattttaaaattgccactttttgtttctttccgaaaagtttgtggagaagtttctgttggggaagaagaaggtgaaggagaaacggggtggattgaagg

SEQ ID NO: 4645 - DNA, 80 bp, Artificial
  Hairpin sequence MM_from_HSbrain_565, mouse
gctgctgcctttcacccaggcctagctgctgcagcctctgccagagccaggtgagccgagggatacagagatgcagcggc

SEQ ID NO: 4646 - DNA, 85 bp, Artificial
  Hairpin sequence MM_from_HSbrain_58, mouse
gctaactgctacgaggaggtcaaggaccactgcaccctggcagagaaactaggtggcagcgcggtcatttccctggagggcaagc

SEQ ID NO: 4647 - DNA, 102 bp, Artificial
  Hairpin sequence MM_from_HSbrain_584, mouse
tctcttcaaatattcaccactcttgttcctcgccaaggttttcctttctagatgaaaaggaggctgggccactggaaggaggtgctgaatagaaagaaaaga

SEQ ID NO: 4648 - DNA, 95 bp, Artificial
  Hairpin sequence MM_from_HSbrain_59, mouse
gaacacctttgtccaggggtgagctttgatctgggggaacttgaactctgtatacttagggttcatctctcggatttgttccctggttggcgttc

SEQ ID NO: 4649 - DNA, 80 bp, Artificial
  Hairpin sequence MM_from_HSbrain_595, mouse
gggcgttcccgctcgcctccttcctcgaccctttttcctatactgggagggttgggcgggggggggggggggggcagccc

SEQ ID NO: 4650 - DNA, 70 bp, Artificial
  Hairpin sequence MM_from_HSbrain_616, mouse
aggacttgaaatacgcgacgctggccacggtgtctcgctgtggcatggtgtggttcagtgaggacgtcct

SEQ ID NO: 4651 - DNA, 65 bp, Artificial
  Hairpin sequence MM_from_HSbrain_617, mouse
gcagaacccctcactgccgccatggtggagttctataccatgtcacaggtacgtgatggctctgc

SEQ ID NO: 4652 - DNA, 94 bp, Artificial
  Hairpin sequence MM_from_HSbrain_62, mouse
gaccccagttctactggaggcccagattcaccaccctccaccttctgcggggacagtggcttctccggatctggctcctatggacgcctgggtc

SEQ ID NO: 4653 - DNA, 90 bp, Artificial
  Hairpin sequence MM_from_HSbrain_644, mouse
ggcaggtctgtgtgcagggcggtcgcagagccggagctgctgctgctaagctcttgggctcggttgagaccgccgtgcttgctccttgct

SEQ ID NO: 4654 - DNA, 114 bp, Artificial
  Hairpin sequence MM_from_HSbrain_645, mouse
ctgagaccttattggctaggaaagaaaagccagtctctcattggttggtatgtgtcacttcatcaaccaataagaggatgccatttatcctttcctgactagctgagagagcag

SEQ ID NO: 4655 - DNA, 88 bp, Artificial
  Hairpin sequence MM_from_HSbrain_649, mouse
tccctgggggagacctggccaaggtgcagcgggctgtgtgcatgctgagcaataccacggccatcgcagaggcctgggcccgcctgga

SEQ ID NO: 4656 - DNA, 85 bp, Artificial
  Hairpin sequence MM_from_HSbrain_69, mouse
cccctgagcaagactgtgcgattcaatgtgctcaaggtcaccaaggctgctggcaccaagaagcagtttcagaagttctaagggg

SEQ ID NO: 4657 - DNA, 105 bp, Artificial
  Hairpin sequence MM_from_HSbrain_692, mouse
ctgctgaagccatgggccttgactttctcctatggccgagccctgcaggcctctgccctaaaggcctggggtgggaaagaggagaatctgaaggcagctcaggag

SEQ ID NO: 4658 - DNA, 118 bp, Artificial
  Hairpin sequence MM_from_HSbrain_700, mouse
tcttcttcccttgaacccagttgttgtggaattacaagctgaacctgactactgatcccaaatttgaatctgtggccagggaggtttgcaagtcaactatttccgaggtaaagtgtga

SEQ ID NO: 4659 - DNA, 94 bp, Artificial
  Hairpin sequence MM_from_HSbrain_715, mouse
tctgagcctggcttccctgttgttaccttagcccaggtagtgttctacttaccagggcttttgcctggcttatcagggaagctttgggcaaagg

SEQ ID NO: 4660 - DNA, 63 bp, Artificial
  Hairpin sequence MM_from_HSbrain_716, mouse
tcccagggagctctgtgggggaggggccgctgtcttggctctatccccagcagccaccttgga

SEQ ID NO: 4661 - DNA, 90 bp, Artificial
  Hairpin sequence MM_from_HSbrain_72, mouse
gcgggcagccgagcctacgggggcagcgggagcagcagcgccttcaccagcttcctccccccgcggcccctggtgcatccgctgaccggc

SEQ ID NO: 4662 - DNA, 55 bp, Artificial
  Hairpin sequence MM_from_HSbrain_722, mouse
ggtggcatagagatgtgccaggagtctgttggaggacttctggtacagtcccacc

SEQ ID NO: 4663 - DNA, 109 bp, Artificial
  Hairpin sequence MM_from_HSbrain_728, mouse
ggtctggctcagtctgctcattgaatcccattccgttttgcagatgaacgggcttgcagcccagggcagatatgaaggcagtggagatggcggagcggcagcacagtcc

SEQ ID NO: 4664 - DNA, 61 bp, Artificial
  Hairpin sequence MM_from_HSbrain_74, mouse
gggatgggggtggcttagcagatccggacagggccctctgtctctgtgtcatccccaaccc

SEQ ID NO: 4665 - DNA, 89 bp, Artificial
  Hairpin sequence MM_from_HSbrain_746, mouse
gtgcgtagccggccccacccactgctcccgctcctaagctacgactacctgacggatgaggaggagaggcacagtgccgagagcagcac

SEQ ID NO: 4666 - DNA, 70 bp, Artificial
  Hairpin sequence MM_from_HSbrain_758, mouse
gcctcggcgcccaggagctgcggcacgacgccggcccgggtcgcagcctcctcgggccctggagtggggc

SEQ ID NO: 4667 - DNA, 101 bp, Artificial
  Hairpin sequence MM_from_HSbrain_76, mouse
ctttctttttcatttcaagtccttgaaatattccttccagacaaaagaccgtttgtgttttgtgatggaatatgttaatggcggagaggtgagtcaggaag

SEQ ID NO: 4668 - DNA, 76 bp, Artificial
  Hairpin sequence MM_from_HSbrain_763, mouse
gccccgtgcaccctccctgtccctgcaggtcattaaggactcgaagcaggagcacaaggacgtggtgatgtgaggt

SEQ ID NO: 4669 - DNA, 68 bp, Artificial
  Hairpin sequence MM_from_HSbrain_766, mouse
gtgcagtgctttggccacatcagtggtggccacatcaatcccgctgtgactgtagccatggtgtgcac

SEQ ID NO: 4670 - DNA, 96 bp, Artificial
  Hairpin sequence MM_from_HSbrain_768, mouse
aagccgtacccaaagtcccgtttctgccaaggggtccctgatgcgaagatccgcatctttgacctgggtcggaagaaggcaaaggtggatgagttt

SEQ ID NO: 4671 - DNA, 80 bp, Artificial
  Hairpin sequence MM_from_HSbrain_774, mouse
tccatcccttcggtggaccatgaggagctggagcgctccttcagcggcttcagtatctcccagtccaaggagaacctgga

SEQ ID NO: 4672 - DNA, 98 bp, Artificial
  Hairpin sequence MM_from_HSbrain_777, mouse
cgacagcactctgactagccccctagaggcatcctgggtcagcagccagaatgactccccaagtgatgtcagtgaggggcccgagtacctggccattg

SEQ ID NO: 4673 - DNA, 88 bp, Artificial
  Hairpin sequence MM_from_HSbrain_778, mouse
gcgttcccggctgctccgagaccccgatggcagtgctgaggatgacagtctagagcagacatccctcatggagagctcagggaaaagc

SEQ ID NO: 4674 - DNA, 91 bp, Artificial
  Hairpin sequence MM_from_HSbrain_782, mouse; MM_from_HSbrain_787, mouse; MM_from_HSbrain_790, mouse
ctgccatctttgcaggtgaagctttgagtgaagctcttcctggggacaatgtgggcttcaatgtaaagaacgtgtcggtcaaagatgttag

SEQ ID NO: 4675 - DNA, 65 bp, Artificial
  Hairpin sequence MM_from_HSbrain_784, mouse
cttctcagtgatggagaatatgccagcgctgagtccagtgggtatggtgactgtcattgacggag

SEQ ID NO: 4676 - DNA, 84 bp, Artificial
  Hairpin sequence MM_from_HSbrain_789, mouse
ggcatggagtcctgtggtatccatgagaccaccttcaactccatcatgaagtgtgatgtggatatccgcaaagacctgtatgcc

SEQ ID NO: 4677 - DNA, 63 bp, Artificial
  Hairpin sequence MM_from_HSbrain_794, mouse
ataggctgtggggtgattgtgtgtttcagctggctgagctgagaggggtccctcgtggcctgt

SEQ ID NO: 4678 - DNA, 97 bp, Artificial
  Hairpin sequence MM_from_HSbrain_798, mouse
gctcttcttccaccagctggtgggtgatcctctcaaacgctacgcccatgctctggtgtttggaatcctgctcacctgccgcctgctgattgcccgc

SEQ ID NO: 4679 - DNA, 87 bp, Artificial
  Hairpin sequence MM_from_HSbrain_799, mouse; MM_from_PT_321, mouse
ttagtctctaggatgtgctcattgcatgggctgtgtagatttttatttaatacacagaacatgcagtgagaacttgatagagattgg

SEQ ID NO: 4680 - DNA, 104 bp, Artificial
  Hairpin sequence MM_from_HSbrain_804, mouse
ccccttctttggtcccattccctccagcccggggcttcaggaccttgtgtcccatggacaagaggaaggaagccctgggttgctggttgaaacaggggcagggg

SEQ ID NO: 4681 - DNA, 70 bp, Artificial
  Hairpin sequence MM_from_HSbrain_808, mouse
cttcagtgagacaggagctggcaagcatgtgccccgggcagtgtttgtagacccacggtcatcgatgaag

SEQ ID NO: 4682 - DNA, 118 bp, Artificial
  Hairpin sequence MM_from_HSbrain_812, mouse
gtatttatccgacggtgcctcgccgccctccgccttctcttcccggttcttcccggagtcgggaaaagctgggttgagagggcgaaaaaggatgtgggaggtggactgtaagctgtgc

SEQ ID NO: 4683 - DNA, 52 bp, Artificial
  Hairpin sequence MM_from_HSbrain_815, mouse
gccttctcttcccggttcttcccggagtcgggaaaagctgggttgagagggc

SEQ ID NO: 4684 - DNA, 99 bp, Artificial
  Hairpin sequence MM_from_HSbrain_82, mouse
cagtgctaactttttcaatgtggttttctgcaggcaaaatggggaaacagaatagcaaactggccccagaagtcatggaggacctggtgaagagcactg

SEQ ID NO: 4685 - DNA, 65 bp, Artificial
  Hairpin sequence MM_from_HSbrain_821, mouse; MM_from_HSbrain_892, mouse
cctccgccttctcttcccggttcttcccggagtcgggaaaagctgggttgagagggcgaaaaagg

SEQ ID NO: 4686 - DNA, 119 bp, Artificial
  Hairpin sequence MM_from_HSbrain_848, mouse
gggcgatggatttcctgctggctgcgggtgctctgactaggttgcactactgtgctgtgagaagcagtgcaatggtattgtcaaagcatctgggaccagcctcgaagaccacctcacct

SEQ ID NO: 4687 - DNA, 50 bp, Artificial
  Hairpin sequence MM_from_HSbrain_869, mouse
ccttctcttcccggttcttcccggagtcgggaaaagctgggttgagaggg

SEQ ID NO: 4688 - DNA, 48 bp, Artificial
  Hairpin sequence MM_from_HSbrain_879, mouse
cttctcttcccggttcttcccggagtcgggaaaagctgggttgagagg

SEQ ID NO: 4689 - DNA, 85 bp, Artificial
  Hairpin sequence MM_from_HSbrain_884, mouse
gctccccctctctaatccttgctatctgggtgcttagtgctatctcaatgcaatgcacctgggcaagggttcagagaaggtgagc

SEQ ID NO: 4690 - DNA, 118 bp, Artificial
  Hairpin sequence MM_from_HSbrain_90, mouse
tattgcccccttggcagagaacgaggggctgcctgtggctgcactggaggagctggccttcaaagcaagcgagcaggttgacctggaaccttgggctgtggggtctggggaggcagta

SEQ ID NO: 4691 - DNA, 92 bp, Artificial
  Hairpin sequence MM_from_MQbrain_1, mouse
tcatacctgacgtcaagggagcagtgctggtctgtgtgacatgtcctcaaacttctcatccaagccagtgggtgtttccaagtttggtgtga

SEQ ID NO: 4692 - DNA, 99 bp, Artificial
  Hairpin sequence MM_from_MQbrain_1004, mouse
gtacttttgtccatctgttctctgttgtgtgatcccaatccagatgatcctttagtgcctgagattgctcggatctacaaaacagatagagaaaagtac

SEQ ID NO: 4693 - DNA, 93 bp, Artificial
  Hairpin sequence MM_from_MQbrain_1030, mouse; MM_from_MQbrain_1590, mouse; MM_from_MQbrain_640, mouse
ccgcggcggcttccgcggaggattcggcagcggtctaggggccgcggtcgtggcccgaggccgtggccgtggtcgaggccgcggggctcgtgg

SEQ ID NO: 4694 - DNA, 96 bp, Artificial
  Hairpin sequence MM_from_MQbrain_1037, mouse
caccttcttctgagtctgacatagacatctccagccccaacgtgtctcatgatgagagcattgccaaggacatgtccctgaaggactcaggcagtg

SEQ ID NO: 4695 - DNA, 78 bp, Artificial
  Hairpin sequence MM_from_MQbrain_1040, mouse
catgtcctcaagatcaatggccccagtgtctctgcagctccatctgcaggctgctctggctccctgggctgggtcatg

SEQ ID NO: 4696 - DNA, 75 bp, Artificial
  Hairpin sequence MM_from_MQbrain_1042, mouse
gggtttgggcatggggcacatcccttggctttctccagcactgagaaagcactgggagactgcagtccaaaactc

SEQ ID NO: 4697 - DNA, 98 bp, Artificial
  Hairpin sequence MM_from_MQbrain_1046, mouse
tgtcttcattagctgcttgaatttgctgtgttccgttctaggcacgactgcccgtgaagtggatggcaccagagagcattttcagctgcgtgtacaca

SEQ ID NO: 4698 - DNA, 61 bp, Artificial
  Hairpin sequence MM_from_MQbrain_1048, mouse
ttccgggttccgtactgctggccgggctacttccggcagcaggatggctgggttcccggga

SEQ ID NO: 4699 - DNA, 88 bp, Artificial
  Hairpin sequence MM_from_MQbrain_1055, mouse; MM_from_MQbrain_919, mouse
ggcctacctggaggccgagtgcgtggagtggctcctcagatacctggagctcgggaaggagacgctgctgcgcacaggtgcaggggcc

SEQ ID NO: 4700 - DNA, 79 bp, Artificial
  Hairpin sequence MM_from_MQbrain_106, mouse
gcggtagcgtcccgggcgggctggaggtgcagcagcggcggcggcggcggtaaatcctcccggccgcacacagcactgt

SEQ ID NO: 4701 - DNA, 116 bp, Artificial
  Hairpin sequence MM_from_MQbrain_1070, mouse; MM_from_MQbrain_1566, mouse
tggaccaaacacaaacggttcccagttttttatctgcactgccaagactgaatggctggatggcaagcatgtggtcttcgggaaggtgaaagaaggcatgaacattgtggaagcca

SEQ ID NO: 4702 - DNA, 65 bp, Artificial
  Hairpin sequence MM_from_MQbrain_1076, mouse
cagtggaggccccagtgccatgtccaccctagcagtacagagggaggctggtggggtctccactg

SEQ ID NO: 4703 - DNA, 90 bp, Artificial
  Hairpin sequence MM_from_MQbrain_1089, mouse
ggtcacagtgtttgtgcccagtgatggctgctcgaacttcactgaggaagacaatgaagttttggttgctggatttggtcagaatgggcc

SEQ ID NO: 4704 - DNA, 77 bp, Artificial
  Hairpin sequence MM_from_MQbrain_1090, mouse; MM_from_MQbrain_1712, mouse
ggcccggaggacccggggcccaggattaggaggccgcggtggcttccgcggaggattcggcagcggtcttaggggcc

SEQ ID NO: 4705 - DNA, 77 bp, Artificial
  Hairpin sequence MM_from_MQbrain_1095, mouse; MM_from_MQbrain_889, mouse
gttggaatggtgacaacatgctggagccaagtgctaatatgccttggttcaagggatggaaagtcacctgcaaagat

SEQ ID NO: 4706 - DNA, 66 bp, Artificial
  Hairpin sequence MM_from_MQbrain_1097, mouse
tctggggactcactctagtgtgcagccttcctccaagtggctgccagctatggaggagattcctga

SEQ ID NO: 4707 - DNA, 76 bp, Artificial
  Hairpin sequence MM_from_MQbrain_1100, mouse; MM_from_MQbrain_1169, mouse
ggcgcctgtgcaggcctgctgggaacaggacttctgaaaagcaagtgtgtctggaaggctgtggtgcaaggccgtt

SEQ ID NO: 4708 - DNA, 74 bp, Artificial
  Hairpin sequence MM_from_MQbrain_1114, mouse
cggaaggtaggattagatcattagctcagtgacctcctagggtttcgatgtgctgtgttctcatcctacagctg

SEQ ID NO: 4709 - DNA, 115 bp, Artificial
  Hairpin sequence MM_from_MQbrain_1116, mouse
cctcagttcagggctatcttgggggaggtgaagctgtgtgagaagatggctcagtttgatgctaagaagtttgcagagagccagcctaaaaaagatactccaaggaaagaaaagg

SEQ ID NO: 4710 - DNA, 112 bp, Artificial
  Hairpin sequence MM_from_MQbrain_1130, mouse
ttctaatgaactgtgtggtagttgattgtgtggtctgtttgtggagaatgtatggatgcgattcattagtattctagaagagattaataatcagctatgttgttccaatgaa

SEQ ID NO: 4711 - DNA, 59 bp, Artificial
  Hairpin sequence MM_from_MQbrain_115, mouse
catggccgtcagcacccctcctttccccaaggtgaaatggagggtgctgtggggccctg

SEQ ID NO: 4712 - DNA, 90 bp, Artificial
  Hairpin sequence MM_from_MQbrain_1152, mouse
atctatgaaggccaagtggaggtgaatggaggggaatacaatgtggaaagcattgacggtcagcctggtgcctttacttgctatctggat

SEQ ID NO: 4713 - DNA, 72 bp, Artificial
  Hairpin sequence MM_from_MQbrain_1162, mouse
ggggcctggtgaacctggaccggttgctgctgcatgagaaccagctacagtgggttcaccacaaggctttcc

SEQ ID NO: 4714 - DNA, 66 bp, Artificial
  Hairpin sequence MM_from_MQbrain_1174, mouse
ccagctctgtccagctgggctcacatattgtaggccacgtagatggggtccagctggtcagccagg

SEQ ID NO: 4715 - DNA, 62 bp, Artificial
  Hairpin sequence MM_from_MQbrain_1175, mouse
aggacaaacggcgccaggagcccctgaggcagcctagcccccaaaggggaactggtgcccct

SEQ ID NO: 4716 - DNA, 102 bp, Artificial
  Hairpin sequence MM_from_MQbrain_1195, mouse
cctggccttgtgtcttggaagagcaccttaggccaggtcccacttccctctacccctgggcttgcttccctagtttgcttttcttgtggcctgctggctagg

SEQ ID NO: 4717 - DNA, 84 bp, Artificial
  Hairpin sequence MM_from_MQbrain_1215, mouse
agaaagcaacattgggcctcattgcgttacttacctcgactcttagttgtcgggaacggtaaccgagacccggtgtctgcttct

SEQ ID NO: 4718 - DNA, 111 bp, Artificial
  Hairpin sequence MM_from_MQbrain_1222, mouse
aggagctcatgaatgtcaagctggccctggacatcgagattgtcacctacaggaggctgctggagggcgaggaaattcggtgagacggggaaggagtgaggtcagacttct

SEQ ID NO: 4719 - DNA, 98 bp, Artificial
  Hairpin sequence MM_from_MQbrain_1234, mouse
agtgtcaccttctggaccaggtgtggtggtcatgcaactgaatgtccctaacggaccccaggccccccagaatccatccatggtccaatggagtcact

SEQ ID NO: 4720 - DNA, 83 bp, Artificial
  Hairpin sequence MM_from_MQbrain_1235, mouse; MM_from_MQbrain_1323, mouse; MM_from_MQbrain_155, mouse
tggggggactgggtctgggatgggtaccctccttatcagcaagatccgggaggagtacccagacagaatcatgaacaccttca

SEQ ID NO: 4721 - DNA, 116 bp, Artificial
  Hairpin sequence MM_from_MQbrain_1248, mouse
tagccctcctggtcaaggtcatccatggcaactttggcatcatggaaggactcatgaccacagtctataccatcattgccacccagaagactgtggatggcccctctggaaaactg

SEQ ID NO: 4722 - DNA, 89 bp, Artificial
  Hairpin sequence MM_from_MQbrain_1253, mouse
gtcctggcatcttgtccatggcaaatgctggaccaaacacaaatggttcccagtttcctatctgccctgtcaagattgaatggctggat

SEQ ID NO: 4723 - DNA, 106 bp, Artificial
  Hairpin sequence MM_from_MQbrain_1262, mouse
gcaaatctgtctggaaggctgtggttggtgcaaggccatttttgctggctacaagcgaggtctctgaaaccaaaaagagcacacggctcttcttaaaattggaggc

SEQ ID NO: 4724 - DNA, 86 bp, Artificial
  Hairpin sequence MM_from_MQbrain_1279, mouse
gccctctgtgctttcacaaggtagtaagttaacgccagaacagcgtgtctgtgggctttacgactggggtggcagcacactggggc

SEQ ID NO: 4725 - DNA, 105 bp, Artificial
  Hairpin sequence MM_from_MQbrain_128, mouse
gctgtccgctcgggctcgggaggcagccaccgccgccagtctgaggcaggtgcccgacatggcgagtgctgtgctgccgagcggatcccagtgtgcggcggcagc

SEQ ID NO: 4726 - DNA, 74 bp, Artificial
  Hairpin sequence MM_from_MQbrain_1289, mouse
gctcagcccataggaaggggaagggcaggctgagaaaccatgtaggtctctgttcctagccagattgggccagc

SEQ ID NO: 4727 - DNA, 118 bp, Artificial
  Hairpin sequence MM_from_MQbrain_1292, mouse
ggctctcgtaactctaccatcatgtctaagtccgagtctcccaaggagccagaacagctgtggaagctctttattggagggctgagcttcgaaacaaccgacaagagtctgaggagcc

SEQ ID NO: 4728 - DNA, 97 bp, Artificial
  Hairpin sequence MM_from_MQbrain_1294, mouse
tacttttgtccatctgttctctgttgtgtgatcccaatccagatgatcctttagtgcctgagattgctcggatctacaaaacagatagagaaaagta

SEQ ID NO: 4729 - DNA, 60 bp, Artificial
  Hairpin sequence MM_from_MQbrain_1295, mouse
gcacaaaagtggtgctgtggccagcctgctgagcaaggcagagagggccacagagctggc

SEQ ID NO: 4730 - DNA, 59 bp, Artificial
  Hairpin sequence MM_from_MQbrain_1302, mouse
atggaggttccctggagcccataggctgtgggcagtgtgctctcgagtggagcagccat

SEQ ID NO: 4731 - DNA, 79 bp, Artificial
  Hairpin sequence MM_from_MQbrain_1305, mouse
caggtcctcttgactcttacaaatccagtggagaacctcacccatgtgactctgttggagtgtgacgagggggaccctg

SEQ ID NO: 4732 - DNA, 117 bp, Artificial
  Hairpin sequence MM_from_MQbrain_1311, mouse
gccttggaagggtcttaaccgaaagggggagggggaggccgccaacaaacggctgagctcacaatcccggccgcggcccgcccgccccctcccccatggagagagccaggccggagc

SEQ ID NO: 4733 - DNA, 84 bp, Artificial
  Hairpin sequence MM_from_MQbrain_1340, mouse
cagttaagccagggcctgaggaggccatgtcagaagagggcaaagtacctctttccaggagcccccaagcccaggacacacttg

SEQ ID NO: 4734 - DNA, 110 bp, Artificial
  Hairpin sequence MM_from_MQbrain_1344, mouse
aggctgaaggggatgctaaaggagacaaaaccaaggtgaaggacaagccacaaagaagatctgcaaggttgtctgctaaacctgctcctccaaagccagagcccaagcct

SEQ ID NO: 4735 - DNA, 81 bp, Artificial
  Hairpin sequence MM_from_MQbrain_1352, mouse
ctgtggctgaggctggcgagctccgggagcagctcaaggcgttgcgcagcacacacgaagctcgcgaagcccagcacgcag

SEQ ID NO: 4736 - DNA, 71 bp, Artificial
  Hairpin sequence MM_from_MQbrain_1355, mouse
cccgcttgccttggtgctcagccctcccactgggagcaggttggggcaagctggaggctcgggctggaggg

SEQ ID NO: 4737 - DNA, 88 bp, Artificial
  Hairpin sequence MM_from_MQbrain_1363, mouse
ctgggagacacccaagtgcccagagccctgctccacattcctccaggaccagagcagggatctgcctgagtggccttggatactctag

SEQ ID NO: 4738 - DNA, 80 bp, Artificial
  Hairpin sequence MM_from_MQbrain_1365, mouse
gctgctctctcccacctgcaccccccacctccacagtaccatctgcagctgaggagatgctgggaagtgggagagacagc

SEQ ID NO: 4739 - DNA, 117 bp, Artificial
  Hairpin sequence MM_from_MQbrain_1378, mouse
gtgtttgtcccttaggtgtccccacccagtgactctggctggcatgctggagatgggtgtgtcctacctgcctgtcaaccagaactgggagcgttacctgacagaggcacagaacac

SEQ ID NO: 4740 - DNA, 116 bp, Artificial
  Hairpin sequence MM_from_MQbrain_1383, mouse
ggagtgtcgcgggctctcctcttttcaattgcagccacgacgttaattttattgggattactgatgggaaatgaggtggcgcaggcttccgagaggaaaagcttgatcattactcc

SEQ ID NO: 4741 - DNA, 108 bp, Artificial
  Hairpin sequence MM_from_MQbrain_1416, mouse; MM_from_MQbrain_527, mouse
ggctgaacgggatgctaaaggaaataaagccaaggtgaaggatgagtcacagagaagatctgcaaggctgtctgttaaatctgcttctccaaagccagagcccaagcc

SEQ ID NO: 4742 - DNA, 79 bp, Artificial
  Hairpin sequence MM_from_MQbrain_1417, mouse
ggggggactgggtctgggatgggtaccctccttatcagcaagatccgggaggagtacccagacagaatcatgaacacct

SEQ ID NO: 4743 - DNA, 117 bp, Artificial
  Hairpin sequence MM_from_MQbrain_1428, mouse
gaccagggaggacttgatcaacagccttggtgctgtaccaggcttgcgatgaagccttcatggaggctttgcaggctgctgcagatatctttgtggttggccagtttggtgttggtt

SEQ ID NO: 4744 - DNA, 96 bp, Artificial
  Hairpin sequence MM_from_MQbrain_1442, mouse
agcacgaggaggtgttgcagcagtggcagatgtgcagcgagctgctctcgccgggctcgctgccgtcgccgccgccgcagccgcctcccccgggct

SEQ ID NO: 4745 - DNA, 82 bp, Artificial
  Hairpin sequence MM_from_MQbrain_1457, mouse
gggacccaggaggcctgcagtttctggctgtccttacaaagttgatttaataaggattccaggaaaaccagcctcctctccc

SEQ ID NO: 4746 - DNA, 76 bp, Artificial
  Hairpin sequence MM_from_MQbrain_1458, mouse
accgatggtgacagggctgtctttaggggcttcagcgagagcagtgaggaggaggaagagccagagagtccccggt

SEQ ID NO: 4747 - DNA, 90 bp, Artificial
  Hairpin sequence MM_from_MQbrain_1466, mouse
tggcacatgtggaggcctgctgggaacaggacttctaaaagatacaattatgtctggaagactgtggtgcaaggccatttttgctggcta

SEQ ID NO: 4748 - DNA, 60 bp, Artificial
  Hairpin sequence MM_from_MQbrain_1496, mouse
ggccgccgctatgcctcagggccttcagcctctcttgggggccctgagtctgcagtggcc

SEQ ID NO: 4749 - DNA, 107 bp, Artificial
  Hairpin sequence MM_from_MQbrain_1516, mouse
ggagagctggaaagtgactctgggagtgacaaggccaacagcccagccggaggtgttccctccacctcttcctgtttgcccagtcccagcactccagtgcagtctcc

SEQ ID NO: 4750 - DNA, 94 bp, Artificial
  Hairpin sequence MM_from_MQbrain_152, mouse
tcttccttgtgctgccggcgctccgtggccaccctcccctgaccttgccaccgctcaggtaatgaggagctgtgggtgcagccagccttggaga

SEQ ID NO: 4751 - DNA, 100 bp, Artificial
  Hairpin sequence MM_from_MQbrain_1524, mouse
tgaggccggtgagtcctggcagtctgaaagcactgtggctatgtggggtacagtgttggtgccccgtggtgccccaggcatgactgaggggaaggcctta

SEQ ID NO: 4752 - DNA, 79 bp, Artificial
  Hairpin sequence MM_from_MQbrain_1525, mouse; MM_from_MQbrain_1592, mouse; MM_from_MQbrain_1700, mouse; MM_from_MQbrain_1724, mouse;
ggtggataacaagaaggctcagctggtggtgatggcccatgacatagaccccattgagctggtggttttcttgcctgcc

SEQ ID NO: 4753 - DNA, 113 bp, Artificial
  Hairpin sequence MM_from_MQbrain_1527, mouse
agtgtatcatcgaccagttcatcagcactggccaggccaagtgggtgcggcacaatggcatcgtgcttctgctgccccacggcatggagggcatggtgagggttgggggccct

SEQ ID NO: 4754 - DNA, 83 bp, Artificial
  Hairpin sequence MM_from_MQbrain_153, mouse; MM_from_MQbrain_1958, mouse; MM_from_MQbrain_1985, mouse; MM_from_MQbrain_579, mouse
tggggggactgggtctgggatgggtaccctccttatcagcaagatctgggaggagtacccagacagaatcatgaacaccttca

SEQ ID NO: 4755 - DNA, 113 bp, Artificial
  Hairpin sequence MM_from_MQbrain_1542, mouse
gaggcacaaagatatctggtccaaggagaaaacctgtgatcgactccccaagttcctcattgtgggaccacagaagacaggtaaattgtccacagtttatcttatgctgcctt

SEQ ID NO: 4756 - DNA, 100 bp, Artificial
  Hairpin sequence MM_from_MQbrain_1544, mouse
ccgtgttcagcgccgaggtcttctgctaccaccatgcccaaaagaaaggctgaaggggaatgctaaaggagacaaagtcaaggtgaaggaggagtcacgg

SEQ ID NO: 4757 - DNA, 79 bp, Artificial
  Hairpin sequence MM_from_MQbrain_1550, mouse
gaagtctccttttctgtagttgaggtgttgcttttggtctagtgaccaccagcctagatggctgcggagagcccgcttt

SEQ ID NO: 4758 - DNA, 95 bp, Artificial
  Hairpin sequence MM_from_MQbrain_1569, mouse
tctaaggtcattctttcagagtctcagaggggctccagccagctgccaggcaggcagctgcaggcgcccttagagctctgaatgatgtcctctga

SEQ ID NO: 4759 - DNA, 95 bp, Artificial
  Hairpin sequence MM_from_MQbrain_1575, mouse
gtggccgtgtcaaaacttggctaccaggctcctttcctctctctgaaggacaggcagtaaagaggaagtctggggtagcagtgtgggcaggccat

SEQ ID NO: 4760 - DNA, 86 bp, Artificial
  Hairpin sequence MM_from_MQbrain_1587, mouse
gcagatctgcgcactctcagtgccccctccccgtctaccgcagtgccagcagaggggcgggggctgcgggtgcgctttgagcctgc

SEQ ID NO: 4761 - DNA, 111 bp, Artificial
  Hairpin sequence MM_from_MQbrain_1595, mouse
cctcttctcatgtatgacacctctgggcatcgggttgggtgcagctctggcagagtcagctgggcctctgcaccagctggcccaatctgttctagagggcatggcagctgg

SEQ ID NO: 4762 - DNA, 86 bp, Artificial
  Hairpin sequence MM_from_MQbrain_1606, mouse
ggctccggagactgaggctcctgcctctcaggctgggacagatgaaccagagcctgagggtacagctgtccaggttcaggagaacc

SEQ ID NO: 4763 - DNA, 83 bp, Artificial
  Hairpin sequence MM_from_MQbrain_1620, mouse
gaggggcggcggaggcaggagccagaggggcctacatgacatcccatacctttaatgcctttggccttcaattctgacctctc

SEQ ID NO: 4764 - DNA, 102 bp, Artificial
  Hairpin sequence MM_from_MQbrain_1625, mouse
tgtcaaagcaagagatggctagtgcttcatccagccagagaggtcgcagtggttctggaaactttggtggtggtcgtggaggcagttttggtggcaatgaca

SEQ ID NO: 4765 - DNA, 99 bp, Artificial
  Hairpin sequence MM_from_MQbrain_1634, mouse
ctacagaggagaggggagctggcagagttggcagtgtttgtgtatgcatgcatacactcacgtgcgtattttccagaacacatttccccccctctgcag

SEQ ID NO: 4766 - DNA, 110 bp, Artificial
  Hairpin sequence MM_from_MQbrain_1637, mouse
cagtggcttcttctttgtggcagctggccaacaaccaggtgtactccatggggaacccccttcagcagcctgggcttggcacaaccatgaagacagggctgaagatgctg

SEQ ID NO: 4767 - DNA, 72 bp, Artificial
  Hairpin sequence MM_from_MQbrain_1646, mouse
aggagctgggcccctttgcctctctggagggcttccgggaactgctagataaggcacaggtgggccaggcct

SEQ ID NO: 4768 - DNA, 107 bp, Artificial
  Hairpin sequence MM_from_MQbrain_1648, mouse
tcttcttgtctatggtaaatgctggaacaaacacaaatggttcccagtttttcaactacactgtgaagaccatgtagtgggatgtcagcatgtcgtctttaggaggg

SEQ ID NO: 4769 - DNA, 93 bp, Artificial
  Hairpin sequence MM_from_MQbrain_168, mouse
taccttggtgaagaacaggaaggctcagctggtggtgattgcccatgatgtagaccccacggagctggtggttttcctgcctgcgccgcggta

SEQ ID NO: 4770 - DNA, 86 bp, Artificial
  Hairpin sequence MM_from_MQbrain_1680, mouse
gtttattttgttctctcctttcttaggctggcaatcctggtggaccgggacctggtggtcgaggacgaggtagaggtcaaggaaac

SEQ ID NO: 4771 - DNA, 104 bp, Artificial
  Hairpin sequence MM_from_MQbrain_1694, mouse
cccctggccaaggtcatccataacaactttggcatcgtggaagggcttatgaccacggtccatgccatcactgccactcagaagtctgtggatggcccctctgg

SEQ ID NO: 4772 - DNA, 105 bp, Artificial
  Hairpin sequence MM_from_MQbrain_1708, mouse
ggacaagatctatgaaggccaagtggaggtgaatggaggggaatacaatgtggaaagcattgacggtcagcctggtgcctttacttgctatctggatgcaggtct

SEQ ID NO: 4773 - DNA, 95 bp, Artificial
  Hairpin sequence MM_from_MQbrain_1709, mouse
cagggtgctgaagggaggctcggtgcgcaagctcaggcgtgccaaacagctggtgctggagctgggcgaggagacgattcttgaaggctgtattg

SEQ ID NO: 4774 - DNA, 82 bp, Artificial
  Hairpin sequence MM_from_MQbrain_1730, mouse; MM_from_MQbrain_1739, mouse; MM_from_MQbrain_1743, mouse; MM_from_MQbrain_1749, mouse; MM_from_MQbrain_1751, mouse; MM_from_MQbrain_1766, mouse; MM_from_MQbrain_1769, mouse; MM_from_MQbrain_1775
ctttctttcttacttttatctgcactgccaagactgagtggctggatggcaagcatgtggtctttggcaaaaagaaaggaag

SEQ ID NO: 4775 - DNA, 95 bp, Artificial
  Hairpin sequence MM_from_MQbrain_1747, mouse
tccattgtggatctgacatgttgcctggagaaacctgccaagtatgataacatcaagaaggtggtgaagcaggcatctgagggcccactaaaggg

SEQ ID NO: 4776 - DNA, 75 bp, Artificial
  Hairpin sequence MM_from_MQbrain_1748, mouse
gcccttggaggggcggccagagaggcagttctttgtgaaatggcaaggcatgtcttactggcactgctcctgggt

SEQ ID NO: 4777 - DNA, 99 bp, Artificial
  Hairpin sequence MM_from_MQbrain_1753, mouse; MM_from_MQbrain_1882, mouse; MM_from_MQbrain_1893, mouse
gggtttagaagtagactctctagacattgaacacatctaggtgaacaagacacctaagatgctgtgaagaatctacagagctcatggctggattaaccc

SEQ ID NO: 4778 - DNA, 73 bp, Artificial
  Hairpin sequence MM_from_MQbrain_1783, mouse
gcatcatgctgtctggagaaacagccaagggggactaccctctggaggctgttctcatgcaacacctgattgc

SEQ ID NO: 4779 - DNA, 91 bp, Artificial
  Hairpin sequence MM_from_MQbrain_1790, mouse
ccgagggtccccccgcacccctcctcagaacggcgtgcagtatacatcggggcgctgtttcccatgagcgggggctggccggggggccagg

SEQ ID NO: 4780 - DNA, 81 bp, Artificial
  Hairpin sequence MM_from_MQbrain_1791, mouse
ccttcattggcaacagcacggccacccaggagctgttcaaatgcatttccgagcagttcacagccatgttccggtgcaagg

SEQ ID NO: 4781 - DNA, 102 bp, Artificial
  Hairpin sequence MM_from_MQbrain_1798, mouse; MM_from_MQbrain_1802, mouse
tgtcaaagcaagagatggctagtgcttcatccagccagagaggtcgcagtggttctggaaactttggtggtggtggtgaaggcggttttggtggcaatgaca

SEQ ID NO: 4782 - DNA, 72 bp, Artificial
  Hairpin sequence MM_from_MQbrain_1805, mouse
tccagtctgaatagtggcagtagtctgggccttagcctgggcagcaactctactgtcacagcctcaactcga

SEQ ID NO: 4783 - DNA, 106 bp, Artificial
  Hairpin sequence MM_from_MQbrain_183, mouse
taaacagctgagtcagaaggtggatgaacttgagaggttagaggcacttggtcccatgtctgtcctcttcctaggacctgagactttctgccacttagctgctttg

SEQ ID NO: 4784 - DNA, 71 bp, Artificial
  Hairpin sequence MM_from_MQbrain_1836, mouse
ccagtgccatccagcagaaggcggccaggaagcagaaatgcagcatcacggccaccaggcggcagcgcagg

SEQ ID NO: 4785 - DNA, 118 bp, Artificial
  Hairpin sequence MM_from_MQbrain_1856, mouse
aatctatgttgtgtgagttgtgtgcagtgctctattcagattagtgccagtcatgtgaaatacatatgactggcaccattctggataatgtaatgctcactatattcttcaagtgatt

SEQ ID NO: 4786 - DNA, 70 bp, Artificial
  Hairpin sequence MM_from_MQbrain_1859, mouse; MM_from_MQbrain_1860, mouse; MM_from_MQbrain_1891, mouse
ccccaataatcccttcctttcactatcttctttttggggggtaggtggaagggattgacattggatgggg

SEQ ID NO: 4787 - DNA, 79 bp, Artificial
  Hairpin sequence MM_from_MQbrain_1869, mouse; MM_from_MQbrain_57, mouse
tcaaaggtgagggtccagatgtggatgtgagcttgcctaaggctactattgatgtctcaggacctaaacttgacattga

SEQ ID NO: 4788 - DNA, 117 bp, Artificial
  Hairpin sequence MM_from_MQbrain_1872, mouse; MM_from_MQbrain_227, mouse; MM_from_MQbrain_895, mouse
ggctgcgaggttgtggtgtctgggaagctccgaggacagagggccaagtccatgaagtttgtggatggtctgatgattcacagtggagaccctgttaactactatgtcgacacagct

SEQ ID NO: 4789 - DNA, 84 bp, Artificial
  Hairpin sequence MM_from_MQbrain_1885, mouse
ctgtaatggttcatactgttggattttcatgagaagcatgtaggcctccttgaggacatccacagtctcagagccactgagcag

SEQ ID NO: 4790 - DNA, 95 bp, Artificial
  Hairpin sequence MM_from_MQbrain_1889, mouse
cagccattcaggagtcaggggtagagcggcaggtgcttttgggagaccaaatccccaagttcaccattgccacgttgccacctccctgaggcctg

SEQ ID NO: 4791 - DNA, 91 bp, Artificial
  Hairpin sequence MM_from_MQbrain_189, mouse
ctcagtgtctactcttaatagtgaagattttgtcttggtttccaggcaaggagatgagacaccatctacaaataatgggagtgatgatgag

SEQ ID NO: 4792 - DNA, 105 bp, Artificial
  Hairpin sequence MM_from_MQbrain_1901, mouse
ccagagtttgcctgcctgcttctgtgtgatatgtttgatattgggttgttaaattatgaaccaactgaatgtcaagcatactctcacagcagtaaggagacttgg

SEQ ID NO: 4793 - DNA, 115 bp, Artificial
  Hairpin sequence MM_from_MQbrain_191, mouse
tccctgctaaccacctcctcaggtcccatctgatgccaaggctgaaggagtctcggtcacacgagtccctgctcagccccagcagcgcagtggaggccctggacctcagcatgga

SEQ ID NO: 4794 - DNA, 114 bp, Artificial
  Hairpin sequence MM_from_MQbrain_193, mouse
ccaatgaggtggtggtccagaggctcttccaggtcaaaggacgccgtgtagtccgtgctactgaggtacctgtgtcctgggacagtttcaacaatggcgactgcttcattctgg

SEQ ID NO: 4795 - DNA, 110 bp, Artificial
  Hairpin sequence MM_from_MQbrain_1946, mouse
ggctgctggaggcctcccaccatttttggcaatggtagaactcacaccggtaaggtaatgggacccggtggttctagacttgccaactatggtgtaagtgctgagctgct

SEQ ID NO: 4796 - DNA, 100 bp, Artificial
  Hairpin sequence MM_from_MQbrain_200, mouse
acataactctggtctctgtcttcagatgtgtcaccggtagcggctggcctcatcggggcctccgtgctggtggtgtgtgtttcagtgactgtctttgtgt

SEQ ID NO: 4797 - DNA, 69 bp, Artificial
  Hairpin sequence MM_from_MQbrain_216, mouse
tctggagtggcttcgaaggggaaacacgcctccgaaaagaggcacaagtgcccctacagtggctgtggg

SEQ ID NO: 4798 - DNA, 109 bp, Artificial
  Hairpin sequence MM_from_MQbrain_222, mouse
agtttgacttcatacctgacgtcaagggagcagtgctggtctgtgtgacatgtcctcaaacttctcatccaagccagtgggtgtttccaagtttggtgtgattttcgct

SEQ ID NO: 4799 - DNA, 58 bp, Artificial
  Hairpin sequence MM_from_MQbrain_234, mouse
tggaggctccaggtgcaccacccagaacactgacgtgggaagccatggagcagatccg

SEQ ID NO: 4800 - DNA, 103 bp, Artificial
  Hairpin sequence MM_from_MQbrain_238, mouse
gtctttgcgccggcggcggtggcggctgtgggggctgggcggagcgccgctgtgcggggcggccgggctggcggcggccgggagccgcaggcgggtgcgaggc

SEQ ID NO: 4801 - DNA, 91 bp, Artificial
  Hairpin sequence MM_from_MQbrain_239, mouse
catgtgtgagctgcagatctgtgacctggctgtggaagacactggggactactcatgtgtgtgtgggcaggagaagacctcagccacactg

SEQ ID NO: 4802 - DNA, 95 bp, Artificial
  Hairpin sequence MM_from_MQbrain_251, mouse
ggcatccagaggccgccactacacttcccacagggaggacacctgctgtccttcctgtcatgtctggagaatgggctgctgcctcgtggacagct

SEQ ID NO: 4803 - DNA, 72 bp, Artificial
  Hairpin sequence MM_from_MQbrain_262, mouse
gctgggatgatgcccttggaggccctggcgtccctcctgcccaggtgctaggagccgtccccaggctccagc

SEQ ID NO: 4804 - DNA, 82 bp, Artificial
  Hairpin sequence MM_from_MQbrain_263, mouse
ctcattgttttgaaggttttcagcccattctctgggctcaattacttctggtctgaggtgaggctgaacatcatggtgtgag

SEQ ID NO: 4805 - DNA, 86 bp, Artificial
  Hairpin sequence MM_from_MQbrain_2679, mouse
gcctcgccgccctccgccttctcttcccggttcttcccggagtcgggaaaagctgggttgagagggcgaaaaaggatgtgggaggt

SEQ ID NO: 4806 - DNA, 76 bp, Artificial
  Hairpin sequence MM_from_MQbrain_285, mouse
aaagatgcccaacgtcttccagaatctggtctcttgcaaaagagtcttccgggaattgaagatgttgtgttttttt

SEQ ID NO: 4807 - DNA, 117 bp, Artificial
  Hairpin sequence MM_from_MQbrain_295, mouse
gaaagattatttgaatgagggggccatggctgatacagctgatctggtggttcttggggccttctatgggcaagggagcaaaggttagtggtttggtccctgtgttggtactctatc

SEQ ID NO: 4808 - DNA, 70 bp, Artificial
  Hairpin sequence MM_from_MQbrain_305, mouse
ctcgaccaactggacatgcatgtctgtggccaaactaaggccaaaggccaaatgcaggtgcatgggtggg

SEQ ID NO: 4809 - DNA, 110 bp, Artificial
  Hairpin sequence MM_from_MQbrain_317, mouse; MM_from_MQbrain_341, mouse; MM_from_MQbrain_962, mouse
aggctgaaagggatgctaaaggagacaaagccaaggtgaagaaggagccacagagaagatctgcaaggctctctgctaaacctgcttctctaaagccagagcccaagcct

SEQ ID NO: 4810 - DNA, 74 bp, Artificial
  Hairpin sequence MM_from_MQbrain_332, mouse
ggccctcggctccctcctccttttcccccgcctccattttgttcgcggacgctggggacggtgggagcggatcc

SEQ ID NO: 4811 - DNA, 115 bp, Artificial
  Hairpin sequence MM_from_MQbrain_36, mouse
agtgtcatcttgcccactcctcagcaccccaccttgcccccaggaggtctggagctctacagacctcctgggggcaaggtggggtgaggcccggagttggggaagctaggaggct

SEQ ID NO: 4812 - DNA, 70 bp, Artificial
  Hairpin sequence MM_from_MQbrain_368, mouse; MM_from_MQbrain_856, mouse
cgccttcatggtgtgggcgcaggctgcgcgcaggaagctggcagaccagtacccgcatctgcacaacgcg

SEQ ID NO: 4813 - DNA, 55 bp, Artificial
  Hairpin sequence MM_from_MQbrain_371, mouse
ggagggcagaggtgggagtgaggcagcgcctgagtgttcctcaccactgtccttc

SEQ ID NO: 4814 - DNA, 103 bp, Artificial
  Hairpin sequence MM_from_MQbrain_393, mouse
tcttcagaccatgctcttaagtcaagagtcagttgctaactgtgatgatgaagtgtggttacattgcagaatctgatgtcattgatgatagccaagctgggga

SEQ ID NO: 4815 - DNA, 89 bp, Artificial
  Hairpin sequence MM_from_MQbrain_398, mouse
tcttccaccttcgatgccggggctggcatctttgtcaagctcatttcctgttatgacaatgaatacagctacagcaacagggtggtgga

SEQ ID NO: 4816 - DNA, 99 bp, Artificial
  Hairpin sequence MM_from_MQbrain_427, mouse
tgccaagaatggctggatgatggcatgtggtctttgggaaggtgaaagaaggcatagacgttgtgaaggccatggagcattttgggtccaggaatggca

SEQ ID NO: 4817 - DNA, 100 bp, Artificial
  Hairpin sequence MM_from_MQbrain_444, mouse
agctggaggatggccgcaccctgtccgactacaacatccagaaaggtaagggctgttttgcttgtctggtattgtaggtgggggctggcgtccgactgct

SEQ ID NO: 4818 - DNA, 77 bp, Artificial
  Hairpin sequence MM_from_MQbrain_496, mouse
ccagctgtcttgctcttttcccagcgttatcaggcagaaatcaatgacttggagaacttgggtgagatgggcagtgg

SEQ ID NO: 4819 - DNA, 74 bp, Artificial
  Hairpin sequence MM_from_MQbrain_498, mouse
acctcagccttggattccaccaatgtagaggaagcattcaagaacatcctcacaggtgggccccgggtctgggt

SEQ ID NO: 4820 - DNA, 68 bp, Artificial
  Hairpin sequence MM_from_MQbrain_502, mouse
cggcaactcggtgggcgcactgggcaacctgaccctggtgctggccatcatcgtcttcatttttgccg

SEQ ID NO: 4821 - DNA, 91 bp, Artificial
  Hairpin sequence MM_from_MQbrain_523, mouse
tcgtgctggagctggatcgggagatgagcaggagtgtggatgtgaccaataccactttcctgctcatggctgcctccatctacttccacga

SEQ ID NO: 4822 - DNA, 92 bp, Artificial
  Hairpin sequence MM_from_MQbrain_539, mouse
gccctgggctcccatcctcatctctccccttgactggacttgctgctacccagctggggtgggtgaggcctgcactgactggggcccagggc

SEQ ID NO: 4823 - DNA, 103 bp, Artificial
  Hairpin sequence MM_from_MQbrain_541, mouse
atttttgtttcacggtctgttgacattccgggatgtggctgtgaacttctctcaggaggagtgggaatacctggactttgttcagagggctctgtacattgat

SEQ ID NO: 4824 - DNA, 91 bp, Artificial
  Hairpin sequence MM_from_MQbrain_542, mouse
accttcagggcggtgctggtggagagcattcctgagggtctggagtttcccaatgccaccacgagcaacccctccactagccaggcctggt

SEQ ID NO: 4825 - DNA, 112 bp, Artificial
  Hairpin sequence MM_from_MQbrain_548, mouse
gggagagggtgagcttggagggtctggaggcgtgtcagcctgcagccagggtttgagcgctcacctcatctgcaggccaggaccttaacaaggccctgggtgaccttgtcct

SEQ ID NO: 4826 - DNA, 71 bp, Artificial
  Hairpin sequence MM_from_MQbrain_564, mouse
tgcagagcccagttcctcccggagctcctgggccttctccgtgagcctgggggagctcaagtccatccgca

SEQ ID NO: 4827 - DNA, 99 bp, Artificial
  Hairpin sequence MM_from_MQbrain_571, mouse
gggcacttatagcgtaggccggcgcgcgcgcgcgcaccattgtgtggctgactcggccgccgctgcggtgtgaggcgcgtgttcgggccttcgccgtcc

SEQ ID NO: 4828 - DNA, 94 bp, Artificial
  Hairpin sequence MM_from_MQbrain_58, mouse
caggggagtggcgtgtccttggcctcgaagaagtcccgactgtcttcctcctctagcaacgacagtgggaccaaggttggtatccagcttcctg

SEQ ID NO: 4829 - DNA, 99 bp, Artificial
  Hairpin sequence MM_from_MQbrain_585, mouse
cagcacaagggctcttgctgcccgcctcctctttgactctgtggatcgtccatccatctgctcactgtgaagatggagaggcagtgcgccctgaggctg

SEQ ID NO: 4830 - DNA, 89 bp, Artificial
  Hairpin sequence MM_from_MQbrain_594, mouse
gctactttctctttttccttcactggttattgcagggggcgggagcctgccagctgcgagggcctctgtggtggtggaggagttggtgc

SEQ ID NO: 4831 - DNA, 73 bp, Artificial
  Hairpin sequence MM_from_MQbrain_599, mouse
tgggttacgctgcatctggaaatgggacggacggacggacggacggagcagacagtgctgagtgaatgaccca

SEQ ID NO: 4832 - DNA, 70 bp, Artificial
  Hairpin sequence MM_from_MQbrain_6, mouse
ctcagctggtggatccggtggcattgagcttcaagaagctgaagaccattctggagtgtcgagggctggg

SEQ ID NO: 4833 - DNA, 93 bp, Artificial
  Hairpin sequence MM_from_MQbrain_610, mouse
gcatgtttgactgttgcaatgtcgtctctttaggtcagaggcctggcttcaagtactggtatgacaaggagtggctgagccggggacacatgc

SEQ ID NO: 4834 - DNA, 77 bp, Artificial
  Hairpin sequence MM_from_MQbrain_625, mouse
ctaacagctgtggctgtcaccatggaggatggacacactattgctttcctgggtgacagtcaaggacagttgcatag

SEQ ID NO: 4835 - DNA, 109 bp, Artificial
  Hairpin sequence MM_from_MQbrain_632, mouse
aagatagactgaatttgtgtttgtggaaagcggcttggcttggaagactccatgatgcagaactggagtctttactgacctgctttccacgtgagcccaaggtcttctt

SEQ ID NO: 4836 - DNA, 77 bp, Artificial
  Hairpin sequence MM_from_MQbrain_646, mouse
tcttgatttagtccttagttcatgtgcctcggtcacttgggggctggggagagcatgcacgctgtggaagagaaagg

SEQ ID NO: 4837 - DNA, 116 bp, Artificial
  Hairpin sequence MM_from_MQbrain_655, mouse
ggctcccgcgctccctcctccccccccccctccccgcgcctctataacttggcgggcaaggaggcggcgcccgcggagtcggagggcggggagctcggaggagggcaccgggagtt

SEQ ID NO: 4838 - DNA, 109 bp, Artificial
  Hairpin sequence MM_from_MQbrain_656, mouse
gcacccaggtgggctggcagtgccctggctgcactttcatcaacaaacccacacggcctgggtgtgagatgtgctgtcgtgcaaggcctgagacctaccagatacctgc

SEQ ID NO: 4839 - DNA, 94 bp, Artificial
  Hairpin sequence MM_from_MQbrain_677, mouse
cggcggtggcggcacgctcaaggccaagccacacgtgaagcggcccatgaatgccttcatggtgtgggcacaggcggcgcgccgcaagctggcg

SEQ ID NO: 4840 - DNA, 68 bp, Artificial
  Hairpin sequence MM_from_MQbrain_693, mouse
tccagggcagctccatgggccagatggctgctccaatgggacaacttggccagatggggcagcctggg

SEQ ID NO: 4841 - DNA, 78 bp, Artificial
  Hairpin sequence MM_from_MQbrain_702, mouse
gcagaatgtgacatctttgctgaaggagtccacacagggcatgagcagccttctcagggagatcacagcatcctctgc

SEQ ID NO: 4842 - DNA, 74 bp, Artificial
  Hairpin sequence MM_from_MQbrain_709, mouse
gttggatcatggggaatcccaccagccaccagcaagcctcctggtacaggctggctcgggggacctattcctgc

SEQ ID NO: 4843 - DNA, 72 bp, Artificial
  Hairpin sequence MM_from_MQbrain_716, mouse
gctacgcctgtcacccatggtctttcgggccctacagggctgtggggctgtaggagaccgggggctgtttgc

SEQ ID NO: 4844 - DNA, 77 bp, Artificial
  Hairpin sequence MM_from_MQbrain_734, mouse
cgcgcgggctgcgcggcgggcgtgcaggggaggcggcggctccggcttactgcagccgctctccggcggccggcccg

SEQ ID NO: 4845 - DNA, 109 bp, Artificial
  Hairpin sequence MM_from_MQbrain_74, mouse
agtgtcccttcctctcttctgcccagacctacgagcagcggaaggtggtggagttcacatgccacacggccttcttcgctagcatcgtggttgtgcagtgggctgacct

SEQ ID NO: 4846 - DNA, 100 bp, Artificial
  Hairpin sequence MM_from_MQbrain_742, mouse
gccgtccggcaaggaggccggcggaggcggggccgcggccgcccctgaaaggcgccccggcggcggcccagcctcttctttcctcgcacagccacacggc

SEQ ID NO: 4847 - DNA, 56 bp, Artificial
  Hairpin sequence MM_from_MQbrain_743, mouse
ccaatagcccacactgtccgcgcctacttccataggtgggaggggcagggagttgg

SEQ ID NO: 4848 - DNA, 84 bp, Artificial
  Hairpin sequence MM_from_MQbrain_769, mouse
gcttctcatttgacagtaactcgatgcaattcactttgtggaacgaaaccacaaagtgaaaagcatcgaattgcagagaaaagt

SEQ ID NO: 4849 - DNA, 108 bp, Artificial
  Hairpin sequence MM_from_MQbrain_807, mouse
gcccacagcacagtgagtgtgcaggacatccaagtacacctggcgcagggccatgtggccattgtgttggtgaattccggggtgctacactgcgacctgtgctccagc

SEQ ID NO: 4850 - DNA, 111 bp, Artificial
  Hairpin sequence MM_from_MQbrain_814, mouse
caccagcctcctcatctgccagggtctgctctgggtaggcactgaccagggtgtcattgtcctgttgcctgtaccccgactggagggcatccccaagatcacaggtgggtg

SEQ ID NO: 4851 - DNA, 95 bp, Artificial
  Hairpin sequence MM_from_MQbrain_819, mouse
gaccagttcatctgcccaggacaggcaaagtgggtgcggcagaatggcattgtgctcctgctgcctcatggcatggaaggcatggtgagaacttc

SEQ ID NO: 4852 - DNA, 64 bp, Artificial
  Hairpin sequence MM_from_MQbrain_829, mouse
cgcacccacagccgggtcctcgcggcccatgctggccgctggggacccaggcagcctaggtctg

SEQ ID NO: 4853 - DNA, 114 bp, Artificial
  Hairpin sequence MM_from_MQbrain_849, mouse
gcatggtggagcctgatctcatggtgcatttgtccttatagatgccagtgaagcatgtgtaccgtgtgctgcagtgccaggaggaggagctcacacagatggtatccacaatgt

SEQ ID NO: 4854 - DNA, 82 bp, Artificial
  Hairpin sequence MM_from_MQbrain_852, mouse
tcaggtggccgctgctgccaccagcgccacggtctgtcgccagaaggaagatggcggatctggaggagcagttgtccgatga

SEQ ID NO: 4855 - DNA, 113 bp, Artificial
  Hairpin sequence MM_from_MQbrain_868, mouse
tgacctgccactctgtcacctctctggagttggttcagcgtccaaccgcagctactctgctgatggcaagggcactgagagccaccctccggaggacaactggcttaagttca

SEQ ID NO: 4856 - DNA, 90 bp, Artificial
  Hairpin sequence MM_from_MQbrain_885, mouse
gcagcggcttccagggaaccaagctcctacaggaagtacggaggcggctaggcttcctggaggagaaggaccagatggaagctgtaaggt

SEQ ID NO: 4857 - DNA, 69 bp, Artificial
  Hairpin sequence MM_from_MQbrain_89, mouse
tgcagtgcaagtcccacagtctgataccatcttggcaattcaggctgatgggacagtggcagggctgca

SEQ ID NO: 4858 - DNA, 79 bp, Artificial
  Hairpin sequence MM_from_MQbrain_899, mouse
cctgtggaggcctgctgggaacaggacttctaaaagcaagtctgtctggaaggctgtggggcaaggccatttttgctgg

SEQ ID NO: 4859 - DNA, 92 bp, Artificial
  Hairpin sequence MM_from_MQbrain_907, mouse
acagcgttcgtgcccaatgatggctgcctgaacttcattgaggaaaatgatgaagttccggttgctggatttggtcgaaaaggtcatgctgt

SEQ ID NO: 4860 - DNA, 90 bp, Artificial
  Hairpin sequence MM_from_MQbrain_911, mouse
acccccctttccctctgccatcatggttctccttggcagcagcgttcgcagccgcctgagggtgaaaacgtgggtgatggggaagttggt

SEQ ID NO: 4861 - DNA, 118 bp, Artificial
  Hairpin sequence MM_from_MQbrain_916, mouse
catgagaaggctatgctccagcatcactaccagaactgtcttgatcatcctcactgggcgccaaaggggcaagaaaatggttttcctgtagcagctggacagtggcttgctgcttgtg

SEQ ID NO: 4862 - DNA, 77 bp, Artificial
  Hairpin sequence MM_from_MQbrain_924, mouse
tggtcttctgtccccactgtggagaggatgcctcagaggcccaggaggtgaccattcctcggggcgatgggggaaca

SEQ ID NO: 4863 - DNA, 64 bp, Artificial
  Hairpin sequence MM_from_MQbrain_937, mouse
gcttggtcccagcaggacctgatggccacgcgtgccttggccacaggaagctgccgagactggc

SEQ ID NO: 4864 - DNA, 115 bp, Artificial
  Hairpin sequence MM_from_MQbrain_957, mouse
ctgtgttttagtttggataaagctcttcattcagcaggaatagattcgggtttcatcatcttcggaactaacctgagcaatccactgaacatgcttttgccgttgttacaaacag

SEQ ID NO: 4865 - DNA, 82 bp, Artificial
  Hairpin sequence MM_from_MQbrain_963, mouse
tgagttacccacccctgccttccattcaggcttctccatgggatcatgagagagcctgatggatgaggctgtgtgtggctca

SEQ ID NO: 4866 - DNA, 95 bp, Artificial
  Hairpin sequence MM_from_MQbrain_964, mouse
acaactttggcattgtggaagggctcatgaccatggtccataccatcactgccacgcagaagactgtggatggcccctctggaaagctgtggtgt

SEQ ID NO: 4867 - DNA, 90 bp, Artificial
  Hairpin sequence MM_from_MQbrain_970, mouse
gtggtgtctgggaagctccaaggacagagggccaagtccatgaagtttgtggatggtctgatgattcacagtggagaccctgttaactac

SEQ ID NO: 4868 - DNA, 99 bp, Artificial
  Hairpin sequence MM_from_MQbrain_984, mouse
catgtcccttacttcttggatgtcctggtgcagagtgtctgggttctcattgagttccaggcgagctttttccaaagtctcaggagagaggccagcttg

SEQ ID NO: 4869 - DNA, 91 bp, Artificial
  Hairpin sequence MM_from_MQbrain_987, mouse
catgcacttgaccaaatcgccttcagccaagctctctctgaccgtggcggtggactcggctccggaggtggcagttaaggtaagtgttttg

SEQ ID NO: 4870 - DNA, 100 bp, Artificial
  Hairpin sequence MM_from_MQbrain_996, mouse
gagactagaaatgaagaatatagagcaaagggtggaggagggaggctggaagagcctggcctctgtaactccccttgcttcttcttcaatgccctatttc

SEQ ID NO: 4871 - DNA, 63 bp, Artificial
  Hairpin sequence MM_from_MQbrain_998, mouse
catgggccttctgggatctgggtgtctacctggcagatttgcccatggcccagaagctacttg

SEQ ID NO: 4872 - DNA, 59 bp, Artificial
  Hairpin sequence MM_from_PT_1, mouse
gcgtgacaagccagtgaccgtggtgcagtctataggcacagaggtcattggcactctgc

SEQ ID NO: 4873 - DNA, 76 bp, Artificial
  Hairpin sequence MM_from_PT_108, mouse
ggtgactgaatcaggaggggtagaggcatccagagatcaactatgacaggtgctcttagctcactgacaggtggcc

SEQ ID NO: 4874 - DNA, 91 bp, Artificial
  Hairpin sequence MM_from_PT_135, mouse
catgggtactgatgccagaattgggaggaatgaacgtctcaacccaagtttaagtcagtcagtcattcttcctggtgggttggtgtccatg

SEQ ID NO: 4875 - DNA, 74 bp, Artificial
  Hairpin sequence MM_from_PT_156, mouse; MM_from_PT_22, mouse
gccttcggggcatcgttaagcatctggagggtctctcagaagaggccatcatggagctgaacctgcccacaggc

SEQ ID NO: 4876 - DNA, 92 bp, Artificial
  Hairpin sequence MM_from_PT_161, mouse; MM_from_PT_235, mouse; MM_from_PT_262, mouse; MM_from_PT_280, mouse
tgccacacaaggccaaactggaagctccaaccgtggtcccggggatagagggaacagagaccactggaaggagttggataggaaggatggca

SEQ ID NO: 4877 - DNA, 68 bp, Artificial
  Hairpin sequence MM_from_PT_195, mouse
gccaactggggttgctgcgctgcctggagtgaacgaaccgcgtgtggggccggcacatcctagcaggc

SEQ ID NO: 4878 - DNA, 108 bp, Artificial
  Hairpin sequence MM_from_PT_21, mouse
tcctgaagcatacaggttctggcatcttgcttatggtaaatgctgggccaaacacaaatggttcacagttttctgtctgcagtgccaagactgagtggcctgacagga

SEQ ID NO: 4879 - DNA, 67 bp, Artificial
  Hairpin sequence MM_from_PT_229, mouse
gctgctcaggggtgcccaaggagttggcaaggatacccccttcctgtcacctcctgaccccttgcgc

SEQ ID NO: 4880 - DNA, 106 bp, Artificial
  Hairpin sequence MM_from_PT_320, mouse
tatctaaatgtgtacagagagattgagcttgaaagctgggtgctgttgctccttttcttggagccaataaacccgtttttacagtctggttatttgtctatgggta

SEQ ID NO: 4881 - DNA, 96 bp, Artificial
  Hairpin sequence MM_from_PT_333, mouse
tggggtaaaacccaggaggcatggaagctgccttggccctggagaagaacctgaaccaggccctcttggatctgcatgccctgggttctgcccgca

SEQ ID NO: 4882 - DNA, 109 bp, Artificial
  Hairpin sequence MM_from_PT_340, mouse
ttgatgattttcacgtgggctgtacatgatgaaaacagtctccctcttctgaatctcgctgaggaaactgcacgtcaccctcctgaaacagccaccctgggaatgttga

SEQ ID NO: 4883 - DNA, 97 bp, Artificial
  Hairpin sequence MM_from_PT_40, mouse
cagagcaggtggcctgaagaatggcttctctgtttacaacacacccaagaagaatctgggaccattgtaatgaggggcacaagcagttccctctctg

SEQ ID NO: 4884 - DNA, 95 bp, Artificial
  Hairpin sequence MM_from_PT_93, mouse
gggggacagcctgacccagagggaggttgctgggtcacgtgctccaatcaaagtggtacaagaagacctagccaggccctcccaggaacacccct

SEQ ID NO: 4885 - DNA, 92 bp, Artificial
  Hairpin sequence MQ_from_HS_10, macaque; MQbrain_2316, macaque
ggcataatgttatactggagagcaggaagagctgtgttgggtataagtaacaggcttttctttatcttctatgtgactctttgcattgtgct

SEQ ID NO: 4886 - DNA, 101 bp, Artificial
  Hairpin sequence MQ_from_HS_101, macaque; MQ_from_HS_102, macaque
aggacccgattcaggagtgagggagagcagggttggagggtcagagccaagtctgactgctgatcctgtctgttctccccaggttgctcttgttctctcct

SEQ ID NO: 4887 - DNA, 76 bp, Artificial
  Hairpin sequence MQ_from_HS_103, macaque
gccaggtctgatggcccagatggcaaccactgcagctggcgtggctgtgggctctgctgtcgggcacacactgggt

SEQ ID NO: 4888 - DNA, 67 bp, Artificial
  Hairpin sequence MQ_from_HS_104, macaque
gcttccgccccgcagccccgaggggtccgagcgcgctggagacccttttcggctgctgggccaacgc

SEQ ID NO: 4889 - DNA, 103 bp, Artificial
  Hairpin sequence MQ_from_HS_106, macaque
ccaacccgtgggaaggcaggtggactccagcagtaggtaggtaatatccaaggtagccatacacagctggtgtttgtgaatctgcacttcccccgggcgatgg

SEQ ID NO: 4890 - DNA, 107 bp, Artificial
  Hairpin sequence MQ_from_HS_110, macaque
tgcgtcacaatgacctggcggacaggtgggagacacagcgtacaccccagggttccctccgtgccgtgcgtagtgcctgttgcttgcttccaggttaaatttctgta

SEQ ID NO: 4891 - DNA, 75 bp, Artificial
  Hairpin sequence MQ_from_HS_112, macaque
ggcaggcaggggaaccccgggagagctgcctcaggaagcactgcagtcctccagcccttcctcccctgcctggcc

SEQ ID NO: 4892 - DNA, 75 bp, Artificial
  Hairpin sequence MQ_from_HS_113, macaque; MQ_from_HSbrain_1413, macaque
cagctgtggcccagtccccaggattcacttggcacggacaacttgctaagtaaagtggggggtggaccatggctg

SEQ ID NO: 4893 - DNA, 92 bp, Artificial
  Hairpin sequence MQ_from_HS_114, macaque; MQ_from_HS_118, macaque
gggcagaggtgggacagtgggctgggaggtggtgaggaggccctttattgaggggccagcttagatcccccagccaccaaggtcctctgtcc

SEQ ID NO: 4894 - DNA, 69 bp, Artificial
  Hairpin sequence MQ_from_HS_116, macaque
gcctctagtgggcgtcttgggtcccggctctattttggactgctggcctgggaaaggctcctcgagtgc

SEQ ID NO: 4895 - DNA, 64 bp, Artificial
  Hairpin sequence MQ_from_HS_12, macaque
tggccggggagggacgctgctcagctgctgctctgctcctgtctcctgtcccctctcccggcca

SEQ ID NO: 4896 - DNA, 78 bp, Artificial
  Hairpin sequence MQ_from_HS_120, macaque
tgcgctcactgcccagccggggccccgggagcctccaggcggagaggctcccgcccgccctgagctgcggcctccgca

SEQ ID NO: 4897 - DNA, 94 bp, Artificial
  Hairpin sequence MQ_from_HS_123, macaque
gccccggtgcggtgcagccgcggatggatgctgcgggaaggggctgccatttgctgcccctgccagcggcgcgcggacctgcccgcgctcctgc

SEQ ID NO: 4898 - DNA, 96 bp, Artificial
  Hairpin sequence MQ_from_HS_124, macaque
atggggtaacaaaaagaacatgggttgagccagacaggtctgggtctgtaggacctcagataaagcacataacccgttggggcttggttttcccat

SEQ ID NO: 4899 - DNA, 89 bp, Artificial
  Hairpin sequence MQ_from_HS_125, macaque; MQbrain_2694, macaque
ctgcacctctgccttgggggtggggggaatggaggcatggaataggtgctctgacctctgaccctctagcccagggagaaggtgagcag

SEQ ID NO: 4900 - DNA, 66 bp, Artificial
  Hairpin sequence MQ_from_HS_126, macaque; MQbrain_2390, macaque
ccagcagtcgtccccgccctgcttcaaacatttgggtttcaggagccgggcggaggtggctgccgg

SEQ ID NO: 4901 - DNA, 83 bp, Artificial
  Hairpin sequence MQ_from_HS_127, macaque
agaaactgctgaagctgccatgtctaagaagaaaactttggagaaaaattttcttcttagacatggcagcgtcaacagtttct

SEQ ID NO: 4902 - DNA, 67 bp, Artificial
  Hairpin sequence MQ_from_HS_128, macaque
ttccgcccccctccagctcccttcctccctggtggacaggtcggaagaggagcggaaaggaaaggaa

SEQ ID NO: 4903 - DNA, 78 bp, Artificial
  Hairpin sequence MQ_from_HS_129, macaque
gaggagtgtttgggggagggaccgaggtcgctgtgtccggggcagagcggccagtgcgccccgagtctgcgctcgttc

SEQ ID NO: 4904 - DNA, 71 bp, Artificial
  Hairpin sequence MQ_from_HS_13, macaque
gtggtgaagatgacctggtcaccgtgtggtccttcactgagggccgcgtggtggctcgaggccacggccac

SEQ ID NO: 4905 - DNA, 86 bp, Artificial
  Hairpin sequence MQ_from_HS_130, macaque
gtaatgccttttgactcatccggttcttggaccaggacgctgtcttgctctgtaagccaggatgagattttattaggctattttac

SEQ ID NO: 4906 - DNA, 100 bp, Artificial
  Hairpin sequence MQ_from_HS_131, macaque
ctgcctgtgagcgcgagcctctttcggctttgcagtctgtcccggtcctttggaacgtggcaaacgtggaagccgagagggttctcgcgagcgttggcag

SEQ ID NO: 4907 - DNA, 107 bp, Artificial
  Hairpin sequence MQ_from_HS_133, macaque
ccgccgggagggagggtaagtgtgagtcccagaggaggtgaggaggaagaggggctcttgcgttctctcgcccgtattcccctggagcagccctaattatttggcgg

SEQ ID NO: 4908 - DNA, 90 bp, Artificial
  Hairpin sequence MQ_from_HS_134, macaque; MQbrain_2538, macaque
tgcagcagttcttcccctcatctgggcctcgccgtctgtctctgtgagtggacatggagaggacgggggcccagcagctggatggctgca

SEQ ID NO: 4909 - DNA, 101 bp, Artificial
  Hairpin sequence MQ_from_HS_135, macaque
gggccttggtggcctgcccagaccagccaggagccaggctggggccaacttagcactcagcatggctcatgatgggtgggtggtgggctgggctcaggcct

SEQ ID NO: 4910 - DNA, 98 bp, Artificial
  Hairpin sequence MQ_from_HS_136, macaque
gggtatgtgggcagggccctggggagctgaggctctgggggtggccggggctgacccctgggcctctgctccccagtgtctgaccgtgaccgcaacct

SEQ ID NO: 4911 - DNA, 104 bp, Artificial
  Hairpin sequence MQ_from_HS_138, macaque
gggaaacaagggcagcgggagaaacggcccggaagggacgaagaagctctcagctttcgccaagtcgcggctcccagtttttccctggaccgccttcctttccc

SEQ ID NO: 4912 - DNA, 87 bp, Artificial
  Hairpin sequence MQ_from_HS_139, macaque
gaatgctcagtgagaggcagaggagcggtaactgccggagctgcgcacagctccgcactccttcctgctccctcacacactggcctc

SEQ ID NO: 4913 - DNA, 94 bp, Artificial
  Hairpin sequence MQ_from_HS_141, macaque; MQbrain_2646, macaque; PT_264, chimp
tgccaaccctactctgggaaggtgccattctgagggccaggagtttgattatgtgtcactctggctgctatggccccctcccagggtctgggca

SEQ ID NO: 4914 - DNA, 77 bp, Artificial
  Hairpin sequence MQ_from_HS_142, macaque
gcccagggcctggagtggagcaaggtggttggtggtacagctttctctccctgcctgccctggccaggccctggagc

SEQ ID NO: 4915 - DNA, 66 bp, Artificial
  Hairpin sequence MQ_from_HS_145, macaque
agcggtggccgggaaggcagggtgccagcacccaaggtgtcttctgttctgccctcctgcctccct

SEQ ID NO: 4916 - DNA, 87 bp, Artificial
  Hairpin sequence MQ_from_HS_146, macaque
gcagcctgggcctgctgaacacttaagggtcgggggttctcagggaatccctgagagctcaaaggatgacctgaggggcctggtggc

SEQ ID NO: 4917 - DNA, 108 bp, Artificial
  Hairpin sequence MQ_from_HS_147, macaque
gcgcgggcgaatgtgcctgcagcgcggcgctgggcggccggtggcgcgcgctcttctggtgggcgcgcaggccggccagctgcgagtaggcactctggcacacctggc

SEQ ID NO: 4918 - DNA, 101 bp, Artificial
  Hairpin sequence MQ_from_HS_148, macaque
ctggaccttcttagggccctggctccatcctgcagatgaggagctctggaaaaggacaaagtcccggaggctgaggagtggagcgggttccaagtgcccag

SEQ ID NO: 4919 - DNA, 55 bp, Artificial
  Hairpin sequence MQ_from_HS_149, macaque
ccgcgcctgctccgctgcttccatcacgttctgaggcctgcggtgcggggcgcgg

SEQ ID NO: 4920 - DNA, 80 bp, Artificial
  Hairpin sequence MQ_from_HS_15, macaque
acccggaagcggatcgcgtggagtgacggtcccaccgcagcggtgagttttgctctgtgttaagtctgcgtgtcgtaggt

SEQ ID NO: 4921 - DNA, 78 bp, Artificial
  Hairpin sequence MQ_from_HS_153, macaque
gctcctggctgccttatgttgatctctggcctgggtaatgaccagaaatctcactggcaggcaggcaggcaggcaagc

SEQ ID NO: 4922 - DNA, 87 bp, Artificial
  Hairpin sequence MQ_from_HS_155, macaque
ctgctgctgctccccacaggggtggccgggccctggaaccgcgaggccacgccacgccggggctcggccaccctccagctgcagcgg

SEQ ID NO: 4923 - DNA, 104 bp, Artificial
  Hairpin sequence MQ_from_HS_156, macaque
aaccttaagggttccttttaagtgatcagttttcccatacatggcagaggcaaaagtttgcagctgccatgggaagaggatgatcagaagggactcctgaggtt

SEQ ID NO: 4924 - DNA, 86 bp, Artificial
  Hairpin sequence MQ_from_HS_157, macaque; MQ_from_HSbrain_1416, macaque
gcctttctggaggaagtggggcaagaaggaggatgcagagctgggccagacatgctcttgcctgccctcttcctccaggtatcggt

SEQ ID NO: 4925 - DNA, 80 bp, Artificial
  Hairpin sequence MQ_from_HS_158, macaque
gggcggtttctccgtttgcctgttttgctgatgtacattcaactcattctcagcaaaataagcaaatggaaaatttgtcc

SEQ ID NO: 4926 - DNA, 101 bp, Artificial
  Hairpin sequence MQ_from_HS_159, macaque
agcagcaaaagccaggtttgtctgactccactaggcccttttgctcccccgcttcttgacagggagaagggctgggagggagaagaaattctgggcctgct

SEQ ID NO: 4927 - DNA, 97 bp, Artificial
  Hairpin sequence MQ_from_HS_16, macaque
gaagatatcgggctgtgaccctctaaagggaagcgctttctgttgtgtgaaagaaaacgaagcgcttctctttggagcgttacagtttgagaagctc

SEQ ID NO: 4928 - DNA, 119 bp, Artificial
  Hairpin sequence MQ_from_HS_160, macaque; MQbrain_2445,MQbrain_2568, macaque
cttcatatcagattctcacctgaatgcatgactcttcaacctcaggacttgcagaattaatggaatgccgtcctaaggttgttgagttgtgcgtttctgggcatttcatctctatggag

SEQ ID NO: 4929 - DNA, 86 bp, Artificial
  Hairpin sequence MQ_from_HS_163, macaque; MQ_from_HSbrain_1407, macaque; MQbrain_2653, macaque
cgtgaccttgcccaggagaaggaggtggcctggagagctgctgtctccagccactgcctgtctccacagtacggcaagaagaaacg

SEQ ID NO: 4930 - DNA, 69 bp, Artificial
  Hairpin sequence MQ_from_HS_164, macaque
ggtagattcccaggggcggtcggaggtgtggactgttcctgccttcatgctctgggaagatgttctacc

SEQ ID NO: 4931 - DNA, 119 bp, Artificial
  Hairpin sequence MQ_from_HS_165, macaque
gcggggccgcgcccaccgccgccacccccaggagcgctggcggctggagtacctcatggagctggacggcggccggcgcggcctggtgtgcggggtgtgcgggggcgcgctggcctcgc

SEQ ID NO: 4932 - DNA, 110 bp, Artificial
  Hairpin sequence MQ_from_HS_167, macaque
tctctactccctcagcttgctctgctaccactttcctgcctctccctctcccaaagcagataaaagatgaggggacaaagactgtgtgtgtctgggaagctgggcagaga

SEQ ID NO: 4933 - DNA, 106 bp, Artificial
  Hairpin sequence MQ_from_HS_168, macaque
tctggcttccccagaccacagaactgtccttgagggccccctgccttggacatggctttgaaggccagctgggggtgatttgaggaggtggatgggggaagagaga

SEQ ID NO: 4934 - DNA, 89 bp, Artificial
  Hairpin sequence MQ_from_HS_169, macaque
ggggctgtagtggtgccagatgagcgagccaaggctctgggtcacttggccctggccctggccctctctcctccatctccacctgccct

SEQ ID NO: 4935 - DNA, 70 bp, Artificial
  Hairpin sequence MQ_from_HS_17, macaque
tccattccgttctcccaccaccgtcgctgtgggtctcagcagctcgggcggagggagaagtggcagcgga

SEQ ID NO: 4936 - DNA, 63 bp, Artificial
  Hairpin sequence MQ_from_HS_170, macaque
gctcgaccctcactccgacccggccaccagtgttgtcggggaggaggaaggacctgtgcgagc

SEQ ID NO: 4937 - DNA, 114 bp, Artificial
  Hairpin sequence MQ_from_HS_172, macaque; MQbrain_2650, macaque
gagagacgaggagttaagagttcattcggctgtccagatgtatccaagtatcctctgttatttggcaataaatacatctgggcaactgactgaacttttcgcttttcatgactc

SEQ ID NO: 4938 - DNA, 79 bp, Artificial
  Hairpin sequence MQ_from_HS_173, macaque
cctgccctgcctccgtcccgcctggcctgacccagccagggctctaggagggttgggtggaggcaaagtggggagcagg

SEQ ID NO: 4939 - DNA, 97 bp, Artificial
  Hairpin sequence MQ_from_HS_174, macaque
gcagggcagggcagcttcacctggctccgcagctcctgagcctgggtgggctaacctgggccaggagtagtgaggtgggtcctgccactgccactgc

SEQ ID NO: 4940 - DNA, 67 bp, Artificial
  Hairpin sequence MQ_from_HS_175, macaque
ctccgtcagcctcctctggcctgtctcctgcagcctcaccgctgcactgaagcccagggctgtggag

SEQ ID NO: 4941 - DNA, 93 bp, Artificial
  Hairpin sequence MQ_from_HS_176, macaque
gagtggctttttcctgcctcccaggctgcccagcggcgccggttgccggggaacgcaggcgccgtggggagggatggcgggaggcggctgctt

SEQ ID NO: 4942 - DNA, 112 bp, Artificial
  Hairpin sequence MQ_from_HS_178, macaque
gagaacgaacttgaggaataaggcttctgtctactactggagacactgatagtgtaaaacccagagtcttcggtaatggacgggagccttatttctatcactcagtgttttc

SEQ ID NO: 4943 - DNA, 88 bp, Artificial
  Hairpin sequence MQ_from_HS_179, macaque
tgaggtagtagtttgaatgggatatggacaggaggcataattgtctctcctttcctcccttaccctccacttccatttctctgcctta

SEQ ID NO: 4944 - DNA, 114 bp, Artificial
  Hairpin sequence MQ_from_HS_180, macaque
gtctagaaatgttgtctccttcatccttgcaacgaacttgagccattgattcagtaaaacattcaatggcacatgcttgttgttaggatcaaaagagataatccatctaaaggc

SEQ ID NO: 4945 - DNA, 78 bp, Artificial
  Hairpin sequence MQ_from_HS_181, macaque
gcctgtctgctgctgagtgattcggggggaacatgtgtgcacacgcacacgtgtttgcccacaccggtgacacagggc

SEQ ID NO: 4946 - DNA, 78 bp, Artificial
  Hairpin sequence MQ_from_HS_182, macaque
gtggacaaccctagggtggggttggaggtgggactgaggctgagtcttcctccccttcctccctgcccaggggtccac

SEQ ID NO: 4947 - DNA, 79 bp, Artificial
  Hairpin sequence MQ_from_HS_183, macaque
accccccggaggaaccgccagcagcgccccggcaccatcaagcatggatcggcgctggacgtgctcctctccatggggt

SEQ ID NO: 4948 - DNA, 93 bp, Artificial
  Hairpin sequence MQ_from_HS_186, macaque
ggggctcctgggaagggcctggctcctcctgcagctgttcctttgctcccttgggcagagaagctggcattcggagccagcctttccagcctc

SEQ ID NO: 4949 - DNA, 118 bp, Artificial
  Hairpin sequence MQ_from_HS_187, macaque
gccctccctgccctcctgcccctcccaggcatccccagcctgtctcaccaagggcctcccccatggcatgggcaacagtctggggccgtctgggggtggggaaggtgccgcagatggc

SEQ ID NO: 4950 - DNA, 67 bp, Artificial
  Hairpin sequence MQ_from_HS_189, macaque
gcagaagcaaatgttgggtgaacggctctttcctcctattcaagccatgcacccgactcttgctggt

SEQ ID NO: 4951 - DNA, 84 bp, Artificial
  Hairpin sequence MQ_from_HS_190, macaque
agtgacgggtggccgtgctgggggcgggagggcttctgttgtaggaagggaggtccgctcggccgggcgcgccgccccagtgct

SEQ ID NO: 4952 - DNA, 111 bp, Artificial
  Hairpin sequence MQ_from_HS_191, macaque; PT_6, chimp
gagcgtccatgggtcagctatgtggactctagctgccaaaggcgcttctccttctgaacagagcgctttgctcagccagtgtagacatggcctgataaacaatggaacttc

SEQ ID NO: 4953 - DNA, 70 bp, Artificial
  Hairpin sequence MQ_from_HS_193, macaque
ggcgcccgcggcggctgtggcggcctgagcgcgatgctccgggttctcggcggcggctgtggccttggcc

SEQ ID NO: 4954 - DNA, 64 bp, Artificial
  Hairpin sequence MQ_from_HS_194, macaque; MQbrain_2633, macaque
gtgggggcgggagccggggtctgcaggtttgcactgatgcctgctcgccctgtctcccaccagc

SEQ ID NO: 4955 - DNA, 98 bp, Artificial
  Hairpin sequence MQ_from_HS_195, macaque
ttgttgctttcctatgagattccctcagcgattcaaaaacacaaaagctaggcagtggttgtatttgggaaggtgagggaagagagagaatggaacag

SEQ ID NO: 4956 - DNA, 104 bp, Artificial
  Hairpin sequence MQ_from_HS_197, macaque
tccggggtcgcggatctgcccgccccgctctcccgaagctcttcgggtagtgtccgaacggcttcggaggggcgagaagccggcatctgaaccgcctctccgga

SEQ ID NO: 4957 - DNA, 103 bp, Artificial
  Hairpin sequence MQ_from_HS_198, macaque
gcctgagacagtgcagggagaaggtggaagtgcagagtgggctctgcggtggccatgctcacctctcgcccatgctgtccccttctccccagcgagctgaggc

SEQ ID NO: 4958 - DNA, 112 bp, Artificial
  Hairpin sequence MQ_from_HS_199, macaque
ggcaaacatatttcataaacatatgttcatgcactccaaaaatgtcccatggttttgccttaccatgggacatttttggttggcagtagcgtgggtgggtgtggtgggtgcc

SEQ ID NO: 4959 - DNA, 102 bp, Artificial
  Hairpin sequence MQ_from_HS_2, macaque; MQbrain_2302, macaque
ccagcggagagccaggagggagagctgggaggcggtcggttctgagtcatcgcagcctatgtcacttctcagaaacctccacccccccatcccggcccctgg

SEQ ID NO: 4960 - DNA, 79 bp, Artificial
  Hairpin sequence MQ_from_HS_20, macaque
tcgcctcccaacccgcgttgccctcgcgccttcgccctgggtaggtgaggccgaggaggcaaccgcgaaaaggaggcgg

SEQ ID NO: 4961 - DNA, 97 bp, Artificial
  Hairpin sequence MQ_from_HS_201, macaque
ggaggctgtggtttgccagggcaggaggtggaagggagcaccatttacaggggtaacttccttaccctttccatcctggcaggctgcagagaacttt

SEQ ID NO: 4962 - DNA, 98 bp, Artificial
  Hairpin sequence MQ_from_HS_202, macaque
ggacattgttttgacagataaagtaggcattcgataaattgaaacaggttttgaattattttgagggaatgtgtactacatctgtctgctgatattcc

SEQ ID NO: 4963 - DNA, 112 bp, Artificial
  Hairpin sequence MQ_from_HS_204, macaque
cttcctggtatccaagtaagaaagatatatagttctggaataacaggaaacttcacgtttttcacatcctgttattctgggttttgtgacttgctgccttgccactatgaag

SEQ ID NO: 4964 - DNA, 72 bp, Artificial
  Hairpin sequence MQ_from_HS_206, macaque
tctcggaagctggcagagcaggagctgattgagaccagcgagcgggtgcagctgctgcattcccaggtgaga

SEQ ID NO: 4965 - DNA, 81 bp, Artificial
  Hairpin sequence MQ_from_HS_207, macaque; PT_from_HS_207, chimp
tctcctctcagggaagctttttgctcgaattatgtttctgatccgaatataagacgaacaaaaggtttgtctgagggcaga

SEQ ID NO: 4966 - DNA, 92 bp, Artificial
  Hairpin sequence MQ_from_HS_208, macaque
ctatgccacctgctgagctcctgggtgtcactggagagcctcacactctcctacaatggtgagcaccctggagtggcagggattgggcttgg

SEQ ID NO: 4967 - DNA, 119 bp, Artificial
  Hairpin sequence MQ_from_HS_209, macaque
ctgggaaccatggggaggccagctcatctacagagtcattttgattcctggccatggagccctcgaatgccagggtcaaggatggctcagttcagccgggctccaaaagagtggaccag

SEQ ID NO: 4968 - DNA, 104 bp, Artificial
  Hairpin sequence MQ_from_HS_21, macaque
tagaagttcagaagagggctaggcggagccgaacccacatccgggagaggcgaggagagcggaagtggcgttggtctggccggagcccttgggtgaaattgtta

SEQ ID NO: 4969 - DNA, 72 bp, Artificial
  Hairpin sequence MQ_from_HS_211, macaque
gtgcacgctctaggggggattccaatattgcggggattggcccaatattggaatccaacctagagcgtgcac

SEQ ID NO: 4970 - DNA, 112 bp, Artificial
  Hairpin sequence MQ_from_HS_212, macaque; MQbrain_2518,MQbrain_2519, macaque
tcttcgagccactctttggtacttgaagagaggataccctttgtatgttcacttgattaatggtgaatatacagggggagactcttatttgcgtatcaaactctgtcgggga

SEQ ID NO: 4971 - DNA, 112 bp, Artificial
  Hairpin sequence MQ_from_HS_213, macaque; MQ_from_HSbrain_1337, macaque
tcttcgagccgctctttggtacttgaagagaggataccctttgtatgttcacttgattaatggtgaatatacagggggagactcttatttgcgtatcaaactctgtcgggga

SEQ ID NO: 4972 - DNA, 102 bp, Artificial
  Hairpin sequence MQ_from_HS_216, macaque
gctcatgccaacgtcagggaaaggattctgctgtcggtcccactccaaagtgcatagaatgggtggtgggcacagaatccggactctgcttgtggcatctgt

SEQ ID NO: 4973 - DNA, 102 bp, Artificial
  Hairpin sequence MQ_from_HS_217, macaque
gctcctatcagggaagagatcagcatctgtgtcagtcttctgtacggctccatgggattaaaggaagcaatgacatcctgatctgttccttgatctttgggc

SEQ ID NO: 4974 - DNA, 80 bp, Artificial
  Hairpin sequence MQ_from_HS_218, macaque
gtcctttctggcctcccacccacagtgtgagtccaagggaagtatggacttgccctatggctgggagcccaggaaggtgc

SEQ ID NO: 4975 - DNA, 68 bp, Artificial
  Hairpin sequence MQ_from_HS_220, macaque; MQ_from_HS_223, macaque; MQ_from_HS_225, macaque; MQ_from_HS_229, macaque; MQ_from_HS_235, macaque; MQ_from_HS_237, macaque
gggtgccagctccagcatcactggcagcagacgttcccggtcttgccatggtccaggccctggtgtcc

SEQ ID NO: 4976 - DNA, 63 bp, Artificial
  Hairpin sequence MQ_from_HS_228, macaque
tgtgctttgctggccaaggttgggatcttagggttctctgtgatcctagcttgcctgagtgta

SEQ ID NO: 4977 - DNA, 91 bp, Artificial
  Hairpin sequence MQ_from_HS_23, macaque
aagaaagcatcacttaacataaactgcacatctgcacatcactgcacgcctggtgtgcaggcatgcagtttatgttgagtgatgctttctt

SEQ ID NO: 4978 - DNA, 87 bp, Artificial
  Hairpin sequence MQ_from_HS_239, macaque
gctggtgcgcgtgacggcgctggagcaggggctcgtaccgtagcggggcagggctccggtcagagccgccgtgtgggacagccaggc

SEQ ID NO: 4979 - DNA, 68 bp, Artificial
  Hairpin sequence MQ_from_HS_24, macaque
ccctctgtccacatgtcatgaaggagagattttgtgatgatgcctcagacagtgaagggagcagaggg

SEQ ID NO: 4980 - DNA, 79 bp, Artificial
  Hairpin sequence MQ_from_HS_240, macaque
cggtctacagctcccagcggcctcaggccacgctcccaggatcccctgggactggcccagggctattggggggtggctg

SEQ ID NO: 4981 - DNA, 72 bp, Artificial
  Hairpin sequence MQ_from_HS_241, macaque
aggtggctccaaggtgagcccactcctcccctaaatataagggagggccctgggaccctgtctgctgttcct

SEQ ID NO: 4982 - DNA, 60 bp, Artificial
  Hairpin sequence MQ_from_HS_243, macaque
gcacggcagggtgaaggcccggcggagacactctgcccaccccacaccctgcctatgggc

SEQ ID NO: 4983 - DNA, 71 bp, Artificial
  Hairpin sequence MQ_from_HS_25, macaque
ccgcccccggccccactccgccttcctcccaccccgcgaacccggaagtggaggaggaggcgcggcggcgg

SEQ ID NO: 4984 - DNA, 109 bp, Artificial
  Hairpin sequence MQ_from_HS_250, macaque
ggcttccgcgccaggagcggggctgggggcggcgccatggggccttgcagccccgatcggcggccgccaggtccctggggccgccgtctccccgctcccggcctcagct

SEQ ID NO: 4985 - DNA, 80 bp, Artificial
  Hairpin sequence MQ_from_HS_254, macaque
gcgcggagctgttcgccgctccaggtgctgagtctgagggaggctccggacccgagagcggcgagagcagccgccgctgc

SEQ ID NO: 4986 - DNA, 69 bp, Artificial
  Hairpin sequence MQ_from_HS_255, macaque; MQbrain_2596, macaque
tctggttcggtctctggcccgagggaagccggtcttttccggctgacctcgcggccagggctggtcgga

SEQ ID NO: 4987 - DNA, 119 bp, Artificial
  Hairpin sequence MQ_from_HS_257, macaque
ccgccacctcctccggccacttagcccgctcttctggccccgccccacgccagcggggtccgcctcgcgctacgcgtaggaaggcggggcctcggggcgagacgccggagctagtccgg

SEQ ID NO: 4988 - DNA, 78 bp, Artificial
  Hairpin sequence MQ_from_HS_258, macaque; PT_from_HS_258, chimp
cgctttggccatggagcgggatggctccagtggaggagtgatccgcctggcagccattgcagagtcaggggtagagcg

SEQ ID NO: 4989 - DNA, 94 bp, Artificial
  Hairpin sequence MQ_from_HS_259, macaque; MQ_from_MM_159, macaque; MQbrain_2602, macaque
ggcgcggggcgcgtcgcccccctcagtccaccagagcccggatacctcagaaattcggctctgggtctgtggggagcgaaatgcaacccaaacc

SEQ ID NO: 4990 - DNA, 97 bp, Artificial
  Hairpin sequence MQ_from_HS_26, macaque; MQ_from_PT_25, macaque
ggcaagggtagccattgtttgggttggggtggtgggccctggagggggtttgtttgctcattctcctctgtgcttaacccctacccagcttcccgcc

SEQ ID NO: 4991 - DNA, 71 bp, Artificial
  Hairpin sequence MQ_from_HS_261, macaque
cagagtggccagtgacaagccccaggctctgaggctgctggcctttatcctgtgctgtgctgccccttttg

SEQ ID NO: 4992 - DNA, 112 bp, Artificial
  Hairpin sequence MQ_from_HS_262, macaque; MQbrain_2605, macaque; PT_from_HS_262, chimp; PT_from_HSbrain_1406, chimp
tggaaccttcctgaaagaggttggggcaggcagtgactgttcagacgtccaatctctttgggacacctcttcagcgctgtcttccctgcctctgcctttaggacgagtctca

SEQ ID NO: 4993 - DNA, 100 bp, Artificial
  Hairpin sequence MQ_from_HS_263, macaque
cctcctcctcccctgtcccctggaagcagcggcccggactcccggctcccgtccctggcggcgccgtggagctcgacgcccgggggtgggggccgaccgg

SEQ ID NO: 4994 - DNA, 82 bp, Artificial
  Hairpin sequence MQ_from_HS_266, macaque
ggttctgtcttgggtcacttggatctgaaggctgcccctttgctctctggggtagccttcagatcttggtgttttgattact

SEQ ID NO: 4995 - DNA, 106 bp, Artificial
  Hairpin sequence MQ_from_HS_268, macaque
tatatatctgaatgtatatttgctcaagactaaactgtaggcttttctctactgcacgctgttgagaacagcctacagtttagttgggagcaaatacaggcttata

SEQ ID NO: 4996 - DNA, 111 bp, Artificial
  Hairpin sequence MQ_from_HS_279, macaque; MQ_from_HSbrain_1066, macaque
gcatcctcaggacctaggcttgggtggtaggaggaattggtgctggtctttcattttggatttgactccaaccccacagcctcagccatcccagccaattgtcataggagc

SEQ ID NO: 4997 - DNA, 109 bp, Artificial
  Hairpin sequence MQ_from_HS_281, macaque; MQbrain_2651, macaque
gcttttatattgtaggtttttgctcatgcaccatggttgtctgagcatgcagcatgcttgtctgctcataccccatggtttctgagcaggaatcttcattgtctactgc

SEQ ID NO: 4998 - DNA, 118 bp, Artificial
  Hairpin sequence MQ_from_HS_284, macaque
gaactgggaggaggagttggaggccggagggagcccgcgctcggggcggcggctggaggtaaccccctgcaccgagctggaaaggcgggccacctctgtcttcactcctctctggatc

SEQ ID NO: 4999 - DNA, 97 bp, Artificial
  Hairpin sequence MQ_from_HS_285, macaque
aggagccaccttccgagcctccagtaccacgtgtcatggccacatgagctgggcctcgtgggcctgatgtggtgctggggcctcaaggtctgctctt

SEQ ID NO: 5000 - DNA, 88 bp, Artificial
  Hairpin sequence MQ_from_HS_286, macaque; MQbrain_2641, macaque
gcctggatacgtgagatggttgaccagagagcacacgctttatatgtgccgtttgtgacctggtccactacccctcagtatctaatgc

SEQ ID NO: 5001 - DNA, 112 bp, Artificial
  Hairpin sequence MQ_from_HS_287, macaque; MQ_from_HS_288, macaque; MQ_from_HS_289, macaque; MQ_from_HS_290, macaque; MQ_from_HSbrain_1360, macaque; MQ_from_HSbrain_1362, macaque; MQ_from_HSbrain_1363, macaque; MQ_from_HSbrain_1364, macaque
gcgacccggagacgcgtggggcggaacttccggacgccccgccctgctgccgatcctgcggagctgagggtgaagccttcggatgcccgtccctcatcgctggcccggtcgc

SEQ ID NO: 5002 - DNA, 100 bp, Artificial
  Hairpin sequence MQ_from_HS_29, macaque
gggtctctctctgtcctctgatttgtgcttggctgaggagaatgaagggtttttgcagtccttgaaggctctaggatcattgggggatggggaaaattcc

SEQ ID NO: 5003 - DNA, 104 bp, Artificial
  Hairpin sequence MQ_from_HS_291, macaque; MQ_from_HSbrain_1437, macaque
ctgtgctttgtgtgttggaggatgaaagtacggagtgatccatcggctaagtgtcttatcacaatgctgacactcaaactgctgacagcacacgtttttcacag

SEQ ID NO: 5004 - DNA, 104 bp, Artificial
  Hairpin sequence MQ_from_HS_292, macaque; MQbrain_2154, macaque
tgtttatcaccagatcctagaaccctatcaatattgtctctgctgtgtaaatagttctgagtagtgcaatattgcttatagggttttggtgtttgggaagaaca

SEQ ID NO: 5005 - DNA, 119 bp, Artificial
  Hairpin sequence MQ_from_HS_298, macaque
gctttggtgctgattcctgggctctgacctgagacctctgggttctgagctgtgatgttgctctcgagctggggatctccggggtcttggttcagggccggggcctctgggttccaagc

SEQ ID NO: 5006 - DNA, 89 bp, Artificial
  Hairpin sequence MQ_from_HS_3, macaque
gcatggtagggcccggggcaggggacggggtgggtggagggtagcagtgcctcatctaatccaccctcctcctgcccggcccccagggc

SEQ ID NO: 5007 - DNA, 71 bp, Artificial
  Hairpin sequence MQ_from_HS_303, macaque; PT_124, chimp; PT_from_HS_303, chimp
gtctccaccacctcccctgcaaacgtccagtggtgcagaggtaatggacgttggctctggtggtgatggac

SEQ ID NO: 5008 - DNA, 95 bp, Artificial
  Hairpin sequence MQ_from_HS_305, macaque; MQ_from_HSbrain_1425, macaque
gcgaccggccttgcagagtcgagagtgggagaagagcgaagcgtgtgagcagcactacggcctcctctcctcctaacctcgctctcgcggcctgc

SEQ ID NO: 5009 - DNA, 87 bp, Artificial
  Hairpin sequence MQ_from_HS_307, macaque; PT_316, chimp
ctgtgaagtgctgtggatttctttgtgaatcaccatatctaagctaatgtggtggtggtttacaaagtaattcatagtgcttcacag

SEQ ID NO: 5010 - DNA, 74 bp, Artificial
  Hairpin sequence MQ_from_HS_31, macaque
agtggagcgggtgagatggaatttcctagaggtccagacatttaggacccggacccatctcacccgctgcctct

SEQ ID NO: 5011 - DNA, 85 bp, Artificial
  Hairpin sequence MQ_from_HS_33, macaque; MQ_from_HS_34, macaque
tctctgtgtgggtctatgtgtgcccgacccctcccctgctaaccatggatgctggggggtctgggcacactcaccagcaccggga

SEQ ID NO: 5012 - DNA, 106 bp, Artificial
  Hairpin sequence MQ_from_HS_36, macaque
gcactttgtagcctgtagggggcagcctgtgaggagagacagacgctttggagtccacagattttagtcttaaattccaggccctgcaccttgcggggatttgtgt

SEQ ID NO: 5013 - DNA, 90 bp, Artificial
  Hairpin sequence MQ_from_HS_38, macaque
tgaggggtaagtttaggcttcgcggaggggaggagacatggagcctgggaactccttgttctcccctctgctgcctctctccacccctta

SEQ ID NO: 5014 - DNA, 106 bp, Artificial
  Hairpin sequence MQ_from_HS_39, macaque
gggctgatgaaagtggagttcagtagacaacccttttcaagccctgcaagaaactggggtttctggaggagagggaaggtgctgaaggggctgctctcgtgagcct

SEQ ID NO: 5015 - DNA, 109 bp, Artificial
  Hairpin sequence MQ_from_HS_41, macaque
ggtaaacttactcaaaggaactcagtcccagctctccccacaggcctatgtgagaaggactttgtggagggggagatggagcatgaagtcctgatgaggaactgcagcc

SEQ ID NO: 5016 - DNA, 113 bp, Artificial
  Hairpin sequence MQ_from_HS_42, macaque
agaaaataacattgtcagacgtgtcatccccagatacagtggacaatatgctattataattgtatggcattgtccttgctgtttggagataatactgctgactttattcctct

SEQ ID NO: 5017 - DNA, 113 bp, Artificial
  Hairpin sequence MQ_from_HS_43, macaque
gaggaaaagtgtgttggacactgaaggcctgaactgtcagcattattgttctccaaagctttggaagaacaatgctctgctgagccttcagtaatcactatacatgactactc

SEQ ID NO: 5018 - DNA, 72 bp, Artificial
  Hairpin sequence MQ_from_HS_44, macaque
ggggaaaagagctaggaaagagctgcaaagcagtgtgggctttttcctttttttgctccttttcattacccc

SEQ ID NO: 5019 - DNA, 59 bp, Artificial
  Hairpin sequence MQ_from_HS_45, macaque
ggtgcagagcctgcatctcagggattatccaaggcacccttgggtgcagtgttcacacc

SEQ ID NO: 5020 - DNA, 101 bp, Artificial
  Hairpin sequence MQ_from_HS_49, macaque
ctctgccctccacccggtgctttgccagctgccatgagaaaggaggtggctgcttctctctctctttggcgactggacctgcctggggtggagaggtggag

SEQ ID NO: 5021 - DNA, 75 bp, Artificial
  Hairpin sequence MQ_from_HS_54, macaque
agtcgctgggaaggaaggagacgcctaaaccgcggcactgcccggtttgagcgtagccaaacctgcccgccggct

SEQ ID NO: 5022 - DNA, 71 bp, Artificial
  Hairpin sequence MQ_from_HS_55, macaque
ggagcctcgcagggtcggggcggaggctgatcctcctcagccctccctgccctgccctgtgtgttggcttt

SEQ ID NO: 5023 - DNA, 65 bp, Artificial
  Hairpin sequence MQ_from_HS_58, macaque
aggggaccttggtttgaggaggcacctgtgtgatgggggctttgtgaggaagctgaggtacccct

SEQ ID NO: 5024 - DNA, 99 bp, Artificial
  Hairpin sequence MQ_from_HS_59, macaque
ggttaattgtgctccaaccaatggctcaaggttcaagaaggccaatgctgtgagcacaggccttctcgagccttgagtgtgctggtgagcacgaagact

SEQ ID NO: 5025 - DNA, 78 bp, Artificial
  Hairpin sequence MQ_from_HS_6, macaque
gcaatcactgtgggttgtgggttggggtgatgtgcaagcctgacctctcccaacacccccctgcccacagacgaaggc

SEQ ID NO: 5026 - DNA, 78 bp, Artificial
  Hairpin sequence MQ_from_HS_60, macaque
ggactctgaattgtactggaaaattcattggaattttcctgagggaaaattctggaatgtgatccatattctgggttc

SEQ ID NO: 5027 - DNA, 87 bp, Artificial
  Hairpin sequence MQ_from_HS_61, macaque; MQ_from_HSbrain_1411, macaque
gagaaacactttaccattttagaggtgtttgttatgttttggacatagaaacataaaaaacacctgcaaaatagcaaagtgtttctc

SEQ ID NO: 5028 - DNA, 94 bp, Artificial
  Hairpin sequence MQ_from_HS_64, macaque
acaaggcatctggggggcaggggcaggcggtggaggttgtggctctgctagctttctccctctccctcctggcttctaccccctggacgtgtgt

SEQ ID NO: 5029 - DNA, 67 bp, Artificial
  Hairpin sequence MQ_from_HS_65, macaque
gaggggagagggaaaagaaaaggcatgaaaatatctatagagccatttctggtgtcctccttccctt

SEQ ID NO: 5030 - DNA, 54 bp, Artificial
  Hairpin sequence MQ_from_HS_7, macaque
ggggcctcctgcccagacttgaagccacacaggcaggtctggcagggaggtctc

SEQ ID NO: 5031 - DNA, 76 bp, Artificial
  Hairpin sequence MQ_from_HS_70, macaque
tcattcccacttgtcccacactggagtttggggaaccattctcccgtctctccactgtggagctgcgttcctgtga

SEQ ID NO: 5032 - DNA, 76 bp, Artificial
  Hairpin sequence MQ_from_HS_74, macaque
gctgcgctccagggtgctgaggcgaccggaaaggcggccaggatcttccggtcgcccggcccaccacccacccagt

SEQ ID NO: 5033 - DNA, 70 bp, Artificial
  Hairpin sequence MQ_from_HS_76, macaque
ggaagggggaaaggaggaggatccttgaaacacctggcgcccacggtcccactccttctcctcctcagcc

SEQ ID NO: 5034 - DNA, 102 bp, Artificial
  Hairpin sequence MQ_from_HS_78, macaque
ggcggcggcggcggcggaggaccggatggcagaggaaggaggcggcagccacggcgacggcggctcctctttggcctccggctctacccagcgacagccccc

SEQ ID NO: 5035 - DNA, 96 bp, Artificial
  Hairpin sequence MQ_from_HS_8, macaque
ggcgcacgcccgggtggagtgggtcaggcagggccagtcccaaacacagctctctgctgactgcccaccttgcccacagcttggtctggaggtgtc

SEQ ID NO: 5036 - DNA, 96 bp, Artificial
  Hairpin sequence MQ_from_HS_82, macaque
gagcccccccttagggtggtcctgaccagggctggcaggggcaagtgtggacgcccggccccttgcccaggctggagccactctgagggacaactc

SEQ ID NO: 5037 - DNA, 96 bp, Artificial
  Hairpin sequence MQ_from_HS_83, macaque
ggcttggggaggtggggttgcgggggtttgagctgtatgtgatcagaagggaagggcttcatctctacgctctgcctccactgcctcttccccacc

SEQ ID NO: 5038 - DNA, 95 bp, Artificial
  Hairpin sequence MQ_from_HS_84, macaque
tttttgtgcttaaattgtaatgtgcacagaatgtggagaaataggactatattcttatgctaatgattctgatgacactgacaattgtataaaaa

SEQ ID NO: 5039 - DNA, 64 bp, Artificial
  Hairpin sequence MQ_from_HS_88, macaque
cgcggagttgggtccgctgcgagaggcagaaacgccagcctcctccagcggatccggctcctcg

SEQ ID NO: 5040 - DNA, 72 bp, Artificial
  Hairpin sequence MQ_from_HS_9, macaque
gtgtcaaatggggtggggccgagtgggctggggccaagcaggacccctgacctcactcccacccctagacat

SEQ ID NO: 5041 - DNA, 98 bp, Artificial
  Hairpin sequence MQ_from_HS_91, macaque
atccgtcgcagcagtagctgcagccgctgcagcccgagctgactgagagggcgggaggcagctcgggtggcggggcggggcgaacagcgcggccggat

SEQ ID NO: 5042 - DNA, 83 bp, Artificial
  Hairpin sequence MQ_from_HS_93, macaque
ggcgcagagcctgccgggagttgtagtccagtgccccgggaactcctacggactggactacaatgaccagcgtgccccgcgct

SEQ ID NO: 5043 - DNA, 87 bp, Artificial
  Hairpin sequence MQ_from_HS_94, macaque
gtctcccgccccttatcccatccagttccgcaattcacactcgttgccaaagagtggggagcggtaatggatacacccgggaacgac

SEQ ID NO: 5044 - DNA, 105 bp, Artificial
  Hairpin sequence MQ_from_HS_97, macaque
tgaggacagcaggggctctaatcttggctctgctgctcgtcctgcagtggcactccctgacacacattaggtgttcagcagagaccagacctgcctcctccctca

SEQ ID NO: 5045 - DNA, 103 bp, Artificial
  Hairpin sequence MQ_from_HS_99, macaque; MQ_from_HSbrain_1178, macaque
ggatgatttggaggagcaaagcagcaattgttctttggtctttcagccatgacctgaccttctgtctgtgagaccaaagaactactttgcttggccaccatct

SEQ ID NO: 5046 - DNA, 64 bp, Artificial
  Hairpin sequence MQ_from_HSbrain_1, macaque
tgtgcttgcgcataactggggccgcttggccccccgcgggcggcccttttaaccgcgagcgaca

SEQ ID NO: 5047 - DNA, 82 bp, Artificial
  Hairpin sequence MQ_from_HSbrain_10, macaque
ttggaggggcgggggtgggggtgtcagggccaaggcaaaacctctggaccgtagagagctcctgagccaccctgccccccaa

SEQ ID NO: 5048 - DNA, 114 bp, Artificial
  Hairpin sequence MQ_from_HSbrain_101, macaque; MQbrain_2564, macaque
ctctgaccgggttgcattttagtctttcgtttttggggtttggcaaaggtacatttacctaggttgatggtaaagtcaaagatgggggagggggggttgcagattcagtcagag

SEQ ID NO: 5049 - DNA, 105 bp, Artificial
  Hairpin sequence MQ_from_HSbrain_103, macaque
ggcctcactgtctaccttccagcagatgtggatcagcaagcaggagtaagacaagtcgggcccctccattgtctaccacaaatgcttctaaacggactgtgagcc

SEQ ID NO: 5050 - DNA, 101 bp, Artificial
  Hairpin sequence MQ_from_HSbrain_104, macaque; MQ_from_HSbrain_105, macaque; MQ_from_HSbrain_107, macaque; MQ_from_HSbrain_108, macaque; MQ_from_HSbrain_153, macaque
cctcgctgtccactttccagtagatgtggattaggaagcaggagtaccacgagtcaggcccctccatcatccaccacaaatgcttctaaatggactgcagg

SEQ ID NO: 5051 - DNA, 77 bp, Artificial
  Hairpin sequence MQ_from_HSbrain_109, macaque
gccccacccggtgaggatatggcagggaagaggagtttccctctgtccccttcccccagtaatcttcatcatgcagc

SEQ ID NO: 5052 - DNA, 71 bp, Artificial
  Hairpin sequence MQ_from_HSbrain_111, macaque; MQ_from_HSbrain_16, macaque; MQ_from_HSbrain_214, macaque; MQ_from_HSbrain_238, macaque; MQ_from_HSbrain_394, macaque; MQ_from_HSbrain_706, macaque
gcacttcttcatgcccggctttgccccactgaccagccggggcagccagcagtaccgggccctgaccgtgc

SEQ ID NO: 5053 - DNA, 77 bp, Artificial
  Hairpin sequence MQ_from_HSbrain_118, macaque
ctgagctctgtgtctgacttccagcagatgcggctctgcagaggctggctgctgtgctggcgggctatggggtagag

SEQ ID NO: 5054 - DNA, 82 bp, Artificial
  Hairpin sequence MQ_from_HSbrain_124, macaque
ttcttgaggccaggctgtggctgtggagtgcatgggaggccccaggggccggtgctgctcagtgactaactggccataggga

SEQ ID NO: 5055 - DNA, 97 bp, Artificial
  Hairpin sequence MQ_from_HSbrain_1247, macaque
ggaccttcttagggccctggctccatcctgcagatgaggagctctggaaaaggacaaagtcccggaggctgaggagtggagcgggttccaagtgccc

SEQ ID NO: 5056 - DNA, 78 bp, Artificial
  Hairpin sequence MQ_from_HSbrain_125, macaque
tgcccattccattcacccctcactgcacctgccctagaacctgggcctaggccacaggggcagggagaagagaaggca

SEQ ID NO: 5057 - DNA, 117 bp, Artificial
  Hairpin sequence MQ_from_HSbrain_132, macaque
ggcagctgccctcactaaggtgtcgttcccacagctacctcgggctcgggctgatgtcggcacgcctggcgatcctgggcggcgtggaggggcagcctggtgagtggacatgttgcc

SEQ ID NO: 5058 - DNA, 71 bp, Artificial
  Hairpin sequence MQ_from_HSbrain_133, macaque
agccttttattgagtggggcaagtgctgggccgtggtcgtgccctgatagcatctgtcccaggcagtggct

SEQ ID NO: 5059 - DNA, 115 bp, Artificial
  Hairpin sequence MQ_from_HSbrain_137, macaque
cggagctgcagctgctggagaaggtgcccacgctggagcggctgcgggccgcccagaagcgccgggcccagcagctgaagaagtgggcacagtacgagcaggacttgcagcaccg

SEQ ID NO: 5060 - DNA, 83 bp, Artificial
  Hairpin sequence MQ_from_HSbrain_139, macaque
cggaatgaggatggggtgagatggggaggagcagccagtcctgtctcaccgctcttcccctgaccccaggttcccagtctccg

SEQ ID NO: 5061 - DNA, 74 bp, Artificial
  Hairpin sequence MQ_from_HSbrain_1399, macaque
gcaatcactgtgggttgtgggttggggtgatgtgcaagcctgaccctccccaacccctgcccacagacgaaggc

SEQ ID NO: 5062 - DNA, 115 bp, Artificial
  Hairpin sequence MQ_from_HSbrain_1401, macaque
ctggagcaagaacatcccaggctgtgactctacaaaggaaagcactttctgttgtcgaaagaaaagaaagcgcttcccttttgagaattacggtttgagaaaagcagtgttgaag

SEQ ID NO: 5063 - DNA, 55 bp, Artificial
  Hairpin sequence MQ_from_HSbrain_141, macaque
ctttttactctgttgtctcagccgcactggggcggaggcagtcaagggtgagaag

SEQ ID NO: 5064 - DNA, 105 bp, Artificial
  Hairpin sequence MQ_from_HSbrain_1410, macaque
gggttaattgtgctccaaccaatggctcaaggttcaagaaggccaatgctgtgagcacaggccttctcgagccttgagtgtgctggtgagcacgaagactgtccc

SEQ ID NO: 5065 - DNA, 102 bp, Artificial
  Hairpin sequence MQ_from_HSbrain_1426, macaque
tgaatgtccccactagcccagggcctggagtggagcaaggtggttggtggtacagctttctctccctgcctgccctggccaggccctggagcggctgattca

SEQ ID NO: 5066 - DNA, 112 bp, Artificial
  Hairpin sequence MQ_from_HSbrain_150, macaque
tcctggttcaagcagtgttctttctctgtcaggcctggtggctgttgtgtggggctccccaaggcaaggggtggccctgggccggtgggttggaagacagggtgaccagaga

SEQ ID NO: 5067 - DNA, 90 bp, Artificial
  Hairpin sequence MQ_from_HSbrain_151, macaque
ctggtgtgaggggaaggggagagtaaggacatgttgaaagatcccaatggcttgtctcatgatgacctctcccttcctgccctggcctgg

SEQ ID NO: 5068 - DNA, 84 bp, Artificial
  Hairpin sequence MQ_from_HSbrain_154, macaque
gactatatcctgggttccagaaaaggcagaggttcttgccgaaagcaggtaagtgtcttgtctgtctgcatccagctaagagtt

SEQ ID NO: 5069 - DNA, 98 bp, Artificial
  Hairpin sequence MQ_from_HSbrain_157, macaque
cctcctggacccctgccctccctgcccggccttccaaggcccggcagcctcagtccactgctgggcctggaacacggagcagtggctgccctgagagg

SEQ ID NO: 5070 - DNA, 83 bp, Artificial
  Hairpin sequence MQ_from_HSbrain_162, macaque
cccttaggggatagggtgcaagggaaatgggacagaatgggtgtttttcctccgtcttcctcttcccattctcctcttttggg

SEQ ID NO: 5071 - DNA, 98 bp, Artificial
  Hairpin sequence MQ_from_HSbrain_165, macaque
ggccaggccccacccacaaaagtcagggactctgggcacagtcagtgatgagaggctgtgccagagaccccctgacagtggcgagtggagttagagct

SEQ ID NO: 5072 - DNA, 90 bp, Artificial
  Hairpin sequence MQ_from_HSbrain_168, macaque
gcactgtcatgggtgctgaaatctaacatgttcttgtcgcactgggtgagaagatgacagaggaaaaagtagagatactggtgacagggc

SEQ ID NO: 5073 - DNA, 99 bp, Artificial
  Hairpin sequence MQ_from_HSbrain_172, macaque
gccagcaagacatgggcctcagtttccaaaccctgacacctctcatttaaccagaagacgtggaggggtgagttggagatggggacttggttggggggt

SEQ ID NO: 5074 - DNA, 78 bp, Artificial
  Hairpin sequence MQ_from_HSbrain_173, macaque
ccctctgtactgatgtgggatactttatttcaggtctggaggcttgaagagaagtgagtctccaggaagttagatggg

SEQ ID NO: 5075 - DNA, 88 bp, Artificial
  Hairpin sequence MQ_from_HSbrain_175, macaque
ttttctaggtatgggaggacatggctatggtggagctggtgatgcaagttcaggttttcatggtggtcatttcgtacatatgagaggg

SEQ ID NO: 5076 - DNA, 99 bp, Artificial
  Hairpin sequence MQ_from_HSbrain_178, macaque
ggcgggctcgggctgcggcgcggcgctgcagttgcggtggcagaaggcctcgctgtcgcgcagcaggcggtgcagccgcaggctgatctccaggtagcc

SEQ ID NO: 5077 - DNA, 98 bp, Artificial
  Hairpin sequence MQ_from_HSbrain_18, macaque
gcagtgcgcgtggccgtggcggctggtgtggggttgagtcagttgtgagacccggagctggtgacccagcgggtggcccaccgaaccggcgacacagc

SEQ ID NO: 5078 - DNA, 109 bp, Artificial
  Hairpin sequence MQ_from_HSbrain_183, macaque
ccttcctcttttctgtcctcctgctatgtccaggactccccgatcaacaaacttctgtatgcacgggacatcccccggtacaagcagatggtggaaaggtattggaggg

SEQ ID NO: 5079 - DNA, 99 bp, Artificial
  Hairpin sequence MQ_from_HSbrain_187, macaque
cagccacagacactgccacccccggggctgcaggtggggccatagctgcagctgcgagtggagctacctcagtccctgagggtgatgctgctcatgctg

SEQ ID NO: 5080 - DNA, 76 bp, Artificial
  Hairpin sequence MQ_from_HSbrain_188, macaque
cagccatcatcttctgcgtagccttgagcgcctacgacttggtgctagctgaggacgaggagatggtgagaggctg

SEQ ID NO: 5081 - DNA, 74 bp, Artificial
  Hairpin sequence MQ_from_HSbrain_189, macaque
acttctgggagcaagctgacccagctgaagatcgcccagcgccttcgactggaccagcccaagctcgatgaggt

SEQ ID NO: 5082 - DNA, 86 bp, Artificial
  Hairpin sequence MQ_from_HSbrain_19, macaque
gggcggctgtgtgagtcccacatccagggcagagggcctggtggggccccttgttaggagaagggaagacgcccgagacgctgctt

SEQ ID NO: 5083 - DNA, 79 bp, Artificial
  Hairpin sequence MQ_from_HSbrain_191, macaque
tcaagaagcttggtggagaagagggagaaggatctggaggtctacctccagaaactcctggctgccttccctggcgtga

SEQ ID NO: 5084 - DNA, 67 bp, Artificial
  Hairpin sequence MQ_from_HSbrain_192, macaque
ggacctggaggaggtggcgtggagaactctgcaggcagaacaagccacagcctggactccagtttcc

SEQ ID NO: 5085 - DNA, 106 bp, Artificial
  Hairpin sequence MQ_from_HSbrain_195, macaque
ggggagtggggtgctagaggccttgctgctgaggaaagttaccatggttaccagcaccatggctctcagaaggaggaggctgacatgttagcacctcagctatcct

SEQ ID NO: 5086 - DNA, 78 bp, Artificial
  Hairpin sequence MQ_from_HSbrain_199, macaque
gaaacaggaaggtctccaagtgtcaactcccagtggaagaatgatgaaccacttggagatcctaagcagccctgtttt

SEQ ID NO: 5087 - DNA, 116 bp, Artificial
  Hairpin sequence MQ_from_HSbrain_20, macaque
ctggaggagcccgcggtgacatcagggcccggtccctgctgtcgtgccccaggtgacgcgcccgggctgacagcagggctggccgctgacgtcactgtcctggcttccaacgctgg

SEQ ID NO: 5088 - DNA, 89 bp, Artificial
  Hairpin sequence MQ_from_HSbrain_21, macaque; MQ_from_HSbrain_623, macaque; MQbrain_2484, macaque
gcaaggcccggtggccatcagcatccagggacctggcagccaccactgaggcccactgcttgtccctcagctggatgcccactggcggc

SEQ ID NO: 5089 - DNA, 114 bp, Artificial
  Hairpin sequence MQ_from_HSbrain_217, macaque
agaggagggctgggtggggtccgcaggaggccaaggcaggaagtgggcaggaccgtcccgtcctcactccttgccaggcctcctgctgacccagtgtgcccactgcacctccct

SEQ ID NO: 5090 - DNA, 78 bp, Artificial
  Hairpin sequence MQ_from_HSbrain_220, macaque; MQbrain_2630, macaque
tgcttggtggcttcaggagtacagccctcccctggactccacttcaccctgggcttgcaccctccttgagccaatgca

SEQ ID NO: 5091 - DNA, 75 bp, Artificial
  Hairpin sequence MQ_from_HSbrain_223, macaque; MQ_from_PT_176, macaque
ggggtagagcagccctcggctgcccggggggcgggcggcagtgctcgtcccggggccgcgcgaggcacaggcgcc

SEQ ID NO: 5092 - DNA, 93 bp, Artificial
  Hairpin sequence MQ_from_HSbrain_226, macaque
ctctcccttgtctcccctctcctcccttttctccgccttcaggtctggttccagaaccgccggaccaagtggaggaagaagcacgcggccgag

SEQ ID NO: 5093 - DNA, 96 bp, Artificial
  Hairpin sequence MQ_from_HSbrain_230, macaque
gcaccatgaagctttgagtgaagctcttcctgggcacaatgtgggcttcaatgtcaagaacatgtctatcaaggaggttcatcatagcaatgatgc

SEQ ID NO: 5094 - DNA, 66 bp, Artificial
  Hairpin sequence MQ_from_HSbrain_231, macaque
cagggcctccgctggggccaggaggtgacgaccagtggccacctctcccccggcaaggaggcgatg

SEQ ID NO: 5095 - DNA, 77 bp, Artificial
  Hairpin sequence MQ_from_HSbrain_232, macaque
ggagggattcctggagaagctgcagtgtggggatgctttagaacgagtactgcccccagtgtctttccacctcctcc

SEQ ID NO: 5096 - DNA, 118 bp, Artificial
  Hairpin sequence MQ_from_HSbrain_233, macaque; MQ_from_HSbrain_780, macaque
ctggctgtgtgactgtcaggcaggcctggctgtgtgactgtcaggaggcctgtctgtgtgagtgtcaggcaggcctgtctgtgtgactgtcatgcaggcctgtctgtgtgactgtcag

SEQ ID NO: 5097 - DNA, 118 bp, Artificial
  Hairpin sequence MQ_from_HSbrain_234, macaque
tcaggaggcctgtctgtgtgagtgtcaggcaggcctgtctgtgtgactgtcatgcaggcctgtctgtgtgactgtcaggaggcctgtctgtgtgactgtcagtcaggcctgtctctga

SEQ ID NO: 5098 - DNA, 118 bp, Artificial
  Hairpin sequence MQ_from_HSbrain_235, macaque; MQ_from_HSbrain_236, macaque
ctgtgtgattgtcgtgcaggcctgtctgtgtgactgtcgtgcaggcctgtctgtgtgactgtcaggaggcctgtatatgtgactgtcgtgcaggcctgtctgtgtgactgtcagacag

SEQ ID NO: 5099 - DNA, 87 bp, Artificial
  Hairpin sequence MQ_from_HSbrain_239, macaque
gatgggatcagtgctgggcctgtgagccaaagcaagccaggctgtaggctggccagcaaagtggccggcaggaagagatgagatgtc

SEQ ID NO: 5100 - DNA, 65 bp, Artificial
  Hairpin sequence MQ_from_HSbrain_241, macaque
gcagacaaagagctgtggtagaaagtacggttgctaatcactttctaccacagctctttgcttgc

SEQ ID NO: 5101 - DNA, 92 bp, Artificial
  Hairpin sequence MQ_from_HSbrain_244, macaque
ggccacccacgagggcctcccggtctagggcccgaccgcgccggacgcggtgtccggggcagggcagggctggggcctgggcctcaggagcc

SEQ ID NO: 5102 - DNA, 120 bp, Artificial
  Hairpin sequence MQ_from_HSbrain_249, macaque
gtactagaagctggtctgattggtccaacagtttgatgctgagtcatgtgtgttgaatcccacttcagtgcacctgtggcctctcagtcaaacaagttgtgcctttcacagcttctttac

SEQ ID NO: 5103 - DNA, 113 bp, Artificial
  Hairpin sequence MQ_from_HSbrain_251, macaque
ggcaccagggcgtgatggtgggcatgggtcagaaggactcctatgtgggcaacgaggcccagagcaagagaggcatcctcaccctgaagtaccccatcgagcacggcatcgtc

SEQ ID NO: 5104 - DNA, 63 bp, Artificial
  Hairpin sequence MQ_from_HSbrain_259, macaque
ggcccaggccgaggccgactggctcaccgtctacctggtggtggcattggcctcggtgtcgtc

SEQ ID NO: 5105 - DNA, 99 bp, Artificial
  Hairpin sequence MQ_from_HSbrain_26, macaque
tgcccctcagctcccattagagtccctcctgccttagagtccctcctgccggtgcctccacaggagggacctaatggggactctaatgagagccctgca

SEQ ID NO: 5106 - DNA, 72 bp, Artificial
  Hairpin sequence MQ_from_HSbrain_260, macaque
ggtttgctcaaggggtggctgggtgctgctcctgatatagggggcctgcattctgccccctccctgccctcc

SEQ ID NO: 5107 - DNA, 116 bp, Artificial
  Hairpin sequence MQ_from_HSbrain_261, macaque
tttgtgggtcgggatgattttgatgatgctgaccagctgaggataggaaatgatgggattttcatgttaacttttttcagtaagtatgtatgcatagcagaaccaccccctccaaa

SEQ ID NO: 5108 - DNA, 97 bp, Artificial
  Hairpin sequence MQ_from_HSbrain_263, macaque
gtacattggatttgagacggtgaatggtgatatattcatctgtacccaaagagcggccaggaatatgtcataccagggctttaccagagacaatggc

SEQ ID NO: 5109 - DNA, 70 bp, Artificial
  Hairpin sequence MQ_from_HSbrain_270, macaque; PT_from_HSbrain_270, chimp
ctgggtggctctccctaagcttgctctgacaaaagagttttgagttggtcttttggctgagcctgcccag

SEQ ID NO: 5110 - DNA, 72 bp, Artificial
  Hairpin sequence MQ_from_HSbrain_273, macaque
cctgccctcaaaccctgcctgccacctccccactcaggcctggtggcagggagggacaagctgtggagctgg

SEQ ID NO: 5111 - DNA, 73 bp, Artificial
  Hairpin sequence MQ_from_HSbrain_275, macaque
ggcgtggagggcccgggaaggcggcctagggacgcaggcaggctcggccgcctctttaggccacggaaccgcc

SEQ ID NO: 5112 - DNA, 61 bp, Artificial
  Hairpin sequence MQ_from_HSbrain_29, macaque; MQ_from_HSbrain_368, macaque; MQ_from_HSbrain_445, macaque
gctgagggagctttgccttggttcctttgtgtccccatggtgccatgggaggctccctggc

SEQ ID NO: 5113 - DNA, 77 bp, Artificial
  Hairpin sequence MQ_from_HSbrain_293, macaque; MQbrain_2475, macaque
ggatgggcggctctatattggccttgctgtccaccttccagcagatgtggatcagcaagcaggagtgcggtgagtcc

SEQ ID NO: 5114 - DNA, 109 bp, Artificial
  Hairpin sequence MQ_from_HSbrain_297, macaque; MQ_from_HSbrain_589, macaque; PT_from_HSbrain_297, chimp; PT_from_HSbrain_589, chimp
agtctactcttcatcttgtgttgagacttcgtggtggtgctaagaaaaggaagaagaagtcttacaccactcccaagaagaataagcacaagagaaagaaggttaagct

SEQ ID NO: 5115 - DNA, 118 bp, Artificial
  Hairpin sequence MQ_from_HSbrain_298, macaque; MQ_from_HSbrain_579, macaque; MQbrain_2411, macaque
gttatgaggactttttctctgcccttcgtcagtatgcagcctgtgaacagcgtctgggaaagtagtggtcattggttgcataatttgatttgaggcttatggaggaaaggacccaagc

SEQ ID NO: 5116 - DNA, 105 bp, Artificial
  Hairpin sequence MQ_from_HSbrain_303, macaque
cctctactggcgctgccaaggctgtgggcaaggtcatccctgagctgaacgggaagctcactggcatggccttccgtgttcccactgccaacatgtcagtggtgg

SEQ ID NO: 5117 - DNA, 119 bp, Artificial
  Hairpin sequence MQ_from_HSbrain_305, macaque; MQ_from_HSbrain_306, macaque; MQ_from_HSbrain_307, macaque
gctgatggaggaagggtgctggtttcccctccctgtgagctgagccttgggtaccatgccatcctcttcgtgcagggctgctgacggaggaggggtgctggtttcccctccctgtgagc

SEQ ID NO: 5118 - DNA, 107 bp, Artificial
  Hairpin sequence MQ_from_HSbrain_312, macaque
ctgcttttctcttgttctctccctgtagttactggggcttccggatgcagatgacgatgcgtttgaagagtacagtgctgacgtggaagaagaggagccagaggcag

SEQ ID NO: 5119 - DNA, 87 bp, Artificial
  Hairpin sequence MQ_from_HSbrain_313, macaque
ctgattcctatcatttccagcttctcagtttctgcctgggcaatggccaggggccaggagtggggagggtttgatggaggggagggg

SEQ ID NO: 5120 - DNA, 105 bp, Artificial
  Hairpin sequence MQ_from_HSbrain_314, macaque; PT_from_HSbrain_314, chimp
ctcagctccaccccactgtgtcttggtcagcctcagtgatggcctgaccccagctgtgaggccttgtgagctaaggctgaagagaccttgcctgtgggagctggg

SEQ ID NO: 5121 - DNA, 103 bp, Artificial
  Hairpin sequence MQ_from_HSbrain_316, macaque
gctttgacctggagtcgtacctgcagctcaactgtgagcgggggacttggaggtgtcctgtgtgcaagtgagtctcagatgcaatgtgtgatgggggaggggc

SEQ ID NO: 5122 - DNA, 88 bp, Artificial
  Hairpin sequence MQ_from_HSbrain_317, macaque
caggaggtgccatgctgggtgttgtgtgtctgcaggtctgaggcccttcatccctgagaaggacagtcagcacttcgagaacttcctg

SEQ ID NO: 5123 - DNA, 117 bp, Artificial
  Hairpin sequence MQ_from_HSbrain_318, macaque
ggcacccaggactctggtcagtccatggaagggcctggaaggatgtgggccagacagagggaactccttgggctgtgtccccagcagccctatgtggtgagcagagtcctgagtccc

SEQ ID NO: 5124 - DNA, 64 bp, Artificial
  Hairpin sequence MQ_from_HSbrain_321, macaque
ggaataactgtgtggagcgttctcctagggccttgaaatgaggccctgggagacacatgggtcc

SEQ ID NO: 5125 - DNA, 105 bp, Artificial
  Hairpin sequence MQ_from_HSbrain_322, macaque
ccaccactgtctgaggcctctcctgcccgctccccacacagaagaaaatcatgatcatcatctgctgtgtgatcctgggcatcgtcatcgcctccactgtcgggg

SEQ ID NO: 5126 - DNA, 67 bp, Artificial
  Hairpin sequence MQ_from_HSbrain_324, macaque; MQbrain_2271, macaque; MQbrain_2272, macaque
ggctgtggtagatggaggtgccatcccagcattcatctctctgttggcatctccccatgctcacatc

SEQ ID NO: 5127 - DNA, 75 bp, Artificial
  Hairpin sequence MQ_from_HSbrain_332, macaque
cctcagcgcccaggagctgcggtccggagccggccccgagctggggcccaggtcgcaggctcctcaggccacagg

SEQ ID NO: 5128 - DNA, 77 bp, Artificial
  Hairpin sequence MQ_from_HSbrain_335, macaque
tggctctggcttgggactggactggggctggccggataactccgcagccgctctcagctcagccctgggtggaaacg

SEQ ID NO: 5129 - DNA, 65 bp, Artificial
  Hairpin sequence MQ_from_HSbrain_346, macaque
gaggggcaggtggacaaccgtcgcctctctgtagccagggggaattgtgtggccagctgtctctc

SEQ ID NO: 5130 - DNA, 92 bp, Artificial
  Hairpin sequence MQ_from_HSbrain_35, macaque
gctgatctctgagaccatggtcagatgggctcaggagtctgtcattgaagaccccgagctggtgagggccatgtttgtgttgctccatcggc

SEQ ID NO: 5131 - DNA, 115 bp, Artificial
  Hairpin sequence MQ_from_HSbrain_355, macaque
aggactctgaggagtactcttgctccaccgattaaactctcagcagcaacttcaagaatcatttttctataggggcctgggaggaattctggcagaagagtaaagtcgaagttct

SEQ ID NO: 5132 - DNA, 63 bp, Artificial
  Hairpin sequence MQ_from_HSbrain_36, macaque
cttgccagaggctttggaagctattgtcccctctctggggacagaggcttctgtctctgcaag

SEQ ID NO: 5133 - DNA, 106 bp, Artificial
  Hairpin sequence MQ_from_HSbrain_364, macaque
tgcaggtggggaggggccctcctacacagcctcttttcctgaacgattctggatggccactatggtgtgaaaggaggaatacgaggaggtgtacagtcatcatgca

SEQ ID NO: 5134 - DNA, 73 bp, Artificial
  Hairpin sequence MQ_from_HSbrain_366, macaque
cggctgactgtggatgaggctgtgcggaagggcctggtggggcccgagctgcacgaccgcctgctctcggctg

SEQ ID NO: 5135 - DNA, 89 bp, Artificial
  Hairpin sequence MQ_from_HSbrain_370, macaque
ctagcatctacctaccttattagtctcatgatcagacacaaatatggctctttgtggctggtcatgaggctaacaaggtaggcacctgg

SEQ ID NO: 5136 - DNA, 86 bp, Artificial
  Hairpin sequence MQ_from_HSbrain_371, macaque
attcagggaggaggtggtactagggaccagcaacctgtttactcctctttggccctctgtacccctccagtctccatccactgagt

SEQ ID NO: 5137 - DNA, 117 bp, Artificial
  Hairpin sequence MQ_from_HSbrain_375, macaque
ctcgctggttgcttcgctcgcgctctacgcgctcagtccccggcggcagcaggatcctggacccaggcgccgccggcgggcgtgaggcgccggagcccgggtgagcagcgcagacag

SEQ ID NO: 5138 - DNA, 106 bp, Artificial
  Hairpin sequence MQ_from_HSbrain_380, macaque
cggagcagcccttgcccctcagagcacactccctccatcaccccagcagcggctctcctgatattggtattggcgagtgtgtgcgtgcctggcgcggcgtgctctg

SEQ ID NO: 5139 - DNA, 94 bp, Artificial
  Hairpin sequence MQ_from_HSbrain_385, macaque
ctgagttcccaggagctgggccctgcctgcagccagggatgggattgccagaggccctggagggaaggacagtccctgctggggaaaaacacag

SEQ ID NO: 5140 - DNA, 97 bp, Artificial
  Hairpin sequence MQ_from_HSbrain_386, macaque
ccagcctcccaaagtgttgggattacaggtatgagccactgtgcctggcctgggtgcctgtcgttcaggcctgtcagtcctgcaggggagagcatgg

SEQ ID NO: 5141 - DNA, 74 bp, Artificial
  Hairpin sequence MQ_from_HSbrain_387, macaque
ggggtttgttctctccctgaagcacttgttcaactcctgttaaagccgcgtgcctcaaggggaggctggacccc

SEQ ID NO: 5142 - DNA, 95 bp, Artificial
  Hairpin sequence MQ_from_HSbrain_388, macaque
ggctccaaggagtactggtttgtgctgaccgctgagaatctgtcctggtacaaggatgatgaggtgagtcaagggccactagtcatcaaggggct

SEQ ID NO: 5143 - DNA, 70 bp, Artificial
  Hairpin sequence MQ_from_HSbrain_39, macaque
tcagctgtggcctccaggatcctgacagcgcctggcccgtggggctcagaggtccagtgggttgcaggga

SEQ ID NO: 5144 - DNA, 78 bp, Artificial
  Hairpin sequence MQ_from_HSbrain_391, macaque
cctgcagaggggtgtgggttccagggtgggattcgcagccccccgaggctgcccgagcccatcctgcccaccagcagg

SEQ ID NO: 5145 - DNA, 105 bp, Artificial
  Hairpin sequence MQ_from_HSbrain_392, macaque
ccccggggaggggcagggcccggagcttcccactaaaaacatgttttgatgctgtgtgcttgtgactgggccttgggcttcaggccctgggatcccttgccaggg

SEQ ID NO: 5146 - DNA, 71 bp, Artificial
  Hairpin sequence MQ_from_HSbrain_395, macaque
atggctgcttgtgacccccgccatggccgctacctgacggttgctgccgtgttcaggggccgcatgtccat

SEQ ID NO: 5147 - DNA, 95 bp, Artificial
  Hairpin sequence MQ_from_HSbrain_396, macaque
cggcaggagcggggccggtcccaggagcggaggcagccctcatcctcctcctcggagaagcagcgcttctactcctgtgaccgctttgggggccg

SEQ ID NO: 5148 - DNA, 71 bp, Artificial
  Hairpin sequence MQ_from_HSbrain_397, macaque
acagccatttccccaggcagtgttgggtcgagaatccacttttctagacccacacagcctagctggcttgt

SEQ ID NO: 5149 - DNA, 114 bp, Artificial
  Hairpin sequence MQ_from_HSbrain_398, macaque; MQbrain_2438, macaque
ggccctgcggggcccggcgctcagaagtgatgaattgatcagatagacgaggccgggcttgtcccgggccagtgattatcgaggcgattctgatctgggcacggccaccgggct

SEQ ID NO: 5150 - DNA, 72 bp, Artificial
  Hairpin sequence MQ_from_HSbrain_400, macaque; MQ_from_HSbrain_508, macaque; MQ_from_HSbrain_511, macaque
tccagacagatccctctgtcctcactctctgatttcattgaggatcttgggtgagagagagggacctgcgga

SEQ ID NO: 5151 - DNA, 81 bp, Artificial
  Hairpin sequence MQ_from_HSbrain_401, macaque
agtccaactaaagacggcctgtggtctgcctcttggcaacaaagaagcctgcacttccataggagtctcgagacatggact

SEQ ID NO: 5152 - DNA, 78 bp, Artificial
  Hairpin sequence MQ_from_HSbrain_402, macaque
gccgaagatggcggaggtgcaggtcctagtcctcgatggtcgaggccatctcctgggcctcctggtagccatcgtggc

SEQ ID NO: 5153 - DNA, 79 bp, Artificial
  Hairpin sequence MQ_from_HSbrain_404, macaque; MQbrain_2541, macaque
ggcgccggcggccccgcggctcctgcgccgccacagctcagccctgtgcaggcctagggcggcggggcctcccccagcc

SEQ ID NO: 5154 - DNA, 111 bp, Artificial
  Hairpin sequence MQ_from_HSbrain_416, macaque
tgaggactttttctctgcccttcgtcagtatgcagcctgtgaacagcgtctgggaaagtagtggtcattggttgcataatttgatttgaggcttatggaggaaaggaccca

SEQ ID NO: 5155 - DNA, 87 bp, Artificial
  Hairpin sequence MQ_from_HSbrain_422, macaque; MQbrain_966,MQbrain_2660, macaque
tgggcatagaatcctgtggcatccacgaaactaccttcaactccatcaagaagtgtgacgtggacatccgcaaagatctgtacacca

SEQ ID NO: 5156 - DNA, 74 bp, Artificial
  Hairpin sequence MQ_from_HSbrain_427, macaque
tgtccaaatgcgtctggaacagagactccgagatgggcaggaagatggctctgtgatcgaacgccaggtgggca

SEQ ID NO: 5157 - DNA, 79 bp, Artificial
  Hairpin sequence MQ_from_HSbrain_440, macaque
ggagttgtggagctgtgaggggggaagagggccctgctgacagctctgtccctccctcagatgccccttccgccagtcc

SEQ ID NO: 5158 - DNA, 102 bp, Artificial
  Hairpin sequence MQ_from_HSbrain_446, macaque
gatacaagtgagcaaaagttggtcagcttggctatggagtggtggcaataatctctaaacattcctaaagaccatgagctgaacctaaactcccttggaatc

SEQ ID NO: 5159 - DNA, 119 bp, Artificial
  Hairpin sequence MQ_from_HSbrain_447, macaque
tgttacaactgaaataaagtctgttgaaatgcaccatgaagctttgagtggagctcttcctggggacagtgtgggcttcaatatcaagaatgtgtctgtcaaagatgttcgttgtggca

SEQ ID NO: 5160 - DNA, 102 bp, Artificial
  Hairpin sequence MQ_from_HSbrain_449, macaque
gcacagaggtggtcaccccagggacagccaggcacctgctcctcttacccttcttgggggaagggggctgccttctgttcctgtaactgcttaccttatggc

SEQ ID NO: 5161 - DNA, 75 bp, Artificial
  Hairpin sequence MQ_from_HSbrain_45, macaque
tccatccggcttctacggggctgggctcacaccggtccttcagggagggttagctggccaggaggagtttgagga

SEQ ID NO: 5162 - DNA, 77 bp, Artificial
  Hairpin sequence MQ_from_HSbrain_450, macaque
tgggaggactgggagtaagggagccagagggagcagctccccacccatggcatctctcgcctccctcgttcgtctca

SEQ ID NO: 5163 - DNA, 69 bp, Artificial
  Hairpin sequence MQ_from_HSbrain_453, macaque
gggaggggcagccctggggggatgggaggagtcagccaggcttctgtctcctcccctcctgtgcctcct

SEQ ID NO: 5164 - DNA, 109 bp, Artificial
  Hairpin sequence MQ_from_HSbrain_457, macaque
aaattcagcagttaagagtggtgtgtgggtgggaaggactggatttgaaatggtcccattcctgacactcctgtccctgtctcccacagacctcttcttgggtgaattt

SEQ ID NO: 5165 - DNA, 65 bp, Artificial
  Hairpin sequence MQ_from_HSbrain_459, macaque
attcttgcagttgaaccttagtgcgcacagaacccttctgtgcgcgagaggtagagggctggagt

SEQ ID NO: 5166 - DNA, 74 bp, Artificial
  Hairpin sequence MQ_from_HSbrain_460, macaque
caggtgctggggccggggccaggtggaagggggccacaggacctttctctcgcctctgctgcagattatgtctg

SEQ ID NO: 5167 - DNA, 102 bp, Artificial
  Hairpin sequence MQ_from_HSbrain_461, macaque
gggcctcaactggagctccggattctggaaggagggactggggccaggtcaactgagccctcttcctctcttctgcctcctcctcagcatcatcaatggctt

SEQ ID NO: 5168 - DNA, 97 bp, Artificial
  Hairpin sequence MQ_from_HSbrain_465, macaque
cttggccactgtctgcttccaggcctcatatctggtgacccgctgcctggctgggcaacctacagtgctgacccccttgatccacggactggcccag

SEQ ID NO: 5169 - DNA, 75 bp, Artificial
  Hairpin sequence MQ_from_HSbrain_468, macaque
ggctccatcgaggcccacaagaggggctcccgcttctggatccaggacaaaggccccatcgtggagaggtgagcc

SEQ ID NO: 5170 - DNA, 91 bp, Artificial
  Hairpin sequence MQ_from_HSbrain_481, macaque; MQ_from_HSbrain_540, macaque; MQ_from_HSbrain_543, macaque; MQ_from_HSbrain_546, macaque
cagatggtgaaatgtgaccctcgccatggtaaatacatggcttgctgcctgttgtaccgtggtgatgtggttcccaaagatgtcaatgctg

SEQ ID NO: 5171 - DNA, 112 bp, Artificial
  Hairpin sequence MQ_from_HSbrain_489, macaque
acggtgtcataaagcagcacatctgggtttttctcatcatgtgcagttccgcagattccctccaggatgccatgagacatgagcaccaggaatgtgctatcggaggacttgt

SEQ ID NO: 5172 - DNA, 73 bp, Artificial
  Hairpin sequence MQ_from_HSbrain_516, macaque
gcttgcccggggcgcccttccctccccgcggggcaccgtcacgcgtggggagggacgcagggcgcccgcaggc

SEQ ID NO: 5173 - DNA, 93 bp, Artificial
  Hairpin sequence MQ_from_HSbrain_517, macaque
tggtctctaaccttctaaatggttctggagggagcacagccatgatggacataatgggtgcacccaagatcaccacagagggaagggaaccca

SEQ ID NO: 5174 - DNA, 70 bp, Artificial
  Hairpin sequence MQ_from_HSbrain_521, macaque
ggcgtcgcgccgtgccctcgagagggacgacttcgagatcgttgtcatcctcgagggcatggtggaagcc

SEQ ID NO: 5175 - DNA, 94 bp, Artificial
  Hairpin sequence MQ_from_HSbrain_522, macaque
ggaggggagggctggctgctggaagaaggaagaagccagactggttagacagtattcttaactcctagcccagcctagcgtgtcctgcccctct

SEQ ID NO: 5176 - DNA, 62 bp, Artificial
  Hairpin sequence MQ_from_HSbrain_527, macaque
tagaggacccccctgcccggccttcaagtctggagggaggctggggggaggcgggtcctgtg

SEQ ID NO: 5177 - DNA, 90 bp, Artificial
  Hairpin sequence MQ_from_HSbrain_528, macaque
ggtagtttttttctaataactgggctttccctcttccttgcccaggcgaggaggaggtgactgctgtggatggttatgagacagaccacc

SEQ ID NO: 5178 - DNA, 76 bp, Artificial
  Hairpin sequence MQ_from_HSbrain_533, macaque
catttcctggctgcatttcttcgtgtctggctttgccccactgaccagccggggcagccagcagtaccgggccctg

SEQ ID NO: 5179 - DNA, 111 bp, Artificial
  Hairpin sequence MQ_from_HSbrain_539, macaque; MQ_from_HSbrain_649, macaque; MQbrain_2623, macaque
tcccactgtggtgcctggtggagacctggccaaggttcagagagctgtgtgcatgctgagcaacactacagctgttgccgaggcctgggctcgcctggaccacaagtttga

SEQ ID NO: 5180 - DNA, 83 bp, Artificial
  Hairpin sequence MQ_from_HSbrain_549, macaque
ggcttctggcagcccagctccgcccagctcactgtgccttggaggcggtggtggtggtggatgcagccccgctggcagaggcc

SEQ ID NO: 5181 - DNA, 91 bp, Artificial
  Hairpin sequence MQ_from_HSbrain_55, macaque
agggggctgggtgtcaggcaaggcgccagataccccgttgcaggctggaggacggggtggctggatctttgcacacacgcacatgcacact

SEQ ID NO: 5182 - DNA, 84 bp, Artificial
  Hairpin sequence MQ_from_HSbrain_551, macaque
ggatgtctggtcccagcctggagggaagggggaagccctgggaagcagggcctcctgttctaggggtggggctgggtgtgcgcc

SEQ ID NO: 5183 - DNA, 67 bp, Artificial
  Hairpin sequence MQ_from_HSbrain_554, macaque
ttggtgtggctggttcaggggctggcattggaacggtgtttggcagcttgatcattggctatgccag

SEQ ID NO: 5184 - DNA, 70 bp, Artificial
  Hairpin sequence MQ_from_HSbrain_555, macaque
gctgctcttgctggctacagccgtgggcctctgctcaccgtgccgctgctgctgcctgcgaaatgacggc

SEQ ID NO: 5185 - DNA, 74 bp, Artificial
  Hairpin sequence MQ_from_HSbrain_558, macaque
gcaggtcctggtgcctgatggtcgaggccatctcctggaacccctggcggccatcatggctaactaggtactgt

SEQ ID NO: 5186 - DNA, 86 bp, Artificial
  Hairpin sequence MQ_from_HSbrain_56, macaque
agccagctggaggctggaacatggcagagggcatactaggggctaacctgccctttctcatgtcccccagtgtgcacccagctgct

SEQ ID NO: 5187 - DNA, 95 bp, Artificial
  Hairpin sequence MQ_from_HSbrain_567, macaque
gctcatgccgatggcttcagtgatggcggtgactgaaccgaaatgggtctcagtctggggccgcttcctctgggtgacgctgctgagcatggtgc

SEQ ID NO: 5188 - DNA, 68 bp, Artificial
  Hairpin sequence MQ_from_HSbrain_575, macaque
gagctcaggccctggggaggcgggggcctcctgaggcctcactcctccttcctcctgcagatgagttt

SEQ ID NO: 5189 - DNA, 73 bp, Artificial
  Hairpin sequence MQ_from_HSbrain_58, macaque; MQbrain_2584, macaque
gctacgaggaggtcaaggaccgctgcaccccggttaaagaagctggggggcagtgccgtcatctccctggagc

SEQ ID NO: 5190 - DNA, 117 bp, Artificial
  Hairpin sequence MQ_from_HSbrain_584, macaque
ctttatttgcttcaaatattcatcacttttattcctcgccaaggttttcttttctagatgaagaggactgggaggcagggctattggaaggagatgctgaatagaaagaaaagagag

SEQ ID NO: 5191 - DNA, 120 bp, Artificial
  Hairpin sequence MQ_from_HSbrain_586, macaque
ggaacggcttggagacaaaggggcacaagagggaagctgcttcctagtgccgagccccataagaggtggataggcccgaggggcgccttccctagcccttatctcttcccgccctgtgcc

SEQ ID NO: 5192 - DNA, 111 bp, Artificial
  Hairpin sequence MQ_from_HSbrain_592, macaque; PT_from_HSbrain_592, chimp
tgaagggctgctcaggaaaacatgcacctgagccagtggccctggggctgtcagcctgcctgggagctgggagccactgtagtttggtttttgtgtgggagttgcctttta

SEQ ID NO: 5193 - DNA, 117 bp, Artificial
  Hairpin sequence MQ_from_HSbrain_597, macaque
ggtgcagcctcagatcccctgttcatctgggaagcctccagccacagcttaggacagaaccgggcccagggcaaaggcctctccccagaggatggactagaaggcctgggccacact

SEQ ID NO: 5194 - DNA, 70 bp, Artificial
  Hairpin sequence MQ_from_HSbrain_602, macaque
atggtggttctgcctgtgatgaatgctaagtggaaacaagcaagaaaaattaacaggcggctgcctctgt

SEQ ID NO: 5195 - DNA, 98 bp, Artificial
  Hairpin sequence MQ_from_HSbrain_607, macaque
gaggcggtcctggtggggagttcgtagccaggtggagtcgctgtccggacgcgcttcatttcggccccgccctccctgctccccttaacagacccctc

SEQ ID NO: 5196 - DNA, 83 bp, Artificial
  Hairpin sequence MQ_from_HSbrain_610, macaque; MQbrain_2570, macaque
tttcagttccaaggccgggaatgagtccaccagctccacatgtaaaaatgaggctggtattgatgcctggttctgggctgggg

SEQ ID NO: 5197 - DNA, 93 bp, Artificial
  Hairpin sequence MQ_from_HSbrain_613, macaque
gtgatggaaggctgttgtcttggtgtatcccttgcctcatattcaatatatttttttctttggtgagtcaccagtgacccgagccctccacac

SEQ ID NO: 5198 - DNA, 92 bp, Artificial
  Hairpin sequence MQ_from_HSbrain_615, macaque
gcggttctgttctccgagccaattgcctcatcgtcttcctcacagcctgttgtgaatttgctgaggtcattggcactggtcttggcgcacgc

SEQ ID NO: 5199 - DNA, 74 bp, Artificial
  Hairpin sequence MQ_from_HSbrain_624, macaque
agttccctggggccagggaacattggtggctccttcctgagcccccattcctcccttgtgtctttcagtgagct

SEQ ID NO: 5200 - DNA, 61 bp, Artificial
  Hairpin sequence MQ_from_HSbrain_625, macaque
cctttcaaggcctgttctttgaagcgacgtggtgcttcacagagcctggccctctgcaagg

SEQ ID NO: 5201 - DNA, 76 bp, Artificial
  Hairpin sequence MQ_from_HSbrain_626, macaque
gtgggaggccagggcaaggcagggggagctgcagggccgtcagaggggccccagcgtctgagccctgtcctcgcgc

SEQ ID NO: 5202 - DNA, 47 bp, Artificial
  Hairpin sequence MQ_from_HSbrain_629, macaque
gggcatggagggtgaagggagaaaagaattctttctcccccatgtcc

SEQ ID NO: 5203 - DNA, 72 bp, Artificial
  Hairpin sequence MQ_from_HSbrain_630, macaque
tgggtgccactggaaagcaaagggtgcattgggacacagcctagtcatgttccttttgcctttctaggccta

SEQ ID NO: 5204 - DNA, 90 bp, Artificial
  Hairpin sequence MQ_from_HSbrain_631, macaque; MQbrain_1737, macaque; MQbrain_2626,MQbrain_2667,MQbrain_2673, macaque; MQbrain_2669, macaque
gtggatcggcggctccatcctggcctcgctgtccaccttccagcagatgtggatcagcaagcaggagtatgacgagtctggcccttccat

SEQ ID NO: 5205 - DNA, 87 bp, Artificial
  Hairpin sequence MQ_from_HSbrain_638, macaque
cccagttaggtcgcggccttcccagccggcgctgaccctgagggtaaaggctgcgtcccaccttggaggtcgctgcttagcgctggg

SEQ ID NO: 5206 - DNA, 90 bp, Artificial
  Hairpin sequence MQ_from_HSbrain_647, macaque
gcctcatgtgccacatgccaggggccggccccgacagactgcctcagctgccccagccatgcctccttggaccctgtggagcagacttgc

SEQ ID NO: 5207 - DNA, 76 bp, Artificial
  Hairpin sequence MQ_from_HSbrain_648, macaque
tctggtttcctggggctgcggcctacttcggtggacccagcgctgaggcggcggcggcgaggcccaagaaataaga

SEQ ID NO: 5208 - DNA, 74 bp, Artificial
  Hairpin sequence MQ_from_HSbrain_656, macaque
ggcgcaggtgggcccagcctcgagctcttcagcacagcgatggtgaccgggcagcggtggcggcctgaccagcc

SEQ ID NO: 5209 - DNA, 63 bp, Artificial
  Hairpin sequence MQ_from_HSbrain_657, macaque
ggctgtcccctgcccagggagctggcatgaaagcacgaggcccagctccctcgggcagctgct

SEQ ID NO: 5210 - DNA, 80 bp, Artificial
  Hairpin sequence MQ_from_HSbrain_659, macaque
gccaactaagctgaagagcctcctgcgcctggtgaaacactggtaccagcaggtgagggggctgccaggatggtgggggc

SEQ ID NO: 5211 - DNA, 78 bp, Artificial
  Hairpin sequence MQ_from_HSbrain_661, macaque
ggcctccaccccctcctagggaacctggaatgcctgtgtcacacactgccctcccagtccctggggcttgggttttcc

SEQ ID NO: 5212 - DNA, 82 bp, Artificial
  Hairpin sequence MQ_from_HSbrain_662, macaque
tctggccctcagaactctcaggtatagaaacccaggatgtctaataccctgtcccagtgcctgagagctgtctggtgtcagg

SEQ ID NO: 5213 - DNA, 81 bp, Artificial
  Hairpin sequence MQ_from_HSbrain_668, macaque; MQ_from_HSbrain_676, macaque; MQ_from_HSbrain_679, macaque; MQ_from_HSbrain_685, macaque; MQ_from_HSbrain_688, macaque
ctggggaagtttgggtcaggggagtctgggcctcaggctggggtggagtttgtggagctgaggcggccccctaccctccag

SEQ ID NO: 5214 - DNA, 114 bp, Artificial
  Hairpin sequence MQ_from_HSbrain_669, macaque; MQ_from_HSbrain_673, macaque; MQ_from_HSbrain_680, macaque; MQ_from_HSbrain_684, macaque; MQ_from_HSbrain_687, macaque; MQbrain_2349, macaque
gctgttggagactctacctacaggtgggtgccataggggtcgggacagcctcttcctgcccagcccttcctgcccctcagcctcacctgtgtggtctcctctcctccacacagc

SEQ ID NO: 5215 - DNA, 80 bp, Artificial
  Hairpin sequence MQ_from_HSbrain_670, macaque; MQ_from_HSbrain_678, macaque; MQ_from_HSbrain_683, macaque; MQ_from_HSbrain_686, macaque
cccagaagggcagagggagggagtcccaggaggtccagtgtccagagctcctcccctctcacctcctcctactccatggg

SEQ ID NO: 5216 - DNA, 116 bp, Artificial
  Hairpin sequence MQ_from_HSbrain_69, macaque
agtgggtgagtgccagcccctgagcaagacagtgcgcttcatcatgttcaaggtcaccaaggccgttggcaccaagaagcagttccagaagttctaaggctggacgtctgcccact

SEQ ID NO: 5217 - DNA, 98 bp, Artificial
  Hairpin sequence MQ_from_HSbrain_691, macaque
ggggaccgtcagcagcgccttagctataatctttcagctattctcggaagagagaagggagagagaggaggcaggggcgggagtgggggctgtcaccc

SEQ ID NO: 5218 - DNA, 116 bp, Artificial
  Hairpin sequence MQ_from_HSbrain_693, macaque
tcccaaggtctggggcctggaggcacgggagggaagtggggtgagcatgagcctctactgagcatgtctgccatcctgccccacagcctcgggcccccacggcgccttcaatggga

SEQ ID NO: 5219 - DNA, 65 bp, Artificial
  Hairpin sequence MQ_from_HSbrain_696, macaque
agaggcagcagctggaagtgtagggattgaaggaacccctcatctgaccagctgctcatttttct

SEQ ID NO: 5220 - DNA, 97 bp, Artificial
  Hairpin sequence MQ_from_HSbrain_699, macaque
gcctttttgggtagctgatcttgcattttctaccactcttcttggtcagtttctagaagacatggaagcatatgctgaggtgagtatatagaaaggt

SEQ ID NO: 5221 - DNA, 119 bp, Artificial
  Hairpin sequence MQ_from_HSbrain_7, macaque
taaaattttagtgcgtttctgctgctgccggctagaggctggtaattatagacgagagtttcgctttctctttattgttttttaatctctctgtgctgcggctctccgacaatatttta

SEQ ID NO: 5222 - DNA, 89 bp, Artificial
  Hairpin sequence MQ_from_HSbrain_704, macaque
ttagcctagttggcaagcgagcaatttccacctctgtgtgtgtacgagcacatggtaagtgtgacttttcttacttttgaataggctga

SEQ ID NO: 5223 - DNA, 77 bp, Artificial
  Hairpin sequence MQ_from_HSbrain_705, macaque
gcttcagctgccccagggctttgccaagatgggatggggtgggtatgagagctggcagagcctcggtgcagcagggc

SEQ ID NO: 5224 - DNA, 70 bp, Artificial
  Hairpin sequence MQ_from_HSbrain_709, macaque
ctgggcacggtggtggtggattaccgcggctaccgcgtcacggcccagtccatcatccccggcatcctgg

SEQ ID NO: 5225 - DNA, 91 bp, Artificial
  Hairpin sequence MQ_from_HSbrain_713, macaque
tgctgtccctgagctggaggggggtctcattctacaaggagagaggtggcccccttttcttgacctcctcctccttcaagctcaaacacca

SEQ ID NO: 5226 - DNA, 63 bp, Artificial
  Hairpin sequence MQ_from_HSbrain_716, macaque
ttcccagggagctctgggggaggggcggccattctggctctgtccccagtggccaccttggaa

SEQ ID NO: 5227 - DNA, 69 bp, Artificial
  Hairpin sequence MQ_from_HSbrain_720, macaque
gggagtccacatctggctttctcagccactgttcatcaccaggggtttcaggaggaaggcttggctcct

SEQ ID NO: 5228 - DNA, 118 bp, Artificial
  Hairpin sequence MQ_from_HSbrain_726, macaque
ttacccgcgtggcttggccttacccgcgaggcttggcggttgttgcttggcttggcggtggtcgcttggcttggcggtgatcgtttggcttggcggtggtcgcttggcgtggcagtga

SEQ ID NO: 5229 - DNA, 106 bp, Artificial
  Hairpin sequence MQ_from_HSbrain_728, macaque
tgcgggctggctcagcctgcttactccatgctcccttttgcaggtaaatgggcttgcagcccagggcaagtatgaaggcagtggagaagatggtggagcagcagca

SEQ ID NO: 5230 - DNA, 68 bp, Artificial
  Hairpin sequence MQ_from_HSbrain_738, macaque
tgactgcaccctttttctcctggcagttgtccctggggatgagcccagggagaagatggacttggtca

SEQ ID NO: 5231 - DNA, 80 bp, Artificial
  Hairpin sequence MQ_from_HSbrain_744, macaque
gcctctccccctttgctaggagtcgggtgggaagagagggtggcctctgtgctccgggttgtcagtggaggggaaggggt

SEQ ID NO: 5232 - DNA, 65 bp, Artificial
  Hairpin sequence MQ_from_HSbrain_745, macaque
gtctccctttctgagggttctgagggggaagcttctcaaatctcagagccagggaggggcatggc

SEQ ID NO: 5233 - DNA, 90 bp, Artificial
  Hairpin sequence MQ_from_HSbrain_747, macaque
ccttgttttcccaggcaggctggcttctcagggcaaggactgttttctgtctggttccagcctcttgtcatgcctaggtggacaaatggg

SEQ ID NO: 5234 - DNA, 64 bp, Artificial
  Hairpin sequence MQ_from_HSbrain_749, macaque
ctctggctggccccagggattttcaaggccaggccgtggaggaaagcctgggactggcacatag

SEQ ID NO: 5235 - DNA, 79 bp, Artificial
  Hairpin sequence MQ_from_HSbrain_758, macaque
gcctcagcgcccaggagctgcggtccggagccggccccgagctggggcccaggtcgcaggctcctcaggccacaggggt

SEQ ID NO: 5236 - DNA, 96 bp, Artificial
  Hairpin sequence MQ_from_HSbrain_768, macaque
aagccgtacccaaagtctcgcttctgccgaggtgtccctgatgccaagattggcatctttgacctggggcggaagaaggcaaaagtggatgagttt

SEQ ID NO: 5237 - DNA, 89 bp, Artificial
  Hairpin sequence MQ_from_HSbrain_770, macaque
gtctgtagtgtcagcgtgatcatgcgttgtgtctgtagtgtcagcatgatcattcgcgtcagcatgatcattcgctgtgatctgcatac

SEQ ID NO: 5238 - DNA, 105 bp, Artificial
  Hairpin sequence MQ_from_HSbrain_772, macaque
ggctgatgaccactgtggtgggatgggtagagaaggagctcagaggactgtgcgccttatttcccctgagccctccctctctcttcccacctgaggctctaggct

SEQ ID NO: 5239 - DNA, 97 bp, Artificial
  Hairpin sequence MQ_from_HSbrain_773, macaque
ccatagcagatttgaggcactgtttagggctgaattattctccaagttgagagatgtcattgggttaaattaaaagccctacctcaaactgaggtgg

SEQ ID NO: 5240 - DNA, 103 bp, Artificial
  Hairpin sequence MQ_from_HSbrain_777, macaque
gatgagctccagtactctgaccagccctatagaggcatcctgggtcagcagccagaatgattccccaagtgatgccagtgaggggcctgagtacctggccatt

SEQ ID NO: 5241 - DNA, 119 bp, Artificial
  Hairpin sequence MQ_from_HSbrain_779, macaque
cctgtgtgatgttgtgcaggcctgtctgtgtgattgtcaggaggcctgtctgtgtgactgtcaggcaggcccgtctgtgtgactgtcgtgcaggcctgtctgtgtgactgtcaggcagg

SEQ ID NO: 5242 - DNA, 78 bp, Artificial
  Hairpin sequence MQ_from_HSbrain_783, macaque; MQ_from_HSbrain_802, macaque; MQ_from_HSbrain_810, macaque
gccgaagagggcgggggtgcaggtcctggagctggatggcggaggccatttcctgggccgcctggcggccatcgtggc

SEQ ID NO: 5243 - DNA, 69 bp, Artificial
  Hairpin sequence MQ_from_HSbrain_785, macaque
acccgcctggctcccttctttctgtctgcttcctggccgcgaggcccggagagctgggagccagagggt

SEQ ID NO: 5244 - DNA, 81 bp, Artificial
  Hairpin sequence MQ_from_HSbrain_786, macaque
tggggtgtccgtgggggcggtctttgcctccctaaacctgtgcagaggagtggagcgtgcttttccctcaaacacatctcg

SEQ ID NO: 5245 - DNA, 119 bp, Artificial
  Hairpin sequence MQ_from_HSbrain_791, macaque; MQ_from_HSbrain_792, macaque
cgctctctccagctcagggttcaccctctgtgggactcgtgctctgtccagctcagggcttaccctccgtgggatttgtgctctgtccaactcagggctcaccctctgtgggactcgcg

SEQ ID NO: 5246 - DNA, 91 bp, Artificial
  Hairpin sequence MQ_from_HSbrain_794, macaque
gtcctctgtgactgtggcctaagcttgggggactcttgtgttttgcagctggctgagctgagaggggttcctcgtggcctgtatgacggac

SEQ ID NO: 5247 - DNA, 66 bp, Artificial
  Hairpin sequence MQ_from_HSbrain_795, macaque
gccctgggggtggtctctagctaacgctctggggtttcacccttggctggtctctgctcctcaggc

SEQ ID NO: 5248 - DNA, 98 bp, Artificial
  Hairpin sequence MQ_from_HSbrain_797, macaque
ctggagtgaagtagggctgagactggagttgggccttctatggcagagggtagtcaggggtgaaggccgaattgagctgattttcctgctgctgctag

SEQ ID NO: 5249 - DNA, 97 bp, Artificial
  Hairpin sequence MQ_from_HSbrain_798, macaque
gctcttcttccaccagctggtcggtgatcctctcaaacgctacgcccatgctctggtgtttggaatcctgctcacctgccgcctgctgattgcccgc

SEQ ID NO: 5250 - DNA, 103 bp, Artificial
  Hairpin sequence MQ_from_HSbrain_85, macaque
tctgcttatttcctggaggggagcccttgaggctgcgaggaggacaggtcatctggttcctcctttcccgtggcacccatgctccttccctgtgttctgcaga

SEQ ID NO: 5251 - DNA, 50 bp, Artificial
  Hairpin sequence MQ_from_HSbrain_869, macaque; MQ_from_PT_210, macaque; PT_from_HSbrain_879, chimp
ccctctctttctagttcttcctagagtgaggaaaagctgggttgagaggg

SEQ ID NO: 5252 - DNA, 51 bp, Artificial
  Hairpin sequence MQ_from_HSbrain_879, macaque; MQbrain_1924,MQbrain_2000, macaque
gccttctcttcccagttcttcttggagtcaagaaaagctgggttgagaggc

SEQ ID NO: 5253 - DNA, 107 bp, Artificial
  Hairpin sequence MQ_from_HSbrain_91, macaque
taagagaaaagtcacaggaagctcatctcctccctggattctgaattaggagcttctgaatcttttccagggataggcaggtagctcacccttggcgcaatttcttg

SEQ ID NO: 5254 - DNA, 90 bp, Artificial
  Hairpin sequence MQ_from_HSbrain_92, macaque
ctgacctgtggagcaggacctctgacgtgtgcccttcctgtgttgtatccagggacagggtgccttatcagagagactgcggagcttcag

SEQ ID NO: 5255 - DNA, 81 bp, Artificial
  Hairpin sequence MQ_from_MM_100, macaque; PT_from_MM_100, chimp
gattttcccaacattttatggcaatttgtttcatttgccgcaggcccataacgatgcaaattgccataaagtgggataatc

SEQ ID NO: 5256 - DNA, 113 bp, Artificial
  Hairpin sequence MQ_from_MM_101, macaque
agcatagttgtagcatgtggttgtattaatgaacgttacaggacagctttataatcatttataaatctgtaacattcaataaagaagcacatgttgcaatgattaattatgtt

SEQ ID NO: 5257 - DNA, 93 bp, Artificial
  Hairpin sequence MQ_from_MM_103, macaque; PT_from_MM_103, chimp
tggcggcgctggcggaggagcagacggaggtggcggtcaagctagagcctgagggaccgccaacgctgctacctccgcaggcgggggacggcg

SEQ ID NO: 5258 - DNA, 89 bp, Artificial
  Hairpin sequence MQ_from_MM_108, macaque
tagggttgatgcaaaagaaaggaaaacatctttgaagttctgaaaaataggacttcaaagatattttcctttcttctccatcgaatcta

SEQ ID NO: 5259 - DNA, 71 bp, Artificial
  Hairpin sequence MQ_from_MM_109, macaque
ggagccgctccaccgatgacaccatcttggcgcagaaactcgccgaggaggtgcccatggacgtggcctct

SEQ ID NO: 5260 - DNA, 89 bp, Artificial
  Hairpin sequence MQ_from_MM_111, macaque; PT_from_MM_111, chimp
gcccctccttctcagccccagctcccgctcacccctgccacgtcaaaggaggcagaaggggagttgggagcagagaggggaccacgggc

SEQ ID NO: 5261 - DNA, 117 bp, Artificial
  Hairpin sequence MQ_from_MM_112, macaque
ggggtgggcgggcggaggtagggcggcttaccataggggttcatgtggtcacctggcatttggggcggcgtgaggccctgctggaaagggtcgctgctaccgtaggggctctgctcc

SEQ ID NO: 5262 - DNA, 94 bp, Artificial
  Hairpin sequence MQ_from_MM_114, macaque
tttgctgtgaaaattgcaaatgtttgcctggagcaaatatgtgaaaatttgcaatttgttgtaggtgtggaattttgctatttttcacagtgga

SEQ ID NO: 5263 - DNA, 109 bp, Artificial
  Hairpin sequence MQ_from_MM_115, macaque
ccatttcaagaatcttctgacaatgaaggtaggcggacaaccaggagattgctgtcacgcatagcttctagcatgtcatctacttttttttcacgaagatctagtcagg

SEQ ID NO: 5264 - DNA, 75 bp, Artificial
  Hairpin sequence MQ_from_MM_117, macaque
gaccgaccaccagacagacagaggggacgctgctgccaccgcggggactaatctgtctgtggggatgggagagtc

SEQ ID NO: 5265 - DNA, 85 bp, Artificial
  Hairpin sequence MQ_from_MM_118, macaque
actcttatttcctccactgcctgactttattgaatgccatggggcatattaatcagtaaagccaagtagtgcatgaaataaaagt

SEQ ID NO: 5266 - DNA, 99 bp, Artificial
  Hairpin sequence MQ_from_MM_122, macaque
caaacaggccactccatctgttcaaacataatgctccaaaccaaggaatatgttccaaaccaaagagcatgatatttgacagatggagaggtctgtatg

SEQ ID NO: 5267 - DNA, 81 bp, Artificial
  Hairpin sequence MQ_from_MM_123, macaque
tttcctaagtgatgtcagcccctgtgagcttccaataggagtcaggcataaatcagggagctgaccttatccaataggaaa

SEQ ID NO: 5268 - DNA, 106 bp, Artificial
  Hairpin sequence MQ_from_MM_124, macaque
ggagggctgatgagcagttcaagttccctgcatagaaatagcctcagaacagttccagtgttgtttctaattgcaatggatgagcagactgtctcattaatcctcc

SEQ ID NO: 5269 - DNA, 86 bp, Artificial
  Hairpin sequence MQ_from_MM_13, macaque
cagagcggcgcctcccagcccctgctgatcaacatgtacctgccaggtaccagggaccagccgggcgctggtggcaccggaacctg

SEQ ID NO: 5270 - DNA, 97 bp, Artificial
  Hairpin sequence MQ_from_MM_131, macaque
agataaaccctaaaaatgcagcagaagcacttccgcacactggtgtccagaatctagtttgtgcggaaatgtttccactagatttatagagtactct

SEQ ID NO: 5271 - DNA, 115 bp, Artificial
  Hairpin sequence MQ_from_MM_135, macaque; MQbrain_977, macaque
ttcttttttgaatatatttttctcttgcagggttacattttgccatctgcctttccagagtaagtggctctatgtgggcactgaacgaggtaatatacatattgtcaatgtggag

SEQ ID NO: 5272 - DNA, 98 bp, Artificial
  Hairpin sequence MQ_from_MM_137, macaque
gccactttcagctttcagtttttatttaaaagacttaattggaagtttttattactcccaattaggctttttaattaaaaggaaaagttgaaagaggc

SEQ ID NO: 5273 - DNA, 114 bp, Artificial
  Hairpin sequence MQ_from_MM_14, macaque
gtatttttaatatcttctctgctatttgactgcatctgattgacctcactgcaacccacagaggaggcagatttagaagcaaaccagtatgacagggaaatagcccaattatgc

SEQ ID NO: 5274 - DNA, 107 bp, Artificial
  Hairpin sequence MQ_from_MM_143, macaque
tgtatgccagatacaagtgaatttaagcccacatgtattgaagctgcaagcttagtttgcaatttatgtgcaagtggttttgtatttattgatctggatcgagtgca

SEQ ID NO: 5275 - DNA, 77 bp, Artificial
  Hairpin sequence MQ_from_MM_146, macaque
gcaaaaaggaaaacagatgggcaatatccagtaagaaaattttgctcagtattgcccatctgcttctctctgcctgc

SEQ ID NO: 5276 - DNA, 79 bp, Artificial
  Hairpin sequence MQ_from_MM_150, macaque; PT_from_MM_150, chimp
tcctcctcaggtgctcatgtgggagagattagcttgtgtttataagccgatctgttcattaagcgcctgccggtgtgga

SEQ ID NO: 5277 - DNA, 83 bp, Artificial
  Hairpin sequence MQ_from_MM_151, macaque
tgtgccatatcatattcttaccaaaacatttgctctgattggtggcccggtcaacaaagactttggctgagatgacatggcca

SEQ ID NO: 5278 - DNA, 118 bp, Artificial
  Hairpin sequence MQ_from_MM_153, macaque
cttcagcctgggcatagttggatgagagggcgtcttggcaggtctctgtgtttaaagagcacaggtgtgagacactgggacgcacgctttcggctcaacattgccttctgggttgggg

SEQ ID NO: 5279 - DNA, 120 bp, Artificial
  Hairpin sequence MQ_from_MM_156, macaque; PT_from_MM_156, chimp
tagatggtttagtcggagctgttacatttggcagcattccttgttagcatttgataaacaattattgccaaatgttagcaaggaaacctgccaaatgttacagctcagatttaactgctg

SEQ ID NO: 5280 - DNA, 118 bp, Artificial
  Hairpin sequence MQ_from_MM_157, macaque
cttcaagtgaaaagtgttaaaataaatggctcatgacttatgaagtgttaaaataaacgtttatttcaacgctatacatgtcataagccatttatttcaacactctgtacttcagaag

SEQ ID NO: 5281 - DNA, 116 bp, Artificial
  Hairpin sequence MQ_from_MM_158, macaque
gctactccatcccctgctgcactaaattgacacttgggcaagcaatggctctcgtcagtcactccgaagctgctacttccagaagtgtcgatttagtacagcgggggatgaggtgc

SEQ ID NO: 5282 - DNA, 99 bp, Artificial
  Hairpin sequence MQ_from_MM_160, macaque
cgtcaaggatttggcatttcaatcgatgggaaatgatgtgtgatcattctaatttattatacatcatttcccatcaatcgacgaactaaagccctgacg

SEQ ID NO: 5283 - DNA, 101 bp, Artificial
  Hairpin sequence MQ_from_MM_163, macaque; PT_from_MM_163, chimp
ccgcacaggaagcagcaggtagttctgtctgctgtctctttagataaaatgtatgtctggcaccaagggaacagctgagaactacctgttgttatgtatgg

SEQ ID NO: 5284 - DNA, 118 bp, Artificial
  Hairpin sequence MQ_from_MM_166, macaque
agctgtctagatggtgcattagggagaatagctgatggattacaaatctctgcatttcaccaacaaaaatgaatttgaatccatcaattttattcccttatgccaaatttaggaagtt

SEQ ID NO: 5285 - DNA, 88 bp, Artificial
  Hairpin sequence MQ_from_MM_173, macaque; PT_from_MM_173, chimp
ggaaaaaaaaggcagacactgtgtttgatgccaataatggttgccagtggcaccgaggttggcatcagaccctctttgtctagttgct

SEQ ID NO: 5286 - DNA, 89 bp, Artificial
  Hairpin sequence MQ_from_MM_174, macaque
ctttactgaagtggggccagttctccgcctcttttaactttactgccaaggctggagaggggtggagtggcctggaagacagttggaag

SEQ ID NO: 5287 - DNA, 76 bp, Artificial
  Hairpin sequence MQ_from_MM_175, macaque
tggcaagaggaggagcagcagggtgaaactgacacagttctggtgagtttcactttgctgctcctcctgattctca

SEQ ID NO: 5288 - DNA, 78 bp, Artificial
  Hairpin sequence MQ_from_MM_178, macaque
aagcagggacttcttgccagcccttggcagcgtgaggcctcccatcatcatccaccgagctggcaagaagtatggctt

SEQ ID NO: 5289 - DNA, 67 bp, Artificial
  Hairpin sequence MQ_from_MM_179, macaque
aggtactctgtgggagggaggagataatagccaaggattatattcctccttcatatttgtagtacct

SEQ ID NO: 5290 - DNA, 76 bp, Artificial
  Hairpin sequence MQ_from_MM_18, macaque
acatgcagctaattatacccacaattggctaattgcaccgacaattagccaattgcaggcccaattggccacttgt

SEQ ID NO: 5291 - DNA, 82 bp, Artificial
  Hairpin sequence MQ_from_MM_181, macaque
gaccagctcacaggaagtggccttcaatagtccgatagtttcctgtatcctgacattgtgaaggcccacttcctgtgctgtc

SEQ ID NO: 5292 - DNA, 93 bp, Artificial
  Hairpin sequence MQ_from_MM_182, macaque
gtcaatgtctgtgcctcactgtttgttaaatattttgacccagtcgccatgggtaagggtgagtgacctgaagggtgggcaggaaggagtgat

SEQ ID NO: 5293 - DNA, 97 bp, Artificial
  Hairpin sequence MQ_from_MM_184, macaque
gtgaggagcaggttagctgggtgaaaagttcacagtgaggggagctgtctgttccctcacttaatttatccactatttggctaaccttgctctgaac

SEQ ID NO: 5294 - DNA, 116 bp, Artificial
  Hairpin sequence MQ_from_MM_186, macaque; PT_from_MM_186, chimp
acacttgctcaaattaatgaccaaaatgtcagatgtgtccacagctaattattcattagatgcttaattagtgtgggatgatcatgacattttaatgttattaatttttatactgt

SEQ ID NO: 5295 - DNA, 119 bp, Artificial
  Hairpin sequence MQ_from_MM_189, macaque
gaaaaggagtatgaaaaaaatgtctgtaatatgtagtaaatgaggcccataactcattggaacctccaatgagttatgtgctaaattcatatttcacaacatggtcatgcatttttttt

SEQ ID NO: 5296 - DNA, 93 bp, Artificial
  Hairpin sequence MQ_from_MM_190, macaque
accaaaggaacttttctggtctattgggtaaatatgtattaaagtaatttttaaaatacttatgtactcaataggctgtaagtggtcaatggt

SEQ ID NO: 5297 - DNA, 99 bp, Artificial
  Hairpin sequence MQ_from_MM_199, macaque
ctgcctgctctgcaaaacttaggaggctacttttgattggaataaaagtgcacacgctgactttttaaaatgtggctttaattaatggtgggtgggcag

SEQ ID NO: 5298 - DNA, 109 bp, Artificial
  Hairpin sequence MQ_from_MM_202, macaque
gtgaggaacgtctagggagccaccagtggtgtaagtgctttggctaagtgatggagacaactgaggaggagtgtgattaccactgggttcctgaatggaaatatatcat

SEQ ID NO: 5299 - DNA, 113 bp, Artificial
  Hairpin sequence MQ_from_MM_214, macaque
gctatgaataagctgacgctgcccattccctccacgtgccccgagccctttgcccgcctcctggagggtgagccaggggccctgtggcgagggtaggctcagcttgaaatggc

SEQ ID NO: 5300 - DNA, 120 bp, Artificial
  Hairpin sequence MQ_from_MM_218, macaque
agggccctgtgactcaggcgcgggttggggaggatgttttggatgccgctctgctgacgctggtgccctctgttcttacatcctccttaatttactgcctgaggagggggccagggctct

SEQ ID NO: 5301 - DNA, 111 bp, Artificial
  Hairpin sequence MQ_from_MM_226, macaque
ccagacagatgatgagttatcttttcctgagggagcaataatccgtatcttgaacaaagaaaaccaagacgacgatggcttctgggaaggggaattcaatgggcgtattgg

SEQ ID NO: 5302 - DNA, 116 bp, Artificial
  Hairpin sequence MQ_from_MM_230, macaque
ccttgggcttcttccagtcatcgtgaggtagatatcatagaggaatgctggggccttatgacttacagcaatccagtaatgatataaaaggtgactggaagttagatgtacattgg

SEQ ID NO: 5303 - DNA, 77 bp, Artificial
  Hairpin sequence MQ_from_MM_232, macaque
tccaagttcatgatgaagagtttgtcagtgggggtcagttccacaggctgtctggtgaactctttgtcgaagttgga

SEQ ID NO: 5304 - DNA, 83 bp, Artificial
  Hairpin sequence MQ_from_MM_234, macaque
ggcccggctccgggtctcggcccgtacggtccggccggccatgctggcggggctggggccggagccgagcccgcggcggggcc

SEQ ID NO: 5305 - DNA, 98 bp, Artificial
  Hairpin sequence MQ_from_MM_236, macaque
ttacacctgaaacttctcgcttgggggtacaattagcctctggcgcctttagaatgagttgctggtgactaattatgccctcaaggaggcatttgtaa

SEQ ID NO: 5306 - DNA, 117 bp, Artificial
  Hairpin sequence MQ_from_MM_237, macaque
ctctgaattgtctgtcttattgtgtttggttgaggcctagtaattttcaataaagcccttaatccaagtacttcactgaaaattaccaggcttctctgtggaggctgagagtcaaag

SEQ ID NO: 5307 - DNA, 108 bp, Artificial
  Hairpin sequence MQ_from_MM_238, macaque
tcctcgatgcttgattagtcagattgatggaggaggccatatgtggccgtgtcaaaacttggctacaaggctctttccctctctatgaaggacaggcaataaagagga

SEQ ID NO: 5308 - DNA, 98 bp, Artificial
  Hairpin sequence MQ_from_MM_239, macaque
cagagtcttgctgtggtagcgccccaggatggagtaggcagggccaaggtccttgccagtcctcagtatcttggggtttacattataacggggtcctg

SEQ ID NO: 5309 - DNA, 110 bp, Artificial
  Hairpin sequence MQ_from_MM_240, macaque
ctgctgaacgggccctctgtgtggctgctgctggctcagacccctgcccaccttgggcgggtgggtctgggtcttggctggcacgcacacccaggggcctgaaatcatgg

SEQ ID NO: 5310 - DNA, 118 bp, Artificial
  Hairpin sequence MQ_from_MM_242, macaque
atgatggaggtgcaggcatttcctgaggattaatgaccagctgggaggaaccagtggcccttggctctgcctcccagccagccattaattctaaggaaatgtcttttgctgaggtcgt

SEQ ID NO: 5311 - DNA, 71 bp, Artificial
  Hairpin sequence MQ_from_MM_256, macaque
gggttgaccaaagcggccatgatggcaatgtccgagtatgaagatcggttgtcatctggtctggtcagccc

SEQ ID NO: 5312 - DNA, 101 bp, Artificial
  Hairpin sequence MQ_from_MM_266, macaque
gatagccttctccaactgttacaatctccacttcactatcagttgaggtaacattaatttcttcattggcagtaacctggggagtggaggaagcttctatc

SEQ ID NO: 5313 - DNA, 113 bp, Artificial
  Hairpin sequence MQ_from_MM_271, macaque
catcccagcatgccagtgggaattacaggctggagagaccttccttctgcaggagaagaaattcttgaagtagaatctgaggtatatcaagcttaattcctatatgtaggatg

SEQ ID NO: 5314 - DNA, 82 bp, Artificial
  Hairpin sequence MQ_from_MM_275, macaque; PT_from_MM_275, chimp
gcttttcttttctcctttttgcacaaagagtctcatgtctgatatttagacatgatgagctttgtgcaaaaggggagctggc

SEQ ID NO: 5315 - DNA, 118 bp, Artificial
  Hairpin sequence MQ_from_MM_28, macaque
tttcttgttctcctctacataccctcagagctgatctgagtgtggagattccattcacttcaaaggaagcttcatgcttggatcttctccacaggggtgctcagactaagacaagaaa

SEQ ID NO: 5316 - DNA, 115 bp, Artificial
  Hairpin sequence MQ_from_MM_283, macaque
tcaacttaagcttagtacctgtgggcagcatcagggtctgccttgcggtgggaccgcttgggtttcagagcagggtccctgttgtttcctgacagacgatctgaagcatagctgg

SEQ ID NO: 5317 - DNA, 103 bp, Artificial
  Hairpin sequence MQ_from_MM_285, macaque
ctgtgtttcccatgtgcctttaaggaatcattcttgatctcagccataaaattggaaagctgcataactgacaagatgatccctaaaggcagctgaaacacgg

SEQ ID NO: 5318 - DNA, 82 bp, Artificial
  Hairpin sequence MQ_from_MM_288, macaque
gtaagaaatgagaaattttttagggccattgagcaccatgcattttcagtgttcagtagccctgaaaatttctcatttaggc

SEQ ID NO: 5319 - DNA, 108 bp, Artificial
  Hairpin sequence MQ_from_MM_290, macaque
tttgtctctgctctctggccatttcggtttttccagtccgatgcccctgagggggagggtcgggccccttggaaaatccgttttcatggcaacacggagcctctcaga

SEQ ID NO: 5320 - DNA, 112 bp, Artificial
  Hairpin sequence MQ_from_MM_293, macaque
tggtgtgctctcggtagctatggaaatcccagggtttccctagcaacagctccagatgggtcttgttgctagggaacgctgggatttcccaggctgccagataagcaagaca

SEQ ID NO: 5321 - DNA, 114 bp, Artificial
  Hairpin sequence MQ_from_MM_294, macaque; MQbrain_1636, macaque
accattgatggcccctccaaggtgaagatggattgccaggagtgccctgagggctaccgtgtcacctatacccccatggcacctggcagctacctcatctccatcaagtatggt

SEQ ID NO: 5322 - DNA, 97 bp, Artificial
  Hairpin sequence MQ_from_MM_296, macaque
gattctcacctgaatgcatgactcttcaacctcaggacttgcagaattaatggaatgccgtcctaaggttgttgagttgtgcgtttctgggcatttc

SEQ ID NO: 5323 - DNA, 114 bp, Artificial
  Hairpin sequence MQ_from_MM_298, macaque; PT_from_MM_298, chimp
tttctctgtggattaattggtcaggaaagacactttttatattgtcaagtggcacttaagccattaattcttgactgtgaaactgcttttcctgggcaatgctctttaaggaaa

SEQ ID NO: 5324 - DNA, 75 bp, Artificial
  Hairpin sequence MQ_from_MM_299, macaque
gctttgccttcctgctcctcctcatactgttcccgcagcaggtcgcagtcatggcgggaggactgcagggcgtgc

SEQ ID NO: 5325 - DNA, 119 bp, Artificial
  Hairpin sequence MQ_from_MM_30, macaque
ttatttttctttctttcacaaagagcaaagggtttcagaatcaagtttgtcttcaagcagcagcaaaggcttgctgacaagatattttggaacaacttgctattaggaaggaagtatga

SEQ ID NO: 5326 - DNA, 108 bp, Artificial
  Hairpin sequence MQ_from_MM_300, macaque; PT_from_MM_300, chimp
attttcaaacaagcatttgtgtgcataaaatgggtaattgcacacacaaatgggcaattttgtatgcaattatccattttgcatacgcaattatatgcttctgagggt

SEQ ID NO: 5327 - DNA, 105 bp, Artificial
  Hairpin sequence MQ_from_MM_301, macaque
tcagatggttgggagtggggatgggggcacttctgttcctgacaacctcattatgtggttatcaggagcagacactgcccaggttgtcacgacaaccagcaatga

SEQ ID NO: 5328 - DNA, 118 bp, Artificial
  Hairpin sequence MQ_from_MM_303, macaque
ggggcaaggggcacttcacctggcacactgggctggaagactttattcagatccaaggaggaggctctggaatgggttttctgtggccgaggtggcggggtgggagggtcctcgcccc

SEQ ID NO: 5329 - DNA, 110 bp, Artificial
  Hairpin sequence MQ_from_MM_304, macaque
cctgtcccagcgcgtggccgaccgtctgggcctggagctgggcaaggtggtcaccaagaagttcagcaaccaggagaccaggtgggggccacgccggcggccgggctagg

SEQ ID NO: 5330 - DNA, 71 bp, Artificial
  Hairpin sequence MQ_from_MM_305, macaque
gggtaggagagatgctgggggcgggggtgctgtgttctagaccccccatattatcccagtgtcccctgccc

SEQ ID NO: 5331 - DNA, 104 bp, Artificial
  Hairpin sequence MQ_from_MM_306, macaque
gctgtgaggtcagaatcctgtgcttacgacacctcggtctgttgccatggaaacaggggcggattaaggctggagcgcggagcgcagggatcaggcccctccgc

SEQ ID NO: 5332 - DNA, 90 bp, Artificial
  Hairpin sequence MQ_from_MM_307, macaque
ttactcacctgaaaactgctgaggagcacaaatgtcatggggataaatcaagcctgtgagattggcatctctcagcagctaggtgactag

SEQ ID NO: 5333 - DNA, 76 bp, Artificial
  Hairpin sequence MQ_from_MM_309, macaque
gtcgagaattgattttatattcctggtcaagttgctgaaacgtagcaattgggtcaggaagatcggttccttggac

SEQ ID NO: 5334 - DNA, 79 bp, Artificial
  Hairpin sequence MQ_from_MM_311, macaque
tacaggatgtctgtgcaattcgatggagctcatcacttttcggtatatgagcaattaaattgtaccaggaagccctgta

SEQ ID NO: 5335 - DNA, 77 bp, Artificial
  Hairpin sequence MQ_from_MM_313, macaque
gtttaaaggaagaagtttgttctactgtaaacagttatgggaactgtttgctttggatggacttggtcctcattggc

SEQ ID NO: 5336 - DNA, 85 bp, Artificial
  Hairpin sequence MQ_from_MM_314, macaque; PT_from_MM_314, chimp
gtcagagagcaggaaatggcttctaattagtagtgtcctcacaggatacaactgcagaagataatttcctgtccccttatttgat

SEQ ID NO: 5337 - DNA, 109 bp, Artificial
  Hairpin sequence MQ_from_MM_315, macaque
gccaatgaaaggcctcagtctgcgggccccgaggagggttgtgggcccttttttgtgaatgaagcgccacggaacagccctcctggggtccccacgagccgcgtctggc

SEQ ID NO: 5338 - DNA, 78 bp, Artificial
  Hairpin sequence MQ_from_MM_316, macaque
ccattgtgcaggattacatttgctctccccatgctgaaagtatgaggaagagaaaccagattgtgttcaccatggtgg

SEQ ID NO: 5339 - DNA, 76 bp, Artificial
  Hairpin sequence MQ_from_MM_317, macaque
cacacatgtgatgaattgtgggtgcttgcctggcttcccaggcaagaaccgtaagcaattattaaatgccattgtg

SEQ ID NO: 5340 - DNA, 79 bp, Artificial
  Hairpin sequence MQ_from_MM_319, macaque
tgctgatgctggcggtgatcccgatggtgtgagctggaaatggggtgctacgtcatcgttgtcatcgtcatcatcatca

SEQ ID NO: 5341 - DNA, 119 bp, Artificial
  Hairpin sequence MQ_from_MM_32, macaque; PT_from_MM_32, chimp
acaattgggagggaaagaggactattatttaaaaggcttttaaatgatgtcactatatattcttttaacaacatcctctaaaagcctttgaaaaaatagtcccttcctccctcagttgt

SEQ ID NO: 5342 - DNA, 118 bp, Artificial
  Hairpin sequence MQ_from_MM_320, macaque
cggagaggggcacgaggcaggcacgcatagctctttaaatattgctgagcatttcctggatcagcatgatatttaaagatttttgttccacctgcctgcgaaatatagagtccagccg

SEQ ID NO: 5343 - DNA, 113 bp, Artificial
  Hairpin sequence MQ_from_MM_323, macaque
gtagatcaaacagcgagaggcactttgtacttctgccaggagaccatatgatatctctcagtgactctcctgcatgccaggaacacggacccatgcctcttagccgggtctgc

SEQ ID NO: 5344 - DNA, 99 bp, Artificial
  Hairpin sequence MQ_from_MM_324, macaque
ctggagtccagccctccaggggttaagggggcggggccaactggttaccatggtgccagactgtttgggtctgctctctgacccttgggggctccccag

SEQ ID NO: 5345 - DNA, 109 bp, Artificial
  Hairpin sequence MQ_from_MM_33, macaque
aggagcagctggagtcggggattaccccctgctgctgacgtgaggacggtgaacaatcgggaacgttcggtggaagggggaattccccgccgctctgtgaggcgcccct

SEQ ID NO: 5346 - DNA, 109 bp, Artificial
  Hairpin sequence MQ_from_MM_335, macaque
agattattttaaattttatgggccaaattctgccctcaattatgcacatgcaactaattgcacacacataactgagggtagagtttggcttttggagttgaaaatctct

SEQ ID NO: 5347 - DNA, 109 bp, Artificial
  Hairpin sequence MQ_from_MM_336, macaque
caagtgttcttattaaatcaccttgaagtgtctcttgtaaaagataactccctgcattgtagaaatgtctttgacaagagaggattagggtgaaattgcaattaccttg

SEQ ID NO: 5348 - DNA, 78 bp, Artificial
  Hairpin sequence MQ_from_MM_338, macaque
ggcgcctggaggtgatgtcaaagcaggtgatcatcatgagatgggccttgcagaagttgacacggctctccaggcgct

SEQ ID NO: 5349 - DNA, 85 bp, Artificial
  Hairpin sequence MQ_from_MM_339, macaque
cttccctgctctaattagaattcccttattccatttctgtttctcaggagaggacagggggctttttaattggggctattagaag

SEQ ID NO: 5350 - DNA, 120 bp, Artificial
  Hairpin sequence MQ_from_MM_34, macaque
gctgtttattcctcatttgagtcataatcctccgtttgtgacatcacaattagccacttgtggtgatgattataatgtcatgaacaaaggattatgactgggagttggaaacaaaacagc

SEQ ID NO: 5351 - DNA, 99 bp, Artificial
  Hairpin sequence MQ_from_MM_345, macaque
gggcctcagccacacgctgagctgcctcccaatcctggttatggacaaacctgcctccggatggggacagaggagagactgagtataggactgaggccc

SEQ ID NO: 5352 - DNA, 109 bp, Artificial
  Hairpin sequence MQ_from_MM_349, macaque
gcaaagaagtggtttggaggactgcattcattttgagtgctgttgtaatcaattttagatacagcattccacaatggatcagtttgcatccaaacctgccttattatgt

SEQ ID NO: 5353 - DNA, 111 bp, Artificial
  Hairpin sequence MQ_from_MM_355, macaque
ctttggcaagggagggtatggtgaagatggtggtcttggaggtggacatttatccaacaaaatgctactgttagataagccatttttacctagattccttaaaaaaaaaag

SEQ ID NO: 5354 - DNA, 85 bp, Artificial
  Hairpin sequence MQ_from_MM_359, macaque
aatctaggaggcaggtgctcacttgtcctcctccatggttggaaaatacaggggggaggccatagtggcaactgtcaccatgatt

SEQ ID NO: 5355 - DNA, 89 bp, Artificial
  Hairpin sequence MQ_from_MM_40, macaque
ggagggggcggcgcgcgagagcctggtggccctggtcagcacctcggacagggactcgggcgccaacgggcaggtgcgctgcgccctct

SEQ ID NO: 5356 - DNA, 97 bp, Artificial
  Hairpin sequence MQ_from_MM_41, macaque
caaatgctatgactcaaacttggggaaattgttcctgtaatggagttctcaatttattggtcaatttcaccttgattttgtgtcactgttagctttg

SEQ ID NO: 5357 - DNA, 118 bp, Artificial
  Hairpin sequence MQ_from_MM_43, macaque
tgtgtaaaaggcagaaataatcatgtaatcatcttgtaattatatggtacttactatgcaattacatagtaaatacattgtaaattcaaaataattacatggttatttgcattatgca

SEQ ID NO: 5358 - DNA, 88 bp, Artificial
  Hairpin sequence MQ_from_MM_46, macaque
tgtggagaagtctggggcttgccctggctctctgtctccttccatcgggaggaacagagagccaggaccaaagctccttctgtaagca

SEQ ID NO: 5359 - DNA, 101 bp, Artificial
  Hairpin sequence MQ_from_MM_5, macaque
agcgccggccggccgcgtcgccgcttcatgaatggagcccacgtgaccaaacatcatgtgacgtctgtggagcggcggcggcggcggtggatcccgagcct

SEQ ID NO: 5360 - DNA, 109 bp, Artificial
  Hairpin sequence MQ_from_MM_50, macaque
gatgagtggggtaaaaccccggatgccatgaaagccgccatggccctggagaaaaaactgattcaggcccttttggatcttcatgccctgggttctgcccacacggatc

SEQ ID NO: 5361 - DNA, 91 bp, Artificial
  Hairpin sequence MQ_from_MM_54, macaque
gtcttttaactctatattgctggtggctctgatttcatgatgcattgtgcttatgaaactctagctttcagcgctaaaatgagttaaagat

SEQ ID NO: 5362 - DNA, 102 bp, Artificial
  Hairpin sequence MQ_from_MM_58, macaque
gcaaagcagctggaaagggcttagccctttaatgccagcagctgtatcttcacagtgcggctgctcagctgaggggctggactctgtccagaagcaccaggc

SEQ ID NO: 5363 - DNA, 113 bp, Artificial
  Hairpin sequence MQ_from_MM_6, macaque
tagacctgggcatttcctggggattaatgaatagctgggcggagttaattgcctaaagtatagtctcaggccattaacctcagttggtcactaatctctaggaatttcttcta

SEQ ID NO: 5364 - DNA, 106 bp, Artificial
  Hairpin sequence MQ_from_MM_65, macaque
ggccgaagcagctagctccgttcgtgatccgggagcctggtgccagcgagacctggaatttccggtctggttggtcttgggccccgcggagccaggttgatacccc

SEQ ID NO: 5365 - DNA, 89 bp, Artificial
  Hairpin sequence MQ_from_MM_66, macaque
ctttattgtataaacactgtgctaaaatggcagaaactaggaccatatcttggtttttgtaataatgccagcagagtatacacaagaag

SEQ ID NO: 5366 - DNA, 85 bp, Artificial
  Hairpin sequence MQ_from_MM_67, macaque; PT_from_MM_67, chimp
gcgggggattcctttctgacctcattcctgtaccatttgtttgcaggcttgtagggggagaggaggacattttggaatcctttgt

SEQ ID NO: 5367 - DNA, 110 bp, Artificial
  Hairpin sequence MQ_from_MM_70, macaque
taattgggtcagaatgttttgttgtcaggattcttagttgcttgcattggcttatgaaaaggtcattatgagagaagggatctgaatagcaacgagattccagctggtta

SEQ ID NO: 5368 - DNA, 84 bp, Artificial
  Hairpin sequence MQ_from_MM_71, macaque
gtaggtactgatttatgaaaagctgtaaaagatcaggtggagctctgtaggacatcgttcacagctgcatggattgaaacctat

SEQ ID NO: 5369 - DNA, 95 bp, Artificial
  Hairpin sequence MQ_from_MM_72, macaque
ttgagctgtaattccattgagggtttctggtgacttcagcttcgcacttgtggttatagtattcccagaacccctcaatggagtgatttcctgaa

SEQ ID NO: 5370 - DNA, 99 bp, Artificial
  Hairpin sequence MQ_from_MM_74, macaque
tgccagtatttcctgaggattaatgatcaactggaagagcttgtggtcctgggaccattaactccatgtggtcattaattttgttggaaatgtcttaca

SEQ ID NO: 5371 - DNA, 95 bp, Artificial
  Hairpin sequence MQ_from_MM_75, macaque
tccagctattaattacactaagtgacaaagattctccttgctgcatgatggacacaaggatgaatctttgttactgattgcaaataacagaacga

SEQ ID NO: 5372 - DNA, 77 bp, Artificial
  Hairpin sequence MQ_from_MM_79, macaque
gcggagtggctgtgataagtgggatgcggaaagtgtccactgagccgatctgtctcccgctcacccacagcagttgc

SEQ ID NO: 5373 - DNA, 75 bp, Artificial
  Hairpin sequence MQ_from_MM_82, macaque
tctggcaaccatgaaacccagatgctaagcactggaagatatttcttccaaagcagcatctggcgtgctggcaga

SEQ ID NO: 5374 - DNA, 114 bp, Artificial
  Hairpin sequence MQ_from_MM_85, macaque
gtaaaccaaaggtatcgaatttgtggcttttgctagctttgcagaaaagatttttttaaaatacatttcttgatagtgcaaaactagcaaaagccacaaatgggatgggtttgc

SEQ ID NO: 5375 - DNA, 88 bp, Artificial
  Hairpin sequence MQ_from_MM_86, macaque; PT_from_MM_86, chimp
agactggctcactggaggctgcagagaagtgaactgaagaattacagtcggtttcacttccctgccttatgtgccttcaggtgcctct

SEQ ID NO: 5376 - DNA, 108 bp, Artificial
  Hairpin sequence MQ_from_MM_89, macaque; MQ_from_MM_90, macaque
ggcgcggcaccagctccgccagctccagccccagatcctgcgcgatgcggcccacgaaggtgccgtgtttggcctcctccgggacggagtagtggagctggccgctcc

SEQ ID NO: 5377 - DNA, 118 bp, Artificial
  Hairpin sequence MQ_from_MM_9, macaque
tgagaaggtatattagcatgttaataggtctttgtgcccaaaggctttggattataaattatgaagactgcattggccagatgggcaggattaattagcatgctagtattacctggca

SEQ ID NO: 5378 - DNA, 109 bp, Artificial
  Hairpin sequence MQ_from_MM_91, macaque
ttgccctgacctccaccttcactgactccctcttttccttcttccctcagccaatgctgaggccttgaaggagatgctgggggacagtgaaggagaagggacagtgcag

SEQ ID NO: 5379 - DNA, 73 bp, Artificial
  Hairpin sequence MQ_from_MM_94, macaque
tggctcacagtttaggatttcatgctgatctggtcgacacagttcagatcagtttgacccaccactgcagtca

SEQ ID NO: 5380 - DNA, 118 bp, Artificial
  Hairpin sequence MQ_from_MM_96, macaque
ttcccttcgtctggctgtgctggcggggctggctctgggcctcagacactctggaatcgccaaggtctgagctcagggcctggcccccttcccaggctaacagccgcgaggagggggg

SEQ ID NO: 5381 - DNA, 111 bp, Artificial
  Hairpin sequence MQ_from_MM_98, macaque
ggggtgctgtaaagcctttattgccacttgttaaggaagacccgtatagctcactcgtgagtaataaggcggtcaacccaaactaaggcactaaaaattttatagcacccc

SEQ ID NO: 5382 - DNA, 92 bp, Artificial
  Hairpin sequence MQ_from_MM_99, macaque; MQbrain_2214, macaque
tcctctttgcaaaatcatatttttgtgggaatgggtcctgctttttgtggcaaggcctgttctgattaataaaggatcgtgaaaaagtaggg

SEQ ID NO: 5383 - DNA, 73 bp, Artificial
  Hairpin sequence MQ_from_PT_1, macaque
ggcagctgaagcgggacaagccagtgaccgtggtgcagtccattggcacggaggtcatcggcaccctgcggcc

SEQ ID NO: 5384 - DNA, 77 bp, Artificial
  Hairpin sequence MQ_from_PT_101, macaque
ggcaagcaaccccggtgagggaaggggagccgaggtgaacgctgcgcctcggtccctcccacctccggacaatcgcc

SEQ ID NO: 5385 - DNA, 66 bp, Artificial
  Hairpin sequence MQ_from_PT_102, macaque
gctgaaggcgggggtctcattctgcaaagagaggtggcctccctttcttgacctcctcctccaagc

SEQ ID NO: 5386 - DNA, 87 bp, Artificial
  Hairpin sequence MQ_from_PT_104, macaque
ctccgggaggcgggcctagaacgccaccgacttgaggaagcccagtacatttcaagttggccgcggcgtgggctccgcgtgggggag

SEQ ID NO: 5387 - DNA, 83 bp, Artificial
  Hairpin sequence MQ_from_PT_105, macaque
ccaggttctggggggtgccagagcctgaccacacagggccttctctccctccaccctgactgtgctctctcccccagggctgg

SEQ ID NO: 5388 - DNA, 80 bp, Artificial
  Hairpin sequence MQ_from_PT_108, macaque
gttggggcaggagtgggctaaggaaacctgctctatgattaatacaggacaggttctcttagctcactcctgcaaatagc

SEQ ID NO: 5389 - DNA, 73 bp, Artificial
  Hairpin sequence MQ_from_PT_110, macaque
ggagagcaatggagagagccgtggagtcttcaacagcttcactgaagaccaagacggactctctgctattacc

SEQ ID NO: 5390 - DNA, 77 bp, Artificial
  Hairpin sequence MQ_from_PT_112, macaque
agggctgcagaggaagggggtctggcgggatggcagcacattgctgctgctgtgcccctagcccactggctgacctt

SEQ ID NO: 5391 - DNA, 104 bp, Artificial
  Hairpin sequence MQ_from_PT_114, macaque
acttcctgctggcatatatgatgacttagcttttttccccgacagatcgaccatgttgatctaacttttctaagccagtttctgtctgatatgccagcttgagt

SEQ ID NO: 5392 - DNA, 85 bp, Artificial
  Hairpin sequence MQ_from_PT_117, macaque
gctaacttttatatcaggatcaggatctgcagagcaattagtatagtgctctgcagatcctggtcctaatatagtatagtatagc

SEQ ID NO: 5393 - DNA, 78 bp, Artificial
  Hairpin sequence MQ_from_PT_122, macaque
ctgtatcccaggagctgatgctgcagatgaacctgctggaactcatccggaagctgcagcagaggggctgccgggcag

SEQ ID NO: 5394 - DNA, 110 bp, Artificial
  Hairpin sequence MQ_from_PT_123, macaque
tcaaatgggagctctccagacttaaggaggtgagaggctgcaaggagggcgggccgtgaccacccacaccccttctccacagcccggcctgatctggaggacccccgggg

SEQ ID NO: 5395 - DNA, 91 bp, Artificial
  Hairpin sequence MQ_from_PT_125, macaque
ctgcactcaagcccaactctgatcatcctgaccccgtccgtgaagtcagaagccctgggtcagacatcagagcacaagccagggggtccag

SEQ ID NO: 5396 - DNA, 79 bp, Artificial
  Hairpin sequence MQ_from_PT_13, macaque
aatttctctggtttcaatgggtacgattattgtaatcaggatccattcaataatcggacccatttaaaccgaaggtttt

SEQ ID NO: 5397 - DNA, 70 bp, Artificial
  Hairpin sequence MQ_from_PT_130, macaque
gccagagcactgctttagagcctctgcgtgtctggccatggcctcaggggtctagcggcagtgctagagc

SEQ ID NO: 5398 - DNA, 116 bp, Artificial
  Hairpin sequence MQ_from_PT_134, macaque
tccatgaggcaggacggggttggtgggggcaggcgggagggcctgggattggaaggttggctagctccacctcctgccctccccaccgcaccctaaacttagtcttgacaaacgga

SEQ ID NO: 5399 - DNA, 91 bp, Artificial
  Hairpin sequence MQ_from_PT_135, macaque
catgagtgccgacaccagaattgggaggaatgaccgtctcaatccaactctaagtcagtcggtcattcttcctggtggtttagtgtccatg

SEQ ID NO: 5400 - DNA, 109 bp, Artificial
  Hairpin sequence MQ_from_PT_138, macaque
cctatggtgttctgcctctgagcgtgtcagagcaggagagggagtggccctggcttccccagcctctcctgccgggcccacctcggaggatgaacacaacagctgtggg

SEQ ID NO: 5401 - DNA, 78 bp, Artificial
  Hairpin sequence MQ_from_PT_139, macaque
acacttcaggtggagatcacatccctttctcaagcttcccagttcccaggacagggttggggcctccaccctctgtgt

SEQ ID NO: 5402 - DNA, 107 bp, Artificial
  Hairpin sequence MQ_from_PT_143, macaque
agtggagaaatgaggaatgaactttgaggctgaatatatctgagaatgcagaattaggattcaaactcagatattcatcctcaaagttcatttctcatttctttatt

SEQ ID NO: 5403 - DNA, 111 bp, Artificial
  Hairpin sequence MQ_from_PT_147, macaque
aggaaaattctagctgtgttgaagaagatatccaaaactcacttcattttccctcccaccccagaaaaaggaagtgagttttggatatcttcaacacagctggaattacct

SEQ ID NO: 5404 - DNA, 75 bp, Artificial
  Hairpin sequence MQ_from_PT_148, macaque
tcagaggatgtcctaggttgggaaggaaacatggggaaaaggctgcttttccagacctgggacgcgatcatctga

SEQ ID NO: 5405 - DNA, 117 bp, Artificial
  Hairpin sequence MQ_from_PT_151, macaque
ttgtggttctgaaatgagttttaatgttgatgcctctgatgagtccatgacttacgagtcacaaggacctgttgagaaaatggcgaaatatattgactcagaagataagagctgtgg

SEQ ID NO: 5406 - DNA, 110 bp, Artificial
  Hairpin sequence MQ_from_PT_154, macaque
ggaagaaaggtgaaacccctatgatatacaacagatgagacatacctaaaccattgctagcttaggtatgtctgatctgttgtatattacaggggtttgccagaacttcc

SEQ ID NO: 5407 - DNA, 99 bp, Artificial
  Hairpin sequence MQ_from_PT_155, macaque
ctctatagtgacctggtggatctcatgctgcggcagggctggcgcaggggcgccttcatccctgagctggagcgtgagatccgcatcatcaacacagag

SEQ ID NO: 5408 - DNA, 86 bp, Artificial
  Hairpin sequence MQ_from_PT_158, macaque
ggccttagaggcttcccggagatggtgagggcaggaagtgtgctgagtcatgccttgccctctccccttaggacctcagcatggcc

SEQ ID NO: 5409 - DNA, 101 bp, Artificial
  Hairpin sequence MQ_from_PT_161, macaque; MQ_from_PT_235, macaque; MQ_from_PT_262, macaque
tgtcccaaaaggccaaactgggaactctagccatggtccaggagagggagggaacaaagaccactggaaggagtcagataggaaagatggcaaaaaggata

SEQ ID NO: 5410 - DNA, 109 bp, Artificial
  Hairpin sequence MQ_from_PT_165, macaque
ttcaggattatgccaaaataagaaaacataccttaaaattaaaatcagtgtggtttgattttaattttaaggtacgttttcttatttcaataacattaattatcccgaa

SEQ ID NO: 5411 - DNA, 92 bp, Artificial
  Hairpin sequence MQ_from_PT_170, macaque
aggggtgctgataacagtggtgggagagctggtgaagaaacaaggcactggcacttgaagatttgctctcaggctcctggaacaggactcct

SEQ ID NO: 5412 - DNA, 75 bp, Artificial
  Hairpin sequence MQ_from_PT_18, macaque
gcagaaggttcggatagaggggtcgctgtggtggacgtacaccagcagcatctttttccgaatcatcttcgaagc

SEQ ID NO: 5413 - DNA, 68 bp, Artificial
  Hairpin sequence MQ_from_PT_185, macaque
gcttggccgggacctgtatcctaacctggctgaagagaggtctcggtgggagaaggagctggctgggc

SEQ ID NO: 5414 - DNA, 94 bp, Artificial
  Hairpin sequence MQ_from_PT_187, macaque
ccatgagatggttgtggtcagttgcacctgataccatgtatccctgaatcatgtgtatttttattagtaatgctgccactaccattgctgatgg

SEQ ID NO: 5415 - DNA, 71 bp, Artificial
  Hairpin sequence MQ_from_PT_188, macaque; MQbrain_1293, macaque
tagctggttggcattctggccctggttcatgccaactctgtgttgactaccccaggatgccagcatagttg

SEQ ID NO: 5416 - DNA, 116 bp, Artificial
  Hairpin sequence MQ_from_PT_191, macaque
cctcagctggatgagaggctgagatgggtggccagcttgtacaccagtccctgaaccgagctgtttacaagactggggaggctccacccagaaggctttcatttgtactctgatgg

SEQ ID NO: 5417 - DNA, 73 bp, Artificial
  Hairpin sequence MQ_from_PT_193, macaque
aaggccgaggaaagggcgtggcccttcgaacaaacccccacccggaattaccacgccccctccttctggcttt

SEQ ID NO: 5418 - DNA, 60 bp, Artificial
  Hairpin sequence MQ_from_PT_195, macaque
acccagctggggttgctgccctgaacgaactgcgtgtggggccggcacatcctagcaggt

SEQ ID NO: 5419 - DNA, 111 bp, Artificial
  Hairpin sequence MQ_from_PT_201, macaque
tagggacaacagggaaggctgtagttctctgcccagtgtataacaagtcccttttttcagggaagccaccggtgcttcagagtgaacggctaaaccttctgtatgttcttg

SEQ ID NO: 5420 - DNA, 99 bp, Artificial
  Hairpin sequence MQ_from_PT_203, macaque
tctcaatgcctccattcccaggccagggccccattctgtctgtgggactgtgggttctcagtggaattgttgcctttcttgttgtggagaaatttgtga

SEQ ID NO: 5421 - DNA, 117 bp, Artificial
  Hairpin sequence MQ_from_PT_204, macaque
gggacggtatcagtagctttcattctctttctcctcactggtatgggttcagagcaatgcctagagcccctctctgctcccctgcctagtggggtggtagtggctacctctcagccc

SEQ ID NO: 5422 - DNA, 78 bp, Artificial
  Hairpin sequence MQ_from_PT_208, macaque
gcggcaggagatcttcctgcagcgccatggacccctgtctgtccacatggcctgcctctccttcttctttctggctgc

SEQ ID NO: 5423 - DNA, 109 bp, Artificial
  Hairpin sequence MQ_from_PT_21, macaque
tcatcctaaagcatacaggtcctggcatcttgtccatggcaaatgctggacccaacacaaaaggttcccagtttatcatctgcactgccaagactgagtggttggatgg

SEQ ID NO: 5424 - DNA, 79 bp, Artificial
  Hairpin sequence MQ_from_PT_211, macaque
gtgttggccatcaggagccacactggagcgcatgggcctcttcactgtgtgccaagttcagtcacctctgattcagcgc

SEQ ID NO: 5425 - DNA, 93 bp, Artificial
  Hairpin sequence MQ_from_PT_219, macaque; MQ_from_PT_220, macaque
gggctgcccggtggtggtgagagcgcagcgtgggtgcagccctggtgaagggcctgagactcacggctctgcgctcggatcgtgggctggcct

SEQ ID NO: 5426 - DNA, 115 bp, Artificial
  Hairpin sequence MQ_from_PT_224, macaque
tcctacagaatgcacttttgctttcagatagcagccttcacctcttcttacagagccatctgaattcagaagacattgaggcgtgtgtttctgggcagactaagtattctgtgga

SEQ ID NO: 5427 - DNA, 94 bp, Artificial
  Hairpin sequence MQ_from_PT_228, macaque; MQbrain_1098, macaque
ttgacacgggggtgctgggagaagggacagctttagaagagaaggatgagttgtttcatcttcttgcttccctttctccaggttcatggatcag

SEQ ID NO: 5428 - DNA, 67 bp, Artificial
  Hairpin sequence MQ_from_PT_229, macaque
ggtctgctcggggtgagaggtcaggagacacagctccagggccccctcagcccctgcccaccaggcc

SEQ ID NO: 5429 - DNA, 99 bp, Artificial
  Hairpin sequence MQ_from_PT_237, macaque
gcacccttgtctaaaaccccgcgcttctccccacccccgccaggcgcagcaccccctccctcggctgcgcccggaggggagcagagcggacaggggcgc

SEQ ID NO: 5430 - DNA, 92 bp, Artificial
  Hairpin sequence MQ_from_PT_242, macaque
tcttgcttctctccagctactccctatgaaaggctgctgcgtccctcctgagttcacagtggctaaagtgctgtggcagtggaggagaaaga

SEQ ID NO: 5431 - DNA, 94 bp, Artificial
  Hairpin sequence MQ_from_PT_251, macaque
gggccctggctgcaggcagctgggcttactgccgggccctgcatacacagcgcctgcagtgggaatgacagttggatacagcaaggcagggttt

SEQ ID NO: 5432 - DNA, 113 bp, Artificial
  Hairpin sequence MQ_from_PT_253, macaque
ctgccagcaagacaaaaggaacaggggacacttgtaatggagagcactaagctatggactgctatggactgctggtgctctccattacaagtatcccctgtaaccttggccag

SEQ ID NO: 5433 - DNA, 84 bp, Artificial
  Hairpin sequence MQ_from_PT_254, macaque
agtggctttttctctgacatttttgcccttctcacaatactgcaaatgtctgcagggtgagcccaagtgttagaaatagccact

SEQ ID NO: 5434 - DNA, 116 bp, Artificial
  Hairpin sequence MQ_from_PT_256, macaque
agcttctgtgtacctgcattagaggatcagtttgggtggaactggaaatatatcttctggctttctgttcagtcctcctgactctgttttgtctgatgtatgtgtgcttaaaggct

SEQ ID NO: 5435 - DNA, 88 bp, Artificial
  Hairpin sequence MQ_from_PT_257, macaque
ctagtgaacaagacaggtatgtgtagatttcatgttatggtgaaagggcaaaaaacatgaaatctacaagggatcagtcacgggctgg

SEQ ID NO: 5436 - DNA, 87 bp, Artificial
  Hairpin sequence MQ_from_PT_26, macaque
gtaacaggagagtcaggcgctgaggggaacagcgtctctaaccacggcgaccctgttctcctctgggcgcttccactgagttattac

SEQ ID NO: 5437 - DNA, 91 bp, Artificial
  Hairpin sequence MQ_from_PT_268, macaque
ctgcaaagcacacactgcccacagactgatggtgaagttaaatttcaaatattgatcgagctggaccattaaggcaggaagtgtgctgcag

SEQ ID NO: 5438 - DNA, 91 bp, Artificial
  Hairpin sequence MQ_from_PT_269, macaque
ggcagaggtagggagtttggggagcatcaggatcaagatgcctgaagaatcctgaccctgctcttgctctcaggtattgcctgcctgtgct

SEQ ID NO: 5439 - DNA, 106 bp, Artificial
  Hairpin sequence MQ_from_PT_270, macaque; MQbrain_1594, macaque
ctgtacacccttcactcccttcccctaccagccggttcgcggcgcctcttggagctaacctgtgaccggctaggagaggacacgggagcgtggggtttaatctcag

SEQ ID NO: 5440 - DNA, 119 bp, Artificial
  Hairpin sequence MQ_from_PT_28, macaque
gctatggattgccatcatagccacgctggggaacatcgtggtggtgggtgtggtgtacgccttcaccttctgaggacggcgcaccctccaccaccatggggtgaggcttggcacgtagc

SEQ ID NO: 5441 - DNA, 99 bp, Artificial
  Hairpin sequence MQ_from_PT_280, macaque
gtcccaaaaggccaaactgggaactctagccatggtccaggagagggagggaacaaagaccactggaaggagtcagataggaaagatggcaaaaaggat

SEQ ID NO: 5442 - DNA, 91 bp, Artificial
  Hairpin sequence MQ_from_PT_283, macaque
tgctgagcccggggtgggggaattgcatctgcaggaaagagatgcagcatgctcctcactcctgagtgctcacctgtcctgcttctctgca

SEQ ID NO: 5443 - DNA, 77 bp, Artificial
  Hairpin sequence MQ_from_PT_285, macaque; MQbrain_1581, macaque
gcagaagcgggagggcccgggcccggggcgcacaggagggctcagcccgccggccctgacccggcccctcccgcagc

SEQ ID NO: 5444 - DNA, 75 bp, Artificial
  Hairpin sequence MQ_from_PT_291, macaque
ggtgaagcggcggctgcagcagggcaaggtgaccattgcggaactcatccagccggctgcacgcagccaggtacc

SEQ ID NO: 5445 - DNA, 111 bp, Artificial
  Hairpin sequence MQ_from_PT_294, macaque; MQbrain_2652, macaque
taggtggcgtgtgtgagtggagacgggcctgggccttggggactggagggcaggggtccttctgcccctggggtcccagggagttctgcctgctcagccaggcctctcctg

SEQ ID NO: 5446 - DNA, 72 bp, Artificial
  Hairpin sequence MQ_from_PT_295, macaque
gtgtaatctcagaggacagggaagtgtgcaagggtggggaccctcatcaccgcccttgactctgtaaggcat

SEQ ID NO: 5447 - DNA, 91 bp, Artificial
  Hairpin sequence MQ_from_PT_297, macaque; MQbrain_1857, macaque
tgctgtgggcaatgccctacttggaaaggcaccagttacttagattacacgtaactgttccctttctgagtagagtaaggcttaccaagta

SEQ ID NO: 5448 - DNA, 112 bp, Artificial
  Hairpin sequence MQ_from_PT_299, macaque
ccacccagaggcctgggagggacttggatctggagggtctcctgctgtcaggccttgcctaaggctctgcaccctccctccagccctccagccctccaccttcctcaggtgg

SEQ ID NO: 5449 - DNA, 120 bp, Artificial
  Hairpin sequence MQ_from_PT_300, macaque
gcctagtagctgagaaacacattaatatggaagggagaacagctttaatgctctgaaaatgactccaatcattaaagctcttctcccttccatattaataaatttggcactcaagagggt

SEQ ID NO: 5450 - DNA, 83 bp, Artificial
  Hairpin sequence MQ_from_PT_308, macaque
ccaggagtcccgagatttggctggagctcccatgctgctgcctgcagctcccatgctgctgcctgccagctgtggttgcctgg

SEQ ID NO: 5451 - DNA, 66 bp, Artificial
  Hairpin sequence MQ_from_PT_31, macaque
gtctccctccagctcctgcacagtgctcccgcttctgggagggctgtgttgagaggatggaaagac

SEQ ID NO: 5452 - DNA, 71 bp, Artificial
  Hairpin sequence MQ_from_PT_310, macaque
agattaatgaggatgaggcagagtaactaataaaacagttttgagttactttgcctcatcaccattaattt

SEQ ID NO: 5453 - DNA, 110 bp, Artificial
  Hairpin sequence MQ_from_PT_320, macaque
tcctaaacagagagaattcgaggttgcctgaaagctgggtgtccttgctccttttcctggagccaatatacccagtttttactcagtttgatttatattctgggcaagga

SEQ ID NO: 5454 - DNA, 92 bp, Artificial
  Hairpin sequence MQ_from_PT_321, macaque; MQbrain_2649, macaque
cttggctctaggatgtgctcattgcatgggctgtgtatattattattcaatacccagagcgtgcagtgtgaacattaaatagagattgaaag

SEQ ID NO: 5455 - DNA, 84 bp, Artificial
  Hairpin sequence MQ_from_PT_325, macaque; MQbrain_1422, macaque
gggccagcttccctgccctgcctgttttcttctttgtggttttatgaaagcgaaggaggaaacaggcaggccagggaagcgctc

SEQ ID NO: 5456 - DNA, 116 bp, Artificial
  Hairpin sequence MQ_from_PT_328, macaque
ggctgagccctccagggtaagtggaaagatggtgggccgcagaacatgtgctgagttcgtgccatatgtctgctgaccatcacctttagaagccccctttcgctgaggagccagct

SEQ ID NO: 5457 - DNA, 99 bp, Artificial
  Hairpin sequence MQ_from_PT_333, macaque; MQbrain_1312, macaque
gtggggtaaaaccctggatgccatgaaagccgccatggccctggagaagaagctgaaccaggcccttttggatctttaggccctgggttctgcccacac

SEQ ID NO: 5458 - DNA, 95 bp, Artificial
  Hairpin sequence MQ_from_PT_338, macaque; MQbrain_2618, macaque
tgagtccggtggctctggtccatttccctgccattcccttggcttcaatttactcccagggctggcagtgagatgggtcaaggctcacaccttca

SEQ ID NO: 5459 - DNA, 104 bp, Artificial
  Hairpin sequence MQ_from_PT_339, macaque
tcagtgagttccaggctgggattgagaagggagcagtgaagagactgggaggttatactttcctctgatgacttcctgttagtgccacgtgtctgggccactga

SEQ ID NO: 5460 - DNA, 94 bp, Artificial
  Hairpin sequence MQ_from_PT_340, macaque
aggtgatctttgtgctgtacatgatgacaactggctccctctactgaactgccatgaggaaactgccatgtcacccttctgactacagccacct

SEQ ID NO: 5461 - DNA, 104 bp, Artificial
  Hairpin sequence MQ_from_PT_36, macaque; MQbrain_2285, macaque
ttggcttgctgggttcagagcactgggcaccaagtctgcgttttggtgtcattgctattcacacagacattgtgtccaggttcctgcatccagaaacattccag

SEQ ID NO: 5462 - DNA, 98 bp, Artificial
  Hairpin sequence MQ_from_PT_37, macaque
cctctcctacattgagcacatctttgagatctcccgccgtcctgacctcctcactatggtggttgactatagaacccgtgtgctgaagatctctgagg

SEQ ID NO: 5463 - DNA, 91 bp, Artificial
  Hairpin sequence MQ_from_PT_40, macaque
agggggcccaaagaacggctcctctgtttacaacacacccaacaggagtctggggtcattgtgatgagggcctcaaacttgtggcttccct

SEQ ID NO: 5464 - DNA, 66 bp, Artificial
  Hairpin sequence MQ_from_PT_43, macaque
cacggagtgagtgaggtgccctgggcagtatggatgcctctgggcctctgactcacatgagccttg

SEQ ID NO: 5465 - DNA, 95 bp, Artificial
  Hairpin sequence MQ_from_PT_44, macaque
gagtaaggggtgaggtggagtggggttggggtgggagttggaggaaggatccctgagctctcgctggactctggatctccacttcacactaagtc

SEQ ID NO: 5466 - DNA, 118 bp, Artificial
  Hairpin sequence MQ_from_PT_50, macaque
tcttttggtggcaggcctttgttatccagctgtcacagtactgggtgggctaaccctgggtggatgcccttgcctcttcttctggaacatcttagtggtagtgcctgcttcctaatga

SEQ ID NO: 5467 - DNA, 79 bp, Artificial
  Hairpin sequence MQ_from_PT_53, macaque; MQbrain_696, macaque
gggccctgctgaggtgtcagctgctctgctcagttagtctttattcccggggtaccaagcagctgcacactcagggcct

SEQ ID NO: 5468 - DNA, 92 bp, Artificial
  Hairpin sequence MQ_from_PT_54, macaque
cctctcggtgcacctggggagcccctaaactgtgaattctgccctggacagggctttgcccttggaggatccccaggtggcattacccgtgg

SEQ ID NO: 5469 - DNA, 98 bp, Artificial
  Hairpin sequence MQ_from_PT_56, macaque
cttgaggcagggttagccgtggttccagcgcagtctccagcaagtggttaccagtctagaggggagcctgggaccactggctttccaccttctcacgg

SEQ ID NO: 5470 - DNA, 95 bp, Artificial
  Hairpin sequence MQ_from_PT_61, macaque
tgctgggcctgccccagggcctgtggtcactgctgagggactgcatccatcccttccctcacccactggcaacagcaccccattgggttccagca

SEQ ID NO: 5471 - DNA, 115 bp, Artificial
  Hairpin sequence MQ_from_PT_63, macaque
cctcccggcctcctactacttccgtttccaaagggagatctctgtggccctctgttgtgccctctgctttgtcatcgatctctccatggtgactgatgtgagtggggtggggggg

SEQ ID NO: 5472 - DNA, 106 bp, Artificial
  Hairpin sequence MQ_from_PT_64, macaque
gcgctggcggctggggcttctcagcctctcttccctggctgtcccctttgtttgaagctccagtgagggagcagtggctggggtggcacagcttcaaagtctccgt

SEQ ID NO: 5473 - DNA, 94 bp, Artificial
  Hairpin sequence MQ_from_PT_71, macaque
aggagggtgtgaatgaaggaggtggggccttgaggggttgtctgcagctctgccccgctcccctctatgccccttcctcttctctctagctcct

SEQ ID NO: 5474 - DNA, 117 bp, Artificial
  Hairpin sequence MQ_from_PT_72, macaque
tcttgctttagctgtgctttcctgggatgagaagatcttggtgtttttaacacataagctttgttagaaatcacctctgaagatcatttcattttctcactttgggttgctgcaaga

SEQ ID NO: 5475 - DNA, 73 bp, Artificial
  Hairpin sequence MQ_from_PT_74, macaque
gatttcaacctttagtacatgtggcttggccactttgtggctgaggtaagaatgtgcttgtggaagacaagtc

SEQ ID NO: 5476 - DNA, 109 bp, Artificial
  Hairpin sequence MQ_from_PT_84, macaque
gggtagtgtggcaggtgaggggttgcctagggcccggcttgttggggctgcaagactcgtcatcctggcacctggttagcatccctcacccaggccatctctgtgtccc

SEQ ID NO: 5477 - DNA, 74 bp, Artificial
  Hairpin sequence MQ_from_PT_86, macaque
tccttactccaaatccaggagtcagagccaactcctatcttggctctgacccaaatcctgctctggactctgga

SEQ ID NO: 5478 - DNA, 74 bp, Artificial
  Hairpin sequence MQ_from_PT_89, macaque
ctggggctgaggctgggggcagggtggagccttgcctgtggtgagagtccctctctctgtccccctcaccccag

SEQ ID NO: 5479 - DNA, 117 bp, Artificial
  Hairpin sequence MQ_from_PT_91, macaque
ccacctcaccccttccaggactcagattcagactctgagggaggagccgctggtggagaagcagacagtgagtatcttcctcgaaggatggggagcagggttctggggggcgggggg

SEQ ID NO: 5480 - DNA, 80 bp, Artificial
  Hairpin sequence MQ_from_PT_93, macaque
cctggggcgggcgggggttgggtggaaggccgggtggtggggccggcctgagagccctagccaggcgctcccgccacagg

SEQ ID NO: 5481 - DNA, 88 bp, Artificial
  Hairpin sequence MQ_from_PT_95, macaque
tgtgtgacctgggccagcccctctgccctttggaactctttcttggagaggccagactagggaacctgggcctggtcccagtacacca

SEQ ID NO: 5482 - DNA, 79 bp, Artificial
  Hairpin sequence MQbrain_1, macaque
atatcaagggagcagtactggtttgtgacaagtcctcaaacttcctgtccaagccagtggatgtttccaagtttgatgt

SEQ ID NO: 5483 - DNA, 66 bp, Artificial
  Hairpin sequence MQbrain_10, macaque
ctgtttgggaggctgaggggaagtcaacttcccctccacgtcttacctctcctccattccagacag

SEQ ID NO: 5484 - DNA, 61 bp, Artificial
  Hairpin sequence MQbrain_100, macaque
tggtctagagccaggagtttgggggcccaccttcctgggcttccaaggaactttaggacca

SEQ ID NO: 5485 - DNA, 114 bp, Artificial
  Hairpin sequence MQbrain_1000, macaque
acctctgtgactaggaaacgtgtcacgtgcccagcacaaccgctccaggatagcaccctttgggatgtaccgctgagctgttcctggcacgtggcatggcactgtggtggaggt

SEQ ID NO: 5486 - DNA, 96 bp, Artificial
  Hairpin sequence MQbrain_1001, macaque
tggacttgctctctggactcaaggcttgctgggtcctgggcctgtgcaggctccaggcaagccagggcaggagtccaggcagagctgtgacttcca

SEQ ID NO: 5487 - DNA, 88 bp, Artificial
  Hairpin sequence MQbrain_1002, macaque
gcctctctacagcagcattgtcactgtagaggcttctaaaccaaatggacagaggtatgatagtgtcaatgagaagctgtcagatagc

SEQ ID NO: 5488 - DNA, 76 bp, Artificial
  Hairpin sequence MQbrain_1003, macaque
agacgagtctgtcttcagctctgcacccatttcctgctgagtccgggtggagggtggaggcgtcgagcgcttgttt

SEQ ID NO: 5489 - DNA, 99 bp, Artificial
  Hairpin sequence MQbrain_1004, macaque
gtactcttgtccatctgttctctgttgtgtgatcccaatccagatgatcctttagtgcctgagattgctcggatctacaaaacagatagagaaaagtac

SEQ ID NO: 5490 - DNA, 93 bp, Artificial
  Hairpin sequence MQbrain_1005, macaque; MQbrain_1252, macaque; MQbrain_1254, macaque; MQbrain_1310, macaque; MQbrain_136, macaque; MQbrain_1467, macaque; MQbrain_1468, macaque; MQbrain_1533, macaque; MQbrain_1613, macaque; MQbrain_2, macaque; MQbrain_408, macaque;
gtccaatcttggatttccagagtcttataatgtagcctcactttctgggtgcaggagaggctggtgatggctacggaggaccattagttggat

SEQ ID NO: 5491 - DNA, 112 bp, Artificial
  Hairpin sequence MQbrain_1006, macaque
tccctccttgccagcccctgatgtctgccagacttttgcctctgctggagcccctgcctgaccagcttcccctccctgtctggttgggatttgggggctgagctgtctgggg

SEQ ID NO: 5492 - DNA, 98 bp, Artificial
  Hairpin sequence MQbrain_1007, macaque
tgggcccacccggtgggactctcgtggggcagggagctgggcccaacatggccccagcctctgcctttgcatcacgggacatcacagggtgggcctca

SEQ ID NO: 5493 - DNA, 115 bp, Artificial
  Hairpin sequence MQbrain_1008, macaque; MQbrain_1009, macaque
gtgggtgagagtctgtgaggcaggagagcttggggacttccactggatagtaataggtgtatgaagaagaaatggtgggggtatctaggccatcttgagcagaaaataaagtcac

SEQ ID NO: 5494 - DNA, 106 bp, Artificial
  Hairpin sequence MQbrain_101, macaque
agcttatttctttgacttcattggagcagctgctttgagccccgcctgactgactgcctttgttgctggggctcagatgagagctggctggtgaagggagtcagct

SEQ ID NO: 5495 - DNA, 61 bp, Artificial
  Hairpin sequence MQbrain_1010, macaque
ggacagggccaggagccgtagcagcacaggttcagcttttggctcctggggccaatggtcc

SEQ ID NO: 5496 - DNA, 108 bp, Artificial
  Hairpin sequence MQbrain_1011, macaque
gctgggccaataagaataaagcagggtgttctgggcaaattgggccacatgtccccaaatcacttggccttatgtatttggatgcactctgttttcttgtattctagc

SEQ ID NO: 5497 - DNA, 74 bp, Artificial
  Hairpin sequence MQbrain_1012, macaque
tgggaggaggcagaggaagctaacacccacagagagagctgagggtgatggccttgtgtctacagcaacgccca

SEQ ID NO: 5498 - DNA, 85 bp, Artificial
  Hairpin sequence MQbrain_1013, macaque
gcaaccctcccccgacttctctctcactgtaacagagctcattcactgagtttgtttccactcctaggggagttggatgggtagc

SEQ ID NO: 5499 - DNA, 107 bp, Artificial
  Hairpin sequence MQbrain_1014, macaque
ctcttcagaactgccaaaccctctagaagagccctgtctttcctcacagttcccattttcctcctgccatgaggaagaaaggcttctctagagcctgccctgaaaag

SEQ ID NO: 5500 - DNA, 103 bp, Artificial
  Hairpin sequence MQbrain_1015, macaque
actgagcctggggcccactgacatggccaatgagctccctcatggtgccaccaggcccacgtagggcagtgcactggctgcattggaggttcccgggcgctgt

SEQ ID NO: 5501 - DNA, 97 bp, Artificial
  Hairpin sequence MQbrain_1016, macaque
ccagaattccagagtctggaaccttgaagttttgggggcctatggatggcaggattcaaggggcagcaggtctccaaggatggacaagtggggctgg

SEQ ID NO: 5502 - DNA, 115 bp, Artificial
  Hairpin sequence MQbrain_1017, macaque
gtgggtgagagtctgtgaggcaggagagcttggggacttccactggatggtaataggtgtatgaagaagaaatggtgggggtatctaggccatcttgagcagaaaataaagtcac

SEQ ID NO: 5503 - DNA, 100 bp, Artificial
  Hairpin sequence MQbrain_1018, macaque
tttcaggggtaagaaaaggtggggattaggacatttctggaggcttagggaccaaggatggtctcttgtctccacctgatcccctttctctaatctgaga

SEQ ID NO: 5504 - DNA, 89 bp, Artificial
  Hairpin sequence MQbrain_1019, macaque
actaaactgttaaatgtgtggcttagatgatttgttcatctaaataggatgaataaatttgtgaggttgggcatagtaaccattttggt

SEQ ID NO: 5505 - DNA, 78 bp, Artificial
  Hairpin sequence MQbrain_102, macaque
gctcggctctcctgtcctgcccacgccaaccagtggaatcaggctgtggggtgggcaggggactggggatcttgttgc

SEQ ID NO: 5506 - DNA, 119 bp, Artificial
  Hairpin sequence MQbrain_1020, macaque
ggtggcgccccaagctgcccacctaggctccccagggaaggcggggaccaaccacccgaaatcacgccccttcctcctccctttcctagggagcttgcgaaggtgtctgggtcgcaccc

SEQ ID NO: 5507 - DNA, 86 bp, Artificial
  Hairpin sequence MQbrain_1021, macaque
ggttgaaggaggggcctgaaggaggttggggatgactgggcagggccagccctgccttctttcccctcacagcccctcctaaagct

SEQ ID NO: 5508 - DNA, 77 bp, Artificial
  Hairpin sequence MQbrain_1022, macaque; MQbrain_1136, macaque
tggaccttcccctgtgactatccttggccctaggcaaagaaagcagcttgcctgaggtcacctgtctggtagggaca

SEQ ID NO: 5509 - DNA, 114 bp, Artificial
  Hairpin sequence MQbrain_1023, macaque
ctctgtcccatgcttaggcacccacatgtggccacaagtgcctttcctacctcatccctatgggaggctggtgtccaggcacctgtggctccaggcagaagtctgagtgcagag

SEQ ID NO: 5510 - DNA, 117 bp, Artificial
  Hairpin sequence MQbrain_1024, macaque
ggttcctttttgcctcttttttctccaaaggcccgttggcccctggctgaggtagtttatcacataataagccctacctgcggggtccagcagcctttgtgaatccagggcagagcc

SEQ ID NO: 5511 - DNA, 116 bp, Artificial
  Hairpin sequence MQbrain_1025, macaque
tctatggagtctgtagggtgaaatgtggggcagtctgtggagtctgtagggtgaaatgtggggcagtctgtggactctgtagggtgaaatgtggagcagtctgtggactctgtagg

SEQ ID NO: 5512 - DNA, 116 bp, Artificial
  Hairpin sequence MQbrain_1026, macaque
tctgtggactctgtagggtgaaatgtggagcagtctgtggactctgtagggtgaaatgtggggcagtctgtggagtctgtagggtggaatgtggagcagtctgtggactctgtagg

SEQ ID NO: 5513 - DNA, 94 bp, Artificial
  Hairpin sequence MQbrain_1027, macaque
cctcatttgacttccttgggcacccactatccactaaaatgcagccatcctgtatcccagtgactggaaaatgggtgctgatgggttaatatgg

SEQ ID NO: 5514 - DNA, 74 bp, Artificial
  Hairpin sequence MQbrain_1028, macaque
tcctggagaaggtgcaccataagcaggagagcatcatggatgcagggccggtcgtggtgcactgcagtgctgga

SEQ ID NO: 5515 - DNA, 117 bp, Artificial
  Hairpin sequence MQbrain_1029, macaque; MQbrain_1032, macaque; MQbrain_1035, macaque; MQbrain_1041, macaque
cttggggtggtcagcagtgccaggtgtctgccctccaggtctcaagtctgtgattgtgcagagactgagcagacctggaaggtgtccacatggtgccttttctcctgacattctggg

SEQ ID NO: 5516 - DNA, 71 bp, Artificial
  Hairpin sequence MQbrain_103, macaque
gagtcagcagaagggtctggaaggcctagcacgtgtacagtggtaggtagggatggggccatctgcagctt

SEQ ID NO: 5517 - DNA, 92 bp, Artificial
  Hairpin sequence MQbrain_1030, macaque
ctgcagtggcttccgcggaggtttcggcagtggcatccggggccgcggtcgcggccctggacgggccggggcagaggccgcggagctcgcag

SEQ ID NO: 5518 - DNA, 64 bp, Artificial
  Hairpin sequence MQbrain_1031, macaque
tggagcaggaaggccaggctcacaggtgccgccaggcacatgaaagggcagggcagctgagcca

SEQ ID NO: 5519 - DNA, 110 bp, Artificial
  Hairpin sequence MQbrain_1033, macaque
gtctcacctgctctcctacataaagacacatgattacttttgagctcaactaaatttagggtggtatctaagttgtctgtgtgttattctggtgagcaaaggtgcttgat

SEQ ID NO: 5520 - DNA, 90 bp, Artificial
  Hairpin sequence MQbrain_1034, macaque
ctgttgtttgagtgactccggggccattttcccacttgggtctggcttcaagttgggaagctggcccaatgggggcaagttagaaaacag

SEQ ID NO: 5521 - DNA, 91 bp, Artificial
  Hairpin sequence MQbrain_1036, macaque
tttgctcttctttccttactctgctgctggtttgggtctggctcttggttgaagagctgatggtggtgtggaggaggggacagaggacgaa

SEQ ID NO: 5522 - DNA, 96 bp, Artificial
  Hairpin sequence MQbrain_1037, macaque
caccttcttctgagtcagacatagacatctccagccccaatgtgtctcacgatgagagcattgccaaggacatgtccctgaaggactcaggcagtg

SEQ ID NO: 5523 - DNA, 119 bp, Artificial
  Hairpin sequence MQbrain_1038, macaque
tgaaaataagtacttttgaaactctttggacattgatattcagatgtttaatatacataggacaaagattataaggcaaatggatgttgatgccaaagtttgtgaagcaacttggggca

SEQ ID NO: 5524 - DNA, 66 bp, Artificial
  Hairpin sequence MQbrain_1039, macaque
ggccactgcagcccctccaacgggctttttctctcctgcattccctggcctggaggggtcagggcc

SEQ ID NO: 5525 - DNA, 117 bp, Artificial
  Hairpin sequence MQbrain_104, macaque
cctgctctgtgctggaggcccaggctttgggggagacagcagaagatcatgctgtgtctgcatgcatcttgatggctagtccccattgcagctggctggccagcactgtgacctagg

SEQ ID NO: 5526 - DNA, 78 bp, Artificial
  Hairpin sequence MQbrain_1040, macaque
agaatcccaaagaggagaagatcagcctgcatttagcagtccacatctgcaggctgctcttctcctcttttggattct

SEQ ID NO: 5527 - DNA, 78 bp, Artificial
  Hairpin sequence MQbrain_1042, macaque
ggttgagggtgtagtgagcagagcaatgcatttctccagcactgagaacagtctgctgctgctggcctgctctctgct

SEQ ID NO: 5528 - DNA, 108 bp, Artificial
  Hairpin sequence MQbrain_1043, macaque
ctacgagacaggaagcacctcattgccctcagactgtctccaaatcctggctgagggaaaccagacaagggaagagagagggtgggggcagagacaggatcctggtgg

SEQ ID NO: 5529 - DNA, 101 bp, Artificial
  Hairpin sequence MQbrain_1044, macaque
aggtcttgcctcagagtcttcttagggcattgccatggacaacgccagtagatactggcctctgttcttggttgccatgaggtagggtgcaggcagatcct

SEQ ID NO: 5530 - DNA, 81 bp, Artificial
  Hairpin sequence MQbrain_1045, macaque
accctttccactttggttgctgctttctgggctcatcgtgtccttgctcaacaggataccccttgaagtggctgcctgggt

SEQ ID NO: 5531 - DNA, 82 bp, Artificial
  Hairpin sequence MQbrain_1046, macaque
acattgttgactctgttgtgcttccattacaggctcgactacctgtgaagtggatggcacctgaaagcattttcaactgtgt

SEQ ID NO: 5532 - DNA, 114 bp, Artificial
  Hairpin sequence MQbrain_1047, macaque
gcactctcaaccaatgcaccagccatgggtagtgatgggtagtgatgggtcctttacatggacaggacttgctttgccacactttcctgtggctgtgcatgcatagtagagtgt

SEQ ID NO: 5533 - DNA, 71 bp, Artificial
  Hairpin sequence MQbrain_1048, macaque
ccgggtccccgcttccgggttccgtactgccggccaggctacttccggcagcgcgatggctgggttcccgg

SEQ ID NO: 5534 - DNA, 81 bp, Artificial
  Hairpin sequence MQbrain_1049, macaque
gggaatgcaatagacagtaaatgctccccttcccttgacgctatagcttagatgggagggagctgctgctgaggaaacacc

SEQ ID NO: 5535 - DNA, 78 bp, Artificial
  Hairpin sequence MQbrain_105, macaque
aggtcagggagaatgtctgtgacttagctgcagactaggagactgctctgctaactaattagcaagcagctttgacct

SEQ ID NO: 5536 - DNA, 106 bp, Artificial
  Hairpin sequence MQbrain_1050, macaque
ctggagggctgagaccatgggcaggattttattttgttccttccagttaaagtagtcacttttggggggtcagaatataagctgaaaatcaggtctggctttgtgg

SEQ ID NO: 5537 - DNA, 118 bp, Artificial
  Hairpin sequence MQbrain_1051, macaque
ctccgtctgaaggccagcctgtgtggggtcagggacagagccccaggccagagaactctctggagcgggaggagatgggtcccgtgccagcacacacagatgccttccaggactgggg

SEQ ID NO: 5538 - DNA, 113 bp, Artificial
  Hairpin sequence MQbrain_1052, macaque
ccagcatgggcttgtcaccaaggctgccaggggtgagtgagcacggctgggcacatcagcccctcctgctcgcccaccccagcccagcctcccagcacagcctcccagtgcgg

SEQ ID NO: 5539 - DNA, 86 bp, Artificial
  Hairpin sequence MQbrain_1053, macaque
catggacatccggcaccctgctcagccctagcaggggagaaactgaaactggctatgctggagctggggagggtgctggggagatg

SEQ ID NO: 5540 - DNA, 95 bp, Artificial
  Hairpin sequence MQbrain_1054, macaque
ccatttggattgagggaatgtctgtgttgtgattccttattgattcgaaggttggaaaggtttgtgttcaatacaggggtctcttggtgcgatgg

SEQ ID NO: 5541 - DNA, 87 bp, Artificial
  Hairpin sequence MQbrain_1055, macaque
gcctacctggagggccggtgcctggagtggctccgcagatacctggagaacgggaaggagacgctacagcgcgcgggtaccaggggc

SEQ ID NO: 5542 - DNA, 101 bp, Artificial
  Hairpin sequence MQbrain_1056, macaque
tctgaatataaatttgttttctcaaatatttgctatgagaggttgatggattaattaaataggtcaattcctagaatttgagagagcaaataaagaccaga

SEQ ID NO: 5543 - DNA, 80 bp, Artificial
  Hairpin sequence MQbrain_1057, macaque; MQbrain_1173, macaque
atttgttttctcaaatatctgctatgagaggttgatggattaattaaataagtcaattcctagaatttgagagagcaaat

SEQ ID NO: 5544 - DNA, 97 bp, Artificial
  Hairpin sequence MQbrain_1058, macaque
tttgtagaggagaagtttcaccagggggttcattggtatttaaagttaaaatagagaatgaaaagtgaaagcctttgtgttggagactcctttcaaa

SEQ ID NO: 5545 - DNA, 95 bp, Artificial
  Hairpin sequence MQbrain_1060, macaque
ttctgactctatgtccatggtagagctctggtcagatgtaattgggcagaaaagtcctcagctgattcggggtcccaccaccatggacaacagaa

SEQ ID NO: 5546 - DNA, 74 bp, Artificial
  Hairpin sequence MQbrain_1061, macaque
ggcagagcagacaggtgggaggttcctgaagcaactcaacgatgcagcaggggcccgagcgctgactttcagcc

SEQ ID NO: 5547 - DNA, 119 bp, Artificial
  Hairpin sequence MQbrain_1062, macaque
ctggccccctggggccccctggtcatggccaaaccctgggtaagagtgagggcatcagggcaggctgagctctgggtagtgaaggggaagggctgagtgggtgggttgaaggggtccag

SEQ ID NO: 5548 - DNA, 118 bp, Artificial
  Hairpin sequence MQbrain_1063, macaque
gcctgctcctgggccctgctgtcctggcagctttacagtttggtgtgtctttgattctcgaagattccggaaccaaattctgaagctgtgatcacaaacttgcagccctggaggacgc

SEQ ID NO: 5549 - DNA, 88 bp, Artificial
  Hairpin sequence MQbrain_1064, macaque
ctgcccccaggttgcagctgcctctggcctggcgcctcccttccccagaggctggtgcccgcctcccagcccttcttggatgggtcag

SEQ ID NO: 5550 - DNA, 82 bp, Artificial
  Hairpin sequence MQbrain_1065, macaque
cgctttcagtgactcctaaagggacagcctgatggcaagtgactcttctcattggcctggcttccccttgagactgggagtg

SEQ ID NO: 5551 - DNA, 96 bp, Artificial
  Hairpin sequence MQbrain_1066, macaque
ccatttggattgagggaatgtctgtgttgtgattccttattgattcgaaggttggaaaggtttgtgctcaatgcaggggtctcttggtgctatggg

SEQ ID NO: 5552 - DNA, 48 bp, Artificial
  Hairpin sequence MQbrain_1067, macaque
ggcgaggttctctggtcctcaggtgtggggggccagggaagtcacgct

SEQ ID NO: 5553 - DNA, 108 bp, Artificial
  Hairpin sequence MQbrain_1068, macaque
ccagggctctgggtggcacacgcccttgcggcttgggaaaaaacaaaaccaaatcttatcaccaaataaacctgggctgggcctgggcgggtgccaaaccgcccatgg

SEQ ID NO: 5554 - DNA, 108 bp, Artificial
  Hairpin sequence MQbrain_1069, macaque
ctcctgggccctgctgtcctggtagctttagagttttgtgtgtctttgattccggaagattccggaaccaaattctgaagctgtgatgacaaacttgcagccctggag

SEQ ID NO: 5555 - DNA, 101 bp, Artificial
  Hairpin sequence MQbrain_107, macaque
ctcctgggggcctggcgaggactgagaccctggaagtggggggataccttcccacccagcactacttcacacaagtcccctgcctggggctctccaaggag

SEQ ID NO: 5556 - DNA, 116 bp, Artificial
  Hairpin sequence MQbrain_1070, macaque
tggacccaacacaaacggttcccagtttttcatctgcactgccaagagtgagtggttggatggcgagcatgtggtctttggcaaggtgaaagaaggcatgaatattgtggaggcca

SEQ ID NO: 5557 - DNA, 112 bp, Artificial
  Hairpin sequence MQbrain_1071, macaque
ccatgttgctacccctggtcacagccatactgctgggcacctgcgccgtgaggtcactgattgggcacggagccgcggggcagcagttggtcaggaggtggcatccacatgg

SEQ ID NO: 5558 - DNA, 70 bp, Artificial
  Hairpin sequence MQbrain_1072, macaque
tcggggcatggggggtgccttcgtgctggtcctgtacgacgagctcaagaaggtgatctaagggccgcgg

SEQ ID NO: 5559 - DNA, 117 bp, Artificial
  Hairpin sequence MQbrain_1073, macaque
ctgcggagggctgcggggcgaaccctgcggcccctctggctttggcggtcacatttccgagaggccagcgggggctgcgcgggctcggtggtcctcgccaagccctcccgagagcag

SEQ ID NO: 5560 - DNA, 86 bp, Artificial
  Hairpin sequence MQbrain_1074, macaque
gcgcgcgtgggaaggggaggggtgggcggggctaacggtccaatccgggtaactccgcccctgcctgactccccccgcgcagacgc

SEQ ID NO: 5561 - DNA, 68 bp, Artificial
  Hairpin sequence MQbrain_1075, macaque
gctgggcagggggagagaggcggggtccgggcagaggacattaaagccctcctgtctcctctcccagt

SEQ ID NO: 5562 - DNA, 72 bp, Artificial
  Hairpin sequence MQbrain_1076, macaque
ggtggggctctcatgccgcgccgccccttgttcttggcctgcagagggaggctggtgggtgtgccctgaact

SEQ ID NO: 5563 - DNA, 76 bp, Artificial
  Hairpin sequence MQbrain_1077, macaque
tgaacaggaattttgtgagcaggagaaagggtgtaagggcactggagttcattcctgctagcagaagagactgtca

SEQ ID NO: 5564 - DNA, 91 bp, Artificial
  Hairpin sequence MQbrain_1078, macaque; MQbrain_1125, macaque
gcaggagcctctcaccttcaagtggctccagaggagaaacaaatctgtctctctgtctgatctacagagagggtgagaaagcaaatctagc

SEQ ID NO: 5565 - DNA, 108 bp, Artificial
  Hairpin sequence MQbrain_1079, macaque
taggaaggaggaggctgtctcctgcctctatttggtgggattgtctgtggctccttagggacaggaatgcagggagtgggggaagaaaggcggcctgactgctaacta

SEQ ID NO: 5566 - DNA, 117 bp, Artificial
  Hairpin sequence MQbrain_108, macaque
gtcaggacacagagggatacttggtgtggggttgagggtgagggacgagtggaggatacccccaggtttatctgacccgcccctctctaaaccaggctccttctgtgtctacagggc

SEQ ID NO: 5567 - DNA, 112 bp, Artificial
  Hairpin sequence MQbrain_1080, macaque
aagaatctaatataaatttgttttctcaaatatctgctatgagaggttgatggattaattaaataagtcaattcctagaatttgagagagcaaataaagacctgagaacctt

SEQ ID NO: 5568 - DNA, 113 bp, Artificial
  Hairpin sequence MQbrain_1081, macaque
ctggcatcttgtccatggcaaatgctatacccaacacaaacggttcccagttcttcatctgcactgccaagagtggttggatggcaagcatgtggtctttagcaaggtgaaag

SEQ ID NO: 5569 - DNA, 95 bp, Artificial
  Hairpin sequence MQbrain_1082, macaque
ggtccatgggcccccagcgttcccccctgccctgtctcctgatgtcatggctggcagcagggctctggggccaggcctggtggggtctttgagct

SEQ ID NO: 5570 - DNA, 80 bp, Artificial
  Hairpin sequence MQbrain_1083, macaque
gctgggcagggggagagaggcggggtccgggcagagcttctccaccaggacattaaagccctcctgtctcctctcccagt

SEQ ID NO: 5571 - DNA, 119 bp, Artificial
  Hairpin sequence MQbrain_1084, macaque
gctttaattttctttgttagcactctaaagtttagtaaagaactaagaaccacgtcagaagctgcagtgttttgttcttgtttcttataggctgaaggggatgctaaaggagataaagc

SEQ ID NO: 5572 - DNA, 117 bp, Artificial
  Hairpin sequence MQbrain_1085, macaque
cccatcgtgggcattgttgctggcctggctgtcctagcagttgttgtcactggagctgtggtggctgctgtgatgtggaggaggaagagctcaggtagggaaggggtgtggggtggg

SEQ ID NO: 5573 - DNA, 101 bp, Artificial
  Hairpin sequence MQbrain_1086, macaque
ttgggttagggcttcttgtggcctgaagagaaaattcatttacagagatggcctcttaacatgaagatcgttggacaggccacatgggtatcccatcccaa

SEQ ID NO: 5574 - DNA, 75 bp, Artificial
  Hairpin sequence MQbrain_1087, macaque
gcctgccctgcccagagctgtgtcctgatgccgtgttcaggctcatggagcagtgctgggcctatgagcctgggc

SEQ ID NO: 5575 - DNA, 81 bp, Artificial
  Hairpin sequence MQbrain_1088, macaque; MQbrain_403, macaque; MQbrain_404, macaque
gcatatctgggcagaggggtgagggattgcttcgaaaggatttcctaaagaggtatcagtgccttattggaatgcccttgc

SEQ ID NO: 5576 - DNA, 89 bp, Artificial
  Hairpin sequence MQbrain_1089, macaque
cacagcctttgtacccagcgacggttgcttgaactttattgaggaaaacgatgaagttctggttgctggatttggttgcaaaggtcatg

SEQ ID NO: 5577 - DNA, 109 bp, Artificial
  Hairpin sequence MQbrain_109, macaque
gtccccatgggcctgcagcctccctcctatcccagtactcctctgccctcagctcaccagctgggcaacgataccgggaaagggtagaagcgtacccccacctgggcac

SEQ ID NO: 5578 - DNA, 70 bp, Artificial
  Hairpin sequence MQbrain_1090, macaque
ggccctggtggcccttggatggggaaccgcggtggcttccgcggaggtttcggcagtggcatcccgggcc

SEQ ID NO: 5579 - DNA, 64 bp, Artificial
  Hairpin sequence MQbrain_1091, macaque; MQbrain_1224, macaque
gcaagctgctggagggcgaggagtgcaggtgggtaactgacgcggcttcctccaacagttgagt

SEQ ID NO: 5580 - DNA, 106 bp, Artificial
  Hairpin sequence MQbrain_1092, macaque
agctggggggcagggctctccagggcgagcccctgtgactttgtctggtttatatccatccagtacaaatccacaggctcttactctagaagcttctgccagggct

SEQ ID NO: 5581 - DNA, 113 bp, Artificial
  Hairpin sequence MQbrain_1093, macaque
taggaaaaatgtcccttgcccagcacagccgttccaggatagcaccctttgggatatacccctgagctcttcttggcacgtggcatggcactgtggtggaggtcagcagcttg

SEQ ID NO: 5582 - DNA, 116 bp, Artificial
  Hairpin sequence MQbrain_1094, macaque
gtggccccacagtgtcatgatatctgtgtggccccacagtgttatgatgtctgcgtggccccagtgtcgtgatctctgtgtggccccacactgttgtgatctcagtgtggccccac

SEQ ID NO: 5583 - DNA, 77 bp, Artificial
  Hairpin sequence MQbrain_1095, macaque
gttggaatggtgacaacatgctggagccaaatgctaacatgccttggttcaagacatggaaagtcacctgaaacgac

SEQ ID NO: 5584 - DNA, 68 bp, Artificial
  Hairpin sequence MQbrain_1096, macaque; MQbrain_1275, macaque
ccaccacgcccagcctgctcttatgtttgtaagggacatattagaggcaggctagggagaagtgttgg

SEQ ID NO: 5585 - DNA, 106 bp, Artificial
  Hairpin sequence MQbrain_1099, macaque
aggatagtgctggtcatgcccccgatgcagccatgccctgaatgatttcattcctgagagtgatcgcattctggtcctggctgcagtggggtacaatttacatcct

SEQ ID NO: 5586 - DNA, 119 bp, Artificial
  Hairpin sequence MQbrain_11, macaque
tgttagtagggctgtcactctcatctctccttatgtctgagattctggcccttcctgtgctttagggaggtccattattttacactaaagggaggaagggtgatggagaattgttgaca

SEQ ID NO: 5587 - DNA, 85 bp, Artificial
  Hairpin sequence MQbrain_1100, macaque
ttggctcctgtggaggcctactaggaacgagacttctaaaaggaactatgtctggaaggctgtggtccaaggtcatttttgccgg

SEQ ID NO: 5588 - DNA, 118 bp, Artificial
  Hairpin sequence MQbrain_1101, macaque
gcctaaggagaatcccaaatttagttcaaacttgtattggttggtgatggtggtactggaaaactaccctcatgaagtagcatttgactgctgaatttgagatataaccaccttgggt

SEQ ID NO: 5589 - DNA, 120 bp, Artificial
  Hairpin sequence MQbrain_1102, macaque
agcaggggaaggggaggagcgggatgagggtgaagacaggcagaaagaaagggcaagagctgctcccagcgctgcatatggaaaaacccacatctgcactccaaggatccgtctcttgtt

SEQ ID NO: 5590 - DNA, 96 bp, Artificial
  Hairpin sequence MQbrain_1103, macaque
ggcagggaaggtactggcttctttatgccctctgggtctgctgggttgccatggtgagcccagctcacacccagtaggtgactcagacctcctgcc

SEQ ID NO: 5591 - DNA, 120 bp, Artificial
  Hairpin sequence MQbrain_1104, macaque
gggggcaggaacatcagaggtgcctgagagaccctggctctggggcagaggcctgagcaagggggccttgctggggtgtctctgccttagccatgcttggtgtttctgggtcctgtgacc

SEQ ID NO: 5592 - DNA, 112 bp, Artificial
  Hairpin sequence MQbrain_1105, macaque; MQbrain_1106, macaque
ccatgttgctacccctggtcacagccatactgctgggcacctgcgccgtgaggtcactgagtggacacggagccgcggggcagcagttggtcaggaggtggcatccacatgg

SEQ ID NO: 5593 - DNA, 109 bp, Artificial
  Hairpin sequence MQbrain_1107, macaque
gcacacctgtggccattcccctataaggtggaaaggacggctgggtcacgcgggagcatccgcacacccatggccgtcctctttaaggtggaaagggctgctggggtgc

SEQ ID NO: 5594 - DNA, 117 bp, Artificial
  Hairpin sequence MQbrain_1108, macaque
cgctcgcccgcccgccctcggtttcggtgcgcccggagcgatcctccttccctctcctcgggggagggtgggtcacttcgcggcactcggggaacgccgaggaaaggggaagccgcg

SEQ ID NO: 5595 - DNA, 113 bp, Artificial
  Hairpin sequence MQbrain_1109, macaque
ggacccttcccccctccagctgtaggaaggaggcggctgtcccctgtctatatttggtgggattgtctgtggctccttagggacaggaatgcagggagtgggggaagaaagcc

SEQ ID NO: 5596 - DNA, 116 bp, Artificial
  Hairpin sequence MQbrain_1110, macaque
tgtcttcatctttgcagtcttgggtgcccacctcagctgcgggcctggtgacagtgcctcagtcatcagtgtcctcaggtgacctgttgcccaaggctgcactggggggagggaca

SEQ ID NO: 5597 - DNA, 77 bp, Artificial
  Hairpin sequence MQbrain_1111, macaque
cctgtcaaggtggccttgggaccagagctggattgggagcctgtcctgcattagctctggtcccagcatggggtggg

SEQ ID NO: 5598 - DNA, 63 bp, Artificial
  Hairpin sequence MQbrain_1112, macaque
caaaggcagcttctgacacaccagccccaggacctggggtgactggaggaagccaggcgagtg

SEQ ID NO: 5599 - DNA, 113 bp, Artificial
  Hairpin sequence MQbrain_1113, macaque
atacgggaaagatgccaccaatgtgggggatgagcacgaagtatctgaaagatgtcactttacagaaacagtgtgtaccattctgacattacaatggtggagttggcaggtgt

SEQ ID NO: 5600 - DNA, 99 bp, Artificial
  Hairpin sequence MQbrain_1114, macaque
ggcactgcctgcggaaggtaggattagatcattagctcagtgacctcctagggtttcgatgtgctgtgttctcatcctacagctggtttggtaatgatc

SEQ ID NO: 5601 - DNA, 101 bp, Artificial
  Hairpin sequence MQbrain_1115, macaque; MQbrain_299, macaque
attaaattggtttccaatatgggaaagaaatgttgtgtgtggtcccttcaggcacctgcaaccccatccctaccccatgctgccttcaaaccttgtttgat

SEQ ID NO: 5602 - DNA, 116 bp, Artificial
  Hairpin sequence MQbrain_1116, macaque
ccccagttccgggctgtcttgggggaagtgaagctgtgtgagaagatggcccagtttgatgctaaagagtttgcagagacccagcctaaaaaagatacaccacggaaagagaaggg

SEQ ID NO: 5603 - DNA, 78 bp, Artificial
  Hairpin sequence MQbrain_1117, macaque; MQbrain_898, macaque
ggaaccaccaagtccctggaaggtggatctggagatgttggcaggagccactccctgtgttccagggttccaggttcc

SEQ ID NO: 5604 - DNA, 82 bp, Artificial
  Hairpin sequence MQbrain_1118, macaque
cacccctgttgggccttgagtgaagggctgaaggccaggctggtgcagggtctggcaggagctgagggcccaggcgggagtg

SEQ ID NO: 5605 - DNA, 59 bp, Artificial
  Hairpin sequence MQbrain_1119, macaque
gtacccagccctgccctggctctggcatgtatgtgggagagggggacagggggagttgc

SEQ ID NO: 5606 - DNA, 114 bp, Artificial
  Hairpin sequence MQbrain_112, macaque
ggacctcatggtcagcctgtgggtggacttagatttgataatccccgaggtcagcctgtaggtggacttagatttgaggggggtcatggtccatcaggggctgctattaggttt

SEQ ID NO: 5607 - DNA, 106 bp, Artificial
  Hairpin sequence MQbrain_1120, macaque
gatctatggctgaggtagtgatggaaggagctgttgggcttggagaaatttggtgtcataaagaaaaagagctagctgtttattattgttgctgggctggggggtc

SEQ ID NO: 5608 - DNA, 109 bp, Artificial
  Hairpin sequence MQbrain_1121, macaque
gcacacctgtggccattcccctataaggtggaaaggatggctgggtcacgcgggagcatccgcacacccatggccgtcctctttaaggtggaaagggctgctggggtgc

SEQ ID NO: 5609 - DNA, 63 bp, Artificial
  Hairpin sequence MQbrain_1122, macaque
tgtagcggaagagtggaagcatgaggcaggtgctggctggtggtggcacatcttccgcttgcg

SEQ ID NO: 5610 - DNA, 95 bp, Artificial
  Hairpin sequence MQbrain_1123, macaque
ccatttggattgagggaatgtctgtgttgtgattccttattgattcaaaggttggaaaggtttgtgctcaatacaggggtctcttggtgcgatgg

SEQ ID NO: 5611 - DNA, 73 bp, Artificial
  Hairpin sequence MQbrain_1124, macaque
aagggtgtcactgagctgtgttttgtctgagcctctcttggtcaacagcaaagcttggcgtcttggcactgtt

SEQ ID NO: 5612 - DNA, 110 bp, Artificial
  Hairpin sequence MQbrain_1126, macaque
ggccaaaaagagtgtctcttgtgaggtcagcgtgcagcttccctggccttgaagcccaaggcacagaggtaatcacacctgtagctttagatgcactgtttccttgtgcc

SEQ ID NO: 5613 - DNA, 118 bp, Artificial
  Hairpin sequence MQbrain_1127, macaque
ttgggcccctcaaggccttcaacctggtcaaggacagtgccacggggctctccaagggctacgccttctgtgagtacgtggacatcaacgtcacggatcaggccattgcggggctgaa

SEQ ID NO: 5614 - DNA, 95 bp, Artificial
  Hairpin sequence MQbrain_1128, macaque; MQbrain_1462, macaque
aggggtgtcactgtagggtggtgttgctgtagtgcagtgtcactgtggagcagcattgtcactgtagaggggtgtcactgtagggtggtgtcact

SEQ ID NO: 5615 - DNA, 117 bp, Artificial
  Hairpin sequence MQbrain_1129, macaque
aatgtggtcacgttacacgattctggccaatagcaggagtggcatgtaaactcttttcctgtttttctctttccttcttgctattggctgaaatgtgaatgcgatggtggacacgtt

SEQ ID NO: 5616 - DNA, 71 bp, Artificial
  Hairpin sequence MQbrain_113, macaque
tccccgcgggagggcgtcggagctgccccggcgccgccgctgctcctccctcgcgccctcccgctcccgga

SEQ ID NO: 5617 - DNA, 94 bp, Artificial
  Hairpin sequence MQbrain_1130, macaque
gaattgtgtggcagtgattgtgtggtctgttcgtggagaatgtatgaaagctattaatattctagaatagattaataaattggctatgttgttc

SEQ ID NO: 5618 - DNA, 81 bp, Artificial
  Hairpin sequence MQbrain_1131, macaque
gatggtcagggtttgactggagaggctgatttggaacatccggagcaggtctgacctctgtagttggcctttattgaattc

SEQ ID NO: 5619 - DNA, 76 bp, Artificial
  Hairpin sequence MQbrain_1132, macaque
tggaggaaaggcagttcctttgctagggcttgggaggtgcacagtgctaggaagggaattttcaagggttcttcca

SEQ ID NO: 5620 - DNA, 103 bp, Artificial
  Hairpin sequence MQbrain_1133, macaque
agtttcaggagctggtgagccagcatggggttgacagctcagctggagataagaatccagatctgggcttagtgcatccctcttcaccaccagctctgctgct

SEQ ID NO: 5621 - DNA, 105 bp, Artificial
  Hairpin sequence MQbrain_1134, macaque
cggggtgagcgctgggggcgctggagcgggaggggccaggcagggggtaccatgggggccttgctgtgtgaccaccattcctgcaggcccatcagcctcaccgtg

SEQ ID NO: 5622 - DNA, 114 bp, Artificial
  Hairpin sequence MQbrain_1135, macaque
ctctgtcccatgcttaggcacccacatgtggccacaagtgcctttcctacctcatccctacgggaggctggtgtccaggcacctgtggctccaggcagaagtctgagtgcagag

SEQ ID NO: 5623 - DNA, 68 bp, Artificial
  Hairpin sequence MQbrain_1137, macaque
tgggggctcctggcttggtccccctgtggtaccccttctctgggtcccctccagcccagcctccccca

SEQ ID NO: 5624 - DNA, 76 bp, Artificial
  Hairpin sequence MQbrain_1138, macaque; MQbrain_1247, macaque
gctttgtttgaatacaacggccacgtcgacaaagccattgaaagtcgaaccgttgtggccgatgtcttagcaaagt

SEQ ID NO: 5625 - DNA, 115 bp, Artificial
  Hairpin sequence MQbrain_1139, macaque
tgagattagttaatattaattgaatggccaaatgatggttgattctgtgctaagtgcttctgataaggcagtgaagtataggaaacacggatggtttttcatttagctgatttca

SEQ ID NO: 5626 - DNA, 109 bp, Artificial
  Hairpin sequence MQbrain_114, macaque
tccttatttgttaaaattaagcattttgcatttttccttccactcgttaagaagaagaaggtcttcgaggggagaagaggaaacgagatgctgaagatgatggagagga

SEQ ID NO: 5627 - DNA, 114 bp, Artificial
  Hairpin sequence MQbrain_1140, macaque; MQbrain_1172, macaque
ggaacatcagaggtgcctgagagaccctggctctggggcagaggcctgagcaagggggccttgctggggtgtctctgccttagccatgctcggtgtttctggattctgtgaccc

SEQ ID NO: 5628 - DNA, 107 bp, Artificial
  Hairpin sequence MQbrain_1141, macaque
agccaggtacaagggtatgtgtgaactttgtgctgtcttggcagtttgtctgtaattctaaaactgttttaaaattaaaagtttactcaacttgccaatgtactgct

SEQ ID NO: 5629 - DNA, 93 bp, Artificial
  Hairpin sequence MQbrain_1142, macaque
gtccaatcttggatttccagagtcttataatatagcctcattttctgggtgcaggagaggctggtgatggctacggaggaccattagttggat

SEQ ID NO: 5630 - DNA, 88 bp, Artificial
  Hairpin sequence MQbrain_1143, macaque
ctgcccccaggttgcagctgcctctggcctggcgcctcccttccgcagaggctggtgcccgcctcccagcccttcttggatgggtcag

SEQ ID NO: 5631 - DNA, 96 bp, Artificial
  Hairpin sequence MQbrain_1144, macaque
cccagtgcactgtggccagggttcacatcggccaagttatgtccatcagcaccaagctgcagaacaaggagcatgtgattgaggccctgtgcaggg

SEQ ID NO: 5632 - DNA, 82 bp, Artificial
  Hairpin sequence MQbrain_1145, macaque
gtggttcacctctttgtgcccccttttgctgtctttcaggggacttgtatacccaggcagcagaggcagcgatggaagccat

SEQ ID NO: 5633 - DNA, 58 bp, Artificial
  Hairpin sequence MQbrain_1146, macaque
aggcctctgctgcggctgcccactggctgtgcccaggccttgaagccgcagcgaacct

SEQ ID NO: 5634 - DNA, 108 bp, Artificial
  Hairpin sequence MQbrain_1147, macaque
ctgcggcagaggcgcaggctagcaggaatggatgtgccctgggctgctgcaagctcccgtccccagtcacatccattcacgcagcctgactgcctccaggggccttag

SEQ ID NO: 5635 - DNA, 119 bp, Artificial
  Hairpin sequence MQbrain_1148, macaque
gcctggcctcctggtatctgtggtcatagtggcccatgggtaggggcacccaggctgaccctgaggtgctgctgctgggtctgtcttggctctggggtatgctgggagggtcaccaggt

SEQ ID NO: 5636 - DNA, 83 bp, Artificial
  Hairpin sequence MQbrain_1149, macaque; MQbrain_439, macaque
ctcctcccacctccagcattggagcccttctgtctctggtctttctctttgaccctgctgggtttaagctgcctagggagggg

SEQ ID NO: 5637 - DNA, 56 bp, Artificial
  Hairpin sequence MQbrain_115, macaque
cttaaccaccagcatccctcctctccccaaagtgaagtggagggtgctgtggtgag

SEQ ID NO: 5638 - DNA, 77 bp, Artificial
  Hairpin sequence MQbrain_1150, macaque
gggacttcccatcaatcagccaagaatgctctgccagtgggtgagagtctgtgaggcaggagagcttggggagttcc

SEQ ID NO: 5639 - DNA, 93 bp, Artificial
  Hairpin sequence MQbrain_1151, macaque
gtccaatcttggatttccagagtcttataatatagcctcactttctgggtgcgggagaggctggtgatggctacggaggaccattagttggat

SEQ ID NO: 5640 - DNA, 73 bp, Artificial
  Hairpin sequence MQbrain_1152, macaque
ggccaagtggaggtaactggcgatgaatacaatgtggaaagcattgatggtcagccaggtgcctttacctgct

SEQ ID NO: 5641 - DNA, 83 bp, Artificial
  Hairpin sequence MQbrain_1153, macaque
aacctcaacaggcattgtgtgacttggggtcagcctaggctgttgcctctgaaccctgtgttgcactgcagcctaggaaggtt

SEQ ID NO: 5642 - DNA, 101 bp, Artificial
  Hairpin sequence MQbrain_1154, macaque
gcagatggtatccagcaagtgcaaagctgaggtttcttgggtctctcacatcagcacctctgaggcctgggttctgtatttccctggagccccactcctgc

SEQ ID NO: 5643 - DNA, 95 bp, Artificial
  Hairpin sequence MQbrain_1155, macaque; MQbrain_1436, macaque
ccatttggattgagggaatgtctgtgttgtgattccttattgattcgaaggttggaaaggtttgtgctcaatacaggggtctcttggtgcgatgg

SEQ ID NO: 5644 - DNA, 97 bp, Artificial
  Hairpin sequence MQbrain_1156, macaque
gattccttggtagaggaagttttagtgttggcttggcaaaagaaattgtttctttagccaaggatatatgatcttgaagagtctttggccttgagtt

SEQ ID NO: 5645 - DNA, 83 bp, Artificial
  Hairpin sequence MQbrain_1157, macaque
acaagatgagaccaaacacctaaggaaggagctggagagtctgggaagacagctccaggccgaggtggaaaacaatcagatgt

SEQ ID NO: 5646 - DNA, 75 bp, Artificial
  Hairpin sequence MQbrain_1158, macaque; MQbrain_1176, macaque
ctgcgaagtgcacctcctgcgttccaggcctcacacagcctgtgccaggttttggaagcaggagtttgtctgcag

SEQ ID NO: 5647 - DNA, 98 bp, Artificial
  Hairpin sequence MQbrain_1159, macaque
tgggcccacccggtgggactcccgtggggcagggagctgggcccaacatggccccagcctctgcctttgcaccacggggcatcacagggtaggcctca

SEQ ID NO: 5648 - DNA, 109 bp, Artificial
  Hairpin sequence MQbrain_116, macaque
ctgcacattattctgatgaaaatccacaatgtctttgagcttctggttgtgtaatgctggagtttaaagtcaccatttgtgggtctggcatcagttaatatttagccag

SEQ ID NO: 5649 - DNA, 116 bp, Artificial
  Hairpin sequence MQbrain_1160, macaque
tagaattgggccgtaggtggagaggagttggaggtgtagatatagggaggaacccagttgtaggtttcttagaaagtcaccatggccttctcagagaccctttattagctcatctg

SEQ ID NO: 5650 - DNA, 109 bp, Artificial
  Hairpin sequence MQbrain_1161, macaque
gcacacccgtggccattcccctttaaggtggaaaggatggctgggtcgcacgggaacatccgcacacccgtggctgtcctctttaaggtggaaagggctgctggggtgc

SEQ ID NO: 5651 - DNA, 72 bp, Artificial
  Hairpin sequence MQbrain_1162, macaque
ggggcctggtgaacctggaccgtctgctgctgcatgagaaccagctgcagtgggtccaccacaaggcgttcc

SEQ ID NO: 5652 - DNA, 114 bp, Artificial
  Hairpin sequence MQbrain_1163, macaque
ctgcaggaattagtgctgagaagcaggagtttggtggaggaaggaagagatccagtcccagatacaggcaaatgagtcttttccctctcccaagcatggcagtcagcactgcag

SEQ ID NO: 5653 - DNA, 106 bp, Artificial
  Hairpin sequence MQbrain_1164, macaque
atgctcccttcccactgtagtgagcaggtgaggaccatgtggatctttctagaaatacatgtgggtgtttgcaaatgcagaactgactggtggaaagggcgagcat

SEQ ID NO: 5654 - DNA, 52 bp, Artificial
  Hairpin sequence MQbrain_1165, macaque
ggaactctgacctggcccactggcttgcagtatgtgggtggggccgagttcc

SEQ ID NO: 5655 - DNA, 85 bp, Artificial
  Hairpin sequence MQbrain_1166, macaque
gcggctggagggactgggggcagcagcggcggtggcggcggcttcggcgcggcgaccttcgccagcacctccgccactcctccgc

SEQ ID NO: 5656 - DNA, 112 bp, Artificial
  Hairpin sequence MQbrain_1167, macaque
gtgggacgtggggtgagcaggccctgtctccacggcagaggagggacatgggtgctgcctgtctccccttcttctctccgtggaccctggcctgcttccagagcctttctat

SEQ ID NO: 5657 - DNA, 89 bp, Artificial
  Hairpin sequence MQbrain_1168, macaque
agtcatccatggtctctgacaggaaccgatctggagttcagaaagctttaaaatgggctccagacaagtgggagtccctgggtttgatt

SEQ ID NO: 5658 - DNA, 74 bp, Artificial
  Hairpin sequence MQbrain_1169, macaque
tggctcctgtggaggcctgctgggaatggggcttctaaaaggaactatgtctggaaggctgtggtccaaggcca

SEQ ID NO: 5659 - DNA, 58 bp, Artificial
  Hairpin sequence MQbrain_117, macaque
aatgagacagaggatggcatctgtgaataacacagatgatgccatcctctatctcatt

SEQ ID NO: 5660 - DNA, 79 bp, Artificial
  Hairpin sequence MQbrain_1170, macaque
gagaggacccttcctccctccagctgtaggaaggaggcggctgtctcctgcctatatttggtgggattgtctgtggctc

SEQ ID NO: 5661 - DNA, 94 bp, Artificial
  Hairpin sequence MQbrain_1171, macaque
cctggttctccttggagctgtagtcactggagctggggtcgctgctgtgatgtggaggaagaagagctcaagtgcggaaggggtgaggagtggg

SEQ ID NO: 5662 - DNA, 64 bp, Artificial
  Hairpin sequence MQbrain_1175, macaque
caaacggcgccaggaacccctgcggcagcctagccctcagcggggagccggggccccggaattg

SEQ ID NO: 5663 - DNA, 110 bp, Artificial
  Hairpin sequence MQbrain_1177, macaque
gtgtgaatgccttgtgcatacacaaatgtgtgttcagtgcacacatgcatttatgtgcacgtgaatttgtgtgcctgaaggtttgattgtgtgtgcccgattgtgaatgc

SEQ ID NO: 5664 - DNA, 118 bp, Artificial
  Hairpin sequence MQbrain_1178, macaque
gcctgctcctgggccctgctgtcctggcagctttacagtttggtgtgtctttgattccagaagattctgcaaccaaattctgaagctgtgatcacaaacttgcagccctggaggacgc

SEQ ID NO: 5665 - DNA, 93 bp, Artificial
  Hairpin sequence MQbrain_1179, macaque
gcccttctctcctctctgggcctgctgtttcttcttcatggtcgttctcctgggactggatagtcaggtatcaagaggcagccactcaggggc

SEQ ID NO: 5666 - DNA, 85 bp, Artificial
  Hairpin sequence MQbrain_1180, macaque
cacaaagcctggcagcacccccagcccagctgcacgataagataagacgtgcccaagggacctggggagagaagccagactggtg

SEQ ID NO: 5667 - DNA, 114 bp, Artificial
  Hairpin sequence MQbrain_1181, macaque
ggaggagatgaacgggacctaggagaaaagtgcctacgacttccgtgatgcctcgcggttgctgtagcctgatgcctcgtgggagttgtagttttctttagaaaccgtcccttc

SEQ ID NO: 5668 - DNA, 94 bp, Artificial
  Hairpin sequence MQbrain_1182, macaque
tggagaaacaggaagtgggacaggatcagtggaaacgctgcttgggtatttgaaattcaagcagtgagacctgagagactggagttcctctcca

SEQ ID NO: 5669 - DNA, 65 bp, Artificial
  Hairpin sequence MQbrain_1183, macaque
tggagctcgcagtccaggtggaacagaccgtattccatgtcagttccttctggcttcgggcctca

SEQ ID NO: 5670 - DNA, 91 bp, Artificial
  Hairpin sequence MQbrain_1184, macaque
ggttccagcacctctggctgcctgggcctcctgcctctggccattggtaccagctgtcaacccctggaggaatgggcagcctgtcggcacc

SEQ ID NO: 5671 - DNA, 66 bp, Artificial
  Hairpin sequence MQbrain_1185, macaque
agtgtgtgattttgtatcccctgctgtgcctcagtagaggacagcgggatgtactcagcatcttct

SEQ ID NO: 5672 - DNA, 104 bp, Artificial
  Hairpin sequence MQbrain_1186, macaque
ggactgctaatatacactcagagtggctagaggcaagtattctccagagacctccagaggtctgaggaaacttgtcctcctggtcaatgaattgggggaagacc

SEQ ID NO: 5673 - DNA, 65 bp, Artificial
  Hairpin sequence MQbrain_1187, macaque
gacagggagccatgggggcagggaaggactctacctaagctctctctgcccttcccatgtctgtc

SEQ ID NO: 5674 - DNA, 75 bp, Artificial
  Hairpin sequence MQbrain_1188, macaque
aggggaccctctgcctgagggctcagcctccagcctggccccgggtgatggaggctctgccctcagggtctctct

SEQ ID NO: 5675 - DNA, 89 bp, Artificial
  Hairpin sequence MQbrain_1189, macaque
cctgtagctacagctcatgtccatgtttttttcatctagtcttaattacagtgctataaaggatgagaaaaacagctgaaagctaaagg

SEQ ID NO: 5676 - DNA, 120 bp, Artificial
  Hairpin sequence MQbrain_119, macaque
tagattttttttcaaattcttcttcaccaatggcatctttctctgacctctagcctctttccctacccaaaggcctggcttggagtcagaaggttctcggtagactttgaaattagtctg

SEQ ID NO: 5677 - DNA, 76 bp, Artificial
  Hairpin sequence MQbrain_1190, macaque
ccatgtgccccctctggtcctagcttccattctggtttcactctcagggagggaaaggtgagcggggcctgcctgg

SEQ ID NO: 5678 - DNA, 79 bp, Artificial
  Hairpin sequence MQbrain_1191, macaque
gctgagctgtgagtgctgtggctgttcacacctaccatgtctcccatagggtgaacatcctcagtgtgtacagcactgc

SEQ ID NO: 5679 - DNA, 101 bp, Artificial
  Hairpin sequence MQbrain_1192, macaque
aggaagtgggagaggtgaaatgagtgctggttttgtggctgggccagagcactctgtgtccctgagagtggtattcaggtttcatgtctgtctagcttctt

SEQ ID NO: 5680 - DNA, 66 bp, Artificial
  Hairpin sequence MQbrain_1194, macaque
tgttcccagagcaaactgttcccagttctctgctggctgtactgggaacacagctacttgggtaca

SEQ ID NO: 5681 - DNA, 119 bp, Artificial
  Hairpin sequence MQbrain_1195, macaque
gtatgcctgcctggccttgtctcttggaagagcaccttaggccaggttcccatttccctttccccctgggcttgcctccctagtttgcttttcctaccgatgtgctggctaggatgtgc

SEQ ID NO: 5682 - DNA, 62 bp, Artificial
  Hairpin sequence MQbrain_1196, macaque
ggcagttcctactggcttggtcagggggaaactctcccttcatctgtccaggaggagctgct

SEQ ID NO: 5683 - DNA, 71 bp, Artificial
  Hairpin sequence MQbrain_1197, macaque
agggtacagagggtacgggttcctcggctgtgcacgtgaggcgcagctgagaattctgatctgaggatgct

SEQ ID NO: 5684 - DNA, 102 bp, Artificial
  Hairpin sequence MQbrain_1198, macaque
catccccgaaaacctgggagcggttgcggagaggggaagaagggacttgtttgtcccctggcccctctgttaagatctagctcccttcaggagatgggggtg

SEQ ID NO: 5685 - DNA, 70 bp, Artificial
  Hairpin sequence MQbrain_1199, macaque
cactaggaagctgcagctggagcggcccatgtcccctgagacgcaggctgacctccagcggaatctggtg

SEQ ID NO: 5686 - DNA, 90 bp, Artificial
  Hairpin sequence MQbrain_12, macaque
tgcttgcagttcagtgcttaggcctggggtccagcctggctccaggtggagctggctggagctttgtggtgtgtcaccaagcttacagca

SEQ ID NO: 5687 - DNA, 111 bp, Artificial
  Hairpin sequence MQbrain_120, macaque
gggcactgcgcgctggttcgcgctgggcagcctcctcgccctggctaggctgctggaaggccggctcgtgggcgaggaggaagccggctttggcgaatgtgacaagttctt

SEQ ID NO: 5688 - DNA, 72 bp, Artificial
  Hairpin sequence MQbrain_1200, macaque
ccagtgcaggatagcacccagatcacttgttctctgcaactgtctgctgctctccattactgtcctgactgg

SEQ ID NO: 5689 - DNA, 93 bp, Artificial
  Hairpin sequence MQbrain_1201, macaque
caagaaggccgaggctggggctgggtcagcaaccgaattccagtttagagacggatttggtcgtggacgtggtcagccacctcagtaaaattg

SEQ ID NO: 5690 - DNA, 109 bp, Artificial
  Hairpin sequence MQbrain_1202, macaque
ggtgggtgttgggcggtggggaggaggcttatgttgtgcacgggaggctgtggatgtacttctcccttgcagagagtaatgcccttccctgccaggtacactcctgtcc

SEQ ID NO: 5691 - DNA, 95 bp, Artificial
  Hairpin sequence MQbrain_1203, macaque
tgggtagtctctctcatggcctgttgatcctgatagaccccagaatacctgtggtagcccagagatgaatgaggcctacttcaaacaatggccta

SEQ ID NO: 5692 - DNA, 114 bp, Artificial
  Hairpin sequence MQbrain_1204, macaque
ctgacaggtccccaggctgtctggctctgtgcctgtctctccagcccggctctgacattcagtgacagggagtgagggtggggcaggccacagtgctggtgccaggggagttag

SEQ ID NO: 5693 - DNA, 86 bp, Artificial
  Hairpin sequence MQbrain_1205, macaque
tcagaggctgccactttgcctggtccccagggcctagcaggtaccctcagctgaggtcccaggaggctgggcttgggaagaactga

SEQ ID NO: 5694 - DNA, 74 bp, Artificial
  Hairpin sequence MQbrain_1208, macaque
tgtagctttggcttggggatggctgtcgctaccactgttcaagtcagcagcagccagccccaggcttttctcca

SEQ ID NO: 5695 - DNA, 97 bp, Artificial
  Hairpin sequence MQbrain_1209, macaque
gagtccccggctgctcaccaagctccctggtcagctgctccctggccatgggttgcagccaccacaggggcctccgggtgggcaagctggaggtctt

SEQ ID NO: 5696 - DNA, 101 bp, Artificial
  Hairpin sequence MQbrain_121, macaque
tcagttgttatcttaattgacttcaactcatgtgtatgtatgtgtgtatgtattacatatatacatataactacatctgtcagagggaagtggcaaattga

SEQ ID NO: 5697 - DNA, 70 bp, Artificial
  Hairpin sequence MQbrain_1210, macaque
ggcatatgctaagtgggcagcatggagggcaggcaggcttggtaccccagcagagttcacagccagtgct

SEQ ID NO: 5698 - DNA, 106 bp, Artificial
  Hairpin sequence MQbrain_1211, macaque
ccttgacccatgggtttctcctggcatttacaggacctgaggatgggggcgtgaaggcatctccagtgcccagtgaccctgagaagccaggcaccccgggtgaagg

SEQ ID NO: 5699 - DNA, 99 bp, Artificial
  Hairpin sequence MQbrain_1212, macaque
ggccctgatgccagcaccaatcccaggctgctgctgctcttctcagggttccttgtgggccttgggagagagcaacttgggatggtcggggagggtgcc

SEQ ID NO: 5700 - DNA, 85 bp, Artificial
  Hairpin sequence MQbrain_1213, macaque
gggttctcctggggcctttgggtcagggagcctctgaaaaaagttagtctcttcctttcccctgccccaagttgctggaagacct

SEQ ID NO: 5701 - DNA, 111 bp, Artificial
  Hairpin sequence MQbrain_1214, macaque; MQbrain_1216, macaque; PT_from_MQbrain_1214, chimp; PT_from_MQbrain_1216, chimp; PT_from_MQbrain_1217, chimp
gggttcacctccctgctcatggaacgtctctcagttgattatggcaagaagtccaagctggagttctccatttacccagcgccccaggtttccacagctgtagttgagccc

SEQ ID NO: 5702 - DNA, 98 bp, Artificial
  Hairpin sequence MQbrain_1215, macaque
gaggctccagcgccggtcccgccccagtgcgttacttacctcgactcttagcttgtcggggacggtaaccgggacccggtgtctgctccttccgcctt

SEQ ID NO: 5703 - DNA, 111 bp, Artificial
  Hairpin sequence MQbrain_1217, macaque
gggttcacctccctgctcatggaacgtctctcagttgattatggcaagaaatccaagctggagttctccatttacccagcgccccaggtttccacagctgtagttgagccc

SEQ ID NO: 5704 - DNA, 81 bp, Artificial
  Hairpin sequence MQbrain_1218, macaque
ggcctgaggctgagtgaggtgtgcttgggccctccggctggatgttctgggggaggaggcaatcactctagctgccaggcc

SEQ ID NO: 5705 - DNA, 65 bp, Artificial
  Hairpin sequence MQbrain_1219, macaque
gggagcgtgggaagggggtggggcaggggagccctgttcctctcctgaccccctgctgtgccccc

SEQ ID NO: 5706 - DNA, 70 bp, Artificial
  Hairpin sequence MQbrain_122, macaque
acattgttcttgctgtactctctatgggcagaagaccatcttttctgagagagagagatggcgagactgt

SEQ ID NO: 5707 - DNA, 97 bp, Artificial
  Hairpin sequence MQbrain_1220, macaque
aggaacccttgtcacccatctcagctagctcatctacttcccgccggcgacaaggccagcgggacctggagctcccggacatgcacatgcgggacct

SEQ ID NO: 5708 - DNA, 91 bp, Artificial
  Hairpin sequence MQbrain_1221, macaque
ccgtttcctgtgcaatcagatggtttggtttctgctttggaaagagggctggaagaggaggcaagtctgaagtggagggctctgaagacgg

SEQ ID NO: 5709 - DNA, 111 bp, Artificial
  Hairpin sequence MQbrain_1222, macaque
gaggtgatgaactccaagctgggcctggacatcgagatcgccacctacaggcgcctgctggagggcgaggagcagaggtgaggaccacagctgtggggagggtgtcccctc

SEQ ID NO: 5710 - DNA, 64 bp, Artificial
  Hairpin sequence MQbrain_1223, macaque
gcaagctgctggagggcgaggagtgcaggtgggtaactgatgcgacttcctccaacagctgagt

SEQ ID NO: 5711 - DNA, 95 bp, Artificial
  Hairpin sequence MQbrain_1225, macaque
cctcccctggggctcagggatgggaggccaggatgaagactagtccctaatcctcaacactggccttgctgtcctcagggctgaccaggcactgg

SEQ ID NO: 5712 - DNA, 70 bp, Artificial
  Hairpin sequence MQbrain_1226, macaque
tggcgagcgggcatcccggtccagtgggcatcccggctgggatggccgcggttgggggtgaggcgcgccg

SEQ ID NO: 5713 - DNA, 110 bp, Artificial
  Hairpin sequence MQbrain_1227, macaque
tgctgctgggagaatctgcagtgggaaagtcaagcctggtgttacgttttgtcaaagggcagttccatgagtaccaggagagcaccattggaggtgagtgtctcggggta

SEQ ID NO: 5714 - DNA, 115 bp, Artificial
  Hairpin sequence MQbrain_1228, macaque
ttctgggcagtccctggcttcctcccctaccctcaaaggaaacattgttcttttctggacagcctttggggatgaggggacagagggaagaagaccttggggcaggagtcctgaa

SEQ ID NO: 5715 - DNA, 59 bp, Artificial
  Hairpin sequence MQbrain_1229, macaque
ctgagccacacatctcactgcccttctggcactgaagggccctggggtagtttgctcag

SEQ ID NO: 5716 - DNA, 119 bp, Artificial
  Hairpin sequence MQbrain_123, macaque
agggatgaaatgggcacctagtcagatcttctcagcttgctagccagaaatgactgtgattttgctgggggctgctgagaaggtaatgtaggttgaaaaggggctctaagttgatttct

SEQ ID NO: 5717 - DNA, 64 bp, Artificial
  Hairpin sequence MQbrain_1230, macaque
ggcttgaggtgcccccgggcctctagtatttccattactggagtccctaatcacgctcttggcc

SEQ ID NO: 5718 - DNA, 64 bp, Artificial
  Hairpin sequence MQbrain_1231, macaque
gcggtacctgcgggagcccctctggccaactcatgaggttgtgctggagaaggccctgcttagc

SEQ ID NO: 5719 - DNA, 103 bp, Artificial
  Hairpin sequence MQbrain_1232, macaque
ccagccctgactccaggggcacctatgagatggccatgctgaatccccctcccagacaggcccttcccatctccagggcccccactgaggttcccagggctgg

SEQ ID NO: 5720 - DNA, 118 bp, Artificial
  Hairpin sequence MQbrain_1233, macaque
ccttcccatctccagggcccccactgaggttcccagggctggagacttcctctggtaaacattcccccagcctcccctcccctggggacactgaggaggtgggccacacccaggaagg

SEQ ID NO: 5721 - DNA, 98 bp, Artificial
  Hairpin sequence MQbrain_1234, macaque
agtgtcaccttctggaccaggtgtggtggtcatgcagctgaatgtccctaatggaccccagccccctcagaacccatccatggtccagtggagtcatt

SEQ ID NO: 5722 - DNA, 97 bp, Artificial
  Hairpin sequence MQbrain_1235, macaque; MQbrain_1323, macaque
gggtggggggacggggtctgggatgggttcccttctgctcagtaagatccgggaggagtacccagacaggatcataaacacgttcagcatcctgccc

SEQ ID NO: 5723 - DNA, 110 bp, Artificial
  Hairpin sequence MQbrain_1236, macaque
gtgacaagaggagataaggacaggttctgtcaggggtgacaccaagagagagggacaggttctgtcgggggtgacaccaggagagagggacaggttctgttgggggtgac

SEQ ID NO: 5724 - DNA, 114 bp, Artificial
  Hairpin sequence MQbrain_1237, macaque; MQbrain_1813, macaque
gggacagtttctgtcaggggtgacaccaggagagagggacaggttctgtcggggtgaccaggagaaagggacaggttctgtcaggggtgacaccaggagagagggacaggttct

SEQ ID NO: 5725 - DNA, 86 bp, Artificial
  Hairpin sequence MQbrain_1238, macaque
gggaaaggcagcatctggagtcccaagctcagtggggctgtgtactgcaccccgcttccactggggctccagaggccaggattccc

SEQ ID NO: 5726 - DNA, 89 bp, Artificial
  Hairpin sequence MQbrain_1239, macaque
ggtggcccaataggtgatgatgggtggacagatggatgccccaaagggtggcagaagtgcgtctgtcccatcacattgccagggttgtt

SEQ ID NO: 5727 - DNA, 79 bp, Artificial
  Hairpin sequence MQbrain_124, macaque
tctggcctgcgagggggcatcctgatagagctggccatgcggggtcgaatctatctggaacccccgaccatgcgtaaga

SEQ ID NO: 5728 - DNA, 97 bp, Artificial
  Hairpin sequence MQbrain_1240, macaque
taaaaaatgtgtccacgtcaactccacggcagatgtctggtctaaactatttcgcccagcacgtctgccacattggatttgggtggttttggttttg

SEQ ID NO: 5729 - DNA, 81 bp, Artificial
  Hairpin sequence MQbrain_1241, macaque
tcaacgtgaaaggaaagggggacctgaagacgtactttgtaaacacagaaatgtcaaggtccctttcccagagcaatgtgg

SEQ ID NO: 5730 - DNA, 120 bp, Artificial
  Hairpin sequence MQbrain_1242, macaque
gcagccggccggtggtgatagcaggaggcttattatgctgtcttggaatggtgttggcctccttcagtagcagcgtgatcgagctgtacctcactgtgggattcattacaggtaagtcgt

SEQ ID NO: 5731 - DNA, 109 bp, Artificial
  Hairpin sequence MQbrain_1243, macaque
gttctcactgcgccacagattcagaacttgtgttcgaagcctgtagcccagcaatgggagagggcgaaaggcttcaaacacgagttctgaatctgtggcttggtacaac

SEQ ID NO: 5732 - DNA, 83 bp, Artificial
  Hairpin sequence MQbrain_1244, macaque
acaatgctgcagcgtgggactgttggtctcatttcctccataaacggaggaaagggatgaaggaaagctccctggcagcctgt

SEQ ID NO: 5733 - DNA, 67 bp, Artificial
  Hairpin sequence MQbrain_1245, macaque
gggaggccttgagcctgagtcctacctcgaggtggatgggtgggaagggtacagggggtggaattcc

SEQ ID NO: 5734 - DNA, 67 bp, Artificial
  Hairpin sequence MQbrain_1246, macaque
ggagaagctgtgctacgtcgccctggacttcaagcaggagatggccatagtggcttccagctcctcc

SEQ ID NO: 5735 - DNA, 97 bp, Artificial
  Hairpin sequence MQbrain_1248, macaque
tctggccaaggtcatccatgacaactttggtatcatggaaggactcatgaccacagtccacgccatcacccagaagactgtggatggcccctccagg

SEQ ID NO: 5736 - DNA, 105 bp, Artificial
  Hairpin sequence MQbrain_1249, macaque
ccagaaagtttggggtcatctccaggcctcctgccaacaaggcccctgaagaatccaagggccgcattggctgtgaggtgtccagtgaccccagcactgagttgg

SEQ ID NO: 5737 - DNA, 72 bp, Artificial
  Hairpin sequence MQbrain_125, macaque
caaggtgttgagttttccccttcagctgcctcactttgtatcttggcagaaggagtaagctcgatttccttg

SEQ ID NO: 5738 - DNA, 102 bp, Artificial
  Hairpin sequence MQbrain_1250, macaque
tctcatttcagctgtgggattaattattgccattctcatcccagtggcagtggctgtcattgttggagtggtgacaagtatcctttgttatcggaagcgaga

SEQ ID NO: 5739 - DNA, 114 bp, Artificial
  Hairpin sequence MQbrain_1251, macaque
agctctcaaattctattaaggtgtaccatacaaaattgcaatatttgatcaattttgtcttcagaaatggctaggttgtgtggttaaacctaaaaaatatgaatctgagagact

SEQ ID NO: 5740 - DNA, 88 bp, Artificial
  Hairpin sequence MQbrain_1253, macaque
gtcctggcatcttgtccatggcaaatgctgggcccaacacaaattgttcccagtttttcatctgcactgccaagacgagtggttggat

SEQ ID NO: 5741 - DNA, 76 bp, Artificial
  Hairpin sequence MQbrain_1255, macaque
tctttgaggaaagagtgaggggtgctgctgagagaagtgcttctacagtagccatatttgaagctttgcttggagg

SEQ ID NO: 5742 - DNA, 83 bp, Artificial
  Hairpin sequence MQbrain_1257, macaque
caggactggagaaggtggtggttctagcttggtctctgctggccttgaagcaagcatccccccctgccctttttccttgactg

SEQ ID NO: 5743 - DNA, 118 bp, Artificial
  Hairpin sequence MQbrain_1258, macaque
ttcacctgttgcctccttgagtcatgcccaggtagcagtggatggtgggccaactgccgagtcatcccctaaggactggctacctgggagtgaggaaaggtagttgatgggctctgag

SEQ ID NO: 5744 - DNA, 113 bp, Artificial
  Hairpin sequence MQbrain_1259, macaque
tggtaaatgggggttggggtggtcttgctggtggagtaacagaaggaagaaatttcttaaattaagaaggtttccagtctttcttccagaggtaccgctacaaatacatgcca

SEQ ID NO: 5745 - DNA, 89 bp, Artificial
  Hairpin sequence MQbrain_126, macaque
aaagtcatattctcctaagggtcagtgctgtggctttctgtctggatgactattaacattttcatgtgaccctagggaggtcttatttt

SEQ ID NO: 5746 - DNA, 85 bp, Artificial
  Hairpin sequence MQbrain_1260, macaque
tagggggcaggaggcagggaggggtccattccccatggtagggcttggggggatgtagttgccccctccctctccctgtctcttg

SEQ ID NO: 5747 - DNA, 120 bp, Artificial
  Hairpin sequence MQbrain_1261, macaque
tattacaatttacttctgttataatatttcagcttattattatgatttatttctgtccctcatgaaagggacagaaagtagtcagacggttatgagctgaaaagacagtaggatgggatg

SEQ ID NO: 5748 - DNA, 98 bp, Artificial
  Hairpin sequence MQbrain_1262, macaque
atgtctggaaggctgtggtccaaggccttttctgctggctaaaagcagggcctccagaaccaaaggaaacacacagctcttcttaaaattgaagatgt

SEQ ID NO: 5749 - DNA, 98 bp, Artificial
  Hairpin sequence MQbrain_1263, macaque
gctctcatcagttatctggtggttgagctgagaggagaaaagtgctccccaagcttggcttctccagcttcaccaaagccagggacctaaaggagagc

SEQ ID NO: 5750 - DNA, 101 bp, Artificial
  Hairpin sequence MQbrain_1264, macaque
tcacagcctgcccgcactcctgaggggccttctcacagacagaccatctcctgtggttgtttggctgctcattttacctctggaatctgcctgggcctgga

SEQ ID NO: 5751 - DNA, 49 bp, Artificial
  Hairpin sequence MQbrain_1265, macaque
tcccagatgggctcagctctgccaagtggtgctgggtatcagtctggga

SEQ ID NO: 5752 - DNA, 116 bp, Artificial
  Hairpin sequence MQbrain_1266, macaque
tggacctagcacaaacggttcccagtttttcatctgcactgccaacactgagtggttgaatggcaagcatgtggtctttggcaaagtgaaagaaggcatgaatattgtgaaggcca

SEQ ID NO: 5753 - DNA, 95 bp, Artificial
  Hairpin sequence MQbrain_1267, macaque
agcatattttgcgagtactcaacaccaacatcgatgagtggtgtaaaatagcctttgccatcactgccattaagggtgtgggtcaaagatatgct

SEQ ID NO: 5754 - DNA, 76 bp, Artificial
  Hairpin sequence MQbrain_1268, macaque
acattttgttggtggctggctgtgtcttctaaaacagatcaactgttctggggcacggtgagtcattccacgttgt

SEQ ID NO: 5755 - DNA, 100 bp, Artificial
  Hairpin sequence MQbrain_1269, macaque
gtaacaaaagatggtgtgactgttgcaaagtcaattggcttaaaggataaatataaaaatattggagctaagcttgttgccagtaacactaagatgttgc

SEQ ID NO: 5756 - DNA, 99 bp, Artificial
  Hairpin sequence MQbrain_127, macaque
agggttacctttcagctctgttctcctggtcccaaggccggggtctgtccgaccctggggttgctgagcagagaaccacctggagctacccttaaccct

SEQ ID NO: 5757 - DNA, 72 bp, Artificial
  Hairpin sequence MQbrain_1270, macaque
tttcaggaaatcatactcaagtttcatatcttaactttggaatggaaacttggaggtgtgagaagcctgaaa

SEQ ID NO: 5758 - DNA, 96 bp, Artificial
  Hairpin sequence MQbrain_1271, macaque
tctagggaagggggctgaaggatctgggctgaggtggggcagattaaatggtcattaccttaaggcccctttccagctgcctcaggcctctgtggg

SEQ ID NO: 5759 - DNA, 112 bp, Artificial
  Hairpin sequence MQbrain_1272, macaque
aaggcaaacatttctgaaatcctgagggctatggtggatgaggtggcttctggctgtagaggctgtagagcagagccaaaactattaggaggggaaaaaaatgctgtgcttt

SEQ ID NO: 5760 - DNA, 79 bp, Artificial
  Hairpin sequence MQbrain_1273, macaque
gtcctcactggacgccacaggggcaagagggtggttttcctgaagcagctggctagtggcttgttacttgtgactggac

SEQ ID NO: 5761 - DNA, 112 bp, Artificial
  Hairpin sequence MQbrain_1274, macaque
ttacaagaaattttattctctccattattactcaatttgtctacatcttcccttgaaattgctctattattgtgtgataatggagaagtctcttaaactttctgaactgtga

SEQ ID NO: 5762 - DNA, 113 bp, Artificial
  Hairpin sequence MQbrain_1276, macaque
agctcccttctgggagctgggtagggatctgggtccctaggtttctgggctttggggagggtgagacgtttaaggggtttagtttctaataaccagaatccaggatggaggct

SEQ ID NO: 5763 - DNA, 100 bp, Artificial
  Hairpin sequence MQbrain_1277, macaque
gggcactcagggcactgagtcaccccatcttggtgtcagggcctgctgctcatgcatgtttatttcattcaggtggtggttgtccaggccatcagtgccc

SEQ ID NO: 5764 - DNA, 94 bp, Artificial
  Hairpin sequence MQbrain_1278, macaque
tctacagaagcgctgctctgagctggctgtctcctctggatctctgaggggccaagggcacagctgtaggtagggagcagccttctcaccaaga

SEQ ID NO: 5765 - DNA, 102 bp, Artificial
  Hairpin sequence MQbrain_128, macaque
gctgtccgctctggctccggaggcagccaacgccgccagtctgaggcaggtgcccgacatggcgagtgcagtgctgccgagcggatcccagtgtgcggcggc

SEQ ID NO: 5766 - DNA, 87 bp, Artificial
  Hairpin sequence MQbrain_1280, macaque
cctctggccatgtcgaggaggaggcctgtgagcactggctctctggacattgctcatccccctccttgacaagcgcctcacagaagg

SEQ ID NO: 5767 - DNA, 107 bp, Artificial
  Hairpin sequence MQbrain_1281, macaque
tactgtaaaaatggggcttcgtgctcccctgacgatggcatctgcgagtgtgcaccaggcttccgcggcaccacttgtcagaggagtaagtgtctcattaggcagta

SEQ ID NO: 5768 - DNA, 81 bp, Artificial
  Hairpin sequence MQbrain_1282, macaque
tggccttagattctgagctgggagataactgctgccaaattgcagagattgtctcccttcttagctttttttctgctgtta

SEQ ID NO: 5769 - DNA, 105 bp, Artificial
  Hairpin sequence MQbrain_1283, macaque
cgtaaccttgaattccagcggtgagtggggaggcatttctgcggctcctaacggggctgtccagggccgtagcactcttggctcatgctgcagcttcagaagatg

SEQ ID NO: 5770 - DNA, 113 bp, Artificial
  Hairpin sequence MQbrain_1284, macaque
ccaggaagcttacggaaaggggtgggaaaatagagaagctgtactctgtatcctgaagtacttaagcagggtttccagagtggcttttttcttttttggtgagtggaacctgg

SEQ ID NO: 5771 - DNA, 61 bp, Artificial
  Hairpin sequence MQbrain_1285, macaque
gacttcccggtctgccaaagcaggagtcatctttcctgtggggcggatgctgcggtacatc

SEQ ID NO: 5772 - DNA, 118 bp, Artificial
  Hairpin sequence MQbrain_1286, macaque
cagcttttaattctgtctgctggaagagaagcactgatgctgctgactggaccctgggtagcccaggcttcacccaggtgggcagtcccaggctttctctctctgggggagagagctg

SEQ ID NO: 5773 - DNA, 81 bp, Artificial
  Hairpin sequence MQbrain_1287, macaque
ctagaaatcaaggccatctggagtgttctgcatgggagagaattctattcagttcgctttagtggccctttttattctcag

SEQ ID NO: 5774 - DNA, 101 bp, Artificial
  Hairpin sequence MQbrain_1288, macaque
cctcgtacccttgactttagatggagcctggggttctctgccatcgctgcctcttgagacagacctgtgacctcactctactgtaagtgcaggggtgcagg

SEQ ID NO: 5775 - DNA, 87 bp, Artificial
  Hairpin sequence MQbrain_129, macaque
ggaatctgggaaaggctgggtgggacagtggggtgggacaggggtgagccctcagactgctgtcccttcatggcccctcccagctcc

SEQ ID NO: 5776 - DNA, 71 bp, Artificial
  Hairpin sequence MQbrain_1290, macaque
ccagtcttcactggcagtggctggtacttggctggctctcagcctggaatggcagctctgctagcagctgg

SEQ ID NO: 5777 - DNA, 110 bp, Artificial
  Hairpin sequence MQbrain_1291, macaque
cagctgcccccacccctcagggctcctgaagatcagtcactgtttgtcactcaaatgaatttgctaaatactacactgatgtcagattccacagggaaatgggcagactg

SEQ ID NO: 5778 - DNA, 112 bp, Artificial
  Hairpin sequence MQbrain_1292, macaque
ctcttctcccttccatcacgtctaagtctgagtctcctaaagagcccgaacagttgaggaagctcttcattggagggttgagctttgaaacaaccgatgagagcctaaggag

SEQ ID NO: 5779 - DNA, 109 bp, Artificial
  Hairpin sequence MQbrain_1294, macaque
tcttatccatctgttctctgttgtgtgatcccaatccagatgatcctttagtgcctgagattgctcggatctacaaaacagatagagaaaagtaagtatggcctcaaga

SEQ ID NO: 5780 - DNA, 117 bp, Artificial
  Hairpin sequence MQbrain_1296, macaque
gcgaggatcgaccaggttcctcccctcacacaaccaagatgaagtccaggcttgcagagtcagacaaaattctggtctacaggcctcttctctgtagggaggatgtttcaatcctgc

SEQ ID NO: 5781 - DNA, 71 bp, Artificial
  Hairpin sequence MQbrain_1297, macaque
gaaaaggaaacctggcctgggcaaaggagttatgggcctatagggtcccctgctaggccaggaccctcttc

SEQ ID NO: 5782 - DNA, 113 bp, Artificial
  Hairpin sequence MQbrain_1298, macaque
ccctggcgctgcctgccacctctgcccaggacactcttccctctcggggtgtgtgatgaactcccaggagagggaagatgggagccagggcaagataggaagctctgcctggg

SEQ ID NO: 5783 - DNA, 72 bp, Artificial
  Hairpin sequence MQbrain_1299, macaque
ctgggtggggcaactcaggctcagacctgccttgatctgaggcagggacagagctgggtgtgtctgcgtcag

SEQ ID NO: 5784 - DNA, 82 bp, Artificial
  Hairpin sequence MQbrain_13, macaque
ggcagagccctcgagggaaaggtcctggctgaggtgtcttgcaaggcatcccacagccaggccggctcccttgtgccaggcc

SEQ ID NO: 5785 - DNA, 49 bp, Artificial
  Hairpin sequence MQbrain_130, macaque
ggggttgtggggtctttgcagccctgtatcagaccccacaggagacccc

SEQ ID NO: 5786 - DNA, 62 bp, Artificial
  Hairpin sequence MQbrain_1300, macaque
cagtctctgggtcctggcctgggtaggatgcaagggtgttctattggcccttttagagactg

SEQ ID NO: 5787 - DNA, 74 bp, Artificial
  Hairpin sequence MQbrain_1301, macaque
ccagtccttgtaccgggcgcgcgtcctggaggatgcaccctccgggacgcgcgtggtacaagtccttgcaacgg

SEQ ID NO: 5788 - DNA, 70 bp, Artificial
  Hairpin sequence MQbrain_1302, macaque
acacgctccgctcggttgggccatagttggatattgtgctctgattgtgctctcgagtggagcattgtgt

SEQ ID NO: 5789 - DNA, 99 bp, Artificial
  Hairpin sequence MQbrain_1303, macaque
tgggccagtagctccaggttgtgccagagtccccagaaagcaccaagaatctagaagcagaggactgactggctggcctggggaaggcttggcaaccca

SEQ ID NO: 5790 - DNA, 95 bp, Artificial
  Hairpin sequence MQbrain_1304, macaque
tacaagcagatacaaggatgcccttgtacacgacacacgtgctgcttgtatagacacgagtgttgtctacgagggcacccttgtgtctgtgtgtg

SEQ ID NO: 5791 - DNA, 79 bp, Artificial
  Hairpin sequence MQbrain_1305, macaque
caggtcctcctgactcttacgaatccagttgagaacctcacccatgtgactctgttggagtgtgaggagggggacgctg

SEQ ID NO: 5792 - DNA, 53 bp, Artificial
  Hairpin sequence MQbrain_1306, macaque; MQbrain_1711, macaque
tcgggcgaggttctctggtcctcaggtgtggggggccagggaagtcgcgccgg

SEQ ID NO: 5793 - DNA, 89 bp, Artificial
  Hairpin sequence MQbrain_1307, macaque
agcagcctaactatagccagtgctggctgccccaggaattgttttggggaggaagttggtgagatctggattgctgaagttggccagct

SEQ ID NO: 5794 - DNA, 103 bp, Artificial
  Hairpin sequence MQbrain_1308, macaque
ttaggaaagccctgtcaaagcaagagatggctagtgcttcatccagccaaagaggctgaagtggctctggaaactctggtggtggttgtggaggtggttttag

SEQ ID NO: 5795 - DNA, 91 bp, Artificial
  Hairpin sequence MQbrain_1309, macaque
cacttctggcccagcacaagccctgctctggccgcctgtctccaagagaggtggcccctctgcttgcagcgcttacgtgttgatcccagtg

SEQ ID NO: 5796 - DNA, 100 bp, Artificial
  Hairpin sequence MQbrain_131, macaque
atatcttatttgaatatttttcttgtagcatggcagacaccgacctgttcatggaatgtgaggaggaggagttggagccatggcagaaaatcagtgatgt

SEQ ID NO: 5797 - DNA, 117 bp, Artificial
  Hairpin sequence MQbrain_1311, macaque
aggcattgcaagggtcttaaccgaaagggggagggggaaggtcgccaacaaacggctgagctcacaatccaggccggggcgtccccctcccccatggagagagccagaccggagcct

SEQ ID NO: 5798 - DNA, 87 bp, Artificial
  Hairpin sequence MQbrain_1313, macaque
gctgcatttgctagtgggaggggctgttgtgtgtccccttttgctgtaggtacacagccttcttttgctaagtcttgcattttcagt

SEQ ID NO: 5799 - DNA, 72 bp, Artificial
  Hairpin sequence MQbrain_1314, macaque
ctctgctttattgctcttgggcacagtgtctaggctcactgcaggtggagtcagcattgtgccctggtaggg

SEQ ID NO: 5800 - DNA, 104 bp, Artificial
  Hairpin sequence MQbrain_1316, macaque
gaggaagggagtcaggggaagcctgtcccaggaaggcccaggctgagagaccccaggtctggccaggctgggatctgggcaggaggctggggctctccttcttc

SEQ ID NO: 5801 - DNA, 84 bp, Artificial
  Hairpin sequence MQbrain_1317, macaque
ggaagagtcaagtcaaggccacaggtcctacaacagggctggaaagcacacctgtgggacctctggccttggcttgactctttc

SEQ ID NO: 5802 - DNA, 74 bp, Artificial
  Hairpin sequence MQbrain_1318, macaque
ggtaagacaggctggcccggagggcaggccagagactggggctgccatctggtaccagcctttgtccctctgcc

SEQ ID NO: 5803 - DNA, 85 bp, Artificial
  Hairpin sequence MQbrain_1319, macaque
ctgtttgctggaggcatgctggtaagtgggcccacatgggagttgcagctttcagccttcatcctttgtatgcctccaagggcag

SEQ ID NO: 5804 - DNA, 76 bp, Artificial
  Hairpin sequence MQbrain_132, macaque
catggtttagcctttggttgtatagttgtgtaatgggttatggactgttacacaccttgccacctctaggcctatg

SEQ ID NO: 5805 - DNA, 84 bp, Artificial
  Hairpin sequence MQbrain_1320, macaque
ggggtgcagcaatgatggtgacttgtcttgctcggactaagctagcactagcagggcaggctaagctggtcattgcgcacgtcc

SEQ ID NO: 5806 - DNA, 112 bp, Artificial
  Hairpin sequence MQbrain_1321, macaque
gaagcctaggtggtgttggcgggtaagcaggggaggcggctgtcctggcacaggcagtggggaggccggggcagccagtgtggtgggcttcctgctgggactgagaaggctc

SEQ ID NO: 5807 - DNA, 69 bp, Artificial
  Hairpin sequence MQbrain_1324, macaque
gcgacagttcgagctcctgctgtggtgggtactgcctggagcagtcccatggtggcggctcgagtgtgc

SEQ ID NO: 5808 - DNA, 103 bp, Artificial
  Hairpin sequence MQbrain_1325, macaque
cggggctccagggagatgccacaggtccccggccctgcaggatgggagggcagagatgcccttcttgaccctgtctgccgggccccctgggtcctgggtcccg

SEQ ID NO: 5809 - DNA, 95 bp, Artificial
  Hairpin sequence MQbrain_1326, macaque
gcgcgcctgcgcggccgcagaggcgggctagtgcgcatgctcaggcggggatgtgtgcgaagcctgacgctgctgcagcgagtctggcgcagagc

SEQ ID NO: 5810 - DNA, 115 bp, Artificial
  Hairpin sequence MQbrain_1327, macaque
ttggacccacagccaaaaagaaaaggctcaaggagagtgagcttatttgagggtctgtagcctaaagcatgggctcttttaaagcctcttgttgggccctgtagcataggtctaa

SEQ ID NO: 5811 - DNA, 76 bp, Artificial
  Hairpin sequence MQbrain_1328, macaque
gatggtaaacctggaggaagagttgtgttgggcccccacaggccccaggctagtgtccttcagcctggtgctcatc

SEQ ID NO: 5812 - DNA, 94 bp, Artificial
  Hairpin sequence MQbrain_1329, macaque
acagagtacccctgtgagcatgccttttctatctctcctgagagggcagtagcatgctgtcttaggagtcagtatgctctttagtatgcttagt

SEQ ID NO: 5813 - DNA, 115 bp, Artificial
  Hairpin sequence MQbrain_133, macaque
tgagttgggagttattactgaagtagcacctagaagggcaggagttcctttggtgacttcatagtgaagtcttgccctctctgtggggtatcacatcagtggttccaagatttca

SEQ ID NO: 5814 - DNA, 113 bp, Artificial
  Hairpin sequence MQbrain_1330, macaque
ttatggtaactaatggcaggttttgcataattccttgtaccagagatcaaaattcttctgtctgatctctggtgcaaggaattatgcaaaatctgtcatcattagatgcatga

SEQ ID NO: 5815 - DNA, 100 bp, Artificial
  Hairpin sequence MQbrain_1331, macaque
ccggcggccccggctcggtccgcaccccttctcctccgggcgccggagcggcaggctgcgtggccggggaggagaggtgcagagcaggcggggcgcgcgg

SEQ ID NO: 5816 - DNA, 112 bp, Artificial
  Hairpin sequence MQbrain_1332, macaque
ccctgtgaagccctcgcaactctcagacccgtgcagttaatcggaggggagcagaccctctttgctgtgacggctgatgggaaggtaagggcgctttttctgtgtcacaggg

SEQ ID NO: 5817 - DNA, 110 bp, Artificial
  Hairpin sequence MQbrain_1333, macaque
tttgaatctaatgacagtcttttgaattgaggagttagtcacattttttttccagccagaattcccagttggtctttcttcttaattctccagtgttcactagatttgaa

SEQ ID NO: 5818 - DNA, 110 bp, Artificial
  Hairpin sequence MQbrain_1334, macaque
tgagacaggcccttgcagagggatgccttaaagctgtccccggctggaggagcactccaccttggggacagtggagggggccttcagccctctgcaccctgcctgcctca

SEQ ID NO: 5819 - DNA, 95 bp, Artificial
  Hairpin sequence MQbrain_1335, macaque
ttctgttacaccctctatgccctcaggagcctgaggagccaagccaatgctctctggctgccttcaacactgaggctcctggtatagaaccagaa

SEQ ID NO: 5820 - DNA, 113 bp, Artificial
  Hairpin sequence MQbrain_1336, macaque
ctttgtgctccacgctcactcaggccctccctggcgggtgcttaggccgagttagaataccactgggtcctggcacatctgccagagggggatagagggtgcagggcggaagg

SEQ ID NO: 5821 - DNA, 116 bp, Artificial
  Hairpin sequence MQbrain_1337, macaque
tgagtggggcagaggcctgttctaaatcagggggctgaggatgagggagggtagatccgggggcactgcttcattctcttttcctgctgatcgctgacgtgctgcctgccctacca

SEQ ID NO: 5822 - DNA, 74 bp, Artificial
  Hairpin sequence MQbrain_1338, macaque
tgtccagtattccagattttcagagggcttcccaaatgtctggttactgtctctcctgacttggagtgctgaca

SEQ ID NO: 5823 - DNA, 106 bp, Artificial
  Hairpin sequence MQbrain_1339, macaque
tggggcagtaaatgaggttggcagagtggcagtgggggctctgcagagccaggcttggagcctgctcattctgagcccttgctgccaaggagcccagcctcaccta

SEQ ID NO: 5824 - DNA, 69 bp, Artificial
  Hairpin sequence MQbrain_134, macaque
ggtccagaggacagcgacagacagctctgaaaggctttagagctggagttggggccacacctctggccc

SEQ ID NO: 5825 - DNA, 91 bp, Artificial
  Hairpin sequence MQbrain_1340, macaque
gacagtcaagccagggcctgaagagggcacactagagaaggaagagaagcttcctcctcccaggagcccccaggcccaggaagcacctgtc

SEQ ID NO: 5826 - DNA, 117 bp, Artificial
  Hairpin sequence MQbrain_1341, macaque
agtgaatctagcagccagtgggcattagtggtacagttctgcaggctacacgatatgaaactaagcatatcttaccttagagaatgtgccaaagcaaatgattggctgcagttcatt

SEQ ID NO: 5827 - DNA, 70 bp, Artificial
  Hairpin sequence MQbrain_1342, macaque
ggtttcacagcacagcagagagtgtactaggctgtctccagcccagggaagctcctgagggcgtgggacc

SEQ ID NO: 5828 - DNA, 115 bp, Artificial
  Hairpin sequence MQbrain_1343, macaque
acaaatagacctgatgtgttagatactgctttgttacgacctggaagattagataagatcatctatatcccacctccagatcacaaggtaatcattgtaaacatttactgtgtgt

SEQ ID NO: 5829 - DNA, 109 bp, Artificial
  Hairpin sequence MQbrain_1344, macaque
aggctgaaggggatgctaaaggagataaagccaaggtgaggtagaaccgcagagaagatccacaaggttgtctgctaaacctgctcctgcaaagccagagcccaagcct

SEQ ID NO: 5830 - DNA, 83 bp, Artificial
  Hairpin sequence MQbrain_1345, macaque
ggaaaggggaatttggaaggagaggttcagtggactggagattttactctagaccttggcacctttttgaagatccctaagcc

SEQ ID NO: 5831 - DNA, 114 bp, Artificial
  Hairpin sequence MQbrain_1346, macaque
ttatctggagttgggggtgggtgtggtggaggggaatgtgttgagttgtgctctaaagaatgggtaagatttagatagattggaactaattccaactcataccattttgtgtga

SEQ ID NO: 5832 - DNA, 119 bp, Artificial
  Hairpin sequence MQbrain_1347, macaque
ttactgtgatgttttcatgcggtgcagattagtagatgctgatggtcctctagctaggcttaaaaaagccatttttagtccagagctctatgaaaacattgctgaatggatcgtggtaa

SEQ ID NO: 5833 - DNA, 94 bp, Artificial
  Hairpin sequence MQbrain_1348, macaque
ctcttcagcaatggagggaaataagggtttggggtcactttgttgtgtgtcttggggatgaggtggcttttcctggatggcccttgctggagag

SEQ ID NO: 5834 - DNA, 101 bp, Artificial
  Hairpin sequence MQbrain_1349, macaque
gagcagtcgggtgaggagaagagaggttggtgtccaggggagatggacaaatctctttctttggatggaaactctttcttccccctctgtttcggattgtc

SEQ ID NO: 5835 - DNA, 99 bp, Artificial
  Hairpin sequence MQbrain_1350, macaque
cacggactgtccattctcctccctgggatttgacagcctgtgctttagctatacccccatgcttgttaaaatgaccacagggctggaaaactgtctgtg

SEQ ID NO: 5836 - DNA, 114 bp, Artificial
  Hairpin sequence MQbrain_1351, macaque
gtcagaggtacctgtctggggcgtcctggcctgatgagggtctctctctagtggggctgtttctagcccccagcagagacagtcatgctgggtgtgtccagatatgggaatggc

SEQ ID NO: 5837 - DNA, 87 bp, Artificial
  Hairpin sequence MQbrain_1352, macaque
ctgtggctgaggctggccaagacgtcagcagagtacctggaatggaactccaagcaggttgaaacttgggagcctgtgtccttgcag

SEQ ID NO: 5838 - DNA, 72 bp, Artificial
  Hairpin sequence MQbrain_1353, macaque
tgtcttgatgtaaggttccagccatttttctcctttcactagaaagagtgaggtggctggatcattgaagca

SEQ ID NO: 5839 - DNA, 101 bp, Artificial
  Hairpin sequence MQbrain_1354, macaque
ggcactctcccagctggctgaggtggaagaaaaaattgagcagctccaccaggaacaggccaacaacgacttcttcctccttgctgagctcctgagtgact

SEQ ID NO: 5840 - DNA, 88 bp, Artificial
  Hairpin sequence MQbrain_1355, macaque
ctgccccagcccacccgcttgccttggtgctcagccctcccactgggagcaggttggggcgagctggaggcccgggctggaggggcag

SEQ ID NO: 5841 - DNA, 55 bp, Artificial
  Hairpin sequence MQbrain_1356, macaque
tttctgtcctgactgcctcttgggttgtcaaaacccaaggcagccttggcaggga

SEQ ID NO: 5842 - DNA, 92 bp, Artificial
  Hairpin sequence MQbrain_1358, macaque
agctccctcactgggggcaaggaacaagccaccttcaactgattacatgtcatagtgggtggccctctttgtcccacacccaatgaagggct

SEQ ID NO: 5843 - DNA, 115 bp, Artificial
  Hairpin sequence MQbrain_1359, macaque
gccagatggagggttggggtgcaagtgatggaggtggggtggttttggccccttctgctaagccagggcctgcccatgccctcctcaagtgtgccccaagactgaatgtttgtgc

SEQ ID NO: 5844 - DNA, 112 bp, Artificial
  Hairpin sequence MQbrain_1360, macaque
tcgtgggccccgtggcttctcattgggtgggttgagttaaagaggtgggattcataactaatctaaatgccactttcttgctcttccagaagaagaaaggggtcagaagcga

SEQ ID NO: 5845 - DNA, 119 bp, Artificial
  Hairpin sequence MQbrain_1361, macaque
gcctggccctctcaggatgtttgagaaaggttggaggccacagagagcaaggagccttccccagaggagtcaggccttgttcctgtcccctttcctcagtttatcctctgagcacatgc

SEQ ID NO: 5846 - DNA, 116 bp, Artificial
  Hairpin sequence MQbrain_1362, macaque
ggccttgcacctgctgccggcagctgttgccggggctcccgttaatggcacaaatggagcctctaatggatgggacctaagccctggctggcagcggggctggaaggatgtgggct

SEQ ID NO: 5847 - DNA, 69 bp, Artificial
  Hairpin sequence MQbrain_1363, macaque
cagagcccaatctggcacatgccccctttcctccaggcccagagcaggggctgttgccgaaaggctgtg

SEQ ID NO: 5848 - DNA, 97 bp, Artificial
  Hairpin sequence MQbrain_1364, macaque
tgctggaactgcattggggtgaggacaggagggccaggtctgcagccttgtatctgctgagcctcttttgtccttcccactccaggtcagtgctgca

SEQ ID NO: 5849 - DNA, 75 bp, Artificial
  Hairpin sequence MQbrain_1365, macaque
cccagcccccggccccaaaccccacagccccagctgcaggctgaggagatgctgggcttgggtggggaatcaggg

SEQ ID NO: 5850 - DNA, 97 bp, Artificial
  Hairpin sequence MQbrain_1366, macaque
ccatgggccagatgggtccagatgcagggtgcaggtcaatgtggtgtgcttttgcttgcatctgcagatcttctgggctggctggttaaccacgtgg

SEQ ID NO: 5851 - DNA, 96 bp, Artificial
  Hairpin sequence MQbrain_1367, macaque
cccacacaatgcacctatgtcctgccagcatcaccaccaccatgccaaagagaaaggctgaaggggatgctaaaggagataaagtcaaggtgaggg

SEQ ID NO: 5852 - DNA, 89 bp, Artificial
  Hairpin sequence MQbrain_1368, macaque
gggcgtcgtcctcttctgcctggtgctgctgtttctctggagccggggcaagggcaacacgaagcacaacatcgagatcgagtatgtcc

SEQ ID NO: 5853 - DNA, 72 bp, Artificial
  Hairpin sequence MQbrain_1369, macaque
gactagggttgggcagaggtcagctcgttcttcccaaagaagagggccctggcctctgctcggggccaggtt

SEQ ID NO: 5854 - DNA, 77 bp, Artificial
  Hairpin sequence MQbrain_137, macaque
agtggcggctgaagcgccgcaggcgggcctcccagtcgccgtgtgagtgggaggcggcggcggctgtggctgcagct

SEQ ID NO: 5855 - DNA, 117 bp, Artificial
  Hairpin sequence MQbrain_1370, macaque
ggagccaaggtggagctgagatgagccttggggactgaggcctctcagcaaacacacttccactggggtcttgggctgggggcttcagtcagtcaagggctccagggtacctgctcc

SEQ ID NO: 5856 - DNA, 81 bp, Artificial
  Hairpin sequence MQbrain_1371, macaque
ggtaaaacagagaatcacttcccatatatcacctgggaccagatagcaggcccacagatgtggcagtgagactgtgggact

SEQ ID NO: 5857 - DNA, 63 bp, Artificial
  Hairpin sequence MQbrain_1372, macaque
ggctttcttacttctgggaaatggcaggtggttgaaaccctgcacatcttcccagggccagcc

SEQ ID NO: 5858 - DNA, 71 bp, Artificial
  Hairpin sequence MQbrain_1373, macaque
ggctgcctgtgagagctctgccttgcgggggagcctcaaaaatcccccatcagctgagttccatgaatgcc

SEQ ID NO: 5859 - DNA, 111 bp, Artificial
  Hairpin sequence MQbrain_1374, macaque
agtagaaggggtggggaagagctgctaagggtgactgtgtttggaaggggatcagcgcttggggctcctctttcaaaccagggcccccatgctcatcatttcccctctact

SEQ ID NO: 5860 - DNA, 81 bp, Artificial
  Hairpin sequence MQbrain_1375, macaque
gaagaatggtggagtgcggaagggtagaaagggtttggtaggcaaaccctgaagatgctcctaacacacatgctgttcttc

SEQ ID NO: 5861 - DNA, 106 bp, Artificial
  Hairpin sequence MQbrain_1376, macaque
ttgatagtggctctgtgtcttcagccttggacccttgggggaggtgagtctgcactctgccttggcaaggggtccagaaggaagaactcagaggtgtcacttccaa

SEQ ID NO: 5862 - DNA, 92 bp, Artificial
  Hairpin sequence MQbrain_1377, macaque
ttccaggccaatgctgaagacacagctcagcttggaagcctgagaagccaggcttcccaggccagagtgtggcttcttaaatggcaaaggaa

SEQ ID NO: 5863 - DNA, 117 bp, Artificial
  Hairpin sequence MQbrain_1378, macaque
cctggtgtttgcctccaaggtgtccccacccagtgactctggctggcatgctggagatgggtgtctcctacctgcctgtcaaccagaactgggagcgttacctggcagaggcacagg

SEQ ID NO: 5864 - DNA, 108 bp, Artificial
  Hairpin sequence MQbrain_1379, macaque
gcctgttccagattcgccgacagagggcgctgggggccggagaggagcgcgttcgggagcctctcccgggtccctggcaccactctgtggggctcggtggttcagagc

SEQ ID NO: 5865 - DNA, 83 bp, Artificial
  Hairpin sequence MQbrain_138, macaque
cctaggaaccatggcatcaataagaccctatttgagaggagaacagtctcaactcgagtcctattaatgccatggttcctagg

SEQ ID NO: 5866 - DNA, 111 bp, Artificial
  Hairpin sequence MQbrain_1380, macaque
tccctctacccctctcaaggcctcttgtccttagaactaaagtcctagcccaggttggaagagagaatgttctcaggacaggaaggggcgatgggtgggggatgggaggga

SEQ ID NO: 5867 - DNA, 111 bp, Artificial
  Hairpin sequence MQbrain_1381, macaque
ggtgcagatggtatccagcaagtgcaaagctgaggtttcttgggtctgtcacatcagcacctctgaagcctgggttctgtatttccctggagccccactcctgctatggcc

SEQ ID NO: 5868 - DNA, 62 bp, Artificial
  Hairpin sequence MQbrain_1385, macaque
ggaggcaggagctggaggcagtagagggtgcccccacattgtgcccagctctccctgcctct

SEQ ID NO: 5869 - DNA, 97 bp, Artificial
  Hairpin sequence MQbrain_1386, macaque
ctggatggctttgggactggcctttgaggggaaaggtggctgccccaagcctggcttagccgttcaaaggccaggtactgccctgaatggcttccag

SEQ ID NO: 5870 - DNA, 86 bp, Artificial
  Hairpin sequence MQbrain_1387, macaque
tccttgggaaggggcgggtgggtctggatgaatcgtctcgggggcccccacgaggcgactcaggcggccctgccctttttagaggg

SEQ ID NO: 5871 - DNA, 89 bp, Artificial
  Hairpin sequence MQbrain_1388, macaque
ggtattcagaaggaggtgctgacccctgggtgctgttcttagctaagcttctcctagacaccagggctcagcacctctggttcagcact

SEQ ID NO: 5872 - DNA, 98 bp, Artificial
  Hairpin sequence MQbrain_1389, macaque
gatcactggcaggatataggccaggcctggaggggaacaggcctggtctccctttcagttccgctccaggcctagtccccagtatcagtgctgagatt

SEQ ID NO: 5873 - DNA, 92 bp, Artificial
  Hairpin sequence MQbrain_139, macaque
caagtatgatgtgcaatcaggctctgaggatggtcaactctaccttaatggtagagagtcatggtcaagaagagcttcacataaaaagcatg

SEQ ID NO: 5874 - DNA, 89 bp, Artificial
  Hairpin sequence MQbrain_1390, macaque
acacaccaagctggtctcagtggtcacttttggggaggaggaaactgatactgaaggaaggggccaaggtgaatgctggctttatctgt

SEQ ID NO: 5875 - DNA, 119 bp, Artificial
  Hairpin sequence MQbrain_1392, macaque
tagcctggctccctgaaggtcctttggcacagccctgtccctcccctgtctgccaaggcccccctctaggccttgggtggctggagggctttgttaagggactaggagaagtgggggta

SEQ ID NO: 5876 - DNA, 65 bp, Artificial
  Hairpin sequence MQbrain_1393, macaque
gcagctgggcttccaggggcttgtctggcctcagccctgggccaggcaagggagtctgaggctgc

SEQ ID NO: 5877 - DNA, 106 bp, Artificial
  Hairpin sequence MQbrain_1394, macaque
ggggtggaagggatggggaggtcaggggagttggagaaccaaaagggaagtgaaggaattggactgaggggagctgatttctagataaccagaaagcagaagccct

SEQ ID NO: 5878 - DNA, 74 bp, Artificial
  Hairpin sequence MQbrain_1395, macaque
gacatcatgcccaggaccacccccacctaagggaaaggggatggggtggcccttgtggtagggatagaggagtc

SEQ ID NO: 5879 - DNA, 79 bp, Artificial
  Hairpin sequence MQbrain_1396, macaque
gggaaggatggtcccacggagaccctggaggagctggtcctgggactagccgctgaggtgtgtgatgattttcttttct

SEQ ID NO: 5880 - DNA, 81 bp, Artificial
  Hairpin sequence MQbrain_1397, macaque
cttattctcactctctcacaatccacaggcatacaaacattgaagtgtgtgtgtgcgtgtgcacgtgcatttgagaaagag

SEQ ID NO: 5881 - DNA, 97 bp, Artificial
  Hairpin sequence MQbrain_1398, macaque
ccgtgtagggcaaggtcattggtaggtgttgcaggtagggtctgagtcaggagtcccctgtcctctggcacctcaacaggattgtggggttctgagg

SEQ ID NO: 5882 - DNA, 90 bp, Artificial
  Hairpin sequence MQbrain_1399, macaque
gagcggggcgccagggaaggaggtgggggagtgccaggttaactaagtcccggcacaccctactgcaccttcctgttttgcaaaccattc

SEQ ID NO: 5883 - DNA, 120 bp, Artificial
  Hairpin sequence MQbrain_14, macaque
ggtggggccttcccctgcagcgaggggcggggccatcccaacgccgcttttgcggccaaagtaggttgggagtggaaggtggtggctgctgttccgcagtgtcgggaagatggcgccgcc

SEQ ID NO: 5884 - DNA, 87 bp, Artificial
  Hairpin sequence MQbrain_140, macaque
gacctgagccagacccatgttggccgtagctgggagactgccctgacccagacccccgtcggccatggcctgaagactggccagatc

SEQ ID NO: 5885 - DNA, 77 bp, Artificial
  Hairpin sequence MQbrain_1400, macaque
ttgggagctgggctgtcaggctctccattgcctttgccttcaaaggtggcatagtggaaaatgaaccacagtcccag

SEQ ID NO: 5886 - DNA, 101 bp, Artificial
  Hairpin sequence MQbrain_1401, macaque
cggagcggctgccgctgccgccgcagctcgggtcgggatttgaaagattaaaaactctgggtggagaaggcggcggcgttgaatgtgtggcggaagcgctg

SEQ ID NO: 5887 - DNA, 57 bp, Artificial
  Hairpin sequence MQbrain_1402, macaque
tgagctcgcatgtgcagggggtggggtcccgtggcttccccctgcgcctccaagcca

SEQ ID NO: 5888 - DNA, 86 bp, Artificial
  Hairpin sequence MQbrain_1403, macaque
atcttggaggtaaatgaaactgccaaaggagcaggaggtgggaagtgttcggcttttcttttttggtcagttagttaacaagagat

SEQ ID NO: 5889 - DNA, 93 bp, Artificial
  Hairpin sequence MQbrain_1404, macaque
caagaaagccgaggctggggctgggtcagcaaccgaatttcagtttaaaggtggatttggtcgtggacgtggtcagccacctcagtaaaattg

SEQ ID NO: 5890 - DNA, 67 bp, Artificial
  Hairpin sequence MQbrain_1405, macaque
gctggaaggcctccggacacgtgccagcaatgagttggcattggcagagctggaggaggaggagggc

SEQ ID NO: 5891 - DNA, 108 bp, Artificial
  Hairpin sequence MQbrain_1406, macaque
tggatgcagggccggtcgtggtgcactgcaggtgacagctcctgctgcccttataggccacagcctgtccctgtctcttagtgcccaaggcttgcttttacctatcta

SEQ ID NO: 5892 - DNA, 117 bp, Artificial
  Hairpin sequence MQbrain_1407, macaque
gagtgtttggaggagtagcctgaactgactatccagtagttctgctattgagatggcccaagctgcccttatttctggctgctggaaggtctgaagttcaacttttctttaatattt

SEQ ID NO: 5893 - DNA, 50 bp, Artificial
  Hairpin sequence MQbrain_1408, macaque
ccgtgggcctccctcccggagcctctgcccatgggggggtggagacccgg

SEQ ID NO: 5894 - DNA, 62 bp, Artificial
  Hairpin sequence MQbrain_1409, macaque
ctagcatggggctgcccgggggtggctccccaaccaccttcctattccggcccatgtccgag

SEQ ID NO: 5895 - DNA, 99 bp, Artificial
  Hairpin sequence MQbrain_141, macaque
ttgggtactgcattgattaggagattatatggagctgcgggagctgccgcctgggggaagagaggtgcaggttctgctaggtttgtgctctcctcccag

SEQ ID NO: 5896 - DNA, 93 bp, Artificial
  Hairpin sequence MQbrain_1410, macaque
tcggttatctgtgaagggttgtgcaaaacaggaaggtctaggaatgactagatatcttgttggcataaatgttatgaaaaggcagaatactgg

SEQ ID NO: 5897 - DNA, 79 bp, Artificial
  Hairpin sequence MQbrain_1411, macaque
gctaatgagtgctttcttccactctgcacacactcctgctgcctggagtgggcggcaggctggaggaccgcaatagagc

SEQ ID NO: 5898 - DNA, 91 bp, Artificial
  Hairpin sequence MQbrain_1412, macaque
ggtgaaatgtttgcttcaaggtccctagatatctaccctgtgggcttgctttgagatttcagggtggtctggtggtgggctctgcagtgcc

SEQ ID NO: 5899 - DNA, 107 bp, Artificial
  Hairpin sequence MQbrain_1413, macaque
aggagggtgcacttatccagtggctggagtaggccaggggttttgcttctcaccccagcactgcccccctgctgtgacagtttctctggagtgctggtgtgccacct

SEQ ID NO: 5900 - DNA, 93 bp, Artificial
  Hairpin sequence MQbrain_1414, macaque
ctggcggggaagatcgagctcaggttcgccacataggtcctgtgcaggagccctggcggtgttgggctgagcccgggtctggatttctgtggg

SEQ ID NO: 5901 - DNA, 99 bp, Artificial
  Hairpin sequence MQbrain_1415, macaque
gcctgctcgtcagccagagggtaggagccatgggccagggaggggcttggtccctgtcctccctcccttgcccagagcagcccctaagcatggccaggc

SEQ ID NO: 5902 - DNA, 110 bp, Artificial
  Hairpin sequence MQbrain_1416, macaque
aggctgaaggggatgctaaaggagataaagccaaggtgaaggacgaatcacagagaagatccacgaggttgtctgctaagcctgctcctccaaagccagaacccaagcct

SEQ ID NO: 5903 - DNA, 73 bp, Artificial
  Hairpin sequence MQbrain_1418, macaque
ctcttagagttgatcctggatgcttccaggaagggctaaccacctgccccctggacatccttcacctttttag

SEQ ID NO: 5904 - DNA, 100 bp, Artificial
  Hairpin sequence MQbrain_1419, macaque
ctcattcccacccctggggccccttcctcgtgcttctccttcctgagggcttgggaaggtcctggggtcagactctggggctcccatggggtgggaggag

SEQ ID NO: 5905 - DNA, 69 bp, Artificial
  Hairpin sequence MQbrain_142, macaque
gcttggttgcaaggctgggctggtggagggtgctgtggcacttaacacatcagcccacagcaggaaggc

SEQ ID NO: 5906 - DNA, 108 bp, Artificial
  Hairpin sequence MQbrain_1420, macaque
tcaaaggtcagctctccagacatgccattcccctggcaggcctgggctgaggtatgcacctgtcttcctggttgcttgggaatggcattgagaagtggcttccattgg

SEQ ID NO: 5907 - DNA, 97 bp, Artificial
  Hairpin sequence MQbrain_1421, macaque
aggctgctgggtgtgagtgctggtgggaagctttggaagggaggctgctcggggcctccctgtggctgtggctgcatgggcagccccgaagcggctt

SEQ ID NO: 5908 - DNA, 73 bp, Artificial
  Hairpin sequence MQbrain_1423, macaque
agggtggaggctgggctggggagttagccacggcgtgcgtgggtggctgtgtctccagcaagtctctctccct

SEQ ID NO: 5909 - DNA, 76 bp, Artificial
  Hairpin sequence MQbrain_1424, macaque
ctgccacccgtgtgcctggctggctgcccctggctcctgccagtttcagaggcagccttggcggaatgggggctgg

SEQ ID NO: 5910 - DNA, 111 bp, Artificial
  Hairpin sequence MQbrain_1425, macaque
tcagggtcgcttttcccctgactgtgtccaatgccaaggagtcctggcctttgcagatgcttcgttttgacccttggctgcagtggaagtcagcacagagcagtgccctgg

SEQ ID NO: 5911 - DNA, 84 bp, Artificial
  Hairpin sequence MQbrain_1426, macaque
tgtgaaaaaagccacagactgagggagagaagggaagggaaccgaggcccctgcctcccaggtcagagtctgcctgctgttccg

SEQ ID NO: 5912 - DNA, 109 bp, Artificial
  Hairpin sequence MQbrain_1427, macaque
ccctggtgtgggaaaggcctgagatgggtgttatctgttaacattatttagagctctttgggttagcaggggccgacacccaattcactgtggtttaccctcacaaggg

SEQ ID NO: 5913 - DNA, 119 bp, Artificial
  Hairpin sequence MQbrain_1428, macaque
gaccaaggctgacttgatcaataaccttggtactatcgccaagtctgggaccaaagcgttcatggaagctttgcaggctggtgcagatatctccatgattggccagttcggtgttggtt

SEQ ID NO: 5914 - DNA, 117 bp, Artificial
  Hairpin sequence MQbrain_1429, macaque
gtaatgctttgttctatagcccccaggtttccctagatgacaaataaacatttcttttcctgcgtgaagatcatctgtggaaaccttggccatggcatcgatatcagagcctgttac

SEQ ID NO: 5915 - DNA, 117 bp, Artificial
  Hairpin sequence MQbrain_143, macaque
aggcggcccttgtctctttcccagccttgcttgccccgttcccttctctttaggcagcagtggatggtgcaggggaaagaggtgggaaggaggtcctgggagggatactggttgtct

SEQ ID NO: 5916 - DNA, 99 bp, Artificial
  Hairpin sequence MQbrain_1430, macaque
tggtctttgacatgcagatgggcacagaattcctgacttaaggctaaagatttatctttagcttatcatgatatgggcttatcatgattgttttgatca

SEQ ID NO: 5917 - DNA, 96 bp, Artificial
  Hairpin sequence MQbrain_1431, macaque
cagaccctagggtgggagttcaaggatgccagggccagacaggccacttctgccctctgaccctcgcgtcctgtttcccacaggtgggcgcttctg

SEQ ID NO: 5918 - DNA, 115 bp, Artificial
  Hairpin sequence MQbrain_1432, macaque
gctctgggatcctgggcactcttggcagccttgtaggaggagttggtggtgtgcgcagtcctgtggcctctcacatgcagaggcttctgagtttctgcccagggatgtctggggc

SEQ ID NO: 5919 - DNA, 93 bp, Artificial
  Hairpin sequence MQbrain_1433, macaque
gctgttccaggtcccaggttcgcccttttctgctactgggcagtccttctggaagccccggaggagtggctggtgcctagggcctgggagggc

SEQ ID NO: 5920 - DNA, 101 bp, Artificial
  Hairpin sequence MQbrain_1434, macaque
ccaggtgaggtgctgctggacgtctgacccccgctgagatggccgctccctgttttccaggccatctgtgcaggggttatggcaccagttcaccacacagg

SEQ ID NO: 5921 - DNA, 108 bp, Artificial
  Hairpin sequence MQbrain_1435, macaque
ctcctgggccctgctgtcctggcagctttacagtttggtgtgtttttgattccggaagattctggaaccaaattctgaagctgtgatcacaaacttgcagccctggag

SEQ ID NO: 5922 - DNA, 73 bp, Artificial
  Hairpin sequence MQbrain_1437, macaque
gagcatgccaggccacgtgtctgtcctcagtgcacaaaagtgccgagaagcagaccgggggcccacagtcctc

SEQ ID NO: 5923 - DNA, 117 bp, Artificial
  Hairpin sequence MQbrain_1438, macaque
aggacggaagctggggtgacagttgctggagcagagatgggaggacggtatagacattcctgccattgctgctgcttcccatctctgcctccagcatccaccaccaagaaaacccct

SEQ ID NO: 5924 - DNA, 77 bp, Artificial
  Hairpin sequence MQbrain_1439, macaque
gctgccccggggcgccttcgccgtggcgcacgaggccaccacctgccacggcgagatctacgtgtccgggggctcgc

SEQ ID NO: 5925 - DNA, 100 bp, Artificial
  Hairpin sequence MQbrain_1440, macaque
cacagtgtcatgatatctgtgtggccccacagtgttatgatgtctgcgtggccccagtgtcgtgatctctgtgtggccccacactgtcgtgtttgctgtg

SEQ ID NO: 5926 - DNA, 114 bp, Artificial
  Hairpin sequence MQbrain_1441, macaque
tgggagtgaccctcagagctgcgcccagacccctctcctgccctctgcacaccagcaggaggcatgaaccttgggtctgggaaaaagctttaacccgaagggcaccaggaccca

SEQ ID NO: 5927 - DNA, 99 bp, Artificial
  Hairpin sequence MQbrain_1442, macaque
agcacgaggaggtgttgcagcagtggcagatgtgcagcgagctgctctcgccgggctcgctgccgtcgccgccgccgccgcagccgcctcccccgggct

SEQ ID NO: 5928 - DNA, 115 bp, Artificial
  Hairpin sequence MQbrain_1443, macaque
gccccctcccgcctctgctccagttctcccgcgagcctgtcagtttcagtccgccgcgggcaggcggagtggaaccgccaggcagagggggacggagaaggagaaggaaccctgc

SEQ ID NO: 5929 - DNA, 76 bp, Artificial
  Hairpin sequence MQbrain_1444, macaque
ccccagcatcgtggtatccttcctcattgccgccctggcttcggtgatggctggcctctgctatgctgaatttggg

SEQ ID NO: 5930 - DNA, 110 bp, Artificial
  Hairpin sequence MQbrain_1446, macaque
tctgaagcccaaatggagagaaaccccggccacttcccaccaccctggtggcccaccacctgccaggaaggtgggggcgtggcagagggggcgcacatctccgcggcaga

SEQ ID NO: 5931 - DNA, 73 bp, Artificial
  Hairpin sequence MQbrain_1447, macaque
agattcttggctccagcctggctctcctccatggaaaggaagatggagagagggaaggggagtgggaagggct

SEQ ID NO: 5932 - DNA, 111 bp, Artificial
  Hairpin sequence MQbrain_1448, macaque
tgtttcacttagtttatatgatctgagcacacactggctgattggagttggggggacttggaggggtcagtccagaagtgtaagacgatcatgtgaaaccagccagaagca

SEQ ID NO: 5933 - DNA, 77 bp, Artificial
  Hairpin sequence MQbrain_1449, macaque
gggcagagggaggaagatggctcccaaggttccaaggcattgcaggaccttggggacatctgctgggtgggtggccc

SEQ ID NO: 5934 - DNA, 61 bp, Artificial
  Hairpin sequence MQbrain_145, macaque
ttcttggcaggtgtgggaggaacaagcctgagtggtgctgtccctccctccccaccaggaa

SEQ ID NO: 5935 - DNA, 62 bp, Artificial
  Hairpin sequence MQbrain_1450, macaque
ggtaggaagcctgggcagggaagattccagtcatcctgcccagtaggaaggggctttctgcc

SEQ ID NO: 5936 - DNA, 95 bp, Artificial
  Hairpin sequence MQbrain_1451, macaque
atttggcagtagtttattcacatgcctttgggaaggtgtgatcacattgtcatcctgcacctcccatcaggtatggataaaggacatttccaggt

SEQ ID NO: 5937 - DNA, 108 bp, Artificial
  Hairpin sequence MQbrain_1452, macaque
gtaaagtgggtgttaggagtatgtgtgaatgagtgttgattgggcatgcaggtgttgttaattgtgtttttgctctttttcatacatatctttgtgttatctgcttac

SEQ ID NO: 5938 - DNA, 117 bp, Artificial
  Hairpin sequence MQbrain_1453, macaque
tgggcggagcgggcagctggggtcgagggctcagggacgccagcctgacggagcgggacccgcaccggtggcgttggcttcccaagttgtgccctgcacctcggcgcgccaagccca

SEQ ID NO: 5939 - DNA, 99 bp, Artificial
  Hairpin sequence MQbrain_1454, macaque
cctgggaagaggaaagctggcctgggggcctagtgaggtgtccatgttcctcatgtcctctttcctgccctttcccaggagctgagcgcctttcccagg

SEQ ID NO: 5940 - DNA, 118 bp, Artificial
  Hairpin sequence MQbrain_1455, macaque
gaggcagggagagactaaagagggcctggcaagggagaaatggggaactgcgggctaggggcctgccactgtcccgatgtttgatttggcaatcccattttcagttcctcctttcttc

SEQ ID NO: 5941 - DNA, 105 bp, Artificial
  Hairpin sequence MQbrain_1456, macaque
ggggagaggtgttggcagctgccggggtgttgggtgccctatctgctctggttagggagggcagcccccaaaccttagtggacacatgctagaaaaattctgact

SEQ ID NO: 5942 - DNA, 72 bp, Artificial
  Hairpin sequence MQbrain_1458, macaque
tgaaggtgacagggctgtcctcaggggcttcagtgagagcagcgaggaggaggaagagccggaaagccctcg

SEQ ID NO: 5943 - DNA, 107 bp, Artificial
  Hairpin sequence MQbrain_1459, macaque
agtgatccagaccatggggaaagacctcactcccatcacgccgtccaggtaagcctgggctggtcacgggaagggcaggtcttgtcatccaaggcctggctagagct

SEQ ID NO: 5944 - DNA, 73 bp, Artificial
  Hairpin sequence MQbrain_146, macaque
gcaatcataacccagacttgacctgccagggctcactggagtgaagtgggccctggttggagggtgtgggggc

SEQ ID NO: 5945 - DNA, 116 bp, Artificial
  Hairpin sequence MQbrain_1460, macaque
gacaagagcaaaactccgtctcaaaaaaaaaaaaaagctgtttccttctgaaatagtgtagtctttaagactacattaaaggaggaaagctttcttgggcaggtttgggtcttgtc

SEQ ID NO: 5946 - DNA, 90 bp, Artificial
  Hairpin sequence MQbrain_1461, macaque
ctcaggctccaatttgcccacttccgggggcagagctgccacttccaagaggtactcctgctcccaaggggcagtggttgtgttcctggg

SEQ ID NO: 5947 - DNA, 70 bp, Artificial
  Hairpin sequence MQbrain_1463, macaque
ggctgacctgctgagcgctggaaggacacctgggaacggatgaggctgcacagtgcctcgaagcccggcc

SEQ ID NO: 5948 - DNA, 77 bp, Artificial
  Hairpin sequence MQbrain_1464, macaque
gaaagtatccaggccctgggctgggtggctatggtgagcagtgcagattccagggctgggggtgtgggtatagattc

SEQ ID NO: 5949 - DNA, 87 bp, Artificial
  Hairpin sequence MQbrain_1465, macaque
gcaatttgactggaatcaatttcgagcctttgccaggcttgacaaaaagtctgatgaaagtttggagaaatacttcagttgttttgt

SEQ ID NO: 5950 - DNA, 96 bp, Artificial
  Hairpin sequence MQbrain_1466, macaque
gcatgagccactgtgccctgcctgggaacaggacttctaaaaggcaaatatgtctggaaggctgtggtcccaaggccctttttgctggctataagc

SEQ ID NO: 5951 - DNA, 82 bp, Artificial
  Hairpin sequence MQbrain_1469, macaque
cactgtagtaataccctcaaaccattacccggagctctgaagacggatctctgaggtagtatggttttgatattgcttaatg

SEQ ID NO: 5952 - DNA, 118 bp, Artificial
  Hairpin sequence MQbrain_147, macaque
ctggccctgacttgcctccccacccagtattgcctggcccctcagaaactagccatggttaaaaggcttgactcaggaggggctggaaggacggagaaaggagaggggtcagagccag

SEQ ID NO: 5953 - DNA, 117 bp, Artificial
  Hairpin sequence MQbrain_1470, macaque
gcttgcccccggctcgctcctcacctctccgccgcccgcccccttctccgcgcgggacgctgcccggagcgcggcggggcgggggtggaggacgagagagcggccggaggcgtcggc

SEQ ID NO: 5954 - DNA, 63 bp, Artificial
  Hairpin sequence MQbrain_1471, macaque
tgctgctttgagagtgggaagggcactttgccctgaatgccattttctgttctttgagtggca

SEQ ID NO: 5955 - DNA, 83 bp, Artificial
  Hairpin sequence MQbrain_1472, macaque
tcagcagggtaagtgtgcgccacgtgacccagcagtgggcttcgtgcactgctgggacacggcacactcgaaaaccaaaatga

SEQ ID NO: 5956 - DNA, 68 bp, Artificial
  Hairpin sequence MQbrain_1473, macaque
tcctgtgactggctgtatttgcatctggtgttcctcttgtaccagtcaactacagtcagcatgtaggg

SEQ ID NO: 5957 - DNA, 107 bp, Artificial
  Hairpin sequence MQbrain_1475, macaque
gttagagggtggaacggatgtgcttggcgctgcgtgggatctggtgcccctcttctggattcgcatccccacccagggcctgcttttactaaccgttctgccctagc

SEQ ID NO: 5958 - DNA, 89 bp, Artificial
  Hairpin sequence MQbrain_1476, macaque
acgcctgaccgctgcttctagggtactgtttccgggtcagggtgacctctggggtgaagaaactgcgactgggagcgggacccgggcgt

SEQ ID NO: 5959 - DNA, 88 bp, Artificial
  Hairpin sequence MQbrain_1477, macaque
ataaagaagaaagctggacttgccttggactgttgagcattgaaagtcatacatcagttctaggcaagccaaaagcaaaatcatttgt

SEQ ID NO: 5960 - DNA, 115 bp, Artificial
  Hairpin sequence MQbrain_1478, macaque
cttcaaagatagtgcaaggcttggggaggcagtgcttcaagggaggaaacctacttgcatctcttctccctgtgaggtaatggagctcacccccttttttgttcttcctttggag

SEQ ID NO: 5961 - DNA, 97 bp, Artificial
  Hairpin sequence MQbrain_1479, macaque
gattccttggtagaggaagttttaatgttggcttggcaaaagaaattgtttctttagccaaggatatatgatcttgaagagtctttggccttgagtt

SEQ ID NO: 5962 - DNA, 114 bp, Artificial
  Hairpin sequence MQbrain_148, macaque
gagaggacccagggagtcaccctgtagatgaaggaagctgtggcactttgctcatgtcatgtaaagtgcttggaatttcatttgataagcaaatggattctctggtagtccctc

SEQ ID NO: 5963 - DNA, 116 bp, Artificial
  Hairpin sequence MQbrain_1480, macaque
cactcggattagtgttttctggagttctcactttctgactcctggaggacgaaatgccacttgtctgagaaggagtgggagtgattcttgagactaaaaacatgatttggatagtg

SEQ ID NO: 5964 - DNA, 81 bp, Artificial
  Hairpin sequence MQbrain_1481, macaque
gagacacggcaactgtcagactgcccagtgtggcctgggaaaaccaccggggctgaggtggcctgacagctgctgcatctt

SEQ ID NO: 5965 - DNA, 101 bp, Artificial
  Hairpin sequence MQbrain_1482, macaque
ttgaatttctggagtctagtttatcctgatgagtttgccgctcagtccagaaggcatgttactcagcaggggtaaatcttgactttgccagaatgggttag

SEQ ID NO: 5966 - DNA, 111 bp, Artificial
  Hairpin sequence MQbrain_1483, macaque
tggtcactagcatctgggcttatttccgtatgatttcttgtagtttagtttaggaaatagccgtgctaggctgttagaaaacactgaaaattctagcctggttagtgttca

SEQ ID NO: 5967 - DNA, 93 bp, Artificial
  Hairpin sequence MQbrain_1484, macaque
tcagggctgcgaagatggtgaccctgcggaagaggaccctgaaggtgctcaccttcctcgtgctcttcatcttcctcacctccttcttcctga

SEQ ID NO: 5968 - DNA, 111 bp, Artificial
  Hairpin sequence MQbrain_1485, macaque
gcttccctggggttacacctcctaacagcataatggggagcatgatgcctccaccagtaggcatggtagctcagccaggagcttctgggatggttgcccccatggccatgc

SEQ ID NO: 5969 - DNA, 116 bp, Artificial
  Hairpin sequence MQbrain_1486, macaque
cccctctgagccctgtgatccactaaattctactgtgagggagcccttagatattaggtcttccctaaaggactctcacacagaagagcaggaggaactctcagtgctatccgggg

SEQ ID NO: 5970 - DNA, 94 bp, Artificial
  Hairpin sequence MQbrain_1487, macaque
tccttgccctggtatgatgccagcaccccacatggggggccctcccatgatgccaatgatgggccctcctcctcctgggatgatgccagtggga

SEQ ID NO: 5971 - DNA, 117 bp, Artificial
  Hairpin sequence MQbrain_1488, macaque
gcacacagagccagcagaaggtcttgcacaggagtgacaggtagctccctggggttgttccccacctctgccccttggaaccctgtgacaaccccttttgaaccaggttctgagagc

SEQ ID NO: 5972 - DNA, 73 bp, Artificial
  Hairpin sequence MQbrain_1489, macaque
tgggactgtggccttccttggggacaggcagtgtcttcgtcatctgtttgttcccaagacatccatgtaatca

SEQ ID NO: 5973 - DNA, 92 bp, Artificial
  Hairpin sequence MQbrain_149, macaque
ggggatgaggggggcactgggagagtaaagagggtggcaaaaggtaacttagattgccactttttaccacaactcttttctaggctattccc

SEQ ID NO: 5974 - DNA, 92 bp, Artificial
  Hairpin sequence MQbrain_1490, macaque
acgggggaggtgcttgtgggtgcggtgaccgcagtgaccgtgggtgatcacagatggtcacgtgtggccatgactgactgcactgagtgggt

SEQ ID NO: 5975 - DNA, 115 bp, Artificial
  Hairpin sequence MQbrain_1491, macaque
gtgctggctggataggcatgggtctcaggtcctctgatgctacccgggcatgggtgacacacaccattccccacagccagagggccatgagcacatcatagctgacaatcaggac

SEQ ID NO: 5976 - DNA, 92 bp, Artificial
  Hairpin sequence MQbrain_1492, macaque
cgcagacgcccccatcggtgctcgctgggttggctcctttcagggtctcccaggatccgatccctgcgagcatcatcagcctggctcctgcg

SEQ ID NO: 5977 - DNA, 75 bp, Artificial
  Hairpin sequence MQbrain_1493, macaque
gcatggggcccagacccagtgaggcctcaagccagggtggcggaggtggcagtgggggctctgggtcacctaggt

SEQ ID NO: 5978 - DNA, 71 bp, Artificial
  Hairpin sequence MQbrain_1494, macaque
tgtggccccttctctgggagcctctattcagagggggcatccctgtgtgtgtggctcccatgggcaacaca

SEQ ID NO: 5979 - DNA, 61 bp, Artificial
  Hairpin sequence MQbrain_1495, macaque
cagccctgtcagtagagggccctcagcctctcagggctggagccctgggctggcgtttctg

SEQ ID NO: 5980 - DNA, 74 bp, Artificial
  Hairpin sequence MQbrain_1496, macaque
gggctacggccgccgctacgcctcagggtcctcggcctccgtggggggccctgagtccgccgtggcctgagcct

SEQ ID NO: 5981 - DNA, 56 bp, Artificial
  Hairpin sequence MQbrain_1497, macaque
tcggcgcggcagctgcagctggcccaggaggctgcccagaagcggctgcaggcaga

SEQ ID NO: 5982 - DNA, 98 bp, Artificial
  Hairpin sequence MQbrain_1498, macaque
ccaggacgcaggcggctttgggcctgaggaccggctgatggccgagcgcgagtacggctcctgcagccaccactaccagcagctactgcagagcctgg

SEQ ID NO: 5983 - DNA, 76 bp, Artificial
  Hairpin sequence MQbrain_1499, macaque
agccctgagaccctttgccctggtgccaggccctgatgcgggagctggagctgaaggagaagaagatcaaggagct

SEQ ID NO: 5984 - DNA, 117 bp, Artificial
  Hairpin sequence MQbrain_15, macaque
ccacccaatcaagggatgaaggaggaatgctggactggaggcccctggagccagatggcaagagggtgacagcttcctttcctgtgtatactccgtccagttccttgagaaaaatgg

SEQ ID NO: 5985 - DNA, 75 bp, Artificial
  Hairpin sequence MQbrain_150, macaque
aggaggagagagtggcctggcagggccagggatggtcttcagaggcccctggctcaggcagctttgtttctgcct

SEQ ID NO: 5986 - DNA, 105 bp, Artificial
  Hairpin sequence MQbrain_1500, macaque
ctctcggagcagcctggcctgtgcggcagccatggacaggtacagcatggaggagctgattcagctgggccaaggtagggcaggcagagctgggggctgtgggag

SEQ ID NO: 5987 - DNA, 68 bp, Artificial
  Hairpin sequence MQbrain_1501, macaque
caggaggacctgtggggcatcctgaggctggctgggagaggcagaggccagggtgcaggtcggacctg

SEQ ID NO: 5988 - DNA, 79 bp, Artificial
  Hairpin sequence MQbrain_1502, macaque
cgaggaggaggtgggcctgtatcctggggggttggggccctgtccccatgctcccctgtgaccctccccacccgtctcg

SEQ ID NO: 5989 - DNA, 117 bp, Artificial
  Hairpin sequence MQbrain_1503, macaque
ctgcagtcactggcagacacactctgtggccaggcaggcccagacctatctgagtatggactgacaccaagctcagagaggtctggacctggccacagagtgcctcatgctaggcag

SEQ ID NO: 5990 - DNA, 103 bp, Artificial
  Hairpin sequence MQbrain_1504, macaque
ccaggcactcgtgcctcttaacgtgttccctgccctgccacccagccaccccactgggctgggctcgggctggagggggtcatcaaggtacaaatgtgcctgg

SEQ ID NO: 5991 - DNA, 113 bp, Artificial
  Hairpin sequence MQbrain_1505, macaque
ctcttttgtttcctcaaggccgtgtctctgtttctttccagaaatcggccccgcctctgtgatggtggggaacctggtctctgggaagagaattgcgcaggccagcggcagag

SEQ ID NO: 5992 - DNA, 120 bp, Artificial
  Hairpin sequence MQbrain_1506, macaque
cctgctcctgggccctgctgtcctggcagctttacagtttggtatgtctttgattccggaaaattctggaaccagattctgaagctgtgatcacaagcttggagccctgtaggacgctgg

SEQ ID NO: 5993 - DNA, 68 bp, Artificial
  Hairpin sequence MQbrain_1507, macaque
ggagcccccagagaccagaggcggccggccgggggccggccctcgccctcggccatggggaagcgtct

SEQ ID NO: 5994 - DNA, 112 bp, Artificial
  Hairpin sequence MQbrain_1508, macaque
atcacataatccaataggaaagtgcagtgcactaagatccggccttggggggaggtatcaggaggcttccctgaggacgcgatggtggcactgcgattggagggatggtgat

SEQ ID NO: 5995 - DNA, 117 bp, Artificial
  Hairpin sequence MQbrain_1509, macaque
tttcttcctgcttgctcagttggcctcctgcctgttaaaatattgaggatgagagcagttttgtgatccgaggtcttcacgggggaaggaggagatgggcgtgggagcagggaggag

SEQ ID NO: 5996 - DNA, 92 bp, Artificial
  Hairpin sequence MQbrain_151, macaque
gggcgtggccggcgggctggctcctggggtgcagatgccatcagatgttttgactatggactgtggctcagggcctggtcttccgtcctacc

SEQ ID NO: 5997 - DNA, 86 bp, Artificial
  Hairpin sequence MQbrain_1510, macaque
taaaatataaaaagaaaagcattccttttcttgttttgcttttgtttggagaggaagaggggtgctggtctaattttagtttttta

SEQ ID NO: 5998 - DNA, 67 bp, Artificial
  Hairpin sequence MQbrain_1511, macaque
cggtcgcgagaggccgctctcctgaccctgacatcggcagcgggagcggcggccaggtaagcggccg

SEQ ID NO: 5999 - DNA, 81 bp, Artificial
  Hairpin sequence MQbrain_1512, macaque
tgggtttattccttccttcccatcttgtattacttgaaattccagaaaatatgggaggggagaaaaaaaggaataacaaca

SEQ ID NO: 6000 - DNA, 72 bp, Artificial
  Hairpin sequence MQbrain_1513, macaque
cccctgatcaggactattctaatttctcttcatccatggacgaagagtctgaggatggcccaatttcctggg

SEQ ID NO: 6001 - DNA, 110 bp, Artificial
  Hairpin sequence MQbrain_1514, macaque
gggctggtgcatcgccggcgagtacgggtgtcctatgtaagtttctattgctgtagaattgcagctgggagctgaaaatactgttcgtgtctgtctggtgcatgttgcct

SEQ ID NO: 6002 - DNA, 108 bp, Artificial
  Hairpin sequence MQbrain_1515, macaque
tacactgagctcctaaagtttaaattcaggtactgagtgtacaatttcaccaacattccaacccatgaaacttttacactctgtgccaagaaactgttggcttttgta

SEQ ID NO: 6003 - DNA, 105 bp, Artificial
  Hairpin sequence MQbrain_1516, macaque
gagaactggaaagtgactctgggagtgacaaggccaacagcccagcaggaggtattccctccacctcttcttgtttgcctagccccagtactccagtgcagtctc

SEQ ID NO: 6004 - DNA, 118 bp, Artificial
  Hairpin sequence MQbrain_1517, macaque
cagaggtcttcagtgatgctgccaaggaagggtggctccatttccggcctcttgtcaccgataagggcaaggtagtgtgttttctaagccaccctgactgtcagaaatgcagaccctg

SEQ ID NO: 6005 - DNA, 93 bp, Artificial
  Hairpin sequence MQbrain_1518, macaque
gtccatcaccgggcagctgggccaggctttctgggaggtgggctccccctatccgccaccgggcagctgggccaggctttttgggaggtgggc

SEQ ID NO: 6006 - DNA, 69 bp, Artificial
  Hairpin sequence MQbrain_1519, macaque
ggaaccccaaagttcacagctgctccctggtgcaaagccaggagggccgagttgtgcagctttgagtcc

SEQ ID NO: 6007 - DNA, 119 bp, Artificial
  Hairpin sequence MQbrain_152, macaque
cctgttcttttctcccctgtgctgccgccgcccgtggccacccctctcctgaacttaccgccactcaggtaatgaggagccgtgggtgcagccagccttggagatgccgaagagacggg

SEQ ID NO: 6008 - DNA, 59 bp, Artificial
  Hairpin sequence MQbrain_1520, macaque
acctcccctccccagaggctggtgctcacctcccagcccttcttggatgggtcagaggt

SEQ ID NO: 6009 - DNA, 92 bp, Artificial
  Hairpin sequence MQbrain_1521, macaque
tgggccagcagagaggagttgtaaaggagtcagaatttctcttgtggcacagacacacaaaggatctttgtggctcttttgcttctggccca

SEQ ID NO: 6010 - DNA, 112 bp, Artificial
  Hairpin sequence MQbrain_1522, macaque
ctcttctccctgccgtcatgtctaagtcagagtctcctaaagagcccgaacagctgaggaagctcttcattggagggttgagctttgaaacaactgatgagaacctgaggag

SEQ ID NO: 6011 - DNA, 92 bp, Artificial
  Hairpin sequence MQbrain_1523, macaque
tgtgctttctctccctctcgtgcagcagggaaatgtctgctgattgttattgtctggacagttcctgtggcgagaggggcgagacttgtccg

SEQ ID NO: 6012 - DNA, 90 bp, Artificial
  Hairpin sequence MQbrain_1524, macaque
tcagaacctgcttctcttccaaccatgggacttacagaacacagagggttactgtgagttcccaatgagatgactgaggggaaggcctga

SEQ ID NO: 6013 - DNA, 79 bp, Artificial
  Hairpin sequence MQbrain_1525, macaque
ggtggagaacaagaaggctcagctggtggtgattgcacatgatgtggatcccatcgagctggttgtcttcttgcctgcc

SEQ ID NO: 6014 - DNA, 97 bp, Artificial
  Hairpin sequence MQbrain_1526, macaque
gccctacttgatgaccagattgagatgtctttcagccaccaacagctttgtttaggttgagggggcagacatctaaaactgatttgataagaaaggc

SEQ ID NO: 6015 - DNA, 120 bp, Artificial
  Hairpin sequence MQbrain_1527, macaque
ccagtgcatcatcgaccagttcatcagcaccggccaggccaagtgggtgcggcataacggcattgtgctgctgctgccccatggcatggaaggcatggtgagggctgcagtggtggctgg

SEQ ID NO: 6016 - DNA, 118 bp, Artificial
  Hairpin sequence MQbrain_1528, macaque
ctgggcgaagcgctgctgctgtcccgggcctggcccgcagccctgggctcggcgacagccgactcggccgcgttgctgggccgggcccggggacagcccgcagccgccccgcaaccgg

SEQ ID NO: 6017 - DNA, 92 bp, Artificial
  Hairpin sequence MQbrain_1529, macaque
cccctttgctgaaactttgtgtctgggacctctgggttctgccagttggctggttggggatcaggggtcagtcaatgggtgtgggccagggg

SEQ ID NO: 6018 - DNA, 89 bp, Artificial
  Hairpin sequence MQbrain_153, macaque
ctgggtggggggacggggtctgggatgggtacccttctgctcagtaaggtccgggaggagtacccagacaggatcatgaacacattcag

SEQ ID NO: 6019 - DNA, 119 bp, Artificial
  Hairpin sequence MQbrain_1530, macaque
catagcagctctgctctgccactgccattctgtggacctccagtgccagcctcagaaggatggcgcaggcacccgaggacaagaaattagggtggaactggcagatgcaggcaagtgtg

SEQ ID NO: 6020 - DNA, 108 bp, Artificial
  Hairpin sequence MQbrain_1531, macaque
tgcttccagggattcaataacagaccggaacacctgggcttccaatgtgcatgcctccaccctgcccagtgcttgcccaggtggaaagtcagtgccttcctggtttca

SEQ ID NO: 6021 - DNA, 113 bp, Artificial
  Hairpin sequence MQbrain_1532, macaque
tctgtctatgtaaaaatcaggagctgccgggcctgtgatactgtgatattccgtttgaccagcagggggtatccgcagcatgtgtcgcggcagcctcttgagcatcagaaaga

SEQ ID NO: 6022 - DNA, 101 bp, Artificial
  Hairpin sequence MQbrain_1534, macaque
tgctggccggtgctgtgtcctggagctttatttggggagtttcacccagaatggtgggagaagcctcccaggtgccaggtaccccgcaccgtgacccttca

SEQ ID NO: 6023 - DNA, 76 bp, Artificial
  Hairpin sequence MQbrain_1535, macaque
ctctgggctcagcacctgaggcaggtttcctgggtcccctctccagcaagcctccaccagcaagctcggcccagag

SEQ ID NO: 6024 - DNA, 55 bp, Artificial
  Hairpin sequence MQbrain_1536, macaque
gcaggtgtgtgtggaggcaagctagtcctgagaccgccccacacgctgtgcctgt

SEQ ID NO: 6025 - DNA, 90 bp, Artificial
  Hairpin sequence MQbrain_1537, macaque
ctcactagggacagggcggtggccaggcagatggctggagggaagcagagcctccttgccggctgcctgtgctgttttgggcccaaagag

SEQ ID NO: 6026 - DNA, 105 bp, Artificial
  Hairpin sequence MQbrain_1538, macaque
tctatttctttttcttttccttagtgattttccctactgggcagcagatgatttcttcaaaggttgcctggatcagagtccttaagggaattaagaagttgggga

SEQ ID NO: 6027 - DNA, 79 bp, Artificial
  Hairpin sequence MQbrain_1539, macaque
gcggcccggcctgctggaggtgggcggccttggcccttcggaaaccggggcatcgatcctgcccgccccgcgcccccgc

SEQ ID NO: 6028 - DNA, 54 bp, Artificial
  Hairpin sequence MQbrain_154, macaque
ctgtggagcggggtgcctgtccctgccactgggtgacacgcccctctccaccag

SEQ ID NO: 6029 - DNA, 116 bp, Artificial
  Hairpin sequence MQbrain_1540, macaque
gagattgtattggattttactaaattgtgtcagtgagggagtaggttgaatacgagacccaaccagggcatattcataactctgtctcctgacagtggttgattatgtaggatttt

SEQ ID NO: 6030 - DNA, 106 bp, Artificial
  Hairpin sequence MQbrain_1541, macaque
gcagctcctgagaaagccagcccacatgtcaataaatctagatctgtttgaagctaacgtcactaaatctccgtcttgactgtttgctggtggtgtcaagagctgc

SEQ ID NO: 6031 - DNA, 114 bp, Artificial
  Hairpin sequence MQbrain_1543, macaque
ggaggagcttttggccatggtgctgccttcctgaactggcagtggtcagaatacatctgaaccctgtcctgggctggtgatgagcagacaccaggcctttttctatgcttttct

SEQ ID NO: 6032 - DNA, 90 bp, Artificial
  Hairpin sequence MQbrain_1544, macaque
gtctagcacctacgtcctgccaccgtcgccaccatgcccaagagagaggctgaaggggatgctaaaggagataaagccaaggtgaaggac

SEQ ID NO: 6033 - DNA, 93 bp, Artificial
  Hairpin sequence MQbrain_1545, macaque
ttctatgggaaagggggaaggattttagttcctcatcgctctgtgctgagagtggatgattgaactgtcaccttctccctaactctcatggga

SEQ ID NO: 6034 - DNA, 115 bp, Artificial
  Hairpin sequence MQbrain_1546, macaque
aacatgtctgagtacagccagcaggcacagagattcaacattggtgaggactgtccagtatttgatggcctctttgagttttgtcacttgtctgttggcggctctgtggcaagtt

SEQ ID NO: 6035 - DNA, 67 bp, Artificial
  Hairpin sequence MQbrain_1547, macaque
ccggtagagggcgcacagtagcgatcggcttttgtagccagttgcttcctgggtgctttaccaccgg

SEQ ID NO: 6036 - DNA, 106 bp, Artificial
  Hairpin sequence MQbrain_1548, macaque
ttgcgttgccttaaggaagggtatggtgaagccaagcagtgggaggtgggaaagcatgcttacctccataattgacttctcttcactctttctgcaggcttttcaa

SEQ ID NO: 6037 - DNA, 118 bp, Artificial
  Hairpin sequence MQbrain_1549, macaque
ttggatacggaggagatgagtgtaccccaggactgtcacccgcttccctccactgaaagcttttctgggggaggcagtgaagatgtcatttctaggcctcattctcctcctgaaacag

SEQ ID NO: 6038 - DNA, 77 bp, Artificial
  Hairpin sequence MQbrain_155, macaque
ggacggggtctgggatgggtaccctcctcatcagcaagatccgggaggagtacccagacaggatcatgaacacgttc

SEQ ID NO: 6039 - DNA, 84 bp, Artificial
  Hairpin sequence MQbrain_1550, macaque
gagttggagtttgcttctctgtagctgggcagctgttcttggtctagtgaccaccagcctggacagctacggagaacccgcctt

SEQ ID NO: 6040 - DNA, 118 bp, Artificial
  Hairpin sequence MQbrain_1551, macaque; MQbrain_1552, macaque
ctgcgggggcatcgctggagccgccggcagctccggcacccggagaagacaaccccgccggggctgggggagcggcggtggctggggctgcaggaggggctcggcggttcctgtgtgg

SEQ ID NO: 6041 - DNA, 116 bp, Artificial
  Hairpin sequence MQbrain_1553, macaque
ttccaaccacccttgccattcctttcctcccccttaattcctcccccagccccatccccagatggggttgatttgtgactggtggggaggggacagggaacagagggacaatggga

SEQ ID NO: 6042 - DNA, 115 bp, Artificial
  Hairpin sequence MQbrain_1554, macaque
cctgggtgaaggattaagagagtagcaggattgtctgtctccttgctgactttgggtggggacgttgagggaggaagacagttctgttgctagtgggtagcctgaagctctatgg

SEQ ID NO: 6043 - DNA, 115 bp, Artificial
  Hairpin sequence MQbrain_1555, macaque
catgtaacaggtcatgtggcagcctcctagggacacgcgtggggtctggagcgggacacgcgtgtgcagccgggccttacgtgtggctcaaggggcggtgggcgagacagacgtg

SEQ ID NO: 6044 - DNA, 88 bp, Artificial
  Hairpin sequence MQbrain_1556, macaque
gaagatgtgggtctccaagaaggaatatgaggaagacggtgcccgatccatccacagaaaaaccttctaatgttgggacatcatcttc

SEQ ID NO: 6045 - DNA, 90 bp, Artificial
  Hairpin sequence MQbrain_1558, macaque
ctgcctgcacgtcttcgtggagccagtgcagctgccgtgcaaacacaacttctgccggggctgcatcggcgaggcgtgggctaaggacag

SEQ ID NO: 6046 - DNA, 71 bp, Artificial
  Hairpin sequence MQbrain_1559, macaque
aagatgcaccacccatatctctgttcagggagacacttactgtcttttctggaagagctatgggcagtctt

SEQ ID NO: 6047 - DNA, 76 bp, Artificial
  Hairpin sequence MQbrain_156, macaque
ggcaggcacagtggcccccacagctgaggattgtggggaggtgcgtgctggttgtgggggtgtgcgtgtgtgtgct

SEQ ID NO: 6048 - DNA, 117 bp, Artificial
  Hairpin sequence MQbrain_1560, macaque
ggaatatcctttactgtgggtggcacagctttttagggttggcttcctaaacattttggggagaatgagtctaccagcagagaagctttcctctggcagtctgagggtgtatcttcc

SEQ ID NO: 6049 - DNA, 71 bp, Artificial
  Hairpin sequence MQbrain_1561, macaque
gttaaaaatgtggtgggagctgatcgcctatgctgccgtaaaatgaaacagctcccccacttatatttgac

SEQ ID NO: 6050 - DNA, 71 bp, Artificial
  Hairpin sequence MQbrain_1562, macaque
ccttctaccatgcttttattgggagtacgcactcataatttgaagagtgacttttgggggagggtggaagg

SEQ ID NO: 6051 - DNA, 118 bp, Artificial
  Hairpin sequence MQbrain_1563, macaque
ctggggaaggagttgaacctggaggtcagggctctgtggtctattacagtccccctggggtctccagcccaggggacactacagggtcctaataaatgactggggacttcattttgag

SEQ ID NO: 6052 - DNA, 120 bp, Artificial
  Hairpin sequence MQbrain_1564, macaque
tggaaaagtgctgacagtgacagccgacagagattaaggagttctacaggaccctcaagaacttctgtggccctccagttatattctgggggctgtgcactggggatttggcctgttcta

SEQ ID NO: 6053 - DNA, 91 bp, Artificial
  Hairpin sequence MQbrain_1565, macaque
aagagcaggcatgcctggtgcctgggtccagctgtccctgcaggccttggggacaccgcatgaaccaggccaggtgtagggggtctttctt

SEQ ID NO: 6054 - DNA, 116 bp, Artificial
  Hairpin sequence MQbrain_1566, macaque
tggacctaacacaaacggttcccagtttttcatctgcactgccaagagtgagtggttggatggcaagcatgtggtctttggcaagatgaaagaaggcatgaatattgtggaggcca

SEQ ID NO: 6055 - DNA, 85 bp, Artificial
  Hairpin sequence MQbrain_1567, macaque
ttcacatgcttttttccccgtagttccgggactactgtgctatctgcttaagatgggagtggcctgggtctccaaaagcattgga

SEQ ID NO: 6056 - DNA, 78 bp, Artificial
  Hairpin sequence MQbrain_1568, macaque
cctgccttgagatagttctgcatctggacagatgtgccaagtacaattctggctcaggtgattgaagtctaagtcagg

SEQ ID NO: 6057 - DNA, 103 bp, Artificial
  Hairpin sequence MQbrain_1569, macaque
gctgcctgctgtggacatgtccctgggatgtccagccagctgccaggcgtgaccaggaggcttgctggggcccatccctgggtcagcgtacgagccagagagc

SEQ ID NO: 6058 - DNA, 106 bp, Artificial
  Hairpin sequence MQbrain_157, macaque
tcccaagggctttcagaaacccaagctggcccaggcctggggcctgggaggtgtcccttcccttcccaggctggagccaagctggccagctgggggtacgacagga

SEQ ID NO: 6059 - DNA, 69 bp, Artificial
  Hairpin sequence MQbrain_1570, macaque
gtttctgactggtgtctagcagccttgccagagagagtggcagtgtgtctgcaggcgaccaggagaaat

SEQ ID NO: 6060 - DNA, 92 bp, Artificial
  Hairpin sequence MQbrain_1571, macaque
gcactgcgcgccggcactagggtgtttttgccgttggctgtggagaaacagcaggcggcgtggactgccgttgctgagctggtgtggaatgt

SEQ ID NO: 6061 - DNA, 108 bp, Artificial
  Hairpin sequence MQbrain_1572, macaque
agttgatgcatctgtggctgtcttttgtgaggtccagaacacactcattaacacaatgattagaaaacatggaacagaagaacaaaaggccacctatttgcctcagct

SEQ ID NO: 6062 - DNA, 115 bp, Artificial
  Hairpin sequence MQbrain_1573, macaque
ctctgagccaggaagccgtgttagaggaagggaccgtggcattcagaggggtccccttgggggcacttgcttgggtcttggatcaaactcaactggggcagcctggctgtgggag

SEQ ID NO: 6063 - DNA, 90 bp, Artificial
  Hairpin sequence MQbrain_1574, macaque
catgaggggcaaggaggaaaagctgctgatcagttgtgtctctccctttaaataaagctgctccttgtagctcctcttagtccctccgtg

SEQ ID NO: 6064 - DNA, 88 bp, Artificial
  Hairpin sequence MQbrain_1575, macaque
tggccgtgtcaaaacttggctacaaggctctttccctctctatgaaggacaggcaataaagaggaggcctggggtggcggcatgggca

SEQ ID NO: 6065 - DNA, 80 bp, Artificial
  Hairpin sequence MQbrain_1576, macaque; PT_from_MQbrain_1576, chimp
gagcctcttccggcacgttgagactgcttttctgtgttatgagaacagagaagtaagctcctcgctctggcagggtaatc

SEQ ID NO: 6066 - DNA, 118 bp, Artificial
  Hairpin sequence MQbrain_1577, macaque
cagccgcctcgcgttccctgtcctgctgggctgatgggaagtgcagtgatttggagaagggtcataccacttcccatgagtcccgtgcagttcaggaaattaaaatgtcggggaaatg

SEQ ID NO: 6067 - DNA, 120 bp, Artificial
  Hairpin sequence MQbrain_1578, macaque; MQbrain_1580, macaque
cagctgggacagtggcctgaggcggccggctggcacctcagagctgggctgggtgggcaggggttcctgcagctgggacagtggcctgaggcggccggctggcacctcagagctgggctg

SEQ ID NO: 6068 - DNA, 111 bp, Artificial
  Hairpin sequence MQbrain_1579, macaque
ggtcctgtgggacttgcatggccgatttggtctctgcaggcgtggggggcctggacactgggtcctgtggggcttgcggggccgctctggtctctgtaggcgtggggggcc

SEQ ID NO: 6069 - DNA, 113 bp, Artificial
  Hairpin sequence MQbrain_158, macaque
ggccctggccctgctactgccccagggtgcctgcactggccggacccccggacccccagccagcggtgcgggtggggtggccaatggcactggggcagggacagtcgtgggcc

SEQ ID NO: 6070 - DNA, 108 bp, Artificial
  Hairpin sequence MQbrain_1582, macaque
ggtgattttgtgcattttagagcatttaggtccaaggctcaggcggtgctaagcaggtttctagtactgcagatgtctggtggaatgttctggaattgcactggggct

SEQ ID NO: 6071 - DNA, 101 bp, Artificial
  Hairpin sequence MQbrain_1583, macaque
ggctggaggcccctgccatggggcactcaccctgcaggacagacagagggatggatggatggatggacaggctggaggcccctgccatggggcactcaccc

SEQ ID NO: 6072 - DNA, 93 bp, Artificial
  Hairpin sequence MQbrain_1584, macaque
cttagcggatgtcttcagtgtgtacactgcgatggtcccttggccacatgctttgggaacgtcttcagtgtatacaaagtggcggtcccttgg

SEQ ID NO: 6073 - DNA, 75 bp, Artificial
  Hairpin sequence MQbrain_1585, macaque
tgtcttcagtgtgtacactgcgatggtcccttggccacatgctttgggaacatcttcagtgcatacaaagtggca

SEQ ID NO: 6074 - DNA, 116 bp, Artificial
  Hairpin sequence MQbrain_1586, macaque
gttggaaagggccgttgtgtagtggggagaatggtgggccagaaggaagccgttctgttgcgggtcctttctgtgtagaccatctgcccagatgcacagcagagggcctgggaagc

SEQ ID NO: 6075 - DNA, 80 bp, Artificial
  Hairpin sequence MQbrain_1587, macaque
ctgtggttcatccctactctcccctcctcagcaaggcttctgggccagcagaggggcgggagcggaatgccagcccccag

SEQ ID NO: 6076 - DNA, 109 bp, Artificial
  Hairpin sequence MQbrain_1588, macaque
ttgaccagatggaggagaaaagcttgctgggggcaacaaaacaaacccaaaggcagtgcttcctagagctgcctgtagccccagggcagtatctctctccaagattcag

SEQ ID NO: 6077 - DNA, 100 bp, Artificial
  Hairpin sequence MQbrain_1589, macaque
gttcatcagttatgtgaagaattgcttctggatgactgaccaggaggctattcaagatctctggcagtggaggaagtctctttaagaaaatattttggac

SEQ ID NO: 6078 - DNA, 118 bp, Artificial
  Hairpin sequence MQbrain_159, macaque
actggcctcaaggggctgggagaggtcaaggctggggctccgttgcccaccaggggtacccttgaggctgtcagctccggcagtgagccctgtcctggctgcacgtggggcaaacagt

SEQ ID NO: 6079 - DNA, 92 bp, Artificial
  Hairpin sequence MQbrain_1590, macaque
ccgcggtggcttccgcggaggtttcggcagtggcatccggggccggggtcgcggggtggacggggccggggccgaggccgcggagctcgcgg

SEQ ID NO: 6080 - DNA, 99 bp, Artificial
  Hairpin sequence MQbrain_1591, macaque
actctgatcctagggtcaggttattgctgagttgctgttagcattaataattatgtaacggccttcccatttttctaccctatgtggattattttgagt

SEQ ID NO: 6081 - DNA, 79 bp, Artificial
  Hairpin sequence MQbrain_1592, macaque; MQbrain_1700, macaque; MQbrain_1724, macaque; MQbrain_468, macaque; MQbrain_664, macaque
ggtggagaacaagaaggctcagctggtggtgattgcacatgacgtggatcccatcgagctggttgtcttcttgcctgcc

SEQ ID NO: 6082 - DNA, 81 bp, Artificial
  Hairpin sequence MQbrain_1593, macaque
aatttctcgtagtggtgaaagctgggaatgcagagtgtgctagagaggctgtgttcccagcatgcaccactaccagaggtt

SEQ ID NO: 6083 - DNA, 111 bp, Artificial
  Hairpin sequence MQbrain_1595, macaque
cctcttctcatgcatgacacctctaggcatcaggctgggtgcagctctggctgagtcggcaggacctctgcaccagctggctcagtctgtgctagagggcatggcggctgg

SEQ ID NO: 6084 - DNA, 65 bp, Artificial
  Hairpin sequence MQbrain_1597, macaque
gcttgttaacacagggaaggggaaactgcagggtttacagcttccttttcccttctctgtgcagc

SEQ ID NO: 6085 - DNA, 76 bp, Artificial
  Hairpin sequence MQbrain_1598, macaque
gctatactttgatgcccttgagtgtctccctgaggacaaagaggccctcacggaggacaagtgcctcccagtatgt

SEQ ID NO: 6086 - DNA, 115 bp, Artificial
  Hairpin sequence MQbrain_1599, macaque
gccccctatctcctggggagggtgagcagggcagggacagtctccagggtcagtccctggatgggtggttacctccccttcctccaccctaagccctggggccctgaaatggggt

SEQ ID NO: 6087 - DNA, 46 bp, Artificial
  Hairpin sequence MQbrain_16, macaque
cgctgcggtccccgaggtcctggagctggccctgcggggcccggcg

SEQ ID NO: 6088 - DNA, 96 bp, Artificial
  Hairpin sequence MQbrain_160, macaque
ggcctgggtactgggggtgtggccagtgccagggccatgaggggtttggtcacaggctggtggtcctggccatggccaagctgctggcctgaggtc

SEQ ID NO: 6089 - DNA, 92 bp, Artificial
  Hairpin sequence MQbrain_1600, macaque
gccccagtaccttcgcctgtgcacagcttgccactggcgctgcctgccgcctggtggaggctgtgctctcgggagaggtgtgtcctctgggc

SEQ ID NO: 6090 - DNA, 86 bp, Artificial
  Hairpin sequence MQbrain_1601, macaque
tttcggcagtggcatcgggggccggggtcgcggccatggacggggctggggccgaggccgcggagctcgcggaggcaaggccgagg

SEQ ID NO: 6091 - DNA, 103 bp, Artificial
  Hairpin sequence MQbrain_1602, macaque
cctgagctctattcctgggctctgaaggtgttcacagtgagaaatgccctgcatacattgttggcctatatcctgagacctgagaccccaaggaggagttggg

SEQ ID NO: 6092 - DNA, 79 bp, Artificial
  Hairpin sequence MQbrain_1603, macaque
agctttttggacatttgtgtccctgggtgtgagatctctatgtaggtgtctgcaccccaggatgtaaagtctctgagct

SEQ ID NO: 6093 - DNA, 118 bp, Artificial
  Hairpin sequence MQbrain_1604, macaque
gggtggaaaggagaatggctttggacttgcagaatgttgcagagacttgcatatgatggtaagtaactctttgggatatgggtatcttttgacagagctgttttcctctctatgaacc

SEQ ID NO: 6094 - DNA, 99 bp, Artificial
  Hairpin sequence MQbrain_1605, macaque
gagataatcttgagacaaccttgcatttccagtttccctccttggacagcctaagtatgagggagggaaacatggcttgcaataaattagcattatgtc

SEQ ID NO: 6095 - DNA, 77 bp, Artificial
  Hairpin sequence MQbrain_1606, macaque
ccaggagactgaggctgctgcctctcaggccccagcagatgaacctgagcctgagagtgcagctgcccagtctcagg

SEQ ID NO: 6096 - DNA, 77 bp, Artificial
  Hairpin sequence MQbrain_1607, macaque
gccattactaggccagagcatccaaggagacagtagtaagtactgcctccttggacgctctggcccagtgacccagc

SEQ ID NO: 6097 - DNA, 115 bp, Artificial
  Hairpin sequence MQbrain_1608, macaque
gagtcatgtcataaaaatgacttcatagttattggggttagggaggtggagaaaagataacctttctcattacgttttgtctggatggctggttttgaggttttaaacatgactt

SEQ ID NO: 6098 - DNA, 97 bp, Artificial
  Hairpin sequence MQbrain_1609, macaque
tcctgaaaatttccaaggggcaccaagtggcagctggcttcctggggtgaagaggcaggcaccccagagtcctcaactgggcctaggggaagaggga

SEQ ID NO: 6099 - DNA, 119 bp, Artificial
  Hairpin sequence MQbrain_161, macaque
gcccagggccaggagatcctccttgatctgggtgcagccgctcctgcctggagaaaagggtgtaccaggagccgtggtgcccagacagggaggaggctccagcctggctttctgagggc

SEQ ID NO: 6100 - DNA, 63 bp, Artificial
  Hairpin sequence MQbrain_1610, macaque
ctgtggccatgggcagtgctccaggcctgcttggtgtggacatggtggtgacccgtgtcaagg

SEQ ID NO: 6101 - DNA, 95 bp, Artificial
  Hairpin sequence MQbrain_1611, macaque
ggcagcagcagcagcggcctccccgacccaggtccctgcagtcaccgactcatcccctggggcggacggagggggcggtggcagcgacggcagcc

SEQ ID NO: 6102 - DNA, 104 bp, Artificial
  Hairpin sequence MQbrain_1612, macaque
tggacacggacaagactattcccagcaggatgagagggaaggcctgccatcctccaggccacttcccaaatccaccctgctgagagtgtagtggtaatgcttca

SEQ ID NO: 6103 - DNA, 120 bp, Artificial
  Hairpin sequence MQbrain_1614, macaque
gggaagattgagagggccataggagaacctaggatggagaggtcattggttctgaggacaaactttgtcctgttcatgatgctttccaaagccaaggtttccttaggctcttagctttct

SEQ ID NO: 6104 - DNA, 117 bp, Artificial
  Hairpin sequence MQbrain_1615, macaque
cttgggggagctaggcctgcagaccagtccagtggtgggtcctgggctggcactgggaatcaggtcagtggaaggtcctggattgggcctgggaatcaggctggtgactgttccaag

SEQ ID NO: 6105 - DNA, 97 bp, Artificial
  Hairpin sequence MQbrain_1616, macaque
gcaaagactctggggagagggaggtggggaagggccgtgttgagatgtctctgcctttgccagcgccatcctttacctcaatggagacttcgatggc

SEQ ID NO: 6106 - DNA, 73 bp, Artificial
  Hairpin sequence MQbrain_1618, macaque
ggccgccgggtctcccggcctaagcctgccgggcctcaacgaaacccccgcagagccgccgggacgcagcgcc

SEQ ID NO: 6107 - DNA, 71 bp, Artificial
  Hairpin sequence MQbrain_1619, macaque
cagactcctctttttacccacctagttggccaagcagtgactgccacaggggagggaaaggggagggactg

SEQ ID NO: 6108 - DNA, 72 bp, Artificial
  Hairpin sequence MQbrain_162, macaque
ctgcatcctttggtcctgtccccgcagccctggcagggggcacgcggtcgggcaggggctagagggaggcgg

SEQ ID NO: 6109 - DNA, 95 bp, Artificial
  Hairpin sequence MQbrain_1620, macaque
gtcaggggagtgaggggtggaggtaggggccagaggggcttacacgatatcccatacctttaatgcctttggccttccattctgacttctctgat

SEQ ID NO: 6110 - DNA, 57 bp, Artificial
  Hairpin sequence MQbrain_1621, macaque
caacctctctcttctcccctgcttcatgaaggcaggggacacagatgggagagattg

SEQ ID NO: 6111 - DNA, 72 bp, Artificial
  Hairpin sequence MQbrain_1622, macaque
ggacgtactcctcttggtgacagcgtgggctgctgagatttgggagtctgcgctgggtccgcttggagttct

SEQ ID NO: 6112 - DNA, 62 bp, Artificial
  Hairpin sequence MQbrain_1624, macaque
tcctgtagggaaggggctgggctcgtatcctactgtgtgcccagtctcctgttccctgagga

SEQ ID NO: 6113 - DNA, 100 bp, Artificial
  Hairpin sequence MQbrain_1625, macaque
gtcaaagcaagagatggcgagtgcttcatccagccaaagaggacgaagtggttctggaaactttggtggtggtcgtggaggtggttttggtggaaatgac

SEQ ID NO: 6114 - DNA, 91 bp, Artificial
  Hairpin sequence MQbrain_1626, macaque
tggacattagccaagctcaaactgagccttgctttgctttgggaaaacataaagcaaagcaaagctcagttggagcttgactatgaattca

SEQ ID NO: 6115 - DNA, 119 bp, Artificial
  Hairpin sequence MQbrain_1627, macaque
gctgggggtggctgggaggggaagagaagggagaggcaagctggctgtgaactatcctgttgtagggccggagctgctcccacctccctgacttacccctgctgcaccattcccccagc

SEQ ID NO: 6116 - DNA, 84 bp, Artificial
  Hairpin sequence MQbrain_1628, macaque
ggcaaaaagaggccggcaatcgagtctccctgttgacagtaaagttgaaatggtgacgtccactgctggctttattgaacagct

SEQ ID NO: 6117 - DNA, 101 bp, Artificial
  Hairpin sequence MQbrain_1629, macaque
tgaagtatttgaagaacatgcatttaatctcatctggctggttctgggatgtgggagcagaaaagaggagtgtgaatgtgtgtgtgtcttcatctgtctta

SEQ ID NO: 6118 - DNA, 116 bp, Artificial
  Hairpin sequence MQbrain_163, macaque
agaggccaccaaagaagctgcatgttgtccttctctgatgccttctctggatttgtgcagagactgggagggctttcagggagggtcaatgtccccagagtccccggctgaccttt

SEQ ID NO: 6119 - DNA, 79 bp, Artificial
  Hairpin sequence MQbrain_1630, macaque
ggactggtttgctgctggaaaaggactggagaaggcgatggcatgctgctgctttgacagtccctagcagttgcggtcc

SEQ ID NO: 6120 - DNA, 112 bp, Artificial
  Hairpin sequence MQbrain_1631, macaque
gccagtggccccactctgggctgccctgttcttcttcatgctgttgctgcttggtctcgacagccaggtttgcatggagctctgggacagggagccaggagggcggcagggt

SEQ ID NO: 6121 - DNA, 76 bp, Artificial
  Hairpin sequence MQbrain_1632, macaque
ggcagggcagggtgggagcagtgtaggcgcctcaccaggggtcagcacagcctctgctccccatctctgccaggtc

SEQ ID NO: 6122 - DNA, 98 bp, Artificial
  Hairpin sequence MQbrain_1633, macaque
ccagtaggctggagcgcatggggtggagatcacgatggcgggccagggcctcaagcccacgcccgccctgcacccccagtctgctgctgcggttctgg

SEQ ID NO: 6123 - DNA, 92 bp, Artificial
  Hairpin sequence MQbrain_1634, macaque
ctgaggggagctggcagagcctgggggcgcagggtgcacagccaggcgctgtgcccagcagtgggctccctgcctgccacctcccctgccag

SEQ ID NO: 6124 - DNA, 72 bp, Artificial
  Hairpin sequence MQbrain_1635, macaque
tctggaccctgatcctgcactactccatctccatgcccatgtgggatgaggaggaggatgaggaggccaaga

SEQ ID NO: 6125 - DNA, 96 bp, Artificial
  Hairpin sequence MQbrain_1637, macaque
ggcttcttctttgtggcagctggccaacagccaggtgggtcccatggggagccttcttcagcagcctgggcttggcacagtcacgaggacagggct

SEQ ID NO: 6126 - DNA, 119 bp, Artificial
  Hairpin sequence MQbrain_1638, macaque
gggtggtttctggtggctcgtgtaccttggcaagtttgtgggctgggtgggccttgaccccagagcccagtccatagggtctgagctgtggggtgcgtgtgaggcatgggggcctgcct

SEQ ID NO: 6127 - DNA, 93 bp, Artificial
  Hairpin sequence MQbrain_1639, macaque; MQbrain_460, macaque; MQbrain_662, macaque
gtccaatcttggatttccagagtcttataatatagcctcactttctgggtgcaggagaggctggtgatggctacggaggaccattagttggat

SEQ ID NO: 6128 - DNA, 65 bp, Artificial
  Hairpin sequence MQbrain_164, macaque
ttggctggtggcccttgtcccccgggttgtctatacgcagaacccgtgggacggtcgcctctcaa

SEQ ID NO: 6129 - DNA, 118 bp, Artificial
  Hairpin sequence MQbrain_1641, macaque
ctgaggtacggaaggccagggtggtggcgggaatccattccggtgtgttctacacattgcttagagattggatggggtgcatcagggtggtttctgattacttttcttcttccctcag

SEQ ID NO: 6130 - DNA, 118 bp, Artificial
  Hairpin sequence MQbrain_1642, macaque
cactgcacccctctctatcctcccaggctactccatgtttggggctggcctcaccgtagggctgtctaacctcttctgtggagtctgcgtgggcatcgtgggcagtggggctgccctg

SEQ ID NO: 6131 - DNA, 79 bp, Artificial
  Hairpin sequence MQbrain_1643, macaque
agtgctcagcatgggaaggcagggggtactgtgtggggctcacaaggccctttgccctttctttcctctcttggacact

SEQ ID NO: 6132 - DNA, 102 bp, Artificial
  Hairpin sequence MQbrain_1644, macaque
gctgaaactaagaatgctgccttggagagggtggaagaactggaagaaaacatctctcatgtaactacatctcagaaaaggaaaaactgcttccatttcagc

SEQ ID NO: 6133 - DNA, 68 bp, Artificial
  Hairpin sequence MQbrain_1645, macaque
ggccttcagccctctctgcctctgcagctgaccacaaggaagctggtagacagggagggactgattcc

SEQ ID NO: 6134 - DNA, 117 bp, Artificial
  Hairpin sequence MQbrain_1647, macaque
gcccaggcccgcacccggcgcctttggttgctgttttcctgtatctcataaatgtactcaagcacacattggaacagatggaaggggcggtgaggggcagcagtgcgggcctgaggc

SEQ ID NO: 6135 - DNA, 118 bp, Artificial
  Hairpin sequence MQbrain_1648, macaque
cttctggcatcttgtccatggcaaatgctggacccaacacaaacagttcccagtttttcaactgccgagactgagtgattggatggcaagcatggggtctttggcaaggtgaaagaag

SEQ ID NO: 6136 - DNA, 81 bp, Artificial
  Hairpin sequence MQbrain_1649, macaque
ttgtttgttttcatgagagctttggggagcatccttttgagagcagcaggaagcctcccccaaagcctcttatacaggtaa

SEQ ID NO: 6137 - DNA, 86 bp, Artificial
  Hairpin sequence MQbrain_165, macaque
tgcagattcatcttgttaggtgacctggggaagaggcccttgttggccctgtccccactcatgggtcgctggtctgtggacttgca

SEQ ID NO: 6138 - DNA, 100 bp, Artificial
  Hairpin sequence MQbrain_1650, macaque
cagtgcctacaataagacagtgaccccttgtcagtaaactgtgactctgtgtaaaggggagacgaccttgacaggaggttactgttctcactaccagctg

SEQ ID NO: 6139 - DNA, 117 bp, Artificial
  Hairpin sequence MQbrain_1651, macaque
gtacgagctgtgggccgcgttgcctggcgcctccggggtcgccctggcctgctgcttcgtggcggcggccgtggccctgcgctggtccgggcgccgggcagcgcggggcgcggtggc

SEQ ID NO: 6140 - DNA, 117 bp, Artificial
  Hairpin sequence MQbrain_1652, macaque
ggcagctgccctccagagcctcataatcgtctattattccaactactgacaacaggcagcaagagcctggctgcagtacgggacgggacgggaaggagtggcctgggaggcaggacc

SEQ ID NO: 6141 - DNA, 97 bp, Artificial
  Hairpin sequence MQbrain_1653, macaque
gtatctgaatgcttttatctatcttatctgacttctggtgaattttttttaatgaaatttaccagaagtctgctagatctgtgctggtggcagctac

SEQ ID NO: 6142 - DNA, 103 bp, Artificial
  Hairpin sequence MQbrain_1655, macaque
ggagcgcggaggcgcctggcgagagaagccgactggagcgcggccaccgctcagagttgccgtgactcggtcgggttctccggccagaagtccccattgttcc

SEQ ID NO: 6143 - DNA, 79 bp, Artificial
  Hairpin sequence MQbrain_1656, macaque
ggtcggcagggtgctcctgaatgctgggtgccgggcagatgccatcaacagcacccagagcacagcgctgcacgtggcc

SEQ ID NO: 6144 - DNA, 98 bp, Artificial
  Hairpin sequence MQbrain_1657, macaque
tctccctggcgtcacgtctaagtcagagtctcctaaagagcccgaacacctaaggaagctcttcattggagggttgagctttgaaacaaccaatgaga

SEQ ID NO: 6145 - DNA, 118 bp, Artificial
  Hairpin sequence MQbrain_1658, macaque
gagattccaggtagtgactggcttgagccccagctctttggcccacctgtgtcgagcttacctcgacacaggtggggcaaagaggtcagaaggtcccaaactagcatttcctacgctc

SEQ ID NO: 6146 - DNA, 89 bp, Artificial
  Hairpin sequence MQbrain_1659, macaque
gtctgctcctgtggcttccaccacctaatcctaactccagggactcgcaggagttaggattaggtcgtggaagccagaggcgcctgggc

SEQ ID NO: 6147 - DNA, 72 bp, Artificial
  Hairpin sequence MQbrain_166, macaque
ccacctcactggccttgctggaggcacagggctctgctgacctgcagccatctgtgaggcccgcggggatgg

SEQ ID NO: 6148 - DNA, 119 bp, Artificial
  Hairpin sequence MQbrain_1660, macaque
gtgtagcaaagaggaaatactgtgccttgggattattttgtttatattcatgctacatttttggcatatatatttgagatacattttggggaggggtgatttcttctctttgaaatcac

SEQ ID NO: 6149 - DNA, 70 bp, Artificial
  Hairpin sequence MQbrain_1661, macaque
ctcgagaggggctgcatggggatgccacgtggaagatgttctgttcccagactcgtgtggccatctcgag

SEQ ID NO: 6150 - DNA, 100 bp, Artificial
  Hairpin sequence MQbrain_1662, macaque
ttgtaaaggggaagctggggagttttgatgttttgatttggaagagggactctagacattctgtccctctgagagaagctggctccttgctgctttgcaa

SEQ ID NO: 6151 - DNA, 115 bp, Artificial
  Hairpin sequence MQbrain_1663, macaque
caatagaggggtcaggtgggcagggttatgagggaaggaggggcatagagaaggcctgaaccccacttgggcttcgcaaccctcttcctcccctctgcctgattcacacattttg

SEQ ID NO: 6152 - DNA, 109 bp, Artificial
  Hairpin sequence MQbrain_1664, macaque
caagttcatcaattatgtgaagaattgcttccgtacaactgagcgggaggctattcaagatctctggcagtggaggaagtctctttaagaaaatagtttaaacaatttg

SEQ ID NO: 6153 - DNA, 72 bp, Artificial
  Hairpin sequence MQbrain_1665, macaque
gggtgtgaaatgtttgctgccagtgagggagaaaggtttgcctcggctaggggtagcgggatttcaggctcc

SEQ ID NO: 6154 - DNA, 89 bp, Artificial
  Hairpin sequence MQbrain_1666, macaque
gaagagagcggaagaaagaggaaacttttggttttgtagcccacagtgtcttgcatagaactttttcctttctcctccaggctctcatc

SEQ ID NO: 6155 - DNA, 94 bp, Artificial
  Hairpin sequence MQbrain_1667, macaque
aatatctccttaattaaggcagcggctctgctggggcctacattccaggattctcagcagagaaaacatgttttctttatagaggagttttatt

SEQ ID NO: 6156 - DNA, 106 bp, Artificial
  Hairpin sequence MQbrain_1668, macaque
tgtaaaagtcccaggttctagaacggctagcaggggtgtgatgggaaaatttggatacacacatacctggctattgctgcttttgtaaaaagatcctgggatagca

SEQ ID NO: 6157 - DNA, 94 bp, Artificial
  Hairpin sequence MQbrain_1669, macaque
gacttcaaaccactaagagccagggattaccaaaagcggtcaccttagagtgccgcttctgttatcccatgcaactctctcatatatgaatttc

SEQ ID NO: 6158 - DNA, 100 bp, Artificial
  Hairpin sequence MQbrain_167, macaque
accacccggcagccctggggccccctggtctctgctgcaggtcgttctaccgccttgaccaccccggcagccccgggccccagtctctgctgcaggttgt

SEQ ID NO: 6159 - DNA, 87 bp, Artificial
  Hairpin sequence MQbrain_1671, macaque
gccccaggaatgttggtgtgtgctgctgtcctggcctcagggaaggaagctgagggcccaggaagcagggctgccatttcccagggt

SEQ ID NO: 6160 - DNA, 91 bp, Artificial
  Hairpin sequence MQbrain_1672, macaque
attctgtgaatttcatccttctataaattcatccatcacattatctagaatggtgatgggtgaatttgtagaaggatgagagtcaaagaat

SEQ ID NO: 6161 - DNA, 71 bp, Artificial
  Hairpin sequence MQbrain_1673, macaque
gggcagcgtgggcacactgtcttccctggacggggtcaccaacaccagtgaggggggctacccagaggccc

SEQ ID NO: 6162 - DNA, 70 bp, Artificial
  Hairpin sequence MQbrain_1674, macaque
cacagccccacaggtcctctttagccacagggaacctcctctggagctgaaagacacggacgccgctgtg

SEQ ID NO: 6163 - DNA, 78 bp, Artificial
  Hairpin sequence MQbrain_1676, macaque
tccaagccagaaatccttgattatttatagtgcgtaagagttcttatatgctgtgggtgaaagagcgcagggcatggg

SEQ ID NO: 6164 - DNA, 111 bp, Artificial
  Hairpin sequence MQbrain_1677, macaque
gggggaagggctggagccggggctagaaccggggctagggccgggggcaggtggtcctgcctgctctatacttagcccagtggagccagtctgggctcttgtcctccagct

SEQ ID NO: 6165 - DNA, 114 bp, Artificial
  Hairpin sequence MQbrain_1678, macaque
agatcgccacctacaggaagctgctggagggcgaggagagtgggctggagtctgggatacagaacataagtactcatacgaaggctcccagtggctatgcaggtaggctgagct

SEQ ID NO: 6166 - DNA, 88 bp, Artificial
  Hairpin sequence MQbrain_1679, macaque
atcgtcagttactgatgcgcctgaagcctgtgtgtccatttctgcacacacgtatacctcggcatggccgtatcacgtctctgattat

SEQ ID NO: 6167 - DNA, 93 bp, Artificial
  Hairpin sequence MQbrain_168, macaque
ccttggtggagaacaagaaggctcagctggtggtgattgcacatgacgtagatcccatcgaggtgcgtttgcttgttgactgctaacccaagg

SEQ ID NO: 6168 - DNA, 74 bp, Artificial
  Hairpin sequence MQbrain_1680, macaque
cttcttgtctattcctctctataggctggtaatcctggtggacctggacctggtggtcgaggaagaggtagagg

SEQ ID NO: 6169 - DNA, 76 bp, Artificial
  Hairpin sequence MQbrain_1681, macaque
tcaggctgccagtgatggacacgggtggacaggtcagcagagatagtggctgccagctgggacaatggtggcagga

SEQ ID NO: 6170 - DNA, 116 bp, Artificial
  Hairpin sequence MQbrain_1682, macaque
gctgggcagcccttcacgccctccagcctcttcctcttaagtagataatgcagagagtggctgtattgtgtgtctcctggggtattggcgttggtcggggggcggggggttccagc

SEQ ID NO: 6171 - DNA, 114 bp, Artificial
  Hairpin sequence MQbrain_1683, macaque
caggttttgtgttcttcctagtggaaggagcctgggagagaccaggcctccctggactgctggcctgcttttcctggggtccctggagccggaggaaggaccaggatgttgctg

SEQ ID NO: 6172 - DNA, 63 bp, Artificial
  Hairpin sequence MQbrain_1684, macaque
aagccaggggcttggactactgggtatggacttgctgtaggtctcaggtccgagcctaagctt

SEQ ID NO: 6173 - DNA, 119 bp, Artificial
  Hairpin sequence MQbrain_1685, macaque
cacggttggggaccatattccccacaatgtctagggggactccagcatggtcggggaccatattccccacagtgtctatggggactccagcatggtcggggaccatattccccacagtg

SEQ ID NO: 6174 - DNA, 103 bp, Artificial
  Hairpin sequence MQbrain_1686, macaque
tggcggctgggctgagtgggtggctggtgccgacgtttgggctacggttgttgttggcgactgtgcttcaagcggtgagtgtaggtcaccttcgcagctgcca

SEQ ID NO: 6175 - DNA, 118 bp, Artificial
  Hairpin sequence MQbrain_1687, macaque
gactccactctgggcaagatgagctctcagattgcacttcagaatcggggatgcatactcattcccctgcacccaccctttttgctgtggtcggctcgtgtttcccaggctgggcgtc

SEQ ID NO: 6176 - DNA, 68 bp, Artificial
  Hairpin sequence MQbrain_1688, macaque
gccagttctgggcagtggcttttcagcacaagggccttgtgttgaaactccctcttctgagacttggc

SEQ ID NO: 6177 - DNA, 77 bp, Artificial
  Hairpin sequence MQbrain_1689, macaque
gggtgctgtgtgcagtcaggggtctgccaccaggttcctgaggttggaggtgaggctggaggctgccacagttatcc

SEQ ID NO: 6178 - DNA, 118 bp, Artificial
  Hairpin sequence MQbrain_169, macaque
agagcagcacatttcaacagtcaaggaggaaaagaatccagtaaaggaagaaaagacgaagtctctttttcagtttgaggaatctgattctcagtgttttgagtttgaaagtgcatct

SEQ ID NO: 6179 - DNA, 72 bp, Artificial
  Hairpin sequence MQbrain_1690, macaque
gctgttctccagacactgatgtgggtggactcttcgtgagccctgcctctcaccaggctgtcccggagtggc

SEQ ID NO: 6180 - DNA, 117 bp, Artificial
  Hairpin sequence MQbrain_1691, macaque
catctggtcccctctctcctcctgcttccggggctggggccccaccatggctgcaggtccttggggcctgggagggctgcagctctaggacaagcagtggatgcagtggggcaggtg

SEQ ID NO: 6181 - DNA, 87 bp, Artificial
  Hairpin sequence MQbrain_1692, macaque
acaagggtgctgtataacaggatgtggtagctactgcagtgcaataaccccagaattgcagtagctactaacctgttttcctcttgt

SEQ ID NO: 6182 - DNA, 73 bp, Artificial
  Hairpin sequence MQbrain_1693, macaque
tggagcaaggcccctcaggccgtggacgccctcgggaggggtgactgtggcttgtgtctgggcctgagtgaca

SEQ ID NO: 6183 - DNA, 106 bp, Artificial
  Hairpin sequence MQbrain_1694, macaque
tccctggtcaaggtcatccataacaactctggcatcatgggaggaatcaggatcacagtccatgccatcactgacatccagaagactgtggatggcccctctggga

SEQ ID NO: 6184 - DNA, 115 bp, Artificial
  Hairpin sequence MQbrain_1695, macaque
gggagggagagaagaatgggtgtgtgggtgagttctttgccattttgagggcagacatgaaagttactatcagaatggtaagggagccactcacagacccaaggcaggcacccct

SEQ ID NO: 6185 - DNA, 86 bp, Artificial
  Hairpin sequence MQbrain_1696, macaque
gtctgcagaacccgctctacatgaagatcagcatctgttgaaagcaggggccagtgggtgctgacgagagaacagagttgcagcat

SEQ ID NO: 6186 - DNA, 65 bp, Artificial
  Hairpin sequence MQbrain_1697, macaque
ccagccaaaacccccaagccgggcgtggtgggtgttggcagcctggaggtggggagtggtggtgg

SEQ ID NO: 6187 - DNA, 117 bp, Artificial
  Hairpin sequence MQbrain_1698, macaque
ttacctttacctttaaaaaacgtttgtctgtttaaatcaggagctgcaggccgaaattcttatctggaagttcttctgaagatggcagacaaatacaaaaagaaaatgtgggggtaa

SEQ ID NO: 6188 - DNA, 83 bp, Artificial
  Hairpin sequence MQbrain_1699, macaque
gaccaatcctaggcttagagggcagaggttcagagtgcccaaggagcctgacgcaactgccccaagaaccctggggtccagtc

SEQ ID NO: 6189 - DNA, 110 bp, Artificial
  Hairpin sequence MQbrain_17, macaque
acaaataagagctgtctcaataaatgattcggctacgatcaccagggtatgtcgtagctaaaaggccctggtgatggtagctgaataatttattgagacaagtcttaggt

SEQ ID NO: 6190 - DNA, 76 bp, Artificial
  Hairpin sequence MQbrain_170, macaque
ctgtgacctctgcccttggaatgccattgtctggttgttactagacacccgccaatccccgggcttagcagctcag

SEQ ID NO: 6191 - DNA, 91 bp, Artificial
  Hairpin sequence MQbrain_1701, macaque
gggctgtgtatgcgcctctgcctggagggggctgtctgttggttaaagggtgtcttttccaggccctggagattgcaggcattaacagtct

SEQ ID NO: 6192 - DNA, 74 bp, Artificial
  Hairpin sequence MQbrain_1702, macaque
gatgaaccctggtcactggatggcctgaggaagagtaccagacttaactcccatctggtaaactgggtcttatc

SEQ ID NO: 6193 - DNA, 90 bp, Artificial
  Hairpin sequence MQbrain_1703, macaque
agggctgtggtttcatgtgtggtgggtcttgggtacacagttaggctgtgagtaacagaagcctagagccccatcgcgtctactagctct

SEQ ID NO: 6194 - DNA, 62 bp, Artificial
  Hairpin sequence MQbrain_1704, macaque
ctttgctgagcccagaggtctctcctcagacacacgggtggagagatctctggggaggaggg

SEQ ID NO: 6195 - DNA, 85 bp, Artificial
  Hairpin sequence MQbrain_1705, macaque
cattggagtttcctcggctgtacagcagataagatgactcccatgctgctgctgttttggtctcgcagccgtggtacatcccatg

SEQ ID NO: 6196 - DNA, 105 bp, Artificial
  Hairpin sequence MQbrain_1706, macaque
cctcaggttggcccaagggacccccgctgtaacaattccaggatggggagtcagacagactacaggatataggagaaaaggcaggggcagagcggggccgtgggg

SEQ ID NO: 6197 - DNA, 117 bp, Artificial
  Hairpin sequence MQbrain_1707, macaque
cggcagctggagcagcggttgcaggagtcctgctctgtgtgcctggccgggctggatggcttccgccggcagcagcaggaggacagggagcggctgcgagcgctggagaagctgctg

SEQ ID NO: 6198 - DNA, 90 bp, Artificial
  Hairpin sequence MQbrain_1708, macaque
atctatgaaggccaagtggaggtaactggcgatgaatacaatgtggaaagcattgatagtcagccaggtgcctttacctgcaattaggat

SEQ ID NO: 6199 - DNA, 78 bp, Artificial
  Hairpin sequence MQbrain_1709, macaque
ctgaagggcggctcggtgcgcaagctccggcgtgccaagcagctggtgctggagctgggcgaggaggcgatcttggag

SEQ ID NO: 6200 - DNA, 112 bp, Artificial
  Hairpin sequence MQbrain_171, macaque
gctgtttcaaggtctcttgaaagagtccctactccctccctgagctccgttctctctgggtttggatatgctgagagagggtagggaaaactgaaaggaacattgatcaagt

SEQ ID NO: 6201 - DNA, 113 bp, Artificial
  Hairpin sequence MQbrain_1710, macaque
agctcacgatccccagggtctcatggtgaagtcaaggccggacccagacaaagcatcagcttgtcctgggcaggcaactggtcaacctaaagaagactctgaggagcttggct

SEQ ID NO: 6202 - DNA, 98 bp, Artificial
  Hairpin sequence MQbrain_1712, macaque
ctggaggccctggtggccctggtggccctgggatggggaaccgcggtggcttccgcggaggtttcggcagtggcatccggggccgcgaggggccacgg

SEQ ID NO: 6203 - DNA, 84 bp, Artificial
  Hairpin sequence MQbrain_1713, macaque
gtctcctacggaagtctgtggctacctgggatcctcaggccatgagtcgttctgggtggctgcaatttccaaatagctaaagat

SEQ ID NO: 6204 - DNA, 59 bp, Artificial
  Hairpin sequence MQbrain_1714, macaque
aagactagctagacactcagggcctcagtgaaaacatgggtccttggtctagttttctt

SEQ ID NO: 6205 - DNA, 116 bp, Artificial
  Hairpin sequence MQbrain_1715, macaque
ctaaaggaggagcctgaggagctggcccagctggctcccaccccaggagacgccatcatctctctggatttcggtgggtgcttcttagctaagccaggcccctggaaccctgttgg

SEQ ID NO: 6206 - DNA, 106 bp, Artificial
  Hairpin sequence MQbrain_1717, macaque
gagcaggtgggtatctaaatcattaagaatgttgggaggaaggaggtcaacggtaaagaagctcctccttctaacaaacatgaatccttgaccatgaccttttttc

SEQ ID NO: 6207 - DNA, 97 bp, Artificial
  Hairpin sequence MQbrain_1718, macaque
ttctgcggaggtttcggcagtggcatccggggccggggttgcggccatggaccgggctgggccgaggccgcggagctcgcggaggcaaggccgagga

SEQ ID NO: 6208 - DNA, 97 bp, Artificial
  Hairpin sequence MQbrain_1719, macaque
tcctcagaggttttggcagtggcatccggggccggggttgcggctgtggacggggccggggccaaggctgcggagctcgcggaggcaaggccgagga

SEQ ID NO: 6209 - DNA, 98 bp, Artificial
  Hairpin sequence MQbrain_172, macaque
agtcagcctacatgcaccagctcttgggcctcaacctcctcttcctgctgtcccagaagcaggtggctgagttccacatggagttggagcggctgcct

SEQ ID NO: 6210 - DNA, 68 bp, Artificial
  Hairpin sequence MQbrain_1720, macaque
gctggtggggtagaggtggagggtgagtgggaagaagccactccatcagctttgtcttggcctttggt

SEQ ID NO: 6211 - DNA, 119 bp, Artificial
  Hairpin sequence MQbrain_1721, macaque
gctctagggacataacagccctggagggtgggtctgagggtcaggggtgcgtgtggaggctgggagccagctgggcagaatgccctgggggaatctgctctccaggggtccctgggagc

SEQ ID NO: 6212 - DNA, 91 bp, Artificial
  Hairpin sequence MQbrain_1723, macaque
gagggcatcagggtggtgcctctgattctggaatggcctctttcccctcctattcagccaaattccatgaccacaggcctctcctgctctc

SEQ ID NO: 6213 - DNA, 99 bp, Artificial
  Hairpin sequence MQbrain_1725, macaque
ttaggctcttggatgtttgttgtataaattatgctacttcactttaccatttggggagagtcaggtggcaatttgtgatggaaacttcacaattcctga

SEQ ID NO: 6214 - DNA, 115 bp, Artificial
  Hairpin sequence MQbrain_1726, macaque
ccgcgctctgctttgttgggcgtggcctcctgtgagaggggccctaggatgaggcgctatgctggattcctgggcttccttaactggagccctaccctgctgtagacgtgaaagg

SEQ ID NO: 6215 - DNA, 97 bp, Artificial
  Hairpin sequence MQbrain_1727, macaque
ggggtcctaacaaatgaccagttgagttggcctgggatagagtgagaggctgtgaactaggatcagcacgaggtgggggtcgggcaatgtggacccc

SEQ ID NO: 6216 - DNA, 85 bp, Artificial
  Hairpin sequence MQbrain_1728, macaque
cctccttcctgaggggcctcagggcatgtggggggtaggctgagaccccaccaccaaaggttgagtgaggtcctcttgattgagg

SEQ ID NO: 6217 - DNA, 116 bp, Artificial
  Hairpin sequence MQbrain_1729, macaque
ctgtcagttggtgcctcctctttctaggtgccttccagcagcccttctccccatcctccctgtaacacaggtggatgctgctctgggtgctgaggagatggtggagatgctgacag

SEQ ID NO: 6218 - DNA, 99 bp, Artificial
  Hairpin sequence MQbrain_173, macaque
ctgtccagaagcttccaccctccctcctcctgttggttttcctgatttcaggtggctgagcagtggggggaggcctctgtgggaacgctgtgtgatcag

SEQ ID NO: 6219 - DNA, 113 bp, Artificial
  Hairpin sequence MQbrain_1731, macaque
cataaggctctcgtcgacagtcttcgagcctgtttcacgccgtttgtgccgtaaggctcacaaccccgcgtaggccataggctcgcatcgacggtcccagagcctgctttatg

SEQ ID NO: 6220 - DNA, 118 bp, Artificial
  Hairpin sequence MQbrain_1732, macaque
ctctgtggactctgtagggtgaaatgtggagcagtctgtggactctgtagggtgaaatgtggagcagtctgtggactctgtagggtgaaatgtggggcagtctgtggactctgtaggg

SEQ ID NO: 6221 - DNA, 120 bp, Artificial
  Hairpin sequence MQbrain_1733, macaque; MQbrain_1735, macaque
ataaacgccgtaaggctctcgtcgacagtcttcgagcctgtttcacgccgtttgtgccgtaaggctcacaacgccgcgtacgccataggctcgcatcgacggtcccagagcctgctttat

SEQ ID NO: 6222 - DNA, 68 bp, Artificial
  Hairpin sequence MQbrain_1734, macaque
tgcccccgggccaggcaagccggctctctctacaaagaaccccggcgtggtggcctaccagggaggcg

SEQ ID NO: 6223 - DNA, 74 bp, Artificial
  Hairpin sequence MQbrain_1736, macaque
ccctggatccatggtctgtggatcccaatgttctgactggagacggggagccagcgagacctggggctccaggg

SEQ ID NO: 6224 - DNA, 66 bp, Artificial
  Hairpin sequence MQbrain_1738, macaque
aggagaaggggagtcgatggaatggtatgaatgctacatgatctattccacccactgccctctctt

SEQ ID NO: 6225 - DNA, 90 bp, Artificial
  Hairpin sequence MQbrain_174, macaque
gggacctggggaggcctaggataggatgggcaggtggggccagagaaagctggctctgtttggtgctcctggctggttttcaaatgtctt

SEQ ID NO: 6226 - DNA, 113 bp, Artificial
  Hairpin sequence MQbrain_1740, macaque
ggacgacgtgcgggttcaggaggtgcccaaactgaaggtatgtgcactgcgtgtaaccagccgggcccgcagccgcatcctcagggcagggggcaagatcctcactttcgacc

SEQ ID NO: 6227 - DNA, 64 bp, Artificial
  Hairpin sequence MQbrain_1741, macaque
tggcagtgggtagtggtggggctggggcggacacctccttccagcctgtcctgcccacgcgcca

SEQ ID NO: 6228 - DNA, 118 bp, Artificial
  Hairpin sequence MQbrain_1742, macaque
ctatggactctgtagggtgaaatgtggagcagtctgtggactctgtgtagactgaaatgtggagcagtctatgaactctgtagggtgaaatgtggagcagtctgtggagtctgtgtag

SEQ ID NO: 6229 - DNA, 79 bp, Artificial
  Hairpin sequence MQbrain_1744, macaque
agccctgggtcaagggcctgccttcacctcagggactctcttcctttgggtgagggggtccttgggtttcccagatgct

SEQ ID NO: 6230 - DNA, 79 bp, Artificial
  Hairpin sequence MQbrain_1745, macaque
agccctaggtcaagggcctgccttcgcctcagggactttcttcctttgggtgagggggtccttggatttcccagatgct

SEQ ID NO: 6231 - DNA, 114 bp, Artificial
  Hairpin sequence MQbrain_1746, macaque
gcttctgatttgcggcttgggctcctggcactggcttctcttctctgtgtccttagcatttgagagaagaggccaggggccttgttcatggagccctggacccaaggcagatgt

SEQ ID NO: 6232 - DNA, 83 bp, Artificial
  Hairpin sequence MQbrain_1747, macaque
ggtggacccgacctgccgtctggaaaaacctgccaaatatgatcacatcaagaaggtggtgaagcaggcgtcggagggcctcc

SEQ ID NO: 6233 - DNA, 94 bp, Artificial
  Hairpin sequence MQbrain_175, macaque
gcccagccccgccttgtccatccctgcaggggaatactgtggagctcccagaggaggagaacactcctgagaagagggtggaccggatctttgc

SEQ ID NO: 6234 - DNA, 116 bp, Artificial
  Hairpin sequence MQbrain_1750, macaque
agctggtagcctattaataagcactggtctaacacagccaaccctcccccacagcgccatgttaatggaggaggggaggaaggtgaaatctactgcatgggattcaggaaacagtt

SEQ ID NO: 6235 - DNA, 116 bp, Artificial
  Hairpin sequence MQbrain_1752, macaque
tgtgcagggtatgtccttgaacttggaatctgacaatgttggtgttgtcgtgtttggaaatgataaactgattaaggaaggagatatagtgaagaggacaggagccattgtggacg

SEQ ID NO: 6236 - DNA, 99 bp, Artificial
  Hairpin sequence MQbrain_1753, macaque; MQbrain_1882, macaque; MQbrain_1893, macaque
gggtttagatgtagattctctggtcatcgagcatatccaagtgaacaaagcacctaagatgcgccgacgaacctacagagctcatggtcgcattaaccc

SEQ ID NO: 6237 - DNA, 75 bp, Artificial
  Hairpin sequence MQbrain_1754, macaque
gggtcccgtggccggggggcatggccgtgtggcttggaggccgcatgaccaatgcccccacagcctgccacatcc

SEQ ID NO: 6238 - DNA, 69 bp, Artificial
  Hairpin sequence MQbrain_1755, macaque
ggctctggcagggactggtggggacgcggggagcggcccaggcccctgccccgccgggcttagcctccc

SEQ ID NO: 6239 - DNA, 99 bp, Artificial
  Hairpin sequence MQbrain_1756, macaque
cggtgcccgagtacacaggtgagcgggggctctgggtgatgtggggagcaacaggcacccacctccatggcccctgctcattcctgctgtcctccgccg

SEQ ID NO: 6240 - DNA, 76 bp, Artificial
  Hairpin sequence MQbrain_1757, macaque
ctacccctggcaaccccatgctggcctcatggcccactggggaagtgtggctaagcacggtggcccccagccctag

SEQ ID NO: 6241 - DNA, 98 bp, Artificial
  Hairpin sequence MQbrain_1758, macaque
acaaatggttcccagtttttcatctgcactgccaagattgagtggttggatggcaagcatgtggtctttggcaaagtgaaagaaggcatgaatattgt

SEQ ID NO: 6242 - DNA, 114 bp, Artificial
  Hairpin sequence MQbrain_176, macaque
ttccttccgtagttctcatgcaagggaggggttcgacttgcaaccgaccagaaaccaagcactggcgcaagatttgctcaagcccctcctcttggccaaactttccggagggga

SEQ ID NO: 6243 - DNA, 92 bp, Artificial
  Hairpin sequence MQbrain_1760, macaque
ctccataatgctcccaacacctgtgacccctaggaaaacagggagcaaggtagatctggccaggagtcacaggatatacacccattctggag

SEQ ID NO: 6244 - DNA, 80 bp, Artificial
  Hairpin sequence MQbrain_1761, macaque
ctatgttttccccaagtggggccagggcgtgggctggctgatggctctgtcttccatggtcctcatccccgggtacatgg

SEQ ID NO: 6245 - DNA, 75 bp, Artificial
  Hairpin sequence MQbrain_1762, macaque
gttctctcccatccttgcccctggttcaggagccattctacctgctcctgtggccaggcgcaaggctacaggtgc

SEQ ID NO: 6246 - DNA, 111 bp, Artificial
  Hairpin sequence MQbrain_1763, macaque
ctgggagttgtttatatagatagtgatcagggagctcactgttttcatcttgttatagatagtgatcagggagctcgctgttttcatcttgttttagtgtgaggcttctag

SEQ ID NO: 6247 - DNA, 111 bp, Artificial
  Hairpin sequence MQbrain_1764, macaque
cctgtggctgtgtggtttggggccacggagcggaggcttcaacgtggacagttcaagtacaccttcgaccccaacatcacctctgctggccccaccaagagcttcctcagg

SEQ ID NO: 6248 - DNA, 66 bp, Artificial
  Hairpin sequence MQbrain_1765, macaque
tgaggggggcatccggccctggcacctggtgaaaccaagtgatgagccggagccgcccaggcctcg

SEQ ID NO: 6249 - DNA, 57 bp, Artificial
  Hairpin sequence MQbrain_1767, macaque
aagctggtggtggtgggggatgggggcgtgggcaaaagtgccctcaccatccagttt

SEQ ID NO: 6250 - DNA, 117 bp, Artificial
  Hairpin sequence MQbrain_1768, macaque
aggaatggggcgactctgggctgctccgggtgggaaccataagggtctgtgctgtctctgagcaccgtctcttctgtttcccaggatcctgcaggcccaggtgccgcctgtgttcct

SEQ ID NO: 6251 - DNA, 86 bp, Artificial
  Hairpin sequence MQbrain_1769, macaque
gttcccagtttttcatctgcactgccaagactgagtggttggagggcaagcatgtggtctttggcaaagtgaaagaaggcatgaat

SEQ ID NO: 6252 - DNA, 92 bp, Artificial
  Hairpin sequence MQbrain_177, macaque
ttctggctgtctcagcggctgctcaaggtcaaggaacaaacagataaaccctttctctggaaccggctcggagaggacgcctccagctagaa

SEQ ID NO: 6253 - DNA, 105 bp, Artificial
  Hairpin sequence MQbrain_1770, macaque
ggcctcactccctctcagacctgcctgggcttttggagcacgagtgaggctgaggctttcacttcctctcagacctgcctgggcttttggagcacgagggtggcc

SEQ ID NO: 6254 - DNA, 113 bp, Artificial
  Hairpin sequence MQbrain_1771, macaque
gctgctgctccgaggcctggccacgtgcagacaggaggaagctgagctcgtcattgggcctcaaggctgccatgtgtctcgtagggcctggtgggcagggggcagtcctgtgc

SEQ ID NO: 6255 - DNA, 66 bp, Artificial
  Hairpin sequence MQbrain_1772, macaque
gggtgggctccatgacgctggccgtgcccgagctcttgctgtggcagctggcacaggagcctgccc

SEQ ID NO: 6256 - DNA, 97 bp, Artificial
  Hairpin sequence MQbrain_1773, macaque
agctcgagccaggcttgctattggggcagggaggtgcctggtccagtctactgccacctctcactctccccttcttccccaggctgctgctcctgct

SEQ ID NO: 6257 - DNA, 76 bp, Artificial
  Hairpin sequence MQbrain_1774, macaque
cactgtgtttggaggtgtctgtgtggggacactgtgtttggaggtgtctctgtgtggggacactgtgttggaggtg

SEQ ID NO: 6258 - DNA, 84 bp, Artificial
  Hairpin sequence MQbrain_1776, macaque
gttggtggtggctggtgtggctgtgtgctgagggtctgtggtccctgcgactctcaggatgccgctgcacgtgccgccaccggc

SEQ ID NO: 6259 - DNA, 75 bp, Artificial
  Hairpin sequence MQbrain_1777, macaque
gtcctggggagattggatggggatggcagcgttctgcatgacagaggcactgccgggccccgggtctgtgggggc

SEQ ID NO: 6260 - DNA, 117 bp, Artificial
  Hairpin sequence MQbrain_1778, macaque
acctgctgtctccgcccctctgcagagcacaagtgcaatgcctcatctcagttcctgtgcagcagcgggcgctgtgtggctgaggtactgctctgcaatggccaggatgactgtggt

SEQ ID NO: 6261 - DNA, 77 bp, Artificial
  Hairpin sequence MQbrain_1779, macaque
ggaagagccttagacctgggtgggccttcaggggcatctagacccctgcacagcccgggcctggtgtccacatctcc

SEQ ID NO: 6262 - DNA, 116 bp, Artificial
  Hairpin sequence MQbrain_178, macaque
ggctcaggccctgcttgcagggggctggcccctcttttgatgcctgtgccctgtcctcattctgttctctgtcttgccaggtgatctctctggccacctccttgcctacctgagcc

SEQ ID NO: 6263 - DNA, 116 bp, Artificial
  Hairpin sequence MQbrain_1780, macaque
tcgcccactctgcactggggcgtttcccactgcgcctcgtgccggcggacgcagctgggtggagaagctatggggttggagaggcgtttggagaaggtctgtggtgcagtgtgtga

SEQ ID NO: 6264 - DNA, 103 bp, Artificial
  Hairpin sequence MQbrain_1781, macaque
ctggtgccccttgccgatctgagcacttggccaagtacaaccagctcctcagaattgaagaggagctgggcagcaaggctaagtttgccggcaggaacttcag

SEQ ID NO: 6265 - DNA, 98 bp, Artificial
  Hairpin sequence MQbrain_1782, macaque
tgtacgagcagctgtctgggaagtagggggttagcttggggacctcaactgtcctggaggacccaagccctgtttcccagttcagtgttgcatgtata

SEQ ID NO: 6266 - DNA, 72 bp, Artificial
  Hairpin sequence MQbrain_1783, macaque
gcatcatgctgtctggagaaacagccaaaggggactatcctctggaggctgtgccatgcagcacctgattgc

SEQ ID NO: 6267 - DNA, 83 bp, Artificial
  Hairpin sequence MQbrain_1784, macaque
ctgcatgttagtctaacgttctgatagaaatgacatgcatttttgctgccatttgttactatcaggactcgactcgtgtgcgg

SEQ ID NO: 6268 - DNA, 116 bp, Artificial
  Hairpin sequence MQbrain_1785, macaque
tggacccaacacaaatggttcccagtttttcatctgtactgccaagactgagtggttggatggcaagcatgtggtctttggcaaagtgaaagaaggcatgaatattgtggaggcca

SEQ ID NO: 6269 - DNA, 61 bp, Artificial
  Hairpin sequence MQbrain_1786, macaque
cggagacttcttcagctacacccgccatgaacctgtgggggtgtgcgggcagatcattccg

SEQ ID NO: 6270 - DNA, 78 bp, Artificial
  Hairpin sequence MQbrain_1787, macaque
tcccattgacatcctcccccaacactccctctccgggcctctgttgcccctcctgttgggtgagggtgttgagtgtga

SEQ ID NO: 6271 - DNA, 86 bp, Artificial
  Hairpin sequence MQbrain_1788, macaque
gttcccagtttttcatctgcactgccaagaccgagtggttggatggcaagcatgtggtctttggcaaagtgaaagaaggcatgaat

SEQ ID NO: 6272 - DNA, 85 bp, Artificial
  Hairpin sequence MQbrain_1789, macaque
atcatggagcagcagttctaccgtgcagcaagagccaacctaaggccatagcaagcaagagtgagaatctgttgttccagctgat

SEQ ID NO: 6273 - DNA, 110 bp, Artificial
  Hairpin sequence MQbrain_179, macaque
ctcaggaagccccaggtgcactcagtgagagccctgcctttcaattgccaaaagctgcatgggggaatgcagcaaggcacacagagctctggcagcccctggggactggg

SEQ ID NO: 6274 - DNA, 92 bp, Artificial
  Hairpin sequence MQbrain_1790, macaque
cgggtccccccgcacccctcctcagaacggcgcgcagtgtacatcggggcactgtttcccatgagtgggggctggccagggggccaggcctg

SEQ ID NO: 6275 - DNA, 81 bp, Artificial
  Hairpin sequence MQbrain_1791, macaque
ccttcatcggcaacagcacggccatccaggagctcttcaagcgcatctcggagcagttcactgccatgttccgccggaagg

SEQ ID NO: 6276 - DNA, 85 bp, Artificial
  Hairpin sequence MQbrain_1792, macaque
ccaggggcagcgcctggaagattcaggagcctgggcggccttcacttactctcacctgcttctgagttgcccaggaggccactgg

SEQ ID NO: 6277 - DNA, 108 bp, Artificial
  Hairpin sequence MQbrain_1793, macaque
ggtgagccagcggttcgaacagctctgtttacagcagcaagaaaaggagagctccctaaagaagcttctgccccaggcagagatgtttgaacatctctctggtaagct

SEQ ID NO: 6278 - DNA, 81 bp, Artificial
  Hairpin sequence MQbrain_1794, macaque
ccaggcaccctggtttgtttggagcattgctgcccagaagcttctatgggataggtggtgcttgggattgatgtgttctgg

SEQ ID NO: 6279 - DNA, 98 bp, Artificial
  Hairpin sequence MQbrain_1795, macaque
tgtacgagcagctgtctgggaagtagggggttagcttggggatctgaagtgtcctggaggccccaagccctgttcccgagttcagtgttgcatgtata

SEQ ID NO: 6280 - DNA, 118 bp, Artificial
  Hairpin sequence MQbrain_1796, macaque
cccatgccactgggtggaagggcagaaggtatgagagcgttaccggggcccatgccactgggtggaagggcagaaggtatgagagcgttaccggggcccatgccactgggtggaaggg

SEQ ID NO: 6281 - DNA, 94 bp, Artificial
  Hairpin sequence MQbrain_1798, macaque
tcaaagcaagagatggctagtgcttcatccagccaaagaggttgaagtggttctggaaactttggtggtggtcgtggaggtggtttcggtggga

SEQ ID NO: 6282 - DNA, 119 bp, Artificial
  Hairpin sequence MQbrain_1799, macaque
accctgtgaactcgccttttctacagtgtgaccctgtgaactcgccttttctacagtgtgaccctgtgaactaggcttttctacagtgtgaccctgtgaactaggcttttctacagtgt

SEQ ID NO: 6283 - DNA, 116 bp, Artificial
  Hairpin sequence MQbrain_18, macaque
tcatgtcgtaaaattgacttcatagttattggggttagggaggtggggaagagataatctttctgattacctgttttgtctggatggctggttttgaggttttaaacctgacttga

SEQ ID NO: 6284 - DNA, 92 bp, Artificial
  Hairpin sequence MQbrain_180, macaque
ggttgcaacagggaggtcttgtctcccctcctgggctttcctcctgccctgtgggcagcagcctgggctgggtcaggagcttccctaagatc

SEQ ID NO: 6285 - DNA, 92 bp, Artificial
  Hairpin sequence MQbrain_1800, macaque
gaggcccctgccatggggcactcaccctgcaggacagacagagggatggatggatggatggacaggctggaggcccctgccatggggcactc

SEQ ID NO: 6286 - DNA, 112 bp, Artificial
  Hairpin sequence MQbrain_1801, macaque
tcagaatgcaagatcaggaagcaaagagcagctcaggaaatcccacggttgacttgccttgctggcaagcttggtggagagggctgaagctgttgctggtggccggttctga

SEQ ID NO: 6287 - DNA, 94 bp, Artificial
  Hairpin sequence MQbrain_1802, macaque
tcaaagcaagagatggctagtgcttcatccagccacagaggttgaagtggttctggaaactttggtggtggtcgtggaggtggtttcggtggga

SEQ ID NO: 6288 - DNA, 93 bp, Artificial
  Hairpin sequence MQbrain_1803, macaque
gttcctgtgaacaatgcactgggaagggtggagatcaggtcccggcctggaatatatttcctccccccctggagctttgattttgcactgagc

SEQ ID NO: 6289 - DNA, 71 bp, Artificial
  Hairpin sequence MQbrain_1804, macaque
ctggcggccgtggtggagggagacgctgttccttgtggagactagctcaccgtcgctttcctggccgccag

SEQ ID NO: 6290 - DNA, 61 bp, Artificial
  Hairpin sequence MQbrain_1806, macaque; MQbrain_1840, macaque
gctgcagaacaaggagcatgtgattgaggccctgtgcagggccaagttcaagctccccagc

SEQ ID NO: 6291 - DNA, 77 bp, Artificial
  Hairpin sequence MQbrain_1807, macaque
cttgaggaacttcctccttttccagctttgggagtcaaggtgagactcccggggacctaggtaggaagtatctgaag

SEQ ID NO: 6292 - DNA, 101 bp, Artificial
  Hairpin sequence MQbrain_1808, macaque
gggttctccatcctgctgtggattggggccatcctctgcttcctggcctacggcatccaggctgccatggaggatgaaccatccaacgacaatgtgagccc

SEQ ID NO: 6293 - DNA, 93 bp, Artificial
  Hairpin sequence MQbrain_1809, macaque
tatctaacatttgtgctctgcaggcagctttgcccattctctaagcctggcttagaaggccctgggaatgtcctgtagagagagacctagata

SEQ ID NO: 6294 - DNA, 72 bp, Artificial
  Hairpin sequence MQbrain_1810, macaque
aggaggacggggccttggaggagacgcagggaagccctcggggcaacctgcccctgaggaagctgtcctctt

SEQ ID NO: 6295 - DNA, 91 bp, Artificial
  Hairpin sequence MQbrain_1811, macaque
gtgctcttccatttggaattgcaacccgtgagttcagaaggcacattgtgccacgctgagctccaggggtgcgaccaggggaagatgggac

SEQ ID NO: 6296 - DNA, 113 bp, Artificial
  Hairpin sequence MQbrain_1812, macaque
gacaggttctgtcaggggtgacaccaggagagagggacaggttctgtcggggtgaccaggagaaagggacaggttctgttgggggtgacaccaggaaagggacagtttctgtc

SEQ ID NO: 6297 - DNA, 102 bp, Artificial
  Hairpin sequence MQbrain_1815, macaque
tgtatccggtgaccgagagctcctacagtgcctatgccatcatgctcctggcgctggtggtatttgcggtgggcatcgtgggcaacctgtcggtcatgtgca

SEQ ID NO: 6298 - DNA, 66 bp, Artificial
  Hairpin sequence MQbrain_1817, macaque
ctgcagaacaaggagcatgtgattgaggccctgtgcagggccaagttcaagctccccagctgccag

SEQ ID NO: 6299 - DNA, 100 bp, Artificial
  Hairpin sequence MQbrain_1819, macaque
cgccgtggctggcgtcaagggcgacaaggctgacaaggcgtcggcgtcggccccggcgccggcctcggccaccgagatcctgctgacgccggctagggtg

SEQ ID NO: 6300 - DNA, 98 bp, Artificial
  Hairpin sequence MQbrain_182, macaque
tccacaaagatcgcgtgaatgacgtctgcaccaatggacaagacctcattaagaaggtgagtccagcccatcggtaagacctccatcacccactggga

SEQ ID NO: 6301 - DNA, 69 bp, Artificial
  Hairpin sequence MQbrain_1820, macaque
gcccacagttgcactgacagcccaaggggaaggaccagttctgggagctgcgcatgtgaggccctgggc

SEQ ID NO: 6302 - DNA, 72 bp, Artificial
  Hairpin sequence MQbrain_1821, macaque
gtagctgcagccgctgcagcccgagctgactgagagggcgggaggcagctcgggtggcggggcggggcgaac

SEQ ID NO: 6303 - DNA, 85 bp, Artificial
  Hairpin sequence MQbrain_1823, macaque
catggtttggtgccagccccttcacctccttccagagcctgagatcaatgctcaagttttggaggacatggtcaccatccccatg

SEQ ID NO: 6304 - DNA, 66 bp, Artificial
  Hairpin sequence MQbrain_1824, macaque
ctgaggcagtgggctgggtagggcccctggggttggaggggcctttgacagtctttctctgcccag

SEQ ID NO: 6305 - DNA, 76 bp, Artificial
  Hairpin sequence MQbrain_1825, macaque
atgcagaggaggcacgccttcttcatgtcaaggagaccatgcagattgatgagaggaagcggccttacaatagcat

SEQ ID NO: 6306 - DNA, 119 bp, Artificial
  Hairpin sequence MQbrain_1826, macaque
gattttgttttgttgcatatttattggattgcttgcagaagaatgaagttttctggccctctggaaatttttttttctcctgagaggttttccaatctagtagaaatagacgcagagtt

SEQ ID NO: 6307 - DNA, 115 bp, Artificial
  Hairpin sequence MQbrain_1827, macaque
ctgcggcgagaggtggaggagctgaggagcagcctgcgaggacttgccggggagattgttggggaggtccggtgagtaatgcagcttcctctcccgctttatccctcccctgcag

SEQ ID NO: 6308 - DNA, 75 bp, Artificial
  Hairpin sequence MQbrain_1828, macaque
ttccacacgtaggtgtccctggcttttgtggccaaagctggtgttatggtcaacaacgggccagggcctgtgggg

SEQ ID NO: 6309 - DNA, 102 bp, Artificial
  Hairpin sequence MQbrain_1829, macaque
gggaagaagctcaaggtttcctgcgtcttcttgcctgtcatcagcacagggctggcagctctgctgaatgcagcctctgaagcccaggagctgcttctttcc

SEQ ID NO: 6310 - DNA, 86 bp, Artificial
  Hairpin sequence MQbrain_1830, macaque
gttcccagtttttcatctgcactgccaagactgagtggttggatggcaatcatgtggtctttggcaaagtgaaagaaggcatgaat

SEQ ID NO: 6311 - DNA, 100 bp, Artificial
  Hairpin sequence MQbrain_1831, macaque
gttcatcaattatgtgaagaattgcttctggatgactgaccaagaggctattcaagatctctggcagtggaggaagtctctttaagaaaatagttaaaac

SEQ ID NO: 6312 - DNA, 99 bp, Artificial
  Hairpin sequence MQbrain_1832, macaque
agtgactgactgtgtgctgagggagggaagcagtccaggaaggagtgtctccacatgccacttctgcctctgtcttcttcccttcatccccgtcccact

SEQ ID NO: 6313 - DNA, 92 bp, Artificial
  Hairpin sequence MQbrain_1833, macaque
tgccgaggtaggaaaggccagccccagacgtcctatcgccacaacgccatgtcgcggtaggaagcaggggccggccatcgctaccttcagca

SEQ ID NO: 6314 - DNA, 117 bp, Artificial
  Hairpin sequence MQbrain_1834, macaque
gagacccttggcttctccttctcctactccctgtctttctggcattttgtagcttgttagattttctgccagaggggtgggtcagagcagtggagaggagacatcgcccatgtgctt

SEQ ID NO: 6315 - DNA, 65 bp, Artificial
  Hairpin sequence MQbrain_1836, macaque
ccacgtgtgcctgggtggcctgttcgtgccggaggcgtacatcacggccaccaggcagtacgtgg

SEQ ID NO: 6316 - DNA, 88 bp, Artificial
  Hairpin sequence MQbrain_1837, macaque
tcttgcatctgacaccaaatgcctggctacatgccacccaggtgcgacccgctccagggacagtgccaggtggggagtttgactagga

SEQ ID NO: 6317 - DNA, 64 bp, Artificial
  Hairpin sequence MQbrain_1838, macaque
tgcccggctgggggaagaggggtttgcccttctcggagggtacctcctgttccctgtctgagca

SEQ ID NO: 6318 - DNA, 115 bp, Artificial
  Hairpin sequence MQbrain_1839, macaque
cgatcctgaccagccacgagaggaccctgcggaggaggagaaggaggagaaggacgcgcccgaggtgcatctcctgttccatttcctgcaagtcctcaccgcctgtttcgggtcg

SEQ ID NO: 6319 - DNA, 95 bp, Artificial
  Hairpin sequence MQbrain_184, macaque
ccgcccccagagcccccagcagggccctccgaggtggagcagcagctacaagcggaggctgagcacctacggaaggagctggagagtctggcagg

SEQ ID NO: 6320 - DNA, 92 bp, Artificial
  Hairpin sequence MQbrain_1842, macaque
caggagaaggtgggcctgggtcggtggggacggggcggctgggcgtgccctgcggccgctgctctaaccgcaccgtcccccaggcccttctg

SEQ ID NO: 6321 - DNA, 118 bp, Artificial
  Hairpin sequence MQbrain_1843, macaque
gttgctcgagccccatgtcctggccctgagccgtgctttcccaccaggctcaagaccatcagcctggtgatccacagcacgcagggagccgaggaggtgctcagggcccacgaggagc

SEQ ID NO: 6322 - DNA, 87 bp, Artificial
  Hairpin sequence MQbrain_1845, macaque
catctggctgtgcagccttgctctgtggcttttcccaacacagtcagtgctattgctggggaagggacaggcaagagcagtcagttg

SEQ ID NO: 6323 - DNA, 87 bp, Artificial
  Hairpin sequence MQbrain_1846, macaque
catctggctgtgcagccttgctctgtggcttttcccaacacaatcagtcctattgctggggaagggacaggcaagagcagtcagttg

SEQ ID NO: 6324 - DNA, 110 bp, Artificial
  Hairpin sequence MQbrain_1847, macaque
cttgactggaggccatcaaccctcttggctggggccttgttctgagccctgacatgtgcttgggcactggtgggcctgggcttctgaggtggcctcctgccctggtcagg

SEQ ID NO: 6325 - DNA, 93 bp, Artificial
  Hairpin sequence MQbrain_1848, macaque
ggtctgctgggtgtgggttggacgctggggtgtgggttggatgctgtctgcagcccacttgggcacccatgcttctgtctacttctggttgcc

SEQ ID NO: 6326 - DNA, 84 bp, Artificial
  Hairpin sequence MQbrain_1849, macaque
caggagaggcagcccatcttggccctggatgaaaaaggaagcccacagaggcccagggcttgtcactgtggctgccagtgtctg

SEQ ID NO: 6327 - DNA, 79 bp, Artificial
  Hairpin sequence MQbrain_185, macaque
ccagaggctcatagaattgacttgtttggaggaggcctgatggcctccttactctcaccaaagcaatttttccctcagg

SEQ ID NO: 6328 - DNA, 93 bp, Artificial
  Hairpin sequence MQbrain_1850, macaque
tgatgtgctaaacaaacatttggaggttaattagcagcatgactaatttagtcattgctgccagtcaccttcaaacaagtatcagtagcttca

SEQ ID NO: 6329 - DNA, 97 bp, Artificial
  Hairpin sequence MQbrain_1851, macaque
agattcagaggcaccggccccgctgccttctcttcagactctttgcatttcagtgaagagcctggaagaaacccaggggcctcctatgcacagatct

SEQ ID NO: 6330 - DNA, 118 bp, Artificial
  Hairpin sequence MQbrain_1853, macaque
gtataggacctaatctgtaatcttaagctgtgcagagccttgaggatggccatcgtttgttgtttatggcttcctccttgatctttgatgaaagaaggattgccttaggtgcttatat

SEQ ID NO: 6331 - DNA, 59 bp, Artificial
  Hairpin sequence MQbrain_1855, macaque
ccctcctttttttccctatcactgaagctttttagtgcattagtggggaagagggtggg

SEQ ID NO: 6332 - DNA, 115 bp, Artificial
  Hairpin sequence MQbrain_1856, macaque
ccacaatcagtcgtgctgtgggcagtgctctattcagaaaggtgccagtcacttagattacatgtcactgtttcctttctgagtggagtaaggcttaccaagtacaagtgtgtgg

SEQ ID NO: 6333 - DNA, 115 bp, Artificial
  Hairpin sequence MQbrain_1858, macaque
gggagcctgctggagcggctgtgcctcctggcatggcgcctcctctgcccaccgtcctgtccactgggcagtgagcagccagccagcaggtgcagctcctcatctgcggagcctc

SEQ ID NO: 6334 - DNA, 84 bp, Artificial
  Hairpin sequence MQbrain_1859, macaque
gctcagaaccccagcagtcccttcctttcactaccttcttttttgggggtagttggaagggactgaagttgtggggggaaaggt

SEQ ID NO: 6335 - DNA, 84 bp, Artificial
  Hairpin sequence MQbrain_186, macaque
agtcctgatggtcacctgcatcacttcctgctggctgttagaggaactccagtagcaggaagaaggagatcgggccccagggct

SEQ ID NO: 6336 - DNA, 88 bp, Artificial
  Hairpin sequence MQbrain_1860, macaque; MQbrain_1891, macaque
ctcagaaccccagcaatcccttcctttcactaccttcttttttgggggtagttggaagggactgaaattgtggggggaaaggtaggag

SEQ ID NO: 6337 - DNA, 86 bp, Artificial
  Hairpin sequence MQbrain_1861, macaque
ttggtggtttcagggagtgtacttcctgaggcctctgggtataaaattcctgtggcctctgggtgtgtaccctctgtggcttccag

SEQ ID NO: 6338 - DNA, 102 bp, Artificial
  Hairpin sequence MQbrain_1862, macaque
ctagagatgatgcattagctgttcttttttcttcttttctcacagcagtattgagcccaggcttctgtgggagagagtggagaagctggtgcccagacctgg

SEQ ID NO: 6339 - DNA, 119 bp, Artificial
  Hairpin sequence MQbrain_1863, macaque
ttggggagacgttgggtgacgttccctggtgagagtaagatggttttggggagacgttgggtggcgttccctggagagagtaggatggtttgggggagacgttgggtggcgttccctgg

SEQ ID NO: 6340 - DNA, 117 bp, Artificial
  Hairpin sequence MQbrain_1864, macaque
ggggagacgttgggtgacgttccctggagagagtaagatggttttgggggagacgttgggtgacgttccctggagagagtaagatggttttgggggagacgttgggtgacgttccct

SEQ ID NO: 6341 - DNA, 108 bp, Artificial
  Hairpin sequence MQbrain_1865, macaque
ctgtgctgtgtgccaatctttcgtttgcctcagacaggtatctcttcgttatcagaagagttgcttcatttcatctgggagcagaaaacagcaggcagctgttaacag

SEQ ID NO: 6342 - DNA, 105 bp, Artificial
  Hairpin sequence MQbrain_1866, macaque
cagggagagttgcgtcatttaaagcctagttaatcttaacgcgtttgctaaacgcagacgaaaaataggaaagattaattgggagtggtaggatgaaacaatctg

SEQ ID NO: 6343 - DNA, 62 bp, Artificial
  Hairpin sequence MQbrain_1867, macaque
aggacgtgagtagggctagggaggggctgcaggccgttcaggagccctttggctcctgtctt

SEQ ID NO: 6344 - DNA, 106 bp, Artificial
  Hairpin sequence MQbrain_1868, macaque
gacctgtgtttgcccggggagagtcagggttctcctgtcagctgggtcccctcccgaccctgggaggctgcctctggagccctgcctcttcttggcagggagcatc

SEQ ID NO: 6345 - DNA, 87 bp, Artificial
  Hairpin sequence MQbrain_1869, macaque
ggcttcaaagcagagggccctgaagtggatgtgaacttacccaaggctgacattgatgtctcaggacccaaggtggatgtcgaagtc

SEQ ID NO: 6346 - DNA, 94 bp, Artificial
  Hairpin sequence MQbrain_187, macaque
ccagggcttctcaaggggtactacaactcccaaggtacatacaaagcaattgtggtgcacactgggaattgtagtccttgagctctcaatttgg

SEQ ID NO: 6347 - DNA, 66 bp, Artificial
  Hairpin sequence MQbrain_1870, macaque
ggctggtgcccggtgctggaggagtggcctgttggctgctcgtctggggggtgggtttgctttgct

SEQ ID NO: 6348 - DNA, 109 bp, Artificial
  Hairpin sequence MQbrain_1872, macaque
tgcgaggtcgtggtgtctgggaaactccgaggacagagggctaaatccatgaagtttgtggatggcctgatgatccacagcggagaccctgttaactactacgttgaca

SEQ ID NO: 6349 - DNA, 102 bp, Artificial
  Hairpin sequence MQbrain_1873, macaque
ccaagcccctctcccatctccccctcgcgcttctctctcgcagtctcctcctcccaaaccgcgagcgaaaagggcgagggggagaggagtctcggcgtctgg

SEQ ID NO: 6350 - DNA, 82 bp, Artificial
  Hairpin sequence MQbrain_1875, macaque
gctcctgctctccctctcccttctccaggccacggatttcatgtccctgtgactggtggggcccatggaggagataggaagc

SEQ ID NO: 6351 - DNA, 98 bp, Artificial
  Hairpin sequence MQbrain_1876, macaque
cggcccaggcctgcagccagggctactccgcccgctgcgccccaggtaagccgggccagcgtgggggagtagcggggcctgggctgcggagggggccg

SEQ ID NO: 6352 - DNA, 85 bp, Artificial
  Hairpin sequence MQbrain_1877, macaque
tccttggaagctcttggccctgaggactttgcctggggcattggccctgccatggcgttccggagggctgagggcacgtccatga

SEQ ID NO: 6353 - DNA, 73 bp, Artificial
  Hairpin sequence MQbrain_1878, macaque
ggccgccgggtctcccggctcaagcctgccgggcctcaacgaaacccccgcagagccgccgggacgcagcgcc

SEQ ID NO: 6354 - DNA, 94 bp, Artificial
  Hairpin sequence MQbrain_1879, macaque
attgttttttttagattcgctcgggcctagccgtcctcggagcccgatattcgggctgggcggttccgcggcctgggcctaggggcttaacagt

SEQ ID NO: 6355 - DNA, 91 bp, Artificial
  Hairpin sequence MQbrain_188, macaque
gaactgcactgagcttcgggtctgcagccctctggtagaacctatggttttgccttgggcctcctgtttctgtgtggctttcttgcttttc

SEQ ID NO: 6356 - DNA, 108 bp, Artificial
  Hairpin sequence MQbrain_1880, macaque
gtccctggctgcagtgccaggcgtggcctttcatgtggcagcaagtcacttactgtgtctccagcttcacaggaaggctcttgtctgtcaggcagtggagttacagac

SEQ ID NO: 6357 - DNA, 76 bp, Artificial
  Hairpin sequence MQbrain_1881, macaque
tcccttgctctccccaaaggaccccactcctttctaaggagaatggcccagtcctttcccgagtccacacagggga

SEQ ID NO: 6358 - DNA, 93 bp, Artificial
  Hairpin sequence MQbrain_1883, macaque
aacttgaggctatgtagcctgcaaatgccctgcagtctgcagtgttctactgtgaactgcttgtgtgttggcaggctaccggtaagaatggtt

SEQ ID NO: 6359 - DNA, 91 bp, Artificial
  Hairpin sequence MQbrain_1884, macaque
tcgccctggtatgatgccagcaccccatatggggggccctcccatgatgccaatgatgggccctcctcctcctgggatgatgccagtggga

SEQ ID NO: 6360 - DNA, 67 bp, Artificial
  Hairpin sequence MQbrain_1885, macaque
ctgtcatactgttgggttttcatgggtaggaaagcttgtcctgaccccagcagcaaagaggtggcag

SEQ ID NO: 6361 - DNA, 68 bp, Artificial
  Hairpin sequence MQbrain_1887, macaque
ggcctctgcgcgccccgctgctcctgctggccatcctggccgtggctctggcagtgagccccgcggcc

SEQ ID NO: 6362 - DNA, 74 bp, Artificial
  Hairpin sequence MQbrain_1888, macaque
tgccgctcctggataacccacagggcagcgcaaaagagaagggagagctgtggggtctgtgaggagaccaggca

SEQ ID NO: 6363 - DNA, 94 bp, Artificial
  Hairpin sequence MQbrain_1889, macaque
attgcagagtcaggggtagagcggcaagtgcttttgggagaccagatacccaaattcgccattgccactttaccgcccccctgaatcctgggat

SEQ ID NO: 6364 - DNA, 81 bp, Artificial
  Hairpin sequence MQbrain_1890, macaque
ccaagacaccagttacagatccagccacgggggcggtgaaggagaagatcacagcctttgtggtggagaggggcttcgggg

SEQ ID NO: 6365 - DNA, 89 bp, Artificial
  Hairpin sequence MQbrain_1892, macaque
agtcatccgtggtctctggcaggaaacaagctggagctcagaaagctttaaaatgggctccagaagtgtgggagtccctgggtttgatt

SEQ ID NO: 6366 - DNA, 89 bp, Artificial
  Hairpin sequence MQbrain_1894, macaque
tctactccataccacagcccttggcccagccatctgcacccacttttgcttgtagtcatggccagggccaaatagctatgcagagcaga

SEQ ID NO: 6367 - DNA, 82 bp, Artificial
  Hairpin sequence MQbrain_1895, macaque
tttctgaagctccttctgaaagagcagttggtgtttattttttactaaacagcaatcgctcttttggaaggaacttgagaag

SEQ ID NO: 6368 - DNA, 74 bp, Artificial
  Hairpin sequence MQbrain_1896, macaque
cacacgtcaccatgagctacccaggggtgaggatggccactcccacccctgggtagatgttccggtgttgtctg

SEQ ID NO: 6369 - DNA, 119 bp, Artificial
  Hairpin sequence MQbrain_1897, macaque
tgttgaccggcaggccccgtctgtgctcacagcttctccccttgtttggccaccctgtcctcagggcatctgcagcaagtggggggcacagcacgggaaacggggccaacgccacagca

SEQ ID NO: 6370 - DNA, 110 bp, Artificial
  Hairpin sequence MQbrain_19, macaque
tggtgtcagctacgggagggccacgtggtgctgagcgtagagggcacagggctccaggcctcctctctgcgtctggagccaggtcgggccaatgacggtgactggcacca

SEQ ID NO: 6371 - DNA, 76 bp, Artificial
  Hairpin sequence MQbrain_190, macaque
ggctgcatgtggatgacggactgaaggggccctggcagacaggagcctgttgtccagtcgtcaaatgttgagggct

SEQ ID NO: 6372 - DNA, 100 bp, Artificial
  Hairpin sequence MQbrain_1901, macaque
gctctcctgcctgcttctgtgtgatatgtttgatattgggttgtttaattaggaaccaactaaatgtcaaacatattcttacagcagctggtgattcagc

SEQ ID NO: 6373 - DNA, 99 bp, Artificial
  Hairpin sequence MQbrain_191, macaque
ctgccaccccaggtcccatctgatgccaaggctgaaggagtctcgctcccacgagtccctgctcagccccagcagtgcggtggaggcgctggacctcag

SEQ ID NO: 6374 - DNA, 53 bp, Artificial
  Hairpin sequence MQbrain_1914, macaque
gctttctcttcccagttcttcctggagtcggggaaaagctgggttgagagggt

SEQ ID NO: 6375 - DNA, 88 bp, Artificial
  Hairpin sequence MQbrain_1917, macaque
tttgcactaaaaatgaggccttatcttcccagttcttcccagagtcaggaaaagctgggttgagagggtagaaaaaaaatgatgtaga

SEQ ID NO: 6376 - DNA, 103 bp, Artificial
  Hairpin sequence MQbrain_192, macaque
ggtaagtgtgttagtggtgggagaatgatggagacctgggatgggccccacatctgcccatccttcagttctaattcttctcccaccctccccatttttttcc

SEQ ID NO: 6377 - DNA, 52 bp, Artificial
  Hairpin sequence MQbrain_1920, macaque
gccttctctttccagttcttcccagaattgggaaaagctgggttgacagggt

SEQ ID NO: 6378 - DNA, 114 bp, Artificial
  Hairpin sequence MQbrain_193, macaque
ccaacgaggtggtggtgcagagactcttccaggtcaaaggtaggcgtgtggtccgtgccaccgaggtgcctgtgtcctgggagagcttcaacaatggcgactgcttcatcctgg

SEQ ID NO: 6379 - DNA, 119 bp, Artificial
  Hairpin sequence MQbrain_1939, macaque
ggtggtggggtcccccctgctgaccgcaggtgctctgacgaggttgcactactgtgctctgagaagcagtgcaatgatattgtcaaagcatctgggaccagccttggggatctccctcc

SEQ ID NO: 6380 - DNA, 104 bp, Artificial
  Hairpin sequence MQbrain_194, macaque
tagcatccttgagtcccagggcctgaagggttcttagacatgggctgattttcttgccacctgcgtcctctcaaccatatcaccactgggcagctcattatcta

SEQ ID NO: 6381 - DNA, 99 bp, Artificial
  Hairpin sequence MQbrain_1946, macaque
gcttgcctccccctgtttttggcaatggtagaactcacactggtgaggtaatgggatccggtggttctagacttgccaactacggggcgagggctcagc

SEQ ID NO: 6382 - DNA, 82 bp, Artificial
  Hairpin sequence MQbrain_195, macaque
tgttttccaattagatcagatgggattgctgttatactggtaatataacagctgttctatatgatacctcaccagggagaca

SEQ ID NO: 6383 - DNA, 89 bp, Artificial
  Hairpin sequence MQbrain_1958, macaque; MQbrain_1985, macaque
ctgggtggggggacggggtctgggatgggtacccttctgctcagtaagatccgggaggagtacccagacaggatcataaacacattcag

SEQ ID NO: 6384 - DNA, 117 bp, Artificial
  Hairpin sequence MQbrain_196, macaque
gtctcctggttattttggggtgattgcaggatagctaatgagaacaatgtgattaaaggaaagatcatagtgtttggagaagactgtcttgagcagcttggaaagcaggtaaatgat

SEQ ID NO: 6385 - DNA, 75 bp, Artificial
  Hairpin sequence MQbrain_197, macaque
gcggcatgctctggttgttgcccatctttggactgctcctacaaagagaaggggggacgaaaatgagtgtgaagc

SEQ ID NO: 6386 - DNA, 53 bp, Artificial
  Hairpin sequence MQbrain_198, macaque
tcgggcgaggttctctggtcctcaggtgtggggagccagggaagtcgcgccgg

SEQ ID NO: 6387 - DNA, 72 bp, Artificial
  Hairpin sequence MQbrain_199, macaque
gattcttcctttccacttctgcattaacaccccaattctttccttaaggagtaggggaagggaagggaaatc

SEQ ID NO: 6388 - DNA, 114 bp, Artificial
  Hairpin sequence MQbrain_20, macaque
caataccaggttttcttccctgtgcaaatggccattgcaattcctataatatttacactgatgatataaagctgcaaaggccaaatgctgggaaaggtgaaaacatgtttattg

SEQ ID NO: 6389 - DNA, 80 bp, Artificial
  Hairpin sequence MQbrain_200, macaque
ggtctctgccttcagatgtgtcaccggtggtggccggcctcattggggcctctgtgctggtggtgtgtgtctcggtgacc

SEQ ID NO: 6390 - DNA, 67 bp, Artificial
  Hairpin sequence MQbrain_201, macaque
ggggacctatactgacctattccccagccatttggaaacaaattctagggtgggttgggaaatctcc

SEQ ID NO: 6391 - DNA, 105 bp, Artificial
  Hairpin sequence MQbrain_202, macaque
tgtggcaggtgaggatttacgtctcatagaagccactgcccccaaattcactttctgggggagtggcttctatgagacatacatccttatctaataatgcttgca

SEQ ID NO: 6392 - DNA, 98 bp, Artificial
  Hairpin sequence MQbrain_203, macaque
cctagaagaaccttcttagacaatggggggagaatgggacttgggtttttccaagaataaactttaattcctgtcatgtgtcttggctactttcttgg

SEQ ID NO: 6393 - DNA, 113 bp, Artificial
  Hairpin sequence MQbrain_204, macaque
gcgagggcgggctgcccccggccttccagctgctgctgcgcgcgtgtgaccagggcgacacggagaccgcgcggcggctgctggagccgggggcagcggagccagccgagcgc

SEQ ID NO: 6394 - DNA, 89 bp, Artificial
  Hairpin sequence MQbrain_205, macaque
ttacttcaagctcctgctgtaccccatctcctacccagagagcttttggagggaaggagacggggtacactcaaaaggccagcaagtgg

SEQ ID NO: 6395 - DNA, 106 bp, Artificial
  Hairpin sequence MQbrain_2050, macaque
agtctgtagccagtcagaaatgagcttattcataaaagtgcagtatggtggagtcagtctgtaattttatgtataagctggtctctaactgaaacgtgcagcagct

SEQ ID NO: 6396 - DNA, 70 bp, Artificial
  Hairpin sequence MQbrain_206, macaque
tggctgccgtctgtcctcttccatcctgttccctccccaaccgcagggtggagaggctggggctgcaccg

SEQ ID NO: 6397 - DNA, 117 bp, Artificial
  Hairpin sequence MQbrain_207, macaque
cagatgtggcctctctgaaccgccgcattcagctggttgaggaggagctggaccgggcccaggagcgcctggctacagccctgcagaagctggaggaggccgagaaggcggctgatg

SEQ ID NO: 6398 - DNA, 87 bp, Artificial
  Hairpin sequence MQbrain_208, macaque
gctcagttttggagaggaagagccaggctttagcctcccttctcaggggtcggggatttctgactctacctctccccacagatgagc

SEQ ID NO: 6399 - DNA, 93 bp, Artificial
  Hairpin sequence MQbrain_2087, macaque
gacgtgcggtacttaatgagaagttgcccgtgtctttttcgctttatttgtgacgaaacattcgcggtgcacttctttttcagtatcctattc

SEQ ID NO: 6400 - DNA, 67 bp, Artificial
  Hairpin sequence MQbrain_21, macaque
tgctctcctctctgtaccccaagcaacagagtatgactttgttgcttggggtacagagtggaaagca

SEQ ID NO: 6401 - DNA, 119 bp, Artificial
  Hairpin sequence MQbrain_210, macaque
tgctggggcctgggacaactgttcccacctcctgacacccttctcccactctcctaggcattctggaactctgggtttggatcaggggtaggaatggaaaagatggagcataaacagca

SEQ ID NO: 6402 - DNA, 114 bp, Artificial
  Hairpin sequence MQbrain_211, macaque
gggccagggcgtgcgcgaggtagggggcgccgggaacagaggaggaggggcccgctcgaggccccgcctctctctggctgcggcctctgctacagccaggacccggagggctcc

SEQ ID NO: 6403 - DNA, 95 bp, Artificial
  Hairpin sequence MQbrain_2112, macaque
tgtcctggctccccctgtctaatccttgctacctgggtgagagtgctttctgaatgcagtgcacccaggcaaggattctgcaagggggagtgaca

SEQ ID NO: 6404 - DNA, 112 bp, Artificial
  Hairpin sequence MQbrain_212, macaque
ctcttttccctgccatcatgtctaagtcagagtctcctaaagagcccgaacagctgagaaagctcttcattggagggttgagctttgaaacacctgatgagagcctgaggag

SEQ ID NO: 6405 - DNA, 115 bp, Artificial
  Hairpin sequence MQbrain_213, macaque
ccttgcgataacttctcctgagtccttcctgttggaattgcattgtttctaacctcttcagtttcccacctgaagacgacatgcacaacaggaatgagtttgctcaggtgcaggg

SEQ ID NO: 6406 - DNA, 67 bp, Artificial
  Hairpin sequence MQbrain_214, macaque
aggttttgaggtgtgcctgcctgcatgcacatttactcctggggcaggcagccagatctcttaattt

SEQ ID NO: 6407 - DNA, 69 bp, Artificial
  Hairpin sequence MQbrain_215, macaque
cactctgcgcggcgcagacatggcctcttcctctttttgaggcggtgtctgcggcagcgcctcagagtg

SEQ ID NO: 6408 - DNA, 85 bp, Artificial
  Hairpin sequence MQbrain_217, macaque
tattgctcctggatcaatggttggagtctgttccatggaaacataacttagacaggagacagacctaagcaaggcagaagcaatg

SEQ ID NO: 6409 - DNA, 94 bp, Artificial
  Hairpin sequence MQbrain_218, macaque
ggagctagttgttgcaaagagaagaaagggaagaaaggcagcaggaagaaccaagttgccccttcctgtcttttttaagtcaactggagtctcc

SEQ ID NO: 6410 - DNA, 90 bp, Artificial
  Hairpin sequence MQbrain_219, macaque
gccaaactggaatgtggaggaggcccgtgggggaataaaggctattttgtccagcccacggtgttctctaatgttacagatgagatgcgc

SEQ ID NO: 6411 - DNA, 82 bp, Artificial
  Hairpin sequence MQbrain_2197, macaque
ggctggccaggcccatcagggcttgtggaatgggaagaagggatccttccccttctgcaggtctgctgggtgcggctgaacc

SEQ ID NO: 6412 - DNA, 112 bp, Artificial
  Hairpin sequence MQbrain_2198, macaque
ccgggctggcgcagccggaccgcggcctgtgcctgaggctgggggacgcgctggcccgcgccggccgcctcccggaggccctgggcgcgttccgcggcgccgcgcggctcgg

SEQ ID NO: 6413 - DNA, 84 bp, Artificial
  Hairpin sequence MQbrain_22, macaque
cctcagatgggcttataagccagctcctggcctagcctcatcagatgtgagcatgaggaagagagaacctggtgggccctgggg

SEQ ID NO: 6414 - DNA, 110 bp, Artificial
  Hairpin sequence MQbrain_220, macaque
gagtcctaaattatggttgtggactgtggagttccctgcagagagcactcagccttctctctctgcatttactttataaatggtttacgagatctctcatagtttgactt

SEQ ID NO: 6415 - DNA, 104 bp, Artificial
  Hairpin sequence MQbrain_2202, macaque
gtgattttggctactaccgtccagaaaatgactccaagtgtgtggagcagccagaactgaagggccatgacctggagttttgtctgtacggaagagaagaacac

SEQ ID NO: 6416 - DNA, 63 bp, Artificial
  Hairpin sequence MQbrain_2204, macaque
ccacctgtccccagcgggctctccaggtgtctgcagggccctaggcgctggccgaccaggtgg

SEQ ID NO: 6417 - DNA, 94 bp, Artificial
  Hairpin sequence MQbrain_2205, macaque
cccgccatctccctggctgacagcacagacctcaggtgaggcgagcagcaagcctgggcttccgagcgttagtcagagatgagatcagagcagg

SEQ ID NO: 6418 - DNA, 113 bp, Artificial
  Hairpin sequence MQbrain_2206, macaque
cttcagtctatctgtctttaatactaacctgcaaccttagaacttactcatttctttggaaatgagttttgttgaaaatgctagttattatttaagatctcaaggactagaag

SEQ ID NO: 6419 - DNA, 55 bp, Artificial
  Hairpin sequence MQbrain_2209, macaque
atctggagtccaaggaatccgtggatgttttcatgggatccttgatctctcagat

SEQ ID NO: 6420 - DNA, 73 bp, Artificial
  Hairpin sequence MQbrain_221, macaque
ggtgtctgaggggcagctggatggccaaactgagggaactggtgccatcagtggctaccctgccactcaatcc

SEQ ID NO: 6421 - DNA, 79 bp, Artificial
  Hairpin sequence MQbrain_2210, macaque
ttcgtgtttcagaaggtgggtcctggcgtggcccgatgggaaaagctgctggccaggtcgggcctgccctgaccaggaa

SEQ ID NO: 6422 - DNA, 93 bp, Artificial
  Hairpin sequence MQbrain_2215, macaque
ggtccaggccaacctgcaaagctcagccagagccccccaggtgagattgcagctggggaggcaaagggcagtgcaggtccaggcactctggcc

SEQ ID NO: 6423 - DNA, 118 bp, Artificial
  Hairpin sequence MQbrain_2219, macaque
actctgtgcaactgtcgtatatggtcccgtgggctgaccgctttgtacatgagaataaatctatttctttctaccagttctcccctatggggctgttttctgactttgtgcttggggt

SEQ ID NO: 6424 - DNA, 90 bp, Artificial
  Hairpin sequence MQbrain_2222, macaque
tccaagccagagctcagagcaatccagcccaaccgtattcggggataaccctgagcaaggctggtgagtgagagtactttagggtaagga

SEQ ID NO: 6425 - DNA, 117 bp, Artificial
  Hairpin sequence MQbrain_2225, macaque
ggcagctgggtttgggctctggccatgtctcaactttgtgctaggagtaaaacatggagcaagtggagactcacacaagtggacaaggccagtctcagccctttgttactggctccc

SEQ ID NO: 6426 - DNA, 80 bp, Artificial
  Hairpin sequence MQbrain_2227, macaque
gtgcctgggtttgggggcatgcagagtatgcccatggaggtgcccatgaatgccatgcagaggcccgtaagaccaggcat

SEQ ID NO: 6427 - DNA, 76 bp, Artificial
  Hairpin sequence MQbrain_223, macaque
gagaatcctagaaatttattgcttgaggaaggggttggtgttctcatttctcaccttcttcaggctgggcttcatc

SEQ ID NO: 6428 - DNA, 117 bp, Artificial
  Hairpin sequence MQbrain_2230, macaque
gcaggagtgattagtttgggttacagcaaaagtgtgtcattaacttggattccttgaagtcagttttgtcaagttcatggcccactttgctacagcatcagagtgaaacatgcctgt

SEQ ID NO: 6429 - DNA, 106 bp, Artificial
  Hairpin sequence MQbrain_2231, macaque
ggagaaagtgccaaagtcaagccttcgtgtccccctctccttcttgctgtgtgctctgcagaagaggggataaaatgctcatctgaggtcctggctggctgtctct

SEQ ID NO: 6430 - DNA, 71 bp, Artificial
  Hairpin sequence MQbrain_224, macaque
gcatgccaacggaaggctgtgcccagaccaagcactggaaatgtgcttctgggcatagtcactggttttgc

SEQ ID NO: 6431 - DNA, 96 bp, Artificial
  Hairpin sequence MQbrain_2240, macaque
ctgaggagagggcggtcagggcatgaagctgcagtcgccactgctgtttctgcaaaatctaagcactgggctgcagccatgtcctactgccggcag

SEQ ID NO: 6432 - DNA, 71 bp, Artificial
  Hairpin sequence MQbrain_2242, macaque
ggcttcttttctatctttgtgccctggtgttggtgcagcatacctagggccaaaatggaaaatgtagaacc

SEQ ID NO: 6433 - DNA, 109 bp, Artificial
  Hairpin sequence MQbrain_2247, macaque
aagaatgaggggtgggagggatttacagttagaaacgacagtgcaggaaggggtattttcttgttgtcagggctggaatgaatcgctgctgctcaagtcaaaggttctt

SEQ ID NO: 6434 - DNA, 82 bp, Artificial
  Hairpin sequence MQbrain_2249, macaque
gggccatagcaatcctgtgatttatgcatggaggctgcttctcctcagcagccgccatagcccggtcactggtacatggttc

SEQ ID NO: 6435 - DNA, 105 bp, Artificial
  Hairpin sequence MQbrain_225, macaque
ccaggaaggctcctgctctgatttcctgtattccttcatgatttggagtagacaactgcccacatgacattcttattacaggggacttatgggtgggattcttgg

SEQ ID NO: 6436 - DNA, 114 bp, Artificial
  Hairpin sequence MQbrain_2250, macaque
tcagctctgaggctcctgtcctcaggcagtgtgcgctcaggccccgggagtcatgtggatgccagtagcctgggcccacagagctgccgggacgttcagggcgcctcgaggtga

SEQ ID NO: 6437 - DNA, 115 bp, Artificial
  Hairpin sequence MQbrain_2251, macaque
tgtgaggtcactgcttttgcccagttcagttctgacctcgatgctgccactcaacaacttttgagttgtggtgtgtgtctaactgagttgctgaagcaaagacagtatactccca

SEQ ID NO: 6438 - DNA, 90 bp, Artificial
  Hairpin sequence MQbrain_2252, macaque
ctgccccttagcatgcgtgcagctctctcttgtcttgggtgttacccttgggcactccagctcggggactgctggcgtgtgagtgtgcag

SEQ ID NO: 6439 - DNA, 67 bp, Artificial
  Hairpin sequence MQbrain_2253, macaque
gggctgagacctagcagaggggccaggcacgccgctcatcctgaccccatgctcagtgtctgggtct

SEQ ID NO: 6440 - DNA, 118 bp, Artificial
  Hairpin sequence MQbrain_2254, macaque
gatcctgagtgaaatgggagctgggacagagaaaggctgatgctgtgggtcggtcatttgccactaataagcccattctcctgccttgccttgccccatcttttagtttttcagggtt

SEQ ID NO: 6441 - DNA, 113 bp, Artificial
  Hairpin sequence MQbrain_2255, macaque
ctgcaaataaccaaggtttccaggagctgccgcatcactcttcctctttgcatcttaatgttggcagtgggaaagagtgagaggtggattcctggacccagtctttatttcag

SEQ ID NO: 6442 - DNA, 67 bp, Artificial
  Hairpin sequence MQbrain_2256, macaque
cgtggcaaacgtggcatagaggtgtgccaggagcctgttggaggacttctggtacagcccgaccacg

SEQ ID NO: 6443 - DNA, 90 bp, Artificial
  Hairpin sequence MQbrain_2257, macaque
accagaggaacggcaatgccgcccgctcgctgacatcgctgacaagtgatgacaacttgtgggcgtgcctgcacacctcctttgcctggt

SEQ ID NO: 6444 - DNA, 49 bp, Artificial
  Hairpin sequence MQbrain_2258, macaque
gggcccctctgcccatgtttcctccaaggaagagtgggcagagtggccc

SEQ ID NO: 6445 - DNA, 116 bp, Artificial
  Hairpin sequence MQbrain_226, macaque
ggtttggctttccagagggcagtgtagagctttatgctgaaaaggtggccactagaggtctgtgtgccattgcccaggcagagtctctgcattacaaactcctaggagggcttgct

SEQ ID NO: 6446 - DNA, 105 bp, Artificial
  Hairpin sequence MQbrain_2260, macaque
gggtaactccaggtgggttttgagagctgggtcggtacttcagacatctcttctccattgtcaggtgccgtctctgctctatgtggtcattgccccctggcatcc

SEQ ID NO: 6447 - DNA, 75 bp, Artificial
  Hairpin sequence MQbrain_2261, macaque
ggagagaaatattgtttctggctgtgggcagctttcatctctgaatgttcggtagcagccagagataattggtcc

SEQ ID NO: 6448 - DNA, 80 bp, Artificial
  Hairpin sequence MQbrain_2262, macaque
gtgccgggctaatctcctggactgcttggagaaagagaagctagtaccccctttctccaatagtcattagtttccggggc

SEQ ID NO: 6449 - DNA, 73 bp, Artificial
  Hairpin sequence MQbrain_2263, macaque
ctgggtttaagatgactccggctcaggcaatgtgggccttgcctgggtcagtgtctctcttcctttaacccag

SEQ ID NO: 6450 - DNA, 97 bp, Artificial
  Hairpin sequence MQbrain_2266, macaque
tgtctagtgtgaagactggtgaggaaagagaacttcaggagaaggaacggtgtccccagctgaagggctgtttaaaagagttagtattgcatggaca

SEQ ID NO: 6451 - DNA, 63 bp, Artificial
  Hairpin sequence MQbrain_2269, macaque
ttgggagggaagatagctggagcgtacggtcacagcagcgtcttcctctgttctctctcctag

SEQ ID NO: 6452 - DNA, 109 bp, Artificial
  Hairpin sequence MQbrain_227, macaque
tgtgaggtcgtggtgtctgggaaactccgaggacagagggctaaatccgtgaagtttgtggatggcctgatgatccacagcggagaccctgttaactactacgttgaca

SEQ ID NO: 6453 - DNA, 100 bp, Artificial
  Hairpin sequence MQbrain_2273, macaque
ttcccagatagttggttcgtttatttcttttctccatattctcagacattctttctgtctcagagatgttagggaagaggttggggcatgctaatgggag

SEQ ID NO: 6454 - DNA, 75 bp, Artificial
  Hairpin sequence MQbrain_2274, macaque
ggagaatctgcataagccccatgcttcttgggtctgggtgactgggctgggggaggaaggggaatgtaatttacc

SEQ ID NO: 6455 - DNA, 111 bp, Artificial
  Hairpin sequence MQbrain_2276, macaque
tgtatctctcacatgactcactgctcctgtctttcacatgggctgtaatttagttcaattcagaactgcagatagtacagcttccacaggagcaagggatgtctgagcaca

SEQ ID NO: 6456 - DNA, 118 bp, Artificial
  Hairpin sequence MQbrain_2277, macaque
gcccacttgtctcgctggcctggaaggtgacggtgctgaatgtggcctttttgccttttccaaaggccacattttccagcccattcacccttccagagccctctgaggtggcctaggc

SEQ ID NO: 6457 - DNA, 86 bp, Artificial
  Hairpin sequence MQbrain_2278, macaque
ttgtgttccttccagtccgccctctgtcaccttgcagacggctttctctccgaatgtctgcaagtgtcagaggcgaggagcagcag

SEQ ID NO: 6458 - DNA, 71 bp, Artificial
  Hairpin sequence MQbrain_228, macaque
ctttcctgatgcgcccgtctcctcgccgccctccgtgggggcgcggcgaacgggttgcgtgctctggagag

SEQ ID NO: 6459 - DNA, 90 bp, Artificial
  Hairpin sequence MQbrain_2282, macaque
agaaaagaggacattttacccagatccgtggcctaatcagaaatgtggcctgtgattaggccacagatctgggtgaaatgtcctccttct

SEQ ID NO: 6460 - DNA, 76 bp, Artificial
  Hairpin sequence MQbrain_2287, macaque
gggcccgcgtgtgcccactgtgctccagacaatagcacacgctgtgggagctgcaatccaggctatgtgctggccc

SEQ ID NO: 6461 - DNA, 101 bp, Artificial
  Hairpin sequence MQbrain_229, macaque
ctccacattttgtgatcacatccacaaagctctgaagccatggtggtcctgccaccagctggccctgttagaggcttggggtgggggtgagcaggtgggag

SEQ ID NO: 6462 - DNA, 78 bp, Artificial
  Hairpin sequence MQbrain_2291, macaque
atgctctcactgcttgcttgtcagaaacactgaagccgtttgccccagtgtggtcaagcagccatgctctctgggcgt

SEQ ID NO: 6463 - DNA, 67 bp, Artificial
  Hairpin sequence MQbrain_2292, macaque
gtgggaaatgatagaagggtcacttaggagcctgcagtggcatggtgaccagtctgttactactcat

SEQ ID NO: 6464 - DNA, 115 bp, Artificial
  Hairpin sequence MQbrain_2297, macaque
accttttcagtattctaatttttgctttgctgacctctcagacctcttcctggcaacattattaggcttttgggaggagggagagagccaagcctgttgggtaagtgaacagagt

SEQ ID NO: 6465 - DNA, 72 bp, Artificial
  Hairpin sequence MQbrain_23, macaque
agcgttgtttccaatgagcccagtaaaggtgcaggtacttgcactggtgtggtgtggtgtggatgtgaggct

SEQ ID NO: 6466 - DNA, 119 bp, Artificial
  Hairpin sequence MQbrain_230, macaque
ttcgtggacacaggtgggcaccctctgggctttctgatgggtgaaaagccctttcttgcccgggctttccccagagtagaaggctcaggagtgtgcctttgtcacttcctgacctcgag

SEQ ID NO: 6467 - DNA, 69 bp, Artificial
  Hairpin sequence MQbrain_2300, macaque
gcccgcgggcgtccaggtccccgccgggcctcagacagtgatgggcccgggcctgacgcccatgctggc

SEQ ID NO: 6468 - DNA, 97 bp, Artificial
  Hairpin sequence MQbrain_2301, macaque
tcttcatgggttaccagaacgtagaggatgaggccgagaccaagaaggtgctgggccttcaagacaccatcacggcagagctggtggtcatcgaaga

SEQ ID NO: 6469 - DNA, 93 bp, Artificial
  Hairpin sequence MQbrain_2303, macaque
gtttaactggcagaaggaagacgtgaaaatattttgaatcctttgtacacaaagggaaaatgaatcctttcagttatttccaagccaggaaac

SEQ ID NO: 6470 - DNA, 77 bp, Artificial
  Hairpin sequence MQbrain_2304, macaque
cgggacttcgtggaggcgccgtcgcagatgctggagaactgggtgtgggagaaggagccgctgctgcggatgtctcg

SEQ ID NO: 6471 - DNA, 109 bp, Artificial
  Hairpin sequence MQbrain_2305, macaque
gcccagcgtagccaggtgtgcccagggctggggcctggggctggggctggacacgctccctgcctggtcccttgctcaccgctcccatctctgccacctcccgccaggc

SEQ ID NO: 6472 - DNA, 118 bp, Artificial
  Hairpin sequence MQbrain_2306, macaque
ggctgggcagagcctgtcccctccccctttgccaggagccagggggtgactggagagacagaccccacccccaagcagggctcctctccccagggtgggcacaggacctctgtacgct

SEQ ID NO: 6473 - DNA, 110 bp, Artificial
  Hairpin sequence MQbrain_2308, macaque
agagcgaagcagaaggggctccctgtccggccgcacgtgccctttcccttgacgacagtcggggcctcgggcgctgtgtgactgtgggagccagggtttgcagggcgcct

SEQ ID NO: 6474 - DNA, 117 bp, Artificial
  Hairpin sequence MQbrain_231, macaque
aggatgcagcctgactcactgagggacaccccacttacgccctgatgggagtggggctctttcctgacttctttgggtgcttgagccgggttcttcgtggacacaggtgggcaccct

SEQ ID NO: 6475 - DNA, 64 bp, Artificial
  Hairpin sequence MQbrain_2310, macaque
ctctgccgagacacagggtggcagacccttccagctgtgccaccctctttgtccctggccagag

SEQ ID NO: 6476 - DNA, 68 bp, Artificial
  Hairpin sequence MQbrain_2311, macaque
gcctggacacaatgcccaagtttgccttctcatcagaggatgaggcggcaggcccggcccctgcaggc

SEQ ID NO: 6477 - DNA, 66 bp, Artificial
  Hairpin sequence MQbrain_2313, macaque
ccacagagactcgggagcccggccaaggggccttgtcttggctgggtttgtcagaggtcaaacggg

SEQ ID NO: 6478 - DNA, 72 bp, Artificial
  Hairpin sequence MQbrain_2317, macaque
tgccccatgacctggacatactgctgagggccacctactttgggagcattgtcctgctggtgagtgctggcg

SEQ ID NO: 6479 - DNA, 76 bp, Artificial
  Hairpin sequence MQbrain_2318, macaque
cacagcaatgaggggaccggatagaggaacagagaaagctaagggtagtctctgtcctcctactccccaggctgtg

SEQ ID NO: 6480 - DNA, 95 bp, Artificial
  Hairpin sequence MQbrain_2319, macaque
cctgaatgggcagggtggacttgggaggcggactactaggtccctggggaaggagggagctggggtccagatctttggtctgaaggagcctaggg

SEQ ID NO: 6481 - DNA, 117 bp, Artificial
  Hairpin sequence MQbrain_232, macaque
accaggaagttgggcccgggtctgggaattcggagactctagcgaccccgccccgggttggagagtgggaagggtcgctggagctaggatccagaagcccagaggctcagcggtggt

SEQ ID NO: 6482 - DNA, 72 bp, Artificial
  Hairpin sequence MQbrain_2321, macaque
cgcagacggcggctctgccgctggagccggcgagcaaggagctggtgggcgagcggcagaacgcggtgggcg

SEQ ID NO: 6483 - DNA, 94 bp, Artificial
  Hairpin sequence MQbrain_2323, macaque
gatcccagctccacgggaggtccagattcaccaccctcaaccttctgtggggacagtggcttctctggatccagctcctatggtcgcctaggtc

SEQ ID NO: 6484 - DNA, 70 bp, Artificial
  Hairpin sequence MQbrain_2324, macaque
agcctcccagcgcccgtcttcgtgtcccatctgcttagagagaggtggggccgagacttgctggagagct

SEQ ID NO: 6485 - DNA, 75 bp, Artificial
  Hairpin sequence MQbrain_2325, macaque
ggctcctaagacgggggtgctagggggtgagaggtaacatccttcacccctcacacctgccctagtgctggagct

SEQ ID NO: 6486 - DNA, 90 bp, Artificial
  Hairpin sequence MQbrain_2327, macaque
gccgggagccgagcctacgggggtggcgggggcagcagcgccttcaccagcttcctgcccccgcgacccctggtgcacccgctgaccggc

SEQ ID NO: 6487 - DNA, 80 bp, Artificial
  Hairpin sequence MQbrain_2328, macaque
gggacgggagctggttggggtggcttagcagatccggacagggccctctgtccctgtgtcgtccccaaccccctcttcct

SEQ ID NO: 6488 - DNA, 61 bp, Artificial
  Hairpin sequence MQbrain_233, macaque
tcaggtccatcccaagctggctttgggattactgttccctgagcatgtgggaagggctgga

SEQ ID NO: 6489 - DNA, 106 bp, Artificial
  Hairpin sequence MQbrain_2334, macaque
catttggaaaatgatactctaccacagaattcgatggactccttagggcccatgcccaaatcttcccattgcttctcaggttagaatgatcctcacctccaacatg

SEQ ID NO: 6490 - DNA, 115 bp, Artificial
  Hairpin sequence MQbrain_2337, macaque
gatagctgtgtttgcatgccatgctccatgttcatttggagccaggagaggttctcagtggagcctggcttagggaacagggagcgatggaagaatgccaacattagcgttggtc

SEQ ID NO: 6491 - DNA, 58 bp, Artificial
  Hairpin sequence MQbrain_234, macaque
tggaggcgcctggtgccccgcccagaaccctgactcgggaagccatggagcagatccg

SEQ ID NO: 6492 - DNA, 79 bp, Artificial
  Hairpin sequence MQbrain_2345, macaque
gggcgccactgttgcctgccatcctcagacagtgtcagctcggctgacatctggatgagatgaggctcaggagcaaacc

SEQ ID NO: 6493 - DNA, 109 bp, Artificial
  Hairpin sequence MQbrain_2347, macaque
gtgtgtgccgtcaccgcatgccacgtgtacacatatgccgggcgctgtctcgagacattcgcacagcgcactgcactggggacacgtggcactggctgaactgccacac

SEQ ID NO: 6494 - DNA, 66 bp, Artificial
  Hairpin sequence MQbrain_235, macaque
agggctgcctcactctgtggtgtcaggcattggactgtgtcctgattcctcagaatatggggacct

SEQ ID NO: 6495 - DNA, 68 bp, Artificial
  Hairpin sequence MQbrain_2353, macaque
tgcattatgcaccttctgtagccagagccaaaaaaactctggctacaggagaaacctggcactgtgca

SEQ ID NO: 6496 - DNA, 77 bp, Artificial
  Hairpin sequence MQbrain_2354, macaque
gatccgcagtgctagagggatgtccgcagtttgtcctcttggataactctgcttttctcttccccagtgccacgatc

SEQ ID NO: 6497 - DNA, 75 bp, Artificial
  Hairpin sequence MQbrain_2355, macaque
gtctcaaggctgacttgaagaaggacagccccttgtcctcagacttgctgtccctcttcaaaccagacttgatgc

SEQ ID NO: 6498 - DNA, 76 bp, Artificial
  Hairpin sequence MQbrain_2357, macaque
ggctctgcctcagggaactcgggtttggggaactgtttatttcagacttactggagtggccagtgtggcagtggcc

SEQ ID NO: 6499 - DNA, 63 bp, Artificial
  Hairpin sequence MQbrain_236, macaque; MQbrain_237, macaque
gcaaagccactgcagagtgtgcctgacattacctcccttgttggggacatcctgtgggcatgc

SEQ ID NO: 6500 - DNA, 84 bp, Artificial
  Hairpin sequence MQbrain_2362, macaque
aaggaatgggcagtggagctagccaactgtctggaggtctgggtgacctcgcagcatggctgctccccccaccccccactcctt

SEQ ID NO: 6501 - DNA, 116 bp, Artificial
  Hairpin sequence MQbrain_2364, macaque
tcaaaaggagtctactcttcatcttgcgttgacacttcatggtggtgctaagaaaaggaagaagtcttaacaccaccccaagaagaataagcacaagagaaagaagactaagctgg

SEQ ID NO: 6502 - DNA, 110 bp, Artificial
  Hairpin sequence MQbrain_2365, macaque
tttacctctcgtatctagttgttgtggaattacaagctgaacctaactacagatcccaaatttgaatctgtggccagagaggtttgcaaatctactataacagaggtaag

SEQ ID NO: 6503 - DNA, 94 bp, Artificial
  Hairpin sequence MQbrain_2366, macaque
taggaagcatagaggaagggattctgggaggttgtagcagtggaaaaattccttttttcctctgatcgccctttcagctctttccttctgactg

SEQ ID NO: 6504 - DNA, 59 bp, Artificial
  Hairpin sequence MQbrain_2367, macaque
tgttctagaagaatggcacagggtacatggtaaaatggccctggccattcctttagaca

SEQ ID NO: 6505 - DNA, 118 bp, Artificial
  Hairpin sequence MQbrain_2368, macaque
ctcttccgccagtccgttggagaagcgctctttgattggccagtggatagcgtcgtggcatgacgcgctggggcgctggccaatcggttgagagctgagctggacttggcggtgggag

SEQ ID NO: 6506 - DNA, 85 bp, Artificial
  Hairpin sequence MQbrain_2370, macaque
aagctgtaccagagtgcaggaggcatgccaggaggaatacctgggggattccctggtagtggagctcctccctctggtggtgctt

SEQ ID NO: 6507 - DNA, 75 bp, Artificial
  Hairpin sequence MQbrain_2371, macaque
ggccctggtgaggccatctgggcttctttctccctccccagggcaaaggtcaggcccaggtgccctcgttccgcc

SEQ ID NO: 6508 - DNA, 64 bp, Artificial
  Hairpin sequence MQbrain_2372, macaque
ggaggcggtgtgggctgcaggaggctgctgtccctgaagcctccgcgtcccagaccaggacccc

SEQ ID NO: 6509 - DNA, 104 bp, Artificial
  Hairpin sequence MQbrain_2373, macaque
tgtttctgggctcctaggcctgtatgaactcaatctcaccaccgatggccctgccaccacgggagcggaggtgaccatctcagccagcctggtggccaaggaca

SEQ ID NO: 6510 - DNA, 87 bp, Artificial
  Hairpin sequence MQbrain_238, macaque
gcggcggcggtggcggctgaggagggcccggcctgcgagagtctcggtgggagccggctcggccctcggccaccatgtcggcgccgt

SEQ ID NO: 6511 - DNA, 118 bp, Artificial
  Hairpin sequence MQbrain_2380, macaque
gggtctcagctccaccccactgtgtcttggtcagcctcagtgatggcctgaccccagctgtgaggccttgtgagctaaggctgaagagaccttgcctgtgggagctggggtggtacct

SEQ ID NO: 6512 - DNA, 80 bp, Artificial
  Hairpin sequence MQbrain_2382, macaque
ggggaacccagctggtcctgggtttgtggattgcttagaaagatccttttgggcagcctgaagcctggggagggttttcc

SEQ ID NO: 6513 - DNA, 73 bp, Artificial
  Hairpin sequence MQbrain_2383, macaque
gttagggtgcctggagcggggtacacttggggcttgcctggccccaggttcccagtccttaatggtccttaac

SEQ ID NO: 6514 - DNA, 95 bp, Artificial
  Hairpin sequence MQbrain_2388,MQbrain_2604, macaque
cagggaggaccagatcaacaggcttattagaagaatgaactaaggtgtttgccatgattatttttctaagctggttggttagtaagtagtacctg

SEQ ID NO: 6515 - DNA, 59 bp, Artificial
  Hairpin sequence MQbrain_2389, macaque
ggctctcctggttgaggagggaggggcctagctgacccctccagcttcagcctccagct

SEQ ID NO: 6516 - DNA, 105 bp, Artificial
  Hairpin sequence MQbrain_239, macaque
gacgggaccaggtgtgagctacagattcgtggcctggctgtggcagatgccggggagtactcgtgcatttgtgggcaggagaggacctcagccacactcaccatc

SEQ ID NO: 6517 - DNA, 119 bp, Artificial
  Hairpin sequence MQbrain_2391, macaque
gctggaaccagttggggagcacagttctgggagctctgcaaaatcagtagcaagtgctgggaaaggcgcatgccagagatactcaagagttcccgagacttgcttgaggctgacccagt

SEQ ID NO: 6518 - DNA, 106 bp, Artificial
  Hairpin sequence MQbrain_2392, macaque
agcccactcttcatcttgtgttgagacttcctggtggtgctaagaaaaggaaggagtcttaccccattcccaagaggaagaagcacaagagaaagaaggtgaagct

SEQ ID NO: 6519 - DNA, 91 bp, Artificial
  Hairpin sequence MQbrain_2393, macaque
cctggagaacttctacgctgactactacaccacggccagcatcgcgctggtgtcctgcctggccatgtgcgtggtggtccggttcctcggg

SEQ ID NO: 6520 - DNA, 63 bp, Artificial
  Hairpin sequence MQbrain_2396, macaque
ccgcgggtggggtggccactgccgcttttggttgtgatggcggcaggggtggctccggtgtgg

SEQ ID NO: 6521 - DNA, 93 bp, Artificial
  Hairpin sequence MQbrain_2397, macaque
cactgtgggctgggccagggagcagctggtggctgggaagtaagatctgacctggaccccttcccacacaccccgtttcctggcccacaggtg

SEQ ID NO: 6522 - DNA, 118 bp, Artificial
  Hairpin sequence MQbrain_2399, macaque
catttcgcgctggagtggagcagcctctagaacgagctggaggattctgcctactgatacagagccttcgagtcgtccggggccgccattacaatccacctccatccgcttggaaatg

SEQ ID NO: 6523 - DNA, 82 bp, Artificial
  Hairpin sequence MQbrain_24, macaque; MQbrain_25, macaque
atcttcaatggaacctttgtgaagctcaacaaggcttcagttaacatgctgaggattgtagagccacacattgcatgggggt

SEQ ID NO: 6524 - DNA, 97 bp, Artificial
  Hairpin sequence MQbrain_240, macaque
ggggctgtgatggagcagggcacatcttcgtcaatgacaggtaacagcttcctgctgaaccctgcattcgcaaggtgctgcccagcttccttgcccc

SEQ ID NO: 6525 - DNA, 115 bp, Artificial
  Hairpin sequence MQbrain_2400, macaque
ggcttatgtgagtctccaggggatgggagagagaggggctggttctggattgttggaaaacaccacagtacttgaccctgactctccctcaccaggcactgggggccacagtgct

SEQ ID NO: 6526 - DNA, 58 bp, Artificial
  Hairpin sequence MQbrain_2402, macaque
ggcttgggctggtggtgggcccggctgcccctttgcctgctgctcagcctttacggtc

SEQ ID NO: 6527 - DNA, 82 bp, Artificial
  Hairpin sequence MQbrain_2403, macaque
gaaatgggctagaagacatttgggggttagggcctgaccgcttccaggtcctggacagatgctcccttctgtgcctgtagtc

SEQ ID NO: 6528 - DNA, 103 bp, Artificial
  Hairpin sequence MQbrain_2404, macaque
ttcctgtgcagcatgatggagggagcccctgagagggaatctggtgagggaatccagactcctgtctctcaaagggaggctcaacagaacattgacctagggg

SEQ ID NO: 6529 - DNA, 60 bp, Artificial
  Hairpin sequence MQbrain_2405, macaque
gcctgaggaggatggagcatctgtatctgctcccgaaggtgcggatgcccagacctcggc

SEQ ID NO: 6530 - DNA, 68 bp, Artificial
  Hairpin sequence MQbrain_2406,MQbrain_2437, macaque
gccatcctgcctggcactggctgatgggcacctctattggttccatcagccagagctctgccaaaggc

SEQ ID NO: 6531 - DNA, 74 bp, Artificial
  Hairpin sequence MQbrain_2409, macaque
cctgagtgtgtttgagacggacgttcagtctctgatctccagagaagagtgtttgtgtcacagcatgatccagg

SEQ ID NO: 6532 - DNA, 96 bp, Artificial
  Hairpin sequence MQbrain_241, macaque
gcagaggtgggtcacccccaggcctcactggctcaggcgggtgttctccgcttctcctttgtagccctgaggcctgggtctgtccttggtccttgc

SEQ ID NO: 6533 - DNA, 80 bp, Artificial
  Hairpin sequence MQbrain_2412, macaque
tggtgacacacctgtgtaggaggccaagacttggcagaggatgtagtctaggtgtcctggtatatatatatggtcactca

SEQ ID NO: 6534 - DNA, 75 bp, Artificial
  Hairpin sequence MQbrain_2414, macaque
gcggaggagctggagcaggcggcggagggcaaggaagtccggtcccaggcctctctgccgctgaccaggatcggc

SEQ ID NO: 6535 - DNA, 79 bp, Artificial
  Hairpin sequence MQbrain_2418, macaque
tacatcagctgagctagggatatctccggaggatgtctcttccctattctcaggaaaaatccctagcttggttgatgta

SEQ ID NO: 6536 - DNA, 79 bp, Artificial
  Hairpin sequence MQbrain_2419, macaque
gccggcggccgtgcaaccccagtctttccagcagatcctcagcttctgctacacgggccggctgagcatgaacgtgggt

SEQ ID NO: 6537 - DNA, 48 bp, Artificial
  Hairpin sequence MQbrain_242, macaque
ggcgaggttctctggtcctcaggtgtagggggccagggaagtcgcgcc

SEQ ID NO: 6538 - DNA, 119 bp, Artificial
  Hairpin sequence MQbrain_2423, macaque
gccttgattccagaagaaggagctctctgaatatgggtttactagttggtggccaattcatgagtcaccaactattaggcctttatgtccagatattatcctaatttatggagtaaggt

SEQ ID NO: 6539 - DNA, 113 bp, Artificial
  Hairpin sequence MQbrain_2425, macaque
gattgccttttggttatctagctggcactttgtagctgcagataaatagttgctgctcttgctactactgcagctgttgattgtgaagttagactacatgggccaggcaaatc

SEQ ID NO: 6540 - DNA, 65 bp, Artificial
  Hairpin sequence MQbrain_2426, macaque
gagtgtatggtgggtgtcctgaattcattcacgtgaatacaggactcagacttcccaccccactc

SEQ ID NO: 6541 - DNA, 118 bp, Artificial
  Hairpin sequence MQbrain_2427, macaque; PT_from_HSbrain_227, chimp
cttctctagtggcttcctaaaggtgtgtggtggcaaagtacttgagctcttccagccttcagaactgagggctatgatggtggggaacagcaactacaactgggaagaactggaagag

SEQ ID NO: 6542 - DNA, 111 bp, Artificial
  Hairpin sequence MQbrain_2428, macaque
gatcattctgttctgcttgctgctctacttctacaaggagaagaacgccaacaacattgtcgtgattcttctcttggtggcgttactcggtaagttggcatttagatgatt

SEQ ID NO: 6543 - DNA, 117 bp, Artificial
  Hairpin sequence MQbrain_243, macaque
ggaaggggcgtatgtgccaggccttcaagcaggtgtcctgtctgccctggggctcctgatttgggtaagggcagacccagatctgacagtggctttgcctggcacactcgccaggct

SEQ ID NO: 6544 - DNA, 115 bp, Artificial
  Hairpin sequence MQbrain_2434, macaque
agattggttgactgtgtactcttatattttattcctgtaactgggccagtttctgcccttaactaaaactggatcaattataggagtgaaataaaagtccatctcctgcctattt

SEQ ID NO: 6545 - DNA, 114 bp, Artificial
  Hairpin sequence MQbrain_2436, macaque
tcccactagtccctctgcagggtcacaggctccacggtcactggctctgtaagacacttgctccagagcctcgcctggggccctgtgtgccaggcctgagtcgggcaccgggga

SEQ ID NO: 6546 - DNA, 109 bp, Artificial
  Hairpin sequence MQbrain_2439, macaque
cgccgacggcttccccgcccccctcctgcccggacttggagcagccccgcctccctccgcggcggccatgttgactccggacgagcggggtgggggcccccgctcggcg

SEQ ID NO: 6547 - DNA, 105 bp, Artificial
  Hairpin sequence MQbrain_244, macaque
ctgccagcctggggcagactgggagctggtgctgcgcccgtcccctgcacaccgcctcggggatggcacactgcagcactgcctccttctgttcccaggtctcag

SEQ ID NO: 6548 - DNA, 111 bp, Artificial
  Hairpin sequence MQbrain_2441, macaque
cagccttccttcctgggtatggaatcttgcggaatccacgagaccacgttcagctccatcatgaagtgtgacgtggacatccgcaaagacctgtacaccaacgtggtgctg

SEQ ID NO: 6549 - DNA, 66 bp, Artificial
  Hairpin sequence MQbrain_2444, macaque
gcagaggctgaggctgcagctggccaccagcagctgtggtggccagagctgcattccttcccctgc

SEQ ID NO: 6550 - DNA, 69 bp, Artificial
  Hairpin sequence MQbrain_2447, macaque
ccagcatcttgttcttttcccttatcccagagcccaacctgggggaggacgatgaggacaaggacttgg

SEQ ID NO: 6551 - DNA, 94 bp, Artificial
  Hairpin sequence MQbrain_2448, macaque
cctgcccttctgcagggagagccctggccccccggccttgcgtggaagaagaggaaagggtgtatgggggtgaaaccctggagcagggaccagg

SEQ ID NO: 6552 - DNA, 117 bp, Artificial
  Hairpin sequence MQbrain_2449, macaque
agctcatctcttgttcccctcatccctgccaccagtctggggcttcaggacctcatgtcagatggatgagaggaagaaagctcctgattggctggtggtggaagaaagggtggggct

SEQ ID NO: 6553 - DNA, 75 bp, Artificial
  Hairpin sequence MQbrain_245, macaque
gtccttcaggacctgggaaggaaaggcacaggcccgcggtggccagccattgtgctgccaccccagcttctggac

SEQ ID NO: 6554 - DNA, 96 bp, Artificial
  Hairpin sequence MQbrain_2456, macaque
ttttggcatttgatgaccaggtcagtcctcctctttacatgccagatgggtttctgggcaagaaccaggggaaagaaaaggtcatggaggccaagg

SEQ ID NO: 6555 - DNA, 97 bp, Artificial
  Hairpin sequence MQbrain_2457, macaque
gcctcttcttgctgtcctaactgactttaaggatctggtcttgagtcttcccataggatctctaagtccttaaggtatgggttttggctctgatggc

SEQ ID NO: 6556 - DNA, 72 bp, Artificial
  Hairpin sequence MQbrain_2458, macaque
ctgccctgggaagggtgacgaggtgtgctgttccttcccaaccccatccctccccacccttcctactcccag

SEQ ID NO: 6557 - DNA, 73 bp, Artificial
  Hairpin sequence MQbrain_2459, macaque
atgcccacaggttccccaattctcacatatggaaagaatacctagtatgtgtgaggagagggtggaggggtat

SEQ ID NO: 6558 - DNA, 81 bp, Artificial
  Hairpin sequence MQbrain_246, macaque
ggtgccttgctttccctcccgtccttccctcttctggattctcggttgagctttggaggggaaggggctgaaggaggaacc

SEQ ID NO: 6559 - DNA, 72 bp, Artificial
  Hairpin sequence MQbrain_2461, macaque
atttatttcacggttcagccatcctatcaaaatttcccttaattgataagatggctgaaccgtgaaataaat

SEQ ID NO: 6560 - DNA, 108 bp, Artificial
  Hairpin sequence MQbrain_2462, macaque
cactggccttgctgtcctcagggctgaccaggcactggctactcttaccatgcggaaattctgcgaggacaaggtggccacagaactgcagccctcccagcgtcggtg

SEQ ID NO: 6561 - DNA, 109 bp, Artificial
  Hairpin sequence MQbrain_2465, macaque
gcaaagttttcttttccttttggtgaggacaggagggtgggagtctttacagtgacaaattttggctcccactctcctatccccaccaaaaaaaaaagaaaacctgagc

SEQ ID NO: 6562 - DNA, 113 bp, Artificial
  Hairpin sequence MQbrain_2467, macaque
acatggtttgataagagtttatagtaaaaagaattggcctactcaggtgtcagcaaagctttcctctctgaataggtcaattccccccactataaacacttttcagcacaagt

SEQ ID NO: 6563 - DNA, 89 bp, Artificial
  Hairpin sequence MQbrain_2468, macaque
tagccacatggtgtggaggactgagaaggtgaggcagttctgccccatgctgccttccaccggttacgacctccaaaatcgaagggctg

SEQ ID NO: 6564 - DNA, 116 bp, Artificial
  Hairpin sequence MQbrain_247, macaque
tgcccctggggtgagggcccccaggaattggagggtgggagctgaggtgagcgtcccttaaggccttctgctcacagcctcctttccctcccccagatcctctccttcatcctgca

SEQ ID NO: 6565 - DNA, 118 bp, Artificial
  Hairpin sequence MQbrain_2471, macaque
gctatcacttggaggtgaacagcctcttttgccagtattcagtgaagaaaggcaagtctaaatatgcagttctctcactggagtgaaagatgttttgttcatttctaatcaactatgc

SEQ ID NO: 6566 - DNA, 79 bp, Artificial
  Hairpin sequence MQbrain_2473, macaque
catgcctgggactggaacacatatatattggttttggagaaaaccccaagagcatatacatgtgctctagtccagtctg

SEQ ID NO: 6567 - DNA, 119 bp, Artificial
  Hairpin sequence MQbrain_2474, macaque
ttctagagtaaggagttttgctggcctcaagccttccgggagtaatggagaccctatacatacctgtttccatgcctcctagaagtttcaaagccagggcaagattcctcagtgtagaa

SEQ ID NO: 6568 - DNA, 116 bp, Artificial
  Hairpin sequence MQbrain_2478, macaque
tggccaatgaaaggacactggaatggaagccaggaatcccgctgtggtggagaggcatagactcatgaatccaccacaatcagatgcttgcttctttttaacagccctatcggccg

SEQ ID NO: 6569 - DNA, 95 bp, Artificial
  Hairpin sequence MQbrain_248, macaque
ccagcgcttcaggatgcctggagctggggaggaaccctattggtgaacatcctggaggccccccgagctccagggtccggagctcccctggctgg

SEQ ID NO: 6570 - DNA, 65 bp, Artificial
  Hairpin sequence MQbrain_2481, macaque
cttctcagtgatggagaacatgccagcgctgagtccggtgggcatggtgactgtcattgatggag

SEQ ID NO: 6571 - DNA, 119 bp, Artificial
  Hairpin sequence MQbrain_249, macaque
ggcaggggtgggccgctctcaggaactaggcagaagagagtcctgtatgggaggcaggagtcaaagcaaaaggccagtgcagccctctctaagccagtaggggaggggcccccagggct

SEQ ID NO: 6572 - DNA, 63 bp, Artificial
  Hairpin sequence MQbrain_2490, macaque
tgtggaggctgctcagcctaccccttctcataattctgggaggggcttggtttggtctcaaca

SEQ ID NO: 6573 - DNA, 97 bp, Artificial
  Hairpin sequence MQbrain_2492, macaque
ctgggatttggggaggggcatgccatcctgcctgtagagaggctgagaccagctcctctccctcaggaggacctgtccatgcccctgatcgaagagg

SEQ ID NO: 6574 - DNA, 79 bp, Artificial
  Hairpin sequence MQbrain_2495, macaque
ttcttcagtgagatgggttctggcaggcatgtgcccagggcagtgtttgtagacctggaacccatggctattgacagag

SEQ ID NO: 6575 - DNA, 89 bp, Artificial
  Hairpin sequence MQbrain_2497, macaque
agtttgtgttctgaaagcctctgtgctgctggatctttgggggggaaatacaggatccttcagcattgaggtgtttaagatttgcaact

SEQ ID NO: 6576 - DNA, 114 bp, Artificial
  Hairpin sequence MQbrain_250, macaque
attgaatgcaatcaagttgggttacctgcctgcaggtaaattaaattaaatcctcatttaaattaggagacatgggtgaggacctaaaggagacaggaggcccaggctttcaat

SEQ ID NO: 6577 - DNA, 77 bp, Artificial
  Hairpin sequence MQbrain_2500, macaque
cataatcacctcagaggtccggagccagattccagagattgtttctgagattctggcaaggccccagggtactgatg

SEQ ID NO: 6578 - DNA, 109 bp, Artificial
  Hairpin sequence MQbrain_2502, macaque
gggggaccggccagcatggccactgtcaaccagtgcttcttcacagacaaggccctgtatgtggtggtctggaacctggcactgggggaggaggccgtggccaacctcc

SEQ ID NO: 6579 - DNA, 87 bp, Artificial
  Hairpin sequence MQbrain_2505, macaque
ctgcagaagatggcagaggtgcaggtcctggtgctcgatggtcaaggccatctcctgggccgcctggcggccatcgtggctaagcag

SEQ ID NO: 6580 - DNA, 68 bp, Artificial
  Hairpin sequence MQbrain_2506, macaque
taatttaccagtcctactggggtttctgcccgccttcccaaggtgggcgaggcctaggaagagagttg

SEQ ID NO: 6581 - DNA, 86 bp, Artificial
  Hairpin sequence MQbrain_2507, macaque
ttgctacggggagcggggaggaagtgggtgctgcttctgcattatctggaaggagcagcccactcctgtcctgggctctgtggtga

SEQ ID NO: 6582 - DNA, 93 bp, Artificial
  Hairpin sequence MQbrain_2508, macaque
ctgggcgttcctgcttggctgctgccctcttctgtcccttttcctatattgggagggatgaagggggagcccagccctggacgtgacgcttag

SEQ ID NO: 6583 - DNA, 99 bp, Artificial
  Hairpin sequence MQbrain_2509, macaque
gggcccggcttctgctgggacagctggagaggagtctcgcgggctgggatgctgttgtggctttgactttggccagtgcttctgacagaggcggagcct

SEQ ID NO: 6584 - DNA, 114 bp, Artificial
  Hairpin sequence MQbrain_251, macaque
ggtgagccaggatggcatccagaggccgccgctgcatttcccgcagggaggacacctgctgtcctttctgtcctgtctggagaatgggctgctgcctcggggacagctggagcc

SEQ ID NO: 6585 - DNA, 102 bp, Artificial
  Hairpin sequence MQbrain_2511, macaque
catgaactgggaactctagcacatgaatagtgggtaatgatgggaagcagccccattcccattattaacccctgccttccctgttagcttcctgcttacgtg

SEQ ID NO: 6586 - DNA, 99 bp, Artificial
  Hairpin sequence MQbrain_2512, macaque
gtaagaatagtatgccagcaatccctgattctctgtctgcttggtgttctctggcagcactaagacaaaggaccagggattaggagtttacgtgcttat

SEQ ID NO: 6587 - DNA, 91 bp, Artificial
  Hairpin sequence MQbrain_2513, macaque
agctgcctggctcagctgggccactgtgggttaaggaagctggcactattttggcccacagtgtcccagcttggctttggctttcttggct

SEQ ID NO: 6588 - DNA, 98 bp, Artificial
  Hairpin sequence MQbrain_2514, macaque
acgaagagccagggccatggagcagcctgtgtagacggggacctgccctgcatgggcaccccctcactggctgcttctcttggtctccaggaaggcgt

SEQ ID NO: 6589 - DNA, 99 bp, Artificial
  Hairpin sequence MQbrain_2515, macaque
agcacttctgtgggccccgagggggtgggagtccaggcagagggcagtcatggcctgagccttctgccactgtctcctcccacggggctccggcatgct

SEQ ID NO: 6590 - DNA, 109 bp, Artificial
  Hairpin sequence MQbrain_252, macaque
tggagcggctggcgcgggagaagattgccacgcaacagcggctggcagagctcaagcacgagctgagccagtggatggacgtgctggagattgaccgcgtgctgcggca

SEQ ID NO: 6591 - DNA, 113 bp, Artificial
  Hairpin sequence MQbrain_2521, macaque
ctgagctcatgccaacgtcagggaaaggattctgctgtcggtcccactccaaagtgcatagaatgggtggtgggcacagaatccggactctgcttgtggcatctgtcgtccgg

SEQ ID NO: 6592 - DNA, 102 bp, Artificial
  Hairpin sequence MQbrain_2522, macaque
ctgcacctttctcgtctcagagtgtgggctttgctctttaggtagaagaactgcgtcgcgacttgaggataaagagccaggagctggaggtgaagaatgcag

SEQ ID NO: 6593 - DNA, 108 bp, Artificial
  Hairpin sequence MQbrain_2523,MQbrain_2582, macaque
agtgttagaatactgtgaaggcaatgacttggatttctatctgaagcaacacaagttaatgtcagagaaagaagctaggtctattgtaatgcagattgtaaatgcact

SEQ ID NO: 6594 - DNA, 104 bp, Artificial
  Hairpin sequence MQbrain_2525, macaque
actatagattcagctgtgggatctggttctgtagctgagagcacatcgctaaacatagatgtgcagtctgaggcttcagataccacggtaagcagctttttggt

SEQ ID NO: 6595 - DNA, 113 bp, Artificial
  Hairpin sequence MQbrain_2526, macaque
gggggcgagggagagaggagcagaaggtggaggtgggtagcccaggttcagggagcttgctttctctctcctacccccctgctccctccactctgcccagctgccctcccccc

SEQ ID NO: 6596 - DNA, 86 bp, Artificial
  Hairpin sequence MQbrain_2527, macaque
gcagggagctgactctgcagaagggtgacattgtctacatccacaaggaggtggacaagaactggctggagggagagcaccatggc

SEQ ID NO: 6597 - DNA, 90 bp, Artificial
  Hairpin sequence MQbrain_2528, macaque
gcctgctcgctgcctttgaccagtggagggaatgggccgacagcaagtcctgctgtgactactctctgcacgtggacatcagcgagtggc

SEQ ID NO: 6598 - DNA, 67 bp, Artificial
  Hairpin sequence MQbrain_2529, macaque
cttcctgactcccaggagcccaagccaagcccagaggcagtggctggggtccctgcagatcatgagg

SEQ ID NO: 6599 - DNA, 99 bp, Artificial
  Hairpin sequence MQbrain_253, macaque
ctgtccttgcagtgaccacgaagcctggagagccagatggctatggacctcacaagggcctgccagttcccaggaagggggtctgggctgccaggacag

SEQ ID NO: 6600 - DNA, 78 bp, Artificial
  Hairpin sequence MQbrain_2533,MQbrain_2613, macaque
gccgaagatggcggaggtgcaggtcctggtgctcgatggtcgaggccatctcctgggccgcctggcggccatcgtggc

SEQ ID NO: 6601 - DNA, 114 bp, Artificial
  Hairpin sequence MQbrain_2534, macaque
agtccaggtcgaaaatggcggcagttggtgtgtcacgggtttctcggctgctgggtcggtccggcccacagctggggcggcctgtgtcgagtggcgcccatggcgaagagggct

SEQ ID NO: 6602 - DNA, 100 bp, Artificial
  Hairpin sequence MQbrain_2535, macaque
gaggagtgaggggaaagcaggccaaccttgaggatcttctcagcatctgaacgccaaggctggggagatcctggacgttggcctgctttccctgcttttc

SEQ ID NO: 6603 - DNA, 115 bp, Artificial
  Hairpin sequence MQbrain_2539, macaque
tgtggattgcggcagtcctgcagctgtgcagggacctaactgggtgtctcccttgcagaaggctgtgggggacccgggcggtggtcagtactctgtagactgcggcacttctgca

SEQ ID NO: 6604 - DNA, 119 bp, Artificial
  Hairpin sequence MQbrain_254, macaque
ttcaaatcgctccaggcttccaagctagcctgggctctgggaagaaggtttgtaggtttggagaaggagctgcttcccaggtgctcaggggatggaagtgataatagggagggtgtgga

SEQ ID NO: 6605 - DNA, 113 bp, Artificial
  Hairpin sequence MQbrain_2540, macaque
cctgggctccagacacccccgatcccccaccaggcccacagtgtgaatcctgcacccatcagggaggcagggctaggtgggccactggggtgtgtgtgggtgctgggctgggg

SEQ ID NO: 6606 - DNA, 102 bp, Artificial
  Hairpin sequence MQbrain_2542, macaque
gtcccttcctgcaatgctgtgtaggcttctcttctgcatcctggataatgtttccaaggtgttgggaaggcctgcgtctcaggtcacaattgtgggtgtgac

SEQ ID NO: 6607 - DNA, 97 bp, Artificial
  Hairpin sequence MQbrain_2543, macaque
tctgctctgagaagcacagctacctgccttcactgaattatacctcaggctgagatttgcagtggcatagcaggtcaggtgatcttctgcaggaagg

SEQ ID NO: 6608 - DNA, 70 bp, Artificial
  Hairpin sequence MQbrain_2546, macaque
gtcctttgttgtagcattgctgtctgcaagggagcccctagcccctggcagacatagctgcttcagtggc

SEQ ID NO: 6609 - DNA, 72 bp, Artificial
  Hairpin sequence MQbrain_255, macaque
ggccctttttggagaaaggccatgtgaaaagggatttcacattgaggtctgcttcctgtttaaggaggtgct

SEQ ID NO: 6610 - DNA, 93 bp, Artificial
  Hairpin sequence MQbrain_2552, macaque
ccagcttcagtggccagattcttgctggggagcttgacaactgtgtgagcagtaccccggacttccccatgcatttggcctgccctgaggagg

SEQ ID NO: 6611 - DNA, 85 bp, Artificial
  Hairpin sequence MQbrain_2556, macaque
tccgtcctcatcctcttgggtgacatttgtagatgtctctgtatcttgacatttacacgtgtcgctcgggacgatgcgtgtcggg

SEQ ID NO: 6612 - DNA, 73 bp, Artificial
  Hairpin sequence MQbrain_2557, macaque
gtgggggagggacagcgtgtccccggaagatgcaggcagcgtctgcaagggggtcagcgccttccactccggc

SEQ ID NO: 6613 - DNA, 110 bp, Artificial
  Hairpin sequence MQbrain_2558, macaque
tgatgacccagattcggttgtaatccaagatgttattgaggacgttgttatagaagatgttcagtgcccagatatcatggaagaagcagatgtatctgaaacggtcatca

SEQ ID NO: 6614 - DNA, 58 bp, Artificial
  Hairpin sequence MQbrain_256, macaque
cctagggtgagtgggctcagcaccaaacttggctgtgcccattccccacgaccccagg

SEQ ID NO: 6615 - DNA, 118 bp, Artificial
  Hairpin sequence MQbrain_2560, macaque
ggttgctgcaccagcttaacatgtgggtgtgatttgaaagttaggttttcagtttgggttctttctggatgagctgttctgtctgtctacacctgtagtgctgaaatacagaaagacc

SEQ ID NO: 6616 - DNA, 82 bp, Artificial
  Hairpin sequence MQbrain_2562, macaque
gcatagcccgggatcgggaaccacctccggggctgcctccggttcttgaggccccccggagcggccctgagaccactgtcgc

SEQ ID NO: 6617 - DNA, 86 bp, Artificial
  Hairpin sequence MQbrain_2563, macaque
ggcagaggccaccagggagtggggatctgaaggaaggggcagggatttctccttcttcttggtcctggctcccaagggcttctgtc

SEQ ID NO: 6618 - DNA, 86 bp, Artificial
  Hairpin sequence MQbrain_2566, macaque
ggcgggcggtttctccgtttgcctgttttgctgatgtacattcaactcattctcagcaaaataagcaaatggaaaatttgtccatc

SEQ ID NO: 6619 - DNA, 85 bp, Artificial
  Hairpin sequence MQbrain_2567, macaque
gtgcctcttccccctttgctaggatttctgtgggaagaaagggtggcttctgtgttctgcgttgtcagtggaggggaagaggtat

SEQ ID NO: 6620 - DNA, 87 bp, Artificial
  Hairpin sequence MQbrain_2569, macaque
gcaggagtcggctttgagtcaaagccagggactgagaaggaagaaatcactgttgggtcctggttctggcctgaagaagaaaccagt

SEQ ID NO: 6621 - DNA, 91 bp, Artificial
  Hairpin sequence MQbrain_257, macaque
ccgaggggcaagggtgtcgggaggagaggtggacaggaaagcgtcctcatcagccatcccaccctcctctcctcccttcgccctctccagg

SEQ ID NO: 6622 - DNA, 112 bp, Artificial
  Hairpin sequence MQbrain_2571, macaque
cccctcttcctctgcctgccagccagccacctttctcttttctggcctggtccctgtgttaggccctatgggggaaaaaggattggggagggctgggaggcggaaagaaggg

SEQ ID NO: 6623 - DNA, 48 bp, Artificial
  Hairpin sequence MQbrain_2573, macaque
ggggagcaggaggggagaacaccaagtgctcttactctcctgagctcc

SEQ ID NO: 6624 - DNA, 83 bp, Artificial
  Hairpin sequence MQbrain_2574, macaque
gctcggcatctgctgagtaccgccatgtctgttgggcatccacagtctcccaccaggcattgtggtctctgctgacgctttgc

SEQ ID NO: 6625 - DNA, 82 bp, Artificial
  Hairpin sequence MQbrain_2577, macaque
tcatgtggtactcttctcaagagggaggcaatcatgtgtaattagatatgattgacacctctgtgagtagagtaacacatgg

SEQ ID NO: 6626 - DNA, 95 bp, Artificial
  Hairpin sequence MQbrain_2578, macaque
gcctctgccttcatgctcctagtcccttccttgaagcggtcggataatcacatgacgagcctcaagcaagggacttcaagctggtggcttccagc

SEQ ID NO: 6627 - DNA, 91 bp, Artificial
  Hairpin sequence MQbrain_2579, macaque
gagatgtgagaacttgtggggagaatgaggtggagaggcccaggttctgaatccccttccctcactcttctctcaggtgatctttattctc

SEQ ID NO: 6628 - DNA, 116 bp, Artificial
  Hairpin sequence MQbrain_258, macaque
gcaacagcctggtccagtgagaggctggtggagttggttttgggtgatggagtcacagaggctcgtcctaggtctaagatgatgccagcacctttgggtgggtcttgggttgaagt

SEQ ID NO: 6629 - DNA, 71 bp, Artificial
  Hairpin sequence MQbrain_2580, macaque
gcattgcccctcccatcccccacagattctgtacaatgggcagagtgtggaggtggacgggcactcaatgc

SEQ ID NO: 6630 - DNA, 81 bp, Artificial
  Hairpin sequence MQbrain_2581, macaque
gcccaggaagccaggccggagttacctttaggggagcctagagtcctctccttggggtaactccagcctggctttctgggc

SEQ ID NO: 6631 - DNA, 77 bp, Artificial
  Hairpin sequence MQbrain_2587, macaque
gagagatgggggacaggtggaagaatggctcagaatattcttctgaaacactcttcggtacctttcccttttctctt

SEQ ID NO: 6632 - DNA, 108 bp, Artificial
  Hairpin sequence MQbrain_259, macaque
catagactcagatccctctgtcctgcagggtcggcatgtcaagactgggcagctggctgccatcaaggtcatggatgtcaccgaggtagggagtggatctgggcagtg

SEQ ID NO: 6633 - DNA, 118 bp, Artificial
  Hairpin sequence MQbrain_2590, macaque
caccttcttgtggatccgggtgcagcagttcacatctcggcgggtggagctgcgcatcttctcccacctgcacgagctctcactgcgctggcacctggggcgccgcacaggggaggtg

SEQ ID NO: 6634 - DNA, 101 bp, Artificial
  Hairpin sequence MQbrain_2592, macaque
atgtcactgctgcattggtgtggcagcaagtgaccaaatgctacaggtcttactatggacaccaggtcaggtgcaactacacaaaacaaagccagttccat

SEQ ID NO: 6635 - DNA, 78 bp, Artificial
  Hairpin sequence MQbrain_2593, macaque
tcatgtactgcagttgcttttttctgcctatgctggtcaagcctagcataggcaccaaaaagcaaaaacagtatgtga

SEQ ID NO: 6636 - DNA, 58 bp, Artificial
  Hairpin sequence MQbrain_2594, macaque; PT_from_HSbrain_121, chimp
gtctgcagccacgctggcctctctgggtgggacttcctctcggagaggcagcggagac

SEQ ID NO: 6637 - DNA, 80 bp, Artificial
  Hairpin sequence MQbrain_2595, macaque
tggaggctgcctggctgtgtcctctcggccaggtgccgtcttggccttggctaggacccagggccacgccgcagccctcg

SEQ ID NO: 6638 - DNA, 114 bp, Artificial
  Hairpin sequence MQbrain_2597, macaque
ggccgggcacgcgcgccccgggctcccgccccccttctgagcctccgccgcctctttccgctggggctgggaggagggaggctgggaggctgctcggggcccagcgtgccagcc

SEQ ID NO: 6639 - DNA, 77 bp, Artificial
  Hairpin sequence MQbrain_2599, macaque
ctgcagcccgaggcctctgtgacgtcacagtgtctgcaggaggagaccatgacgtcacagaggcttagcgctctgag

SEQ ID NO: 6640 - DNA, 95 bp, Artificial
  Hairpin sequence MQbrain_26, macaque
tatatagtggttggtggttgagttatggttggccagcccaccctcaggggtggtgagaaaagcatggctgatgacaggcccggaagcatgacata

SEQ ID NO: 6641 - DNA, 54 bp, Artificial
  Hairpin sequence MQbrain_260, macaque
gcctggcccaagccacagtgagggagtaagagagctgtgggcagcaggccaggc

SEQ ID NO: 6642 - DNA, 74 bp, Artificial
  Hairpin sequence MQbrain_2606, macaque
cctaagtgttcagagcagctaactactggcagctaactactgacactagtagtttgttgccctgaacacatagg

SEQ ID NO: 6643 - DNA, 104 bp, Artificial
  Hairpin sequence MQbrain_2608, macaque
ccccactggcggagaatgaggggctacctgtggctgccctggaggaactggctttcaaagcaagcgagcaggtgggcctgaatggctgggcagaaggtgtaggg

SEQ ID NO: 6644 - DNA, 85 bp, Artificial
  Hairpin sequence MQbrain_261, macaque
gcaggcctccgagtccccgaaggtcccaccatccccgcaggaactccctggatggagggggccgatcccggggagcgggttctgc

SEQ ID NO: 6645 - DNA, 111 bp, Artificial
  Hairpin sequence MQbrain_2610, macaque
agggctttgttctctaggcatggaatcttgtggcatccatgagaccaccttcaactccatcatgaagtgtgacgtggacatccgcaaagacctgtatgccaacacggtgct

SEQ ID NO: 6646 - DNA, 92 bp, Artificial
  Hairpin sequence MQbrain_2612, macaque
gccaggctcagcccgccccattcctgagcccttggtgcagttagctgtagacaagggctaccggattgcagagggaaatgaaccgccttggt

SEQ ID NO: 6647 - DNA, 118 bp, Artificial
  Hairpin sequence MQbrain_2614, macaque
gctttggtgctgattcctgggctctgacctgagacctctgggttctgagctgtgatgttgctctcgagctgggatctccggggtcttggttcagggccggggcctctgggttccaagc

SEQ ID NO: 6648 - DNA, 89 bp, Artificial
  Hairpin sequence MQbrain_2615, macaque
tttttatgcatttgtgttttaccacctccaggagactgcccaaagactcttcagtatcatggagttggtaaagcacagatgcatgaaaa

SEQ ID NO: 6649 - DNA, 117 bp, Artificial
  Hairpin sequence MQbrain_2616, macaque
cccggcttcagtattctggggtcctgggggccggggtgggcaggggtgacttggagagggtgacttgtcggagacaccctctcacccggcccctcatgccccaggaagagcaccggg

SEQ ID NO: 6650 - DNA, 86 bp, Artificial
  Hairpin sequence MQbrain_2617, macaque
ggtgacgggtggtgaagatgacctggtcaccgtgtggtccttcactgagggccgcgtggtggctcgaggccacggccacaagtcct

SEQ ID NO: 6651 - DNA, 115 bp, Artificial
  Hairpin sequence MQbrain_2619, macaque
ttccctctgactcccacttccaagccttggccaccacacccaccccttgtgaatgtcaggcaatgggtgatgggtgtggtgtccacaggcaacaggggagaaggaggagatggag

SEQ ID NO: 6652 - DNA, 69 bp, Artificial
  Hairpin sequence MQbrain_262, macaque
ggatgacgtctccggaggccctggcctccctcccgcctgggcgctaggagccatcccggggctccagcc

SEQ ID NO: 6653 - DNA, 91 bp, Artificial
  Hairpin sequence MQbrain_2620, macaque; MQbrain_2621, macaque
ctggccacatacgcccctgtcatctctgctgagaaagcctaccatgaacagctttctgtagcagagatcaccaatgcttgctttgagccag

SEQ ID NO: 6654 - DNA, 91 bp, Artificial
  Hairpin sequence MQbrain_2622, macaque
ctggccacatacgcccctgtcatctctgctgagaaagcctaccatgaacagcttactgtagcagagatcaccaatgcttgctttgagccag

SEQ ID NO: 6655 - DNA, 93 bp, Artificial
  Hairpin sequence MQbrain_2625,MQbrain_2648, macaque
cctgggccctgaccttctcttatggccgagccctgcaggcctctgccctgaaggcctggggtgggaagaaggagaacctgaaggctgcacagg

SEQ ID NO: 6656 - DNA, 85 bp, Artificial
  Hairpin sequence MQbrain_2629, macaque
ccaggggggtgaagtgaagatggtgctgtgttgtggaaaggggatgcagatccctgcccagcaccaccacctcctatgctcctgg

SEQ ID NO: 6657 - DNA, 85 bp, Artificial
  Hairpin sequence MQbrain_263, macaque
atgaattcctcccactggccctcagctaggacctctctcagtacttctggtctgaggttctctgcccagtgaccacgtcgttcat

SEQ ID NO: 6658 - DNA, 76 bp, Artificial
  Hairpin sequence MQbrain_2631, macaque
ctgcagggcttgttctcaaactggctgtcagaatgtggatggcaggctgcagccacttggggaaccggctctgtgg

SEQ ID NO: 6659 - DNA, 116 bp, Artificial
  Hairpin sequence MQbrain_2632, macaque
gctcggagctgctgcttctggttctcttgtggccgccgtcgctgtccggctgccttgagctgctgaacagacgaggcgtgggccacagcacctcagaagccaacgcagctcgacgc

SEQ ID NO: 6660 - DNA, 90 bp, Artificial
  Hairpin sequence MQbrain_2634, macaque
ggccttcagctgctcggggttggcgagcgcggcgcagcgcttcatcctgcgccacgtgggcgagctgggcgccgagcagctggagcggct

SEQ ID NO: 6661 - DNA, 94 bp, Artificial
  Hairpin sequence MQbrain_2635, macaque
cttgggcctgggatggggacagggatcagcatgacacagatccagtaccttctctcccctactcccttgttccccagtcccctgtgtcatcaag

SEQ ID NO: 6662 - DNA, 92 bp, Artificial
  Hairpin sequence MQbrain_2636, macaque
tgggacctaggctagaagttgttagcatgggaggttttcccatgctaagaagtcctcccatgctaagaactcctagactaggagtcatccca

SEQ ID NO: 6663 - DNA, 117 bp, Artificial
  Hairpin sequence MQbrain_2639, macaque
gttacaactgaaataaagtctgttgaaatgcaccatgaagctttgagtggagctcttcctggggacagtgtgggcttcaatatcaagaatgtgtctgtcaaagatgttcgttgtggc

SEQ ID NO: 6664 - DNA, 118 bp, Artificial
  Hairpin sequence MQbrain_264, macaque
gggaacttccatcctccaggccactttccatcttccccttcctccttctcctcttctggggacacaggatggggaggactggagagcaccaggcaagctgtgagattgagaggacacc

SEQ ID NO: 6665 - DNA, 90 bp, Artificial
  Hairpin sequence MQbrain_2640, macaque
ggcgctccatctccttgtcctcctgacgtctgtgatcccatgaatgggacgatgaagcagactcaggtggtgccgggaaggcggtggctc

SEQ ID NO: 6666 - DNA, 99 bp, Artificial
  Hairpin sequence MQbrain_2643, macaque
gaaaactttgagactgtctttgagtgacctagtctgggacccattcactggtgggttctaaggttagacgctcattcaggatattttcaatactaagtc

SEQ ID NO: 6667 - DNA, 81 bp, Artificial
  Hairpin sequence MQbrain_2644, macaque
ttggggtgacgggtggcgcaatgggatcaggtgcctcaaagggcatcacatctgatcccacagcctcacccatcaccccaa

SEQ ID NO: 6668 - DNA, 107 bp, Artificial
  Hairpin sequence MQbrain_2645, macaque
gggttttctgggtatgtgggcagggccctggggagctgaggctctgggggtggccggggctgacccctgggcctctgctccccagtgtctgaccgtgaccgcaacct

SEQ ID NO: 6669 - DNA, 107 bp, Artificial
  Hairpin sequence MQbrain_2647, macaque
gccactcacctccctctctacctccaacaaccccaccccttccccactgtttctctcctcagctggtggctgggggtcagttccgggtggtcaaggagcccctcggc

SEQ ID NO: 6670 - DNA, 116 bp, Artificial
  Hairpin sequence MQbrain_265, macaque
gtgtcagaccagccctctcctcagctcaccacccttctctgacccgtgccccctccttggctgaaagaaaggagtcttgaagggtggaggggaggtagcggggaggaaggtctcac

SEQ ID NO: 6671 - DNA, 91 bp, Artificial
  Hairpin sequence MQbrain_2658, macaque
gtatcagaacactggcccagtcagaggagttgtctgaggatggggtttcttcagacagctcctctgattagtatggtgtgaaatgtagtac

SEQ ID NO: 6672 - DNA, 93 bp, Artificial
  Hairpin sequence MQbrain_2659, macaque
ctgccctctgcgccccctctaggagacgttttcatcctggtgttcagcctggacaaccgcgactcctttgaggaggtgcagcggctcaggcag

SEQ ID NO: 6673 - DNA, 79 bp, Artificial
  Hairpin sequence MQbrain_266, macaque
ctcctctctcggggggctggttagattggagggcgtgggatctaaacagcaccagctgtccccaagaaaatttaagggg

SEQ ID NO: 6674 - DNA, 95 bp, Artificial
  Hairpin sequence MQbrain_2661, macaque
ctgtaggttctgtcttgggtcacttggatctgaaggctgcccctttgctctctggggtagccttcagatcttggtgttttgattactcactatag

SEQ ID NO: 6675 - DNA, 118 bp, Artificial
  Hairpin sequence MQbrain_2663, macaque
ccgacggctacctccagattggtgggtagggggctgggggagagcgtgggctggggttcggggacaccctctcagcgctgccctcccccaggctccttctacaagggagtggcagagg

SEQ ID NO: 6676 - DNA, 118 bp, Artificial
  Hairpin sequence MQbrain_2664, macaque
ccgacggctacctccagattggtgggtagggggctgggggagagtgtgggctggggttcggggacaccctctcagcgctgccctcccccaggctccttctacaagggagtggcagagg

SEQ ID NO: 6677 - DNA, 81 bp, Artificial
  Hairpin sequence MQbrain_2665, macaque
gggctgacatgtccaccccagtgcacccactctgctttttaactgggcagactggtaagcagactggtgggatctgtgccc

SEQ ID NO: 6678 - DNA, 77 bp, Artificial
  Hairpin sequence MQbrain_2666, macaque
ccatggtgcaatgctttggccacatcagcggtggccacatcaaccctgcagtgactgtggccatggtgtgcaccagg

SEQ ID NO: 6679 - DNA, 71 bp, Artificial
  Hairpin sequence MQbrain_2668, macaque
gcactagattgtaaagactgggatggacctctttcttaatgtccaatgtcctttgtcttaagatttggtgc

SEQ ID NO: 6680 - DNA, 100 bp, Artificial
  Hairpin sequence MQbrain_267, macaque
ttgcagggtctgtttgcccctcatcagcctgcccagcatgtcagggtcacccggaggagaggctgggcggccacaagggaagtaagcttagacagagcgg

SEQ ID NO: 6681 - DNA, 105 bp, Artificial
  Hairpin sequence MQbrain_2670, macaque
cagtcaacattacaactgaagcaacatctgtcgaaatgcaccatgaagctttgagtgaagctcttcctggggtcagtgtgggcttcaatgtcaagaatgtgtctg

SEQ ID NO: 6682 - DNA, 105 bp, Artificial
  Hairpin sequence MQbrain_2675, macaque
gttcttccatgtgaagttgtctcgggctctgggctgacgagagaacacctggtaaccaggttagccctctgtcagtcacctagggcagggcagcatggtgcggat

SEQ ID NO: 6683 - DNA, 76 bp, Artificial
  Hairpin sequence MQbrain_2679, macaque
tctgtctcttaggctttctcttcccagttttcccaaagttgggaaaagctgggttgagagggcaaaaggaaaaaga

SEQ ID NO: 6684 - DNA, 98 bp, Artificial
  Hairpin sequence MQbrain_268, macaque
gcccccttggagttgggtagtatggtgaatggggtttcataaaacctccagcctgcacccctcccttctccatctcgcttgctgcccaacaccatggc

SEQ ID NO: 6685 - DNA, 87 bp, Artificial
  Hairpin sequence MQbrain_2681, macaque
ggcttctcaggagctctgggaggggctgggtttggcagggcagttttcgagccctgtctcctcccatcttccagtttaccagcagcc

SEQ ID NO: 6686 - DNA, 98 bp, Artificial
  Hairpin sequence MQbrain_2684, macaque
gaggtgagccggtcccagaggcagggcgaggggcaagcgggagtggggtttgcagcggacccagccctgcctcctccctgcaggagatcgtcaacttc

SEQ ID NO: 6687 - DNA, 108 bp, Artificial
  Hairpin sequence MQbrain_2689, macaque
accccatcagcaccaagctgtaccagagtgcaggaggcatgccaggaggaatgcctgggggatttcctggtggtggagcttctcactctggtggtgcttccttggggt

SEQ ID NO: 6688 - DNA, 101 bp, Artificial
  Hairpin sequence MQbrain_269, macaque
tactcaaaagagcagagagcagggcccgtagacgcttctagtgcaggacacaggaattctaggcagtgggagaaaagggccctgattggtggctgagagta

SEQ ID NO: 6689 - DNA, 76 bp, Artificial
  Hairpin sequence MQbrain_2695, macaque
ctccttctctctgtcattgacccattagtgatttcttggaagatatcagtaatgggccaatggcagagagaaggag

SEQ ID NO: 6690 - DNA, 79 bp, Artificial
  Hairpin sequence MQbrain_2697, macaque
caggaaggctctctatacctggctccccagtgttctgcccctggcactcagcacaaggagccaggctttggggagactg

SEQ ID NO: 6691 - DNA, 54 bp, Artificial
  Hairpin sequence MQbrain_2698, macaque
gcctctgaggcctcatggaggacacgtggtcagtcctccttgagattctcaggc

SEQ ID NO: 6692 - DNA, 119 bp, Artificial
  Hairpin sequence MQbrain_2699, macaque
gagtctagaaatgttgtctccttcatccttgcaacgaacttgagccattgattcagtaaaacattcaatggcacatgcttgttgttaggatcaaaagagataatccatctaaaggcctc

SEQ ID NO: 6693 - DNA, 99 bp, Artificial
  Hairpin sequence MQbrain_27, macaque
cttgacctgcgagcggagctggactcgctgctcctgcagctgctgggggacctggaggaactggaggggaagcgagcggtgttgaacgcccgggtggag

SEQ ID NO: 6694 - DNA, 114 bp, Artificial
  Hairpin sequence MQbrain_2700, macaque
aggtactgtgctttgtgtgttggaggatgaaagtacggagtgatccatcggctaagtgtcttatcacaatgctgacactcaaactgctgacagcacacgtttttcacagtactt

SEQ ID NO: 6695 - DNA, 117 bp, Artificial
  Hairpin sequence MQbrain_271, macaque
aggcacgtttcctgggaagatctgaactggctgcacctccctctcctctgttctccgtccttctcccaggatggtgaagggggacctagtacccagtgaccccccccctgggatcct

SEQ ID NO: 6696 - DNA, 77 bp, Artificial
  Hairpin sequence MQbrain_272, macaque
tgactcggggtgaggactctgggtttgggggatgggagctaggtccatccctcggcagccaggaggccccagactca

SEQ ID NO: 6697 - DNA, 76 bp, Artificial
  Hairpin sequence MQbrain_273, macaque
tggtgggcactggacaggcatagcagactctcttgtggccacactgggttgttgcctttcagacagtgtcccgcca

SEQ ID NO: 6698 - DNA, 115 bp, Artificial
  Hairpin sequence MQbrain_274, macaque
cgaagctaattggagcaggttgagcgccaggcagctgccactcctgcaggaggagaaatcctccttggatgacctcttgcttggcttgggtttggctctgctctggggggattcg

SEQ ID NO: 6699 - DNA, 70 bp, Artificial
  Hairpin sequence MQbrain_275, macaque; PT_from_MQbrain_275, chimp
ggcagtcggtgcctcaggagacgggcagcagagcatcccacagggcctggcccccatcctggccaatgcc

SEQ ID NO: 6700 - DNA, 99 bp, Artificial
  Hairpin sequence MQbrain_276, macaque
gctgctgttacaccagtgttgttatgccagtgttgttatggtggtggtgttacatcagtattgttaacgctggtgtgacgttgctgttgttacaccggt

SEQ ID NO: 6701 - DNA, 111 bp, Artificial
  Hairpin sequence MQbrain_277, macaque
tcctggggcttggggtggggagaacggagctggctgggaacacctctgtgggggccatctggcccctgtgccagggtctgggccagccccttggtcttgccaggcccggga

SEQ ID NO: 6702 - DNA, 81 bp, Artificial
  Hairpin sequence MQbrain_278, macaque
gggaactcgaaccagggcagtgggaggcactcagccagggcttgtggactggtctgattggcactcttctgccctggtccc

SEQ ID NO: 6703 - DNA, 105 bp, Artificial
  Hairpin sequence MQbrain_279, macaque
ggccaccacagggctgaagagtcaccggtcgggcggcacccggcctgggacgcgtaggggcgcacgtgtcccggcccggagtcgccaagggaccccggcccggcc

SEQ ID NO: 6704 - DNA, 91 bp, Artificial
  Hairpin sequence MQbrain_28, macaque
ggcctgtgtgccctgaccctccccacagcccctctgagaggctaggtctgagcctcaggagtgtatgggattggagctgggccactgggct

SEQ ID NO: 6705 - DNA, 61 bp, Artificial
  Hairpin sequence MQbrain_280, macaque
ccacgcccactagcctactctgtccacagttccttgggctgctgaggggctagtgcagtgg

SEQ ID NO: 6706 - DNA, 85 bp, Artificial
  Hairpin sequence MQbrain_281, macaque
tgagttcaggtgggaggacaggaggcaggtgtggctggaggaagccgcctgaatctgcctccctgacattccacaggtgaaccca

SEQ ID NO: 6707 - DNA, 111 bp, Artificial
  Hairpin sequence MQbrain_283, macaque
ttctttgctgtgagctgggaagtgtgcagttggtggtctttcttctcctttctttaggacagtaagagactcactcactgcacttctgctcagttggcttctgcatcggga

SEQ ID NO: 6708 - DNA, 76 bp, Artificial
  Hairpin sequence MQbrain_284, macaque
gcaagcctgatcccgggggctgacctctggacggtctcagggactgaccagggatgcagccgcgggacgggggagc

SEQ ID NO: 6709 - DNA, 88 bp, Artificial
  Hairpin sequence MQbrain_285, macaque
gcactcaaaaagatgcccaacgtcttccagaatctggtctcttgcaaaagggtcttccgggaattgaagatgttgtgtttttttaagc

SEQ ID NO: 6710 - DNA, 117 bp, Artificial
  Hairpin sequence MQbrain_286, macaque
gcagccatcgactgggggaaaatggcagagcagtggctgcaggaaaaggaggcagaacggcggaaacagaagcagcggctgacacctcggccttcccccagtcccatgatcgaaagc

SEQ ID NO: 6711 - DNA, 64 bp, Artificial
  Hairpin sequence MQbrain_287, macaque
gccctagctctccctgagccatgccaggcatgtgtgactggccctggctggggtcaggaagggc

SEQ ID NO: 6712 - DNA, 73 bp, Artificial
  Hairpin sequence MQbrain_288, macaque
ttggggctggaagtgggaactgggcactgcagtcagctctgatcctggccggttcccctatcctcacccccag

SEQ ID NO: 6713 - DNA, 111 bp, Artificial
  Hairpin sequence MQbrain_289, macaque
ggctcattggtgggagcaatatcaccctacctccagctagctatgggcccagagtttctccctgagtcgctgttgctggtagggagattttctcttcccgccctcacttcc

SEQ ID NO: 6714 - DNA, 67 bp, Artificial
  Hairpin sequence MQbrain_29, macaque
gggtaaagggacagggacgggtggccccaggaagaggggcctggtggagccgctcgtctccctgccc

SEQ ID NO: 6715 - DNA, 86 bp, Artificial
  Hairpin sequence MQbrain_290, macaque
gaaaggaaatctcagagtacatgagaggccaaagctgctatattgcaggcagaggttagaatatgctgctctggaattttcaggtc

SEQ ID NO: 6716 - DNA, 82 bp, Artificial
  Hairpin sequence MQbrain_291, macaque
tctgtctccaccctggggggaaatggccttggcatggggaccaagcgccgtgctgacgccttatttatacccctaggacaga

SEQ ID NO: 6717 - DNA, 93 bp, Artificial
  Hairpin sequence MQbrain_292, macaque
gatcctgggcttcccagcacagaggatgtcatcttgaagacagagcaggtcaccaagaacattcaggaactgttgcgggcagcccaggagttc

SEQ ID NO: 6718 - DNA, 63 bp, Artificial
  Hairpin sequence MQbrain_293, macaque
cctgaggcctgtgtcccaggatggtgtctgcattgtctagggtgagtcactggctttgtcagg

SEQ ID NO: 6719 - DNA, 76 bp, Artificial
  Hairpin sequence MQbrain_294, macaque
gcgggccccggccgcctggagcgcggagccgcaggagcggagcctgggttagcggcggtgctggaagatggcgagc

SEQ ID NO: 6720 - DNA, 114 bp, Artificial
  Hairpin sequence MQbrain_295, macaque
aggactatttgaatgagggggccatggccgacacagctgacctggtggtccttggggccttctatgggcaagggagcaaaggtcagggtggcttctgcccactggggtggtact

SEQ ID NO: 6721 - DNA, 108 bp, Artificial
  Hairpin sequence MQbrain_296, macaque
ttacttttctcttcccacaggccaatggccatgtgtctcaggatcaagaggaacccgtctacctggagagcgtggccagagcacctgctgaggatgagacccaggtgg

SEQ ID NO: 6722 - DNA, 113 bp, Artificial
  Hairpin sequence MQbrain_297, macaque
ctggccgggcggagggtggggctgtactgcggggctggggcggggagcgggcgggaaatggaactgtgacggtcccggcctgaggcccctgcagccacgcatctcccggtgag

SEQ ID NO: 6723 - DNA, 112 bp, Artificial
  Hairpin sequence MQbrain_298, macaque
tgttgttcaaagttatattgctggccagaatggaaattatagaaactagctatgtatgaaatgcatgttttccgtccattgtggccagattaggtatttccttaagatgaca

SEQ ID NO: 6724 - DNA, 113 bp, Artificial
  Hairpin sequence MQbrain_30, macaque
cgccatgcactgcctgggagggctgcatgcaggtcactccgtcagtgtctggggatggacgggcacatggatgggtgaactgacagatgacagactgggcagctgggtgggcg

SEQ ID NO: 6725 - DNA, 77 bp, Artificial
  Hairpin sequence MQbrain_300, macaque
gagccaaggttgaggctgcgtcaacaaccaaattccagtaagaggcagatttggtcgtggacgtggtcagccacctc

SEQ ID NO: 6726 - DNA, 67 bp, Artificial
  Hairpin sequence MQbrain_301, macaque
tctcaccatagctctgccccttggcttcctgcctgcgggaggccatggggtgggatacagggtggga

SEQ ID NO: 6727 - DNA, 71 bp, Artificial
  Hairpin sequence MQbrain_302, macaque
ggatgcttagggttggagggaggctcagaggagtgtcaaatgttcctcttgacccaccctactccccatcc

SEQ ID NO: 6728 - DNA, 90 bp, Artificial
  Hairpin sequence MQbrain_303, macaque
ctctctctgcagggagtcagtggaggggtccggcaggtcaggggtctccccgttcctgcctttttcctggttcacagacagcggcaaggg

SEQ ID NO: 6729 - DNA, 62 bp, Artificial
  Hairpin sequence MQbrain_305, macaque
gcttcccacagtcagcatagaggtggccaacctaaggccaaagctatgtgacttcttggggc

SEQ ID NO: 6730 - DNA, 114 bp, Artificial
  Hairpin sequence MQbrain_306, macaque
agtttgctgccgtggctgactttggggttttctttttagagcctgtcccattgcagcttcagatgctgccaaggttaggcctggggaggagagggttcggctccggcagagtct

SEQ ID NO: 6731 - DNA, 114 bp, Artificial
  Hairpin sequence MQbrain_307, macaque
gggactttatttgccccttgacccctggccaggctgctcagtgggtagataggagaatcctgcttcatctgcctcctccaccttctaggccaggtggcagaggcaaacaagcct

SEQ ID NO: 6732 - DNA, 93 bp, Artificial
  Hairpin sequence MQbrain_308, macaque
atgctaaggaaatgagaaggatgggagtaaaaagaggacaagccccgatgtcctttttatcagttcccccccttctctcctctcctgtctcat

SEQ ID NO: 6733 - DNA, 91 bp, Artificial
  Hairpin sequence MQbrain_309, macaque
gtttttgagttacaatcttcccagccccaccctgctgctgaaggcctttgccttttgcctgctgtagctgtggttgtgcctaaccccagac

SEQ ID NO: 6734 - DNA, 106 bp, Artificial
  Hairpin sequence MQbrain_31, macaque
tccaaggcctcgctgcgggagctggccctgggcagcaacaagctgggtgatgtgggcattgcagagctgtgcccagggctgctccaccccagctccagcctcagga

SEQ ID NO: 6735 - DNA, 77 bp, Artificial
  Hairpin sequence MQbrain_310, macaque
catctggtcactgcacagggccccagtgactgcctcatggcctttcccttcccggggccctctgtgcttgcctcctg

SEQ ID NO: 6736 - DNA, 105 bp, Artificial
  Hairpin sequence MQbrain_311, macaque
ccaagcagcatcaggggaggccagaccgggggtggggcaaagaggaaagcaggggtctctcctctcagcctcaacctgaacctgtcaggccctgtaggctgcggg

SEQ ID NO: 6737 - DNA, 75 bp, Artificial
  Hairpin sequence MQbrain_312, macaque
aggatcctccagcaccttgctcccaggtaccctgttcggggagaggggagcaggtgcatgctgggagagggacct

SEQ ID NO: 6738 - DNA, 92 bp, Artificial
  Hairpin sequence MQbrain_313, macaque
tctgtctgtgtctcttcctccatgagtttgtctgtccttgggggctggggggtacagggagagtgtggaggtgcacggagaatcagtgcaga

SEQ ID NO: 6739 - DNA, 111 bp, Artificial
  Hairpin sequence MQbrain_314, macaque
aggccgccacttggtgtccttggctgtggacgtgtgtgggagtgcactttgtgttttctcctgtgtaccacgcaaccacagcctcgaggtgacgagtgtacctggcgtcct

SEQ ID NO: 6740 - DNA, 78 bp, Artificial
  Hairpin sequence MQbrain_315, macaque
gtggcctctgggcctgggctggcctggcaagggcctcccctttccttggccagggcaggcctagcctgagaatgctac

SEQ ID NO: 6741 - DNA, 99 bp, Artificial
  Hairpin sequence MQbrain_316, macaque
gaagccatgagggaattctctgagtacatgcattttcacacatctgctaatgcaaaagccccttgtgagcattagtactcaggaatgtgatgtggattc

SEQ ID NO: 6742 - DNA, 110 bp, Artificial
  Hairpin sequence MQbrain_317, macaque
aggctgaaggggatgctaaaggagataaagccaaggtgaagcatgaaccacagagaagatccacgaggttgtctgctaaacctgctcctccaaagccagagcccaagcct

SEQ ID NO: 6743 - DNA, 76 bp, Artificial
  Hairpin sequence MQbrain_319, macaque
cttgggtttcctccagctttcttgctctcttgccattgctgggcccagagaggaggggagatggttggaacttgag

SEQ ID NO: 6744 - DNA, 90 bp, Artificial
  Hairpin sequence MQbrain_32, macaque
gaggaaggggcctgtgagggacgcttccccagcaccccttgcacagggggagccagggcaggaagacctccccaccaggtcgccagcctt

SEQ ID NO: 6745 - DNA, 119 bp, Artificial
  Hairpin sequence MQbrain_320, macaque
ccctgttagtattggggaggggagggggtagcaatcaaaccagctagcaaggtgcccccggagaccctctgccaggcctggtttgtttgcctttctctttctactccccaaacctgggg

SEQ ID NO: 6746 - DNA, 93 bp, Artificial
  Hairpin sequence MQbrain_321, macaque
gagacagagagtcagcatagaccagcgtcatcctcctccctgccgcacctggccagggcagggatgggatgaggctgggaagggcctcatctc

SEQ ID NO: 6747 - DNA, 68 bp, Artificial
  Hairpin sequence MQbrain_322, macaque
ttcgtaactctggttgtaactggggaccctgcccatgagggcagggtgaccccaggtccggaggtgga

SEQ ID NO: 6748 - DNA, 114 bp, Artificial
  Hairpin sequence MQbrain_323, macaque
ttcctcatttggcctgagcggctcagagtcaggaagtcagagcgcaggtgagtgtgtgtgctcttacctgtgtatgttacctgtctgtgtgccttgggggggagtgaaaagggg

SEQ ID NO: 6749 - DNA, 74 bp, Artificial
  Hairpin sequence MQbrain_325, macaque
tggctgggtgactaaagggcttgtcttggtggggtctcccatccctccaagacccatcctgcacagtccctcca

SEQ ID NO: 6750 - DNA, 88 bp, Artificial
  Hairpin sequence MQbrain_326, macaque
cccacctcaactcctgcctggggctcttcctgcccagccagccccatccggaagttgggagggagagctactggaagagtatgctggg

SEQ ID NO: 6751 - DNA, 73 bp, Artificial
  Hairpin sequence MQbrain_327, macaque
attaagttttccccaagcaaggaaggcaggtggtcagagagatcaaacgctgctggcgtggggattgcaggat

SEQ ID NO: 6752 - DNA, 118 bp, Artificial
  Hairpin sequence MQbrain_328, macaque
ctaacttcataaagtccaactggaagggaagaattggagggacggaataccaggagaggggctccaggctccgtccttcaaagttcctgccttccaaggttgcgatggtgtggagtgg

SEQ ID NO: 6753 - DNA, 92 bp, Artificial
  Hairpin sequence MQbrain_329, macaque
gacttcttgctccccttcctggaagaggtgagtgagtcaggccaacttaaagggtgcaggcctggtctcagacccccaggaatagcgttgtt

SEQ ID NO: 6754 - DNA, 102 bp, Artificial
  Hairpin sequence MQbrain_33, macaque
ggaggcgatcacctatggccggaagctgggcgggtgagtgcctggactcgggagggtcccagctaggccctcacgctagtctagttggccttgtttccctcc

SEQ ID NO: 6755 - DNA, 112 bp, Artificial
  Hairpin sequence MQbrain_330, macaque
gcccctcccaccgcccgcccccctgggggcgcagggcatggtgtgaaaggccaagtgctgaggcgggtatcatgggtgctgtgccctagggcctgggtggcagggagtgggt

SEQ ID NO: 6756 - DNA, 81 bp, Artificial
  Hairpin sequence MQbrain_331, macaque
ggggccccatgggagggggtggtcggtgctcctttttctttaaagctcttttggccagctgcccctctgccccaggacccc

SEQ ID NO: 6757 - DNA, 65 bp, Artificial
  Hairpin sequence MQbrain_332, macaque
ctgctccctcctcctttttcccccgcctccattttgttcgcggacgctggggacggtgggagcag

SEQ ID NO: 6758 - DNA, 110 bp, Artificial
  Hairpin sequence MQbrain_333, macaque
tctttgacctttgccacttacatctccttattgatcctcatacctaagtctctttgacttagagtaaagtggacttttgagtgggggtaagtttgacaaattgttggaga

SEQ ID NO: 6759 - DNA, 92 bp, Artificial
  Hairpin sequence MQbrain_334, macaque
gggcctgaaagttgctagcaacagtacctaagctcagaaaggtctaagaccctatgctttctgagcttagctactgtttctagaatttgttc

SEQ ID NO: 6760 - DNA, 97 bp, Artificial
  Hairpin sequence MQbrain_335, macaque
ggggtgggtgggaggcagcctctccctccagcctgggctttctggggctggagtgccccttctgtccgggttgtgtctgctcccctcgtcctgccct

SEQ ID NO: 6761 - DNA, 116 bp, Artificial
  Hairpin sequence MQbrain_336, macaque
ggtcttgggtttgggcgggggggccagaccttgggaaggggcttaggaagggagaggcagctcttccttcagctggctctcatcaggctgcagtccccctccccgcccccacctcc

SEQ ID NO: 6762 - DNA, 103 bp, Artificial
  Hairpin sequence MQbrain_337, macaque
agagcagctgcctgagagaggacccttgtcatccccagccgctgagtgcagaactcacccctgcctcgtggcagggatgtccacctctttctacagaaggcct

SEQ ID NO: 6763 - DNA, 116 bp, Artificial
  Hairpin sequence MQbrain_338, macaque
ttgtctggcgagtctgatctagagaattcctcccagtctggaagccttcctgagacccctgagcatagttctggggaggaagatgactgggaatctagtgcagatgaagcagagag

SEQ ID NO: 6764 - DNA, 92 bp, Artificial
  Hairpin sequence MQbrain_339, macaque
tgatggtttgctgtttggaagccactggcagggctgccgtgcatgtggctgtgagggctgcacagccctgccaaggggcttcctccccgtca

SEQ ID NO: 6765 - DNA, 116 bp, Artificial
  Hairpin sequence MQbrain_34, macaque
ctgtgccaccccgcagacaccctggtctctttcctggaggcactgagtccgtcaaacagcagggctcagcgttctgaggacagagggcaggggccctgggtggtttggtggcagag

SEQ ID NO: 6766 - DNA, 84 bp, Artificial
  Hairpin sequence MQbrain_340, macaque
tcttgcggcgagcgggctggcgtgcggcggcgttgcgggcgggagcggctgcaacgccggtgcctgaggagcgatgccgaggga

SEQ ID NO: 6767 - DNA, 110 bp, Artificial
  Hairpin sequence MQbrain_341, macaque
aggctgaaggggatgctaaaggagataaagccaaggtgaaggacaaatcacagagaagatctgcgaggttgtctactaaacttgctcctccaaagccacagcccaagcct

SEQ ID NO: 6768 - DNA, 113 bp, Artificial
  Hairpin sequence MQbrain_342, macaque
cccctggcttgcctgccccaggctgctgcctgtgcccccgacctccctgccttctcccacgggggcttctctcacaactaggcggtccctgggatggggcatgtggccaaggg

SEQ ID NO: 6769 - DNA, 110 bp, Artificial
  Hairpin sequence MQbrain_343, macaque
aggctgcaccaatgaatcctgagcaggttctagctcagtatgtggatctctgacttcagtcaggcttcgatgcagagtctgaacctggtctggatgaggagctgtagtct

SEQ ID NO: 6770 - DNA, 76 bp, Artificial
  Hairpin sequence MQbrain_344, macaque
gtcctgagggcctgggtgctggtgggagattctgccctccagggtaggccagttacccagggctgtctcttaaaac

SEQ ID NO: 6771 - DNA, 74 bp, Artificial
  Hairpin sequence MQbrain_345, macaque
tggcgtagccagcgcacctagctgaggagtgtaagtagtagaagccactggcgtctgagcagggtgaaggccca

SEQ ID NO: 6772 - DNA, 116 bp, Artificial
  Hairpin sequence MQbrain_346, macaque
tggctccttctctgttactgtggcttggtgttgtccttcctcttccagccaagccagctctgtgaacagcttttggtgttgaggaggaagattcccagccgccaacagtaatgtca

SEQ ID NO: 6773 - DNA, 86 bp, Artificial
  Hairpin sequence MQbrain_347, macaque
gggagaggctggtgaaacggctctcctctgccgtccttccacaggggcgcagatcctgaggccgagctctgccaacttccttcccc

SEQ ID NO: 6774 - DNA, 108 bp, Artificial
  Hairpin sequence MQbrain_349, macaque
ggctgcaccagtgagtcctgagtaggttctagttcagtatgtggatctctgacttcagtcagttttcgatgcagagtctgaacctggtctggaccaggagctgtagtc

SEQ ID NO: 6775 - DNA, 111 bp, Artificial
  Hairpin sequence MQbrain_35, macaque
gggtgtctcctggagaggacgtggcccctgctgccagctcctgagcagcccgtgtcggggccggagggagccgcacagtgggggccagcctcgctggacggagaataaccc

SEQ ID NO: 6776 - DNA, 111 bp, Artificial
  Hairpin sequence MQbrain_350, macaque
ttacagactgtaccaatgaattttgagtaggttctagttcagtacgtggacctgtgacttcagtcagttttcgatgcagagtctgaacctggtctggacgaggagctgtag

SEQ ID NO: 6777 - DNA, 95 bp, Artificial
  Hairpin sequence MQbrain_351, macaque
ccccaccctgcatacctgtggagaggaggctgatgcctcttgcgcatcttatccccccactcccatccctcctcaagtccccaggggctgtgggg

SEQ ID NO: 6778 - DNA, 75 bp, Artificial
  Hairpin sequence MQbrain_352, macaque
ctgggtgaggaggtgagagggagaggggaatgcagcttggcgcagcctccctgcctgaggtcagccatcacgtgg

SEQ ID NO: 6779 - DNA, 63 bp, Artificial
  Hairpin sequence MQbrain_353, macaque
ccaccaggcctggctcagcgctaggccgggcttggctcgtctgagagcagctggggctggtgg

SEQ ID NO: 6780 - DNA, 74 bp, Artificial
  Hairpin sequence MQbrain_354, macaque
cctgggcactccagtgacgccggagctgcctgggccagatcccacacccagcctcactggctcctgtccccagg

SEQ ID NO: 6781 - DNA, 117 bp, Artificial
  Hairpin sequence MQbrain_355, macaque
tgccgggcttggttggctggttgtgctcgttgcataatctgggccctggggccagccctgtgaagctgccagggacagtgtgtgcgaggcagagctgccaaacaggccttgcaggca

SEQ ID NO: 6782 - DNA, 81 bp, Artificial
  Hairpin sequence MQbrain_356, macaque
ctccttctcatccaatgctcccggaaggtctcgcttgttacccaggactaagacctatggagaagcgagggtgaggatgag

SEQ ID NO: 6783 - DNA, 95 bp, Artificial
  Hairpin sequence MQbrain_357, macaque; MQbrain_667, macaque
tctgcctgtcacagtctgcgtgtcctggtcactggtctttataattgttgtgcaataactaaaggctaaggactagatgcactatcgtgtaaaga

SEQ ID NO: 6784 - DNA, 109 bp, Artificial
  Hairpin sequence MQbrain_358, macaque
agatttattctcatgctcttggctatactgtgaattactgaaatgttgaacaaacctgtgaaagacatacattcgctctttaagatggccaggagctaaacttgagtct

SEQ ID NO: 6785 - DNA, 83 bp, Artificial
  Hairpin sequence MQbrain_359, macaque
aagcccactccccacgcagggcctttcctgtcccttgtggggccttccaaccctgtcctttccactggtgggtggtgatgctt

SEQ ID NO: 6786 - DNA, 107 bp, Artificial
  Hairpin sequence MQbrain_36, macaque
tggcatcttgcccgcccctcagcaccctgccttgtctccaggaggtccgaagctctgtaggacctcctgggggcaaggtggggtgaggtcggagagtagggaggtca

SEQ ID NO: 6787 - DNA, 96 bp, Artificial
  Hairpin sequence MQbrain_360, macaque
ctcctcatccattccgtagtctctgagcctggtcctcagcccaaagctggctccctagaccaatgagagccagagaaccagaatgggccataggag

SEQ ID NO: 6788 - DNA, 101 bp, Artificial
  Hairpin sequence MQbrain_361, macaque
gccgtactcccacagaggcaccccgcaggacacagtgacttcaggctccttttcttggaaacactgttggctgtgacctcttttccctctgacaccttggc

SEQ ID NO: 6789 - DNA, 99 bp, Artificial
  Hairpin sequence MQbrain_362, macaque
tcagacttcagggaagcagaggactaggagagcggggcagaagattctggatgggaggagtggcctgtcctacattatgaagctacccagggggtctgg

SEQ ID NO: 6790 - DNA, 88 bp, Artificial
  Hairpin sequence MQbrain_363, macaque
ggaaggtaatagaatgtgtgttgggagaggctttccttaagagccagtgcagaggaaagtcttgaaatgcactaaggaaatacagtct

SEQ ID NO: 6791 - DNA, 67 bp, Artificial
  Hairpin sequence MQbrain_364, macaque
ttactgaaacctgaaagagcctgcagccagtgttttctggcctcaggccttgaaagctgggcagtaa

SEQ ID NO: 6792 - DNA, 83 bp, Artificial
  Hairpin sequence MQbrain_365, macaque
aacctcaacaggcattgtgtgacttggggtcagcctaggcggttgcctctgaaccctgtgttgcactgcagcctaggaaggtt

SEQ ID NO: 6793 - DNA, 101 bp, Artificial
  Hairpin sequence MQbrain_366, macaque
tgattgatgctacacctgcctctgatgtgacaaaaccgaagccatgaatcaaagctttctatgattcttgcgcattctgaggctggtgaaagcactagccg

SEQ ID NO: 6794 - DNA, 83 bp, Artificial
  Hairpin sequence MQbrain_367, macaque
acaccaggcatggtggaaatcgggacctctgtttattcagtcggtcatctgctgattgagtgggtctgttcaatcgtgcatgt

SEQ ID NO: 6795 - DNA, 61 bp, Artificial
  Hairpin sequence MQbrain_368, macaque
gccttcatggtgtgggcgcaggcggcgcgcaggaagctcgcggaccagtacccgcacttgc

SEQ ID NO: 6796 - DNA, 79 bp, Artificial
  Hairpin sequence MQbrain_369, macaque
ccagtttccttttctttgctctgttttctctgaggatcccatgctgagtggagacagagccaggaatactaacagttgg

SEQ ID NO: 6797 - DNA, 78 bp, Artificial
  Hairpin sequence MQbrain_37, macaque
gggcaacagggtgaggacagccaggctctctggggccaccccccagcccccacccttcttgcctcccctgcactgtcc

SEQ ID NO: 6798 - DNA, 111 bp, Artificial
  Hairpin sequence MQbrain_370, macaque
gcatgacagcaaagactcagtctctttcatttgtccagatcaatgcccacgtgcccaatttaggtcaaggcatcaggcagaggaaaggactggagactgacattgagatgc

SEQ ID NO: 6799 - DNA, 59 bp, Artificial
  Hairpin sequence MQbrain_371, macaque
gggcagggcacaggtgggagtgaggacccccctccacagtgccccttctagcccttccc

SEQ ID NO: 6800 - DNA, 91 bp, Artificial
  Hairpin sequence MQbrain_372, macaque
gtcttcctgggccctggggctcactgtggaggagctgacggcttgggcccttggccagtcctggctcttctttgggcctcaccagggacac

SEQ ID NO: 6801 - DNA, 79 bp, Artificial
  Hairpin sequence MQbrain_373, macaque
gtggaggccaactacccggagacactgggccgcctgctcatcctgcgggcgcccagggtgtttcctgtgctctggacgc

SEQ ID NO: 6802 - DNA, 108 bp, Artificial
  Hairpin sequence MQbrain_375, macaque
gctgatgctgctgcctgcatcctggcacctcccctgggcttgcccagccagagagctatgggcggcggccttggaggggagccagggagcagagccagaggctccagc

SEQ ID NO: 6803 - DNA, 101 bp, Artificial
  Hairpin sequence MQbrain_376, macaque
tccaactgtggcccgtgttctctccttttgtccccacagtgtgactctgccaggaacctggagtggctgaagactgtgaaggagagtcatgggtctgtgga

SEQ ID NO: 6804 - DNA, 107 bp, Artificial
  Hairpin sequence MQbrain_377, macaque
aaagtcacctgcaggcctcccaaagaggtgatagacatggagctgagtcctcagaggagtgacacagagcctgggatggatcagtgggagttctgcagcgaaacttt

SEQ ID NO: 6805 - DNA, 118 bp, Artificial
  Hairpin sequence MQbrain_378, macaque
ggctgtgactcctgatggggcaactgggagtaggggatactccaggcgctcgtgccttctgagaacgcctgccctgggggcatctcctgagtccagtgccccagtcttagagaaggcc

SEQ ID NO: 6806 - DNA, 89 bp, Artificial
  Hairpin sequence MQbrain_379, macaque
ctctcccgtggaggagaggggatggctgaggacactggcccttaccccagagccaggcagcatccatccctgctgtttgcatctgagag

SEQ ID NO: 6807 - DNA, 116 bp, Artificial
  Hairpin sequence MQbrain_38, macaque
ggggcccgaacctgagggactgctgtgctgtgggtgtctgtggtcagcattgctggtgttggcagtgaccgctgagcttgtgagcacgtggggaggcagtgtaggggtgtggcctt

SEQ ID NO: 6808 - DNA, 115 bp, Artificial
  Hairpin sequence MQbrain_380, macaque
gtctgtggctgtttccccttcactgacagctagaccggtaagcccacccttcccacagggaatgggctgttcccacctgggtcctgctgtggccacggtgggcagccaaaaagat

SEQ ID NO: 6809 - DNA, 83 bp, Artificial
  Hairpin sequence MQbrain_381, macaque
tttggcttgggcagggtaggggtggccgatgctccccacggggtccctcctcggtctccctcccccaagagctctgggccaag

SEQ ID NO: 6810 - DNA, 115 bp, Artificial
  Hairpin sequence MQbrain_382, macaque
ctgcccagccccagctatgcgcacccggccctcgtgggcaaggacaagaaggggcgggcgcccatccccccgctgtccatggggctggcactgcgcaagtacgcgggccaggcgg

SEQ ID NO: 6811 - DNA, 68 bp, Artificial
  Hairpin sequence MQbrain_383, macaque
gggcttgtgccgatgggtggtgtgatgcctggggctgtccctgctgcagcagcccaggaggtgagtcc

SEQ ID NO: 6812 - DNA, 83 bp, Artificial
  Hairpin sequence MQbrain_384, macaque
cccacctccaagaggctgcagccccgtgtctggccatgtgagccttggcctttcaccagggctgctggtttcttctctgtggg

SEQ ID NO: 6813 - DNA, 109 bp, Artificial
  Hairpin sequence MQbrain_385, macaque
gccaagctcatcaccagcttcctggagctgcactgccttgaaagccccacagagctgtctcagagcagtgacagtgaggccggcgaccctgggagccagagctgacagc

SEQ ID NO: 6814 - DNA, 89 bp, Artificial
  Hairpin sequence MQbrain_386, macaque
ttttggcagtggcatccggggccggggtcgcggcggccgtggacagggccggggctgaggccacagagctcgcggaggcaaggccgagg

SEQ ID NO: 6815 - DNA, 54 bp, Artificial
  Hairpin sequence MQbrain_387, macaque
tcgggcgaggttctctggtcctcaggtgtgggggggccagggaagtcgcgccgg

SEQ ID NO: 6816 - DNA, 105 bp, Artificial
  Hairpin sequence MQbrain_388, macaque
ttcattcccctttttttcctttaatagcctgctccacccagagaagcacactttgtgagaaccaatgggaaggagcctgagctgctggaacctattccctatgaa

SEQ ID NO: 6817 - DNA, 87 bp, Artificial
  Hairpin sequence MQbrain_389, macaque
tggcttgctgagaggtagctggcctagtgtacagggactatgagggtcccttgccctggagctgtgcacctccccgcgtgtgggcca

SEQ ID NO: 6818 - DNA, 116 bp, Artificial
  Hairpin sequence MQbrain_39, macaque
ggggagacgttgggtgacgttccctggagagagtaagatggttttgggggagacgttgggtggcgttccctggtgagagtgggatggttttggggagacgttgggtgacgttccct

SEQ ID NO: 6819 - DNA, 79 bp, Artificial
  Hairpin sequence MQbrain_390, macaque
aggcattttggacgccaggggaaatggaaatgttgctttcaaaacttagtttcctttccatttcttcctagtctggcct

SEQ ID NO: 6820 - DNA, 116 bp, Artificial
  Hairpin sequence MQbrain_391, macaque
gtgatagtaattgtttgtttctcctgactcctctggttgttctgctcacacaggcactgctgggagacagtggcagccagaactggagcactggaacagcagataaatacgggcgc

SEQ ID NO: 6821 - DNA, 99 bp, Artificial
  Hairpin sequence MQbrain_392, macaque
ctgggtggatggtgcaggtttagagggggctgaggatgaggaaacagaggagctcttcctgacctacagcctgaggcccactgcctcatcatcccctgg

SEQ ID NO: 6822 - DNA, 93 bp, Artificial
  Hairpin sequence MQbrain_393, macaque
ccttgctccaaagtcatcgtccggtttctcactgtgatgatgaagcatggttacactggtgaatttgaaatcattgatgatcacagagctggg

SEQ ID NO: 6823 - DNA, 91 bp, Artificial
  Hairpin sequence MQbrain_394, macaque
tcatggtatcttcttgctaaccatcaccaccagctctccttaataagtgagcaagagtgggtcaggggagaaggaaaagaggtcaacatga

SEQ ID NO: 6824 - DNA, 115 bp, Artificial
  Hairpin sequence MQbrain_395, macaque
ggggacatgggagggcgctgaacggaaatattcatgaaaccaggaaaggtttcataagcccaaacggctgttcctgggatttatgaagtaactgtttgcattttcttctggccct

SEQ ID NO: 6825 - DNA, 96 bp, Artificial
  Hairpin sequence MQbrain_396, macaque
aggtcacgaagggaagatggctgtggaaggtgttttaaaggtgagtatctgcttccatttctttcctttcttttcccattttcccttctcttgcct

SEQ ID NO: 6826 - DNA, 70 bp, Artificial
  Hairpin sequence MQbrain_397, macaque
cctaccctggttcgggtgtgcgggtgtgagggtcaagcttcctcagaccccagccacctgcagcaggcgg

SEQ ID NO: 6827 - DNA, 108 bp, Artificial
  Hairpin sequence MQbrain_398, macaque
gcaacactcactcttccaccttcaatgctggggctggcactttgtcaagctcatttcctggtatgacaatgaatctggctacagcaacagggtggtggacttcatggc

SEQ ID NO: 6828 - DNA, 81 bp, Artificial
  Hairpin sequence MQbrain_399, macaque
ggacgtgccctctatatgaggttggggagcggctgagtcggccttttccgcccgctcccccctccccccgagcgccgctcc

SEQ ID NO: 6829 - DNA, 57 bp, Artificial
  Hairpin sequence MQbrain_4, macaque; PT_from_MQbrain_4, chimp
gtttgaccgctggccctaccttgctcctgacctggggcctgtggggcagctgtctgc

SEQ ID NO: 6830 - DNA, 117 bp, Artificial
  Hairpin sequence MQbrain_40, macaque
ggggaatacgttgggtgacgttccctggagagagtaagatggttttggggaatacgttgggtggcgttccctggagagagtaagatggttttggggagacgttgggtggcgttccct

SEQ ID NO: 6831 - DNA, 87 bp, Artificial
  Hairpin sequence MQbrain_400, macaque
ccagaaatgtattctgtgatagtgattttgatttgagtctcagcttgagttgaaattgcttagcatttgactaaaatatatatttgg

SEQ ID NO: 6832 - DNA, 109 bp, Artificial
  Hairpin sequence MQbrain_401, macaque
gcctcccaagcctgtgcccagggctctgtccccgactccgaggactgggatggggtgaactatgccgaggagggaggggacggagcctgaggctggcccaggctgaggc

SEQ ID NO: 6833 - DNA, 109 bp, Artificial
  Hairpin sequence MQbrain_405, macaque
gggccggaaggagggcagagccatgggcctgggcctgcttttccaggatcctacatgaaagagcactggccagagagggcccagctctagccatggctccggcgagccc

SEQ ID NO: 6834 - DNA, 78 bp, Artificial
  Hairpin sequence MQbrain_406, macaque
tcccctgctcctccccattggggaaagcatctctggagggcttttgactggagaaatggggaaggaggagctggggga

SEQ ID NO: 6835 - DNA, 98 bp, Artificial
  Hairpin sequence MQbrain_407, macaque
aagctgcaggaaccaaccatgtggacaaatgaaaaaatgcctgttgtctacagattgcagcaatcctacataaacatatggaggtctctgtctggctt

SEQ ID NO: 6836 - DNA, 119 bp, Artificial
  Hairpin sequence MQbrain_409, macaque
ctccagtgattccaggactgtggagagcatcctggtgtgacaacgttgtctgctcatacagagcagacattccccgttttcctcattccaggtctcacagagtaagagtcacttggtag

SEQ ID NO: 6837 - DNA, 119 bp, Artificial
  Hairpin sequence MQbrain_41, macaque
agaagtggggttgggcaggggctgataagcagtttggcagcaccccaagtgcaaaggccctgtggtgggaagctgccaagctgtttccttttcctttgtgtaagtatctttaatattct

SEQ ID NO: 6838 - DNA, 93 bp, Artificial
  Hairpin sequence MQbrain_410, macaque
gtccaatcttggatttccagagtcttataatgtagcctcactttctgggtgcaggagaggctggtgatggctacggaggaccataagttggat

SEQ ID NO: 6839 - DNA, 76 bp, Artificial
  Hairpin sequence MQbrain_411, macaque
gcgtaatgcatcattggctgactaatgagccctgaagactcgggtgctcatgatcagtgtgtacaatgcaactagc

SEQ ID NO: 6840 - DNA, 96 bp, Artificial
  Hairpin sequence MQbrain_413, macaque; MQbrain_414, macaque
tccgcggaggtttcggcagtggcatccggggccgcggtcgcggcggtggacgggccggggcagaggccgcggagctcgcggaggcaaggccgagga

SEQ ID NO: 6841 - DNA, 117 bp, Artificial
  Hairpin sequence MQbrain_415, macaque
gctgagaaagactgctgtgagctgtgttgccaccctatataaaactgggctccctaagtcaggatgcctgagggagatagagatgttgggtgaacaattagcagtatctgtcacagt

SEQ ID NO: 6842 - DNA, 86 bp, Artificial
  Hairpin sequence MQbrain_416, macaque
ccagccattaatttgagaggtaaatcaaccctctctctcctccaaataactgacaatggaagaggagtggcctctcaaaaggtagg

SEQ ID NO: 6843 - DNA, 96 bp, Artificial
  Hairpin sequence MQbrain_417, macaque
ccatctgccccgaaggaaacaaacgctcctgcagactacagatagcagatgctgctctcttccttcctgcagcagcatttaccactggtctgatgg

SEQ ID NO: 6844 - DNA, 93 bp, Artificial
  Hairpin sequence MQbrain_418, macaque
atgaaagtggggtgtcgggggactagggacatgtgcagagagagactctctggcctctttgctgtcttttgtccccttccctctcacttctgt

SEQ ID NO: 6845 - DNA, 100 bp, Artificial
  Hairpin sequence MQbrain_419, macaque
catttcccacttgtctttttaaattctttcttggggttttgccagagtcaactagaaaatgtctcatgtgaaactttgagagaagagacattgtaaaatg

SEQ ID NO: 6846 - DNA, 93 bp, Artificial
  Hairpin sequence MQbrain_420, macaque
ctgcagagcgacccccactcagccttctggacagccaggttcagtttcatatggtggctgttccccaggctggtttgggtagcctctctctag

SEQ ID NO: 6847 - DNA, 72 bp, Artificial
  Hairpin sequence MQbrain_421, macaque
gacagaggtctttctccccttcccacctcccgctaccagtcactaggagggagaaggggacagaagctcgtc

SEQ ID NO: 6848 - DNA, 118 bp, Artificial
  Hairpin sequence MQbrain_422, macaque
tggtgtgtgctgagggtggccgcaggggtctgcagggtgatcccaccaggctctccagcatgcactgagctccctgggggctcaccctactaccctgatagccagcctcaagtagcca

SEQ ID NO: 6849 - DNA, 71 bp, Artificial
  Hairpin sequence MQbrain_423, macaque
gggccctcccctacggacgcacttcccttccccggcaggaaggagggtgctgacccagggggcacacgccc

SEQ ID NO: 6850 - DNA, 86 bp, Artificial
  Hairpin sequence MQbrain_424, macaque
gagatcaggtagaagatctacaaaacgagttggaggctggaaacaaatttcagatagtgataagtagaaatgttctgccttaactc

SEQ ID NO: 6851 - DNA, 69 bp, Artificial
  Hairpin sequence MQbrain_425, macaque
agcaaacactggtgagccactggtgaggaaacataaccttcctaaatcgctgaggctcccagagtggct

SEQ ID NO: 6852 - DNA, 118 bp, Artificial
  Hairpin sequence MQbrain_426, macaque; MQbrain_700, macaque
cttaaggagacttcctgtgggttgccatgttgcacgtccattagatcttgattttacaggtgaaggtcatggccaaaggtgatgataaaagcagccaacaggctccatctcacttaag

SEQ ID NO: 6853 - DNA, 105 bp, Artificial
  Hairpin sequence MQbrain_427, macaque
tgccaagactgagtggctagatggcaagcatgtggtctctggcaaggtgagagaagaaactgaatattgtggaggccatggagtgctttgggtccaggaatggca

SEQ ID NO: 6854 - DNA, 115 bp, Artificial
  Hairpin sequence MQbrain_428, macaque; MQbrain_429, macaque
acttcttccagctctttgtcccagacaacgtcctcaagaacatggtggtgcagacaaacatgtacgccaagaagttccaggagcggtttgggagcgacggagcctgggtggaggt

SEQ ID NO: 6855 - DNA, 111 bp, Artificial
  Hairpin sequence MQbrain_43, macaque
ctgggtctgtcctccaggggacaggctcagccaccttgagcaagttatgaggtctctttgggccttgttgcctggtgcctgccctgtcccatcccctgggggctgatgagg

SEQ ID NO: 6856 - DNA, 98 bp, Artificial
  Hairpin sequence MQbrain_430, macaque
tcacaggacaggtttgtgaaagatgtgaattctctcagacacaaggaccttgtgtcaggccaggagctccacgtttggtcaggtgcctgtgactgtga

SEQ ID NO: 6857 - DNA, 114 bp, Artificial
  Hairpin sequence MQbrain_431, macaque
gagcatcctgaagcttctcttatggtgctctccaaaggagtcagcctgctggctctgcaagggtcagtaggctctggggcggtggggggccgagggaggcggggaggttggctc

SEQ ID NO: 6858 - DNA, 116 bp, Artificial
  Hairpin sequence MQbrain_432, macaque
agtgagcacgttcagtaatatctagaagtggcctagcttactaataatttgatttatggaaaaatggctgaaattaataggtaaacacttttagttttctattacatgtgtttatt

SEQ ID NO: 6859 - DNA, 102 bp, Artificial
  Hairpin sequence MQbrain_433, macaque
ctctaatgggtcgggacggggaggactgctggaggaccgcagagaaatgagcctactcctctggggccctgggcagacctcccagttcctgttctaaaggag

SEQ ID NO: 6860 - DNA, 103 bp, Artificial
  Hairpin sequence MQbrain_434, macaque
cgtgcgctccgggctccgtagccagctcctgcccgggcgcgcacacgcgcttcctctcttgcgctcccgggcgtccggaggcgaaggtcccggagcgttcccg

SEQ ID NO: 6861 - DNA, 115 bp, Artificial
  Hairpin sequence MQbrain_435, macaque
ctcacctggctcttgtcacctcggtcatcttgaagtgatccgtggacaatgctgctccctgccgcagatccgctggtcactcaggcagaacggggtatgcaaatggcctggagag

SEQ ID NO: 6862 - DNA, 106 bp, Artificial
  Hairpin sequence MQbrain_436, macaque
ggagctggtgggagggaaagactgggaaggcgacagtatccttgcctatgggcggtttttggtttcttgttgcttttttttttttttcccctccctgtaaaatttc

SEQ ID NO: 6863 - DNA, 87 bp, Artificial
  Hairpin sequence MQbrain_437, macaque
aggaggcccccagtgagcctcctgccccacaggctctctcaacatacgtgcagcgggcccatggcgtaggcttcctgctgccatcct

SEQ ID NO: 6864 - DNA, 64 bp, Artificial
  Hairpin sequence MQbrain_438, macaque
tgctggcctcacgtgctctggcagtctctaggcccgggccttgttctgccttggttgagcggca

SEQ ID NO: 6865 - DNA, 96 bp, Artificial
  Hairpin sequence MQbrain_44, macaque
tggaaaaggtgaggctcactggccaaggcttcctggaggaaggatgtccttgtttgaggaagtgaccttccttctggccctccaggcctctccccg

SEQ ID NO: 6866 - DNA, 56 bp, Artificial
  Hairpin sequence MQbrain_440, macaque
acgtgtctgagctgctcgctggacccttacttgttcaggagcagctcgctggccgt

SEQ ID NO: 6867 - DNA, 63 bp, Artificial
  Hairpin sequence MQbrain_441, macaque
ggggaaagagagcgttggcactgagaatattctccctttctcctagtgcacgcctttttgcct

SEQ ID NO: 6868 - DNA, 99 bp, Artificial
  Hairpin sequence MQbrain_442, macaque
tttcgtcagcagctgactcaagttgagcaccagccatgctgtcccacctggtgtggaatggctgtgtgctcgggtccctggagcagtcgctggatggaa

SEQ ID NO: 6869 - DNA, 73 bp, Artificial
  Hairpin sequence MQbrain_443, macaque
ggagcggcggccgggagcggagttacctcaccttctgtctcttccgcgcacgtctcagccgggccgccgaccc

SEQ ID NO: 6870 - DNA, 92 bp, Artificial
  Hairpin sequence MQbrain_444, macaque
gctggaagatggccgcactctctcagactacaacatccagaaagagtccactctgcacctggtgttgcgcctgcgaggtggcattattgagc

SEQ ID NO: 6871 - DNA, 82 bp, Artificial
  Hairpin sequence MQbrain_445, macaque
tttcactggctgagtttggcccctagccatgtgttaatataaggtagccatggcttctcagagggatgacttcccagtggaa

SEQ ID NO: 6872 - DNA, 114 bp, Artificial
  Hairpin sequence MQbrain_446, macaque
catggggagagtgtgggcacccttctgagagggggcccgggccgcacacccctgagccaccatggggagagtgtgggtgcccttctgagagggggcctgggccgcacacccctg

SEQ ID NO: 6873 - DNA, 68 bp, Artificial
  Hairpin sequence MQbrain_447, macaque
gcctcatcgggaggcctgtggagtgaaagctggggttccccagaactccctttcatgcctcatgaggc

SEQ ID NO: 6874 - DNA, 81 bp, Artificial
  Hairpin sequence MQbrain_448, macaque
catggaagtgtggtggtggaggtggcagtcatagtcaatgaagagaagactaatgcctccaccagtaacagtaccaccatg

SEQ ID NO: 6875 - DNA, 78 bp, Artificial
  Hairpin sequence MQbrain_449, macaque
aggaagacacagcaggaggaggaagaggaaggtgtaggaacattttctaatttttcttttccttccatttgtcttcct

SEQ ID NO: 6876 - DNA, 64 bp, Artificial
  Hairpin sequence MQbrain_45, macaque
gccacattcccagggtcctcttcggggagaaaagagcttctgagggacttctggggatggcagc

SEQ ID NO: 6877 - DNA, 80 bp, Artificial
  Hairpin sequence MQbrain_450, macaque
gctgggacgcggggaggatgcgagcgctgcaggtaatggctgtggctttgctgcgctcgcctattccccgcgctgccggc

SEQ ID NO: 6878 - DNA, 119 bp, Artificial
  Hairpin sequence MQbrain_451, macaque
gggtgtggctagagaaactttgggcccctgagcagaaggctctatggaaaacggcttttctctaaggttttcttgatggctttctgttacatgggcttagaggacagtgcgtctcacct

SEQ ID NO: 6879 - DNA, 91 bp, Artificial
  Hairpin sequence MQbrain_452, macaque
gtgcaggctgaacttgagagcccaggcacgggagaagaacccaagacacaaagttggggtgtgtttggggatgacaaggcaggctagatac

SEQ ID NO: 6880 - DNA, 106 bp, Artificial
  Hairpin sequence MQbrain_453, macaque
ttcagcaaagcctgtgcagagggagccagagctacccgtggaagggacctcagcgaaaaccagcaatttcccgcacatgggtagctcccctgacggcccagtggaa

SEQ ID NO: 6881 - DNA, 112 bp, Artificial
  Hairpin sequence MQbrain_454, macaque
tattgtgttaaaaattaatctacactgtgcaaaacattcacacagatttcgtttaattaataaagcaaatctatgtgaatgttttgcacagtgtagattattttgcataatg

SEQ ID NO: 6882 - DNA, 118 bp, Artificial
  Hairpin sequence MQbrain_455, macaque
ctggacttctgagaaaggtatttccttagaatcctggaaataaaaatctaaagactgtcacatcaggaacagttggagtagaaggaaatgggggagtctgagagtttttagaaggtag

SEQ ID NO: 6883 - DNA, 106 bp, Artificial
  Hairpin sequence MQbrain_456, macaque
gccggaaatgtagcagtgctctatgtcatctggcacctctgattaatcccatctcccaagatggagttttcagagatgtctttcaaaattgagcaaaacattttgc

SEQ ID NO: 6884 - DNA, 115 bp, Artificial
  Hairpin sequence MQbrain_457, macaque
ttgtggtcccttctctctgagaacagaccagatggcaccacggagacctgccgagccagagagagccaggttgtgtggtgcagatggagggtgctaaggaaagaagggaagtcag

SEQ ID NO: 6885 - DNA, 80 bp, Artificial
  Hairpin sequence MQbrain_458, macaque
gcttccagttagtccatcctgtctttctagacactctggtgaaagactttggataagagagaggatggagctactgatgt

SEQ ID NO: 6886 - DNA, 91 bp, Artificial
  Hairpin sequence MQbrain_459, macaque
gtggagctcttgattggtgtggggttgagggtggcctcgggccctgcccactgggccttgttcacccccataccagacgaaaatgtactgc

SEQ ID NO: 6887 - DNA, 115 bp, Artificial
  Hairpin sequence MQbrain_46, macaque
agtctgtcctctcttgggtgctttgatatcggctgtggcagccctgagagccaggtggagttgtcctttcatctgtccctcttggctgccagccctgggccccatcggacacatt

SEQ ID NO: 6888 - DNA, 114 bp, Artificial
  Hairpin sequence MQbrain_461, macaque
gcctagaagcggaaggagccttcctcagggctctggcagcctctcatcaaaggacgtggtcttgctttgggtgagggtctgcctagagccttggatgaaggtttcccatctggc

SEQ ID NO: 6889 - DNA, 114 bp, Artificial
  Hairpin sequence MQbrain_462, macaque
ggactgcagagaaccttctggctgtgcagctgagaactgagtcagtgcaagagtgcctggctcctgcttgactttgagcagctgaggttagcagatgggcaaaggctgcggttc

SEQ ID NO: 6890 - DNA, 99 bp, Artificial
  Hairpin sequence MQbrain_463, macaque
gtacaccagtggatcctccagccagataaatcctcacagtgcccaatcgcccaggcaccttgtgaaccctaccctggctgtgggtgctgtctgaagtac

SEQ ID NO: 6891 - DNA, 100 bp, Artificial
  Hairpin sequence MQbrain_464, macaque
agaggtctggggatgaggttgaggcaaaagtgacttcttggggactttgctttttggagaagtcaaatttcctgcttcctgatttcagcccttcaactct

SEQ ID NO: 6892 - DNA, 78 bp, Artificial
  Hairpin sequence MQbrain_465, macaque
gagatgtcaagcaggcagcctctggacgtcactgttgccctgcatggtggccccagagcagcctctacgaacaacctc

SEQ ID NO: 6893 - DNA, 112 bp, Artificial
  Hairpin sequence MQbrain_466, macaque
cttctgtttcaggaagcttgctctgctctgggtgctgaatgctgggaaggtggacaggaagcctccccacattagggcccagggaatgaagagctttggcttccccctgaag

SEQ ID NO: 6894 - DNA, 81 bp, Artificial
  Hairpin sequence MQbrain_467, macaque
gactgagacggtgtccaccaaggggatccaataatgccagtgtggcatctaaatattttcctctgtgggcctgtctttttc

SEQ ID NO: 6895 - DNA, 69 bp, Artificial
  Hairpin sequence MQbrain_469, macaque
gctagaaacggccgcctctgaggagggcagcaccacccattttcccagaggcctgccttaaattctagc

SEQ ID NO: 6896 - DNA, 118 bp, Artificial
  Hairpin sequence MQbrain_47, macaque
gtcaggcattttgcaaggaaaagccacttggggaaagatggaaaaggacaaaaaaattaataaatttccattggccctcgggtgagctgagggtttttgcaaggaagttgtggtggac

SEQ ID NO: 6897 - DNA, 107 bp, Artificial
  Hairpin sequence MQbrain_470, macaque
gctacctgtgaccactcccccggggttggaatggccacgggcatggggctggaccctagccttaaccccgggccacaagtcattctggcttgggtgggtggaggggc

SEQ ID NO: 6898 - DNA, 110 bp, Artificial
  Hairpin sequence MQbrain_471, macaque
tccatgggctctggagaccatcagttcaacctcgcagagatcctgtcacagaactacagtgttcagggagagtgcgaggaggcctcgaggtgcccagagaagcccaagga

SEQ ID NO: 6899 - DNA, 84 bp, Artificial
  Hairpin sequence MQbrain_472, macaque
tctctctgctcctcggaacactcacgccttgaaggtcttccctggccttcagggcgggctatgtgagggtctccaggtgaagga

SEQ ID NO: 6900 - DNA, 78 bp, Artificial
  Hairpin sequence MQbrain_473, macaque
tccacgctgcctctgggtctgcctggtctgaggagggaatttaagtttcctcgggcctcagaccccgggctctgagga

SEQ ID NO: 6901 - DNA, 99 bp, Artificial
  Hairpin sequence MQbrain_474, macaque
ggtaggtcctctctagggagcctgcttggggcagcggctcgggagctagctgccctgacccagcttttctccccgacaggtgatagagaaggacctgcc

SEQ ID NO: 6902 - DNA, 117 bp, Artificial
  Hairpin sequence MQbrain_475, macaque
ggagggcccaccgtgtctgtccgtgatggacgtgtggagggcccactgtgtctgtccgtgatggacgcgtggagggcccaccgtgtctgcgtgtgatggacgcgtggagggcccacc

SEQ ID NO: 6903 - DNA, 118 bp, Artificial
  Hairpin sequence MQbrain_476, macaque
gtccgtgatggacgtgtggagggcccactgtgtctgtccgtgatggacgcgtggagggtacactgtgtctgtccgtgatggacgtgtggagggcccaccgtgtctgtccgtgatggac

SEQ ID NO: 6904 - DNA, 106 bp, Artificial
  Hairpin sequence MQbrain_477, macaque
tggtgaaggccctggagtaggcggtgcgtaccccgtgtcccgaggcccggctaggggctgggcaggggtgccaggtgggcccagccagcttctggcgtcccagcca

SEQ ID NO: 6905 - DNA, 53 bp, Artificial
  Hairpin sequence MQbrain_478, macaque
ggggtgcgcagcgtcgccgcctcttaattcgggggtgacgctgcccatttccc

SEQ ID NO: 6906 - DNA, 73 bp, Artificial
  Hairpin sequence MQbrain_479, macaque
ccctacgagcagctggtgcggcaggtggaggccttgaaggctgagaacagtcacctgaggcaggagctacggg

SEQ ID NO: 6907 - DNA, 98 bp, Artificial
  Hairpin sequence MQbrain_48, macaque
tgggagcaggcagggctgggcaggccaggggtctgggaggcaggggcccgggcagccctgaacccaacccctggcttcctctcccatcccaggtccta

SEQ ID NO: 6908 - DNA, 75 bp, Artificial
  Hairpin sequence MQbrain_480, macaque
ccaggagccccctttcaggacccagcggggatctcacacttgctgtccccatccatggcctgagggggagcctgg

SEQ ID NO: 6909 - DNA, 95 bp, Artificial
  Hairpin sequence MQbrain_481, macaque
gttccactttggaagtgtgcggggctgtgctgcgggggcagctagggtcaccacccgcccttcccagcccagtccccaaactccacgcctggggc

SEQ ID NO: 6910 - DNA, 97 bp, Artificial
  Hairpin sequence MQbrain_482, macaque
gccatgcacagcggcatctccccgtggtcttccttggtggccaggatgaggccctgccccagagagcctaggaggagaggcgcctctgtccttgagc

SEQ ID NO: 6911 - DNA, 97 bp, Artificial
  Hairpin sequence MQbrain_483, macaque
tgactcctgcgtcccccgcaggcgtcctgcatcctgcagctggtcaagcatatccagaagcttcaggccaaggacgtgcccgtggcggaggaggtca

SEQ ID NO: 6912 - DNA, 105 bp, Artificial
  Hairpin sequence MQbrain_484, macaque
cagacaaacacagagctgggaaattccgtggcagggcagatgagggattgatctgagtcccatgatcctcggccctgctgaggtcccaggaggctgtacacactg

SEQ ID NO: 6913 - DNA, 88 bp, Artificial
  Hairpin sequence MQbrain_485, macaque
gcctggcggccggcaccttcctcttcatcaccttcctggagatcctggccaaggagctggaggagaagagtgaccgtctgctcaaggt

SEQ ID NO: 6914 - DNA, 61 bp, Artificial
  Hairpin sequence MQbrain_486, macaque
cctgggctcaggctgcagtctgggcttcctggcccatgacacctcagattgtgggaacagg

SEQ ID NO: 6915 - DNA, 111 bp, Artificial
  Hairpin sequence MQbrain_487, macaque
ccccaggcttttgtcatccccaggtcttagggctgagtctcccagggctgaggttggtagagttggccgggcaggactgaggaatttggcattgggggtggaaggctgggg

SEQ ID NO: 6916 - DNA, 68 bp, Artificial
  Hairpin sequence MQbrain_488, macaque
ggatctcttttcagcctgagcttctcttttagcctgagctgaaagaggtcctctttggaaggagctcc

SEQ ID NO: 6917 - DNA, 108 bp, Artificial
  Hairpin sequence MQbrain_489, macaque
acagtgccccctctgccccctccgagagccggagctgtctccccgtctcccgcccccaaggagacggagaggatcctgcttcttcggggacgggggctgtatgactgt

SEQ ID NO: 6918 - DNA, 106 bp, Artificial
  Hairpin sequence MQbrain_49, macaque
gtggccagagcctgagctggtccccagagacacaggcagtagctgacagcctcgccttcacgctgctgctgttctcagccgggacaggcctcaggtggcaatgcac

SEQ ID NO: 6919 - DNA, 99 bp, Artificial
  Hairpin sequence MQbrain_490, macaque
ggcagcctgtctcatctactctgggtggcatcccctgcagaaagacaatctgatgagacagcaagagggaatggctgcctgggaaagatgaatagggcc

SEQ ID NO: 6920 - DNA, 87 bp, Artificial
  Hairpin sequence MQbrain_491, macaque
aggagaagatcgaggtgggttggggcgggctctgggggtttgggctcgcagcccagatcccagcccactcacctcggctactctcct

SEQ ID NO: 6921 - DNA, 79 bp, Artificial
  Hairpin sequence MQbrain_492, macaque
tggacagtggaacaaatgccaggggagagctgattggctggattagctaccatccaaactggagagatcctattggaca

SEQ ID NO: 6922 - DNA, 66 bp, Artificial
  Hairpin sequence MQbrain_493, macaque
ggcactgcccttgcagactcgcctttctccacccgccctggagaaaggtagggtgctgggcctgcc

SEQ ID NO: 6923 - DNA, 74 bp, Artificial
  Hairpin sequence MQbrain_494, macaque
gtggaatcttctgacccgaaggctgggcacgacgctggtcctgaccttgtgcccagcccagaccctgatcctgc

SEQ ID NO: 6924 - DNA, 116 bp, Artificial
  Hairpin sequence MQbrain_495, macaque
tgaagccgtggtctggggcagggtggtgggagagtggtagagggatcccggctcagcgctgaggtgtgtgcccctccccccttcctgtcccacccacttctccatccacagcttca

SEQ ID NO: 6925 - DNA, 71 bp, Artificial
  Hairpin sequence MQbrain_496, macaque
ccctccctctcctcccagcgctaccaggcagaaatcaatgacctggagaacttgggtgagatgggcagcgg

SEQ ID NO: 6926 - DNA, 60 bp, Artificial
  Hairpin sequence MQbrain_497, macaque
tcactggtgggtgaggctctgtggttggcaggtgccaggccccaggtctcgccctcatgg

SEQ ID NO: 6927 - DNA, 102 bp, Artificial
  Hairpin sequence MQbrain_498, macaque
gtccttcatcgagacctcagccttggattccaccaacgtagaggaagcgttcaagaacatcctcacaggtggctgggggccggctgggtgtggggagggtac

SEQ ID NO: 6928 - DNA, 94 bp, Artificial
  Hairpin sequence MQbrain_499, macaque
tcgagcgcatgggccccgccatgggcccggccctgggcgctggcattgagcgcatgggcctggccatgggtggcggtggcggtgccagctttga

SEQ ID NO: 6929 - DNA, 80 bp, Artificial
  Hairpin sequence MQbrain_5, macaque
ctggagggctgaagtgggtgtcttggagccagcagtttctgggagaagggataaggctctcaccttccacactctactgg

SEQ ID NO: 6930 - DNA, 101 bp, Artificial
  Hairpin sequence MQbrain_50, macaque
gagggacggggcaagccaagggtgctctccaaggcaccatggccaggtaagcctgtgccagctgtgggatttggggtttccctgagctggttttgtccctt

SEQ ID NO: 6931 - DNA, 119 bp, Artificial
  Hairpin sequence MQbrain_500, macaque
ggctatcacggtggaatgtgagtaggggcaccgcggagtgaggcaggatctgtgggacaaccccggctggacttcctggcccgcgtgtgagcccctgcaatcctgtttcccagatggcc

SEQ ID NO: 6932 - DNA, 77 bp, Artificial
  Hairpin sequence MQbrain_501, macaque
tgttaccgttgcctggtgcggggcagggcctaacaaggaaacctgggccctccaagccaggctgaggtctggtaaca

SEQ ID NO: 6933 - DNA, 59 bp, Artificial
  Hairpin sequence MQbrain_502, macaque
ggccttcgtcttggctgtcactggcaacctgacgctggtgctggcccagaggagagacc

SEQ ID NO: 6934 - DNA, 108 bp, Artificial
  Hairpin sequence MQbrain_503, macaque
tgagagcttcctgctaagaaggctcctgtctcttccagttccggaaaccctgactgatgtttctggaactggtgacccacaggtgacctttaggctggaaagagtcca

SEQ ID NO: 6935 - DNA, 96 bp, Artificial
  Hairpin sequence MQbrain_504, macaque
cggggtggaacggggcatggggctgccttggggctggagtaggggctgtccctgggtggccccgagtcagccctgtgtctccaggagttctacacg

SEQ ID NO: 6936 - DNA, 117 bp, Artificial
  Hairpin sequence MQbrain_505, macaque
ggaagctccctgctggcctgggacgcctcctctgggtgagctgggatggatggcagccactcagggctgcttcccacctggcaggacccgggatggagccaggtcgggctggagccc

SEQ ID NO: 6937 - DNA, 105 bp, Artificial
  Hairpin sequence MQbrain_506, macaque
gagacttggcagctgtgggcatcttgggccagccccaggtagtcctgaaatccaggatcaggaaaaggcagagggtgggctgaggtcacaccactgtaaagtttc

SEQ ID NO: 6938 - DNA, 66 bp, Artificial
  Hairpin sequence MQbrain_507, macaque
ttggagaggatttcagggagagccttggccagacctgattgggaaaggcgactgggatctgtccag

SEQ ID NO: 6939 - DNA, 83 bp, Artificial
  Hairpin sequence MQbrain_508, macaque
ggtgggcgcagggggactgggggtgagcaggcacagaccccagctcgtgctcactctcggtccctccctagacgtggtgcacc

SEQ ID NO: 6940 - DNA, 111 bp, Artificial
  Hairpin sequence MQbrain_509, macaque
ctccgttggtgcccaaggcaggggccaggtctttgcttcctaagtttcagcctggttgaagagcctggttcttaagattggcaattcctccccatcccaggcccactgaag

SEQ ID NO: 6941 - DNA, 119 bp, Artificial
  Hairpin sequence MQbrain_51, macaque
ggggaccaggcttgggggtgggggcgggtcaccgctgggggccaggcttggcggtggggcaggtcaccgctgggggccagggttggcggtggagggctttcaggatggaggtgggccct

SEQ ID NO: 6942 - DNA, 59 bp, Artificial
  Hairpin sequence MQbrain_510, macaque
gtccctggccctgagtctgcgctgggctccccaaagcccagccaagctctggtcgttgc

SEQ ID NO: 6943 - DNA, 77 bp, Artificial
  Hairpin sequence MQbrain_511, macaque
gcggcggcgccggcggtcgcctaacccgcggccgcgtgcaggggctgctggaagaggaggcggcggcgcgaggccgc

SEQ ID NO: 6944 - DNA, 83 bp, Artificial
  Hairpin sequence MQbrain_512, macaque
gtgtaagggaacaggtgtggggaagaggtggggttgggttccaactctggctttttctagtagaaaggcctaacccattatac

SEQ ID NO: 6945 - DNA, 59 bp, Artificial
  Hairpin sequence MQbrain_513, macaque
ctggctccgcagagatggagtctgaggacctgggactccgtgctttctgaggggcacag

SEQ ID NO: 6946 - DNA, 92 bp, Artificial
  Hairpin sequence MQbrain_514, macaque
ctccttaaggaagagccgggccctgctgtcgctgatgaatgggaaatttccatttgcacatgcgcacgggatcctggccgccctcctaggag

SEQ ID NO: 6947 - DNA, 113 bp, Artificial
  Hairpin sequence MQbrain_515, macaque
gctctggccatgaaaatgttctgtttggttttgttttaattatagcaaaatacgtgtcttaaccattttttttttcttgagacaggatctcacttcattgcccaggctagagc

SEQ ID NO: 6948 - DNA, 77 bp, Artificial
  Hairpin sequence MQbrain_516, macaque
gcctctgatccttggatgtgcatggccatgctggcctcccaggccacgctgctgacagtgtccagggatggtgtggt

SEQ ID NO: 6949 - DNA, 64 bp, Artificial
  Hairpin sequence MQbrain_517, macaque
gatggctctgacactgtgttggtggcgatgttccagacaatcccaccaggacggcccagacatc

SEQ ID NO: 6950 - DNA, 75 bp, Artificial
  Hairpin sequence MQbrain_518, macaque
tcctctctcctggggcctctctcgggctgggggctggtctcagtttccccattctgcctggcctaggtgtgtgga

SEQ ID NO: 6951 - DNA, 93 bp, Artificial
  Hairpin sequence MQbrain_519, macaque
gcgcgtgcgcgtggtgtgcacacgcgtgtgcgcgcctgcctgtgtcagcaggtctgtgtgtacccttgcgtgtgtacctggatatgctcgtgt

SEQ ID NO: 6952 - DNA, 92 bp, Artificial
  Hairpin sequence MQbrain_52, macaque
gggtaggttcatttccaggttccaggattcccatccgccctggcgctcctgccagcagtgggtgggcagcctgagctcccttgggctcgcct

SEQ ID NO: 6953 - DNA, 90 bp, Artificial
  Hairpin sequence MQbrain_520, macaque
acaggagataaggcccacagcggccctcttccctgtccctggtctgcaggtggaaatggggatggggtggggctgagggagctggcctgt

SEQ ID NO: 6954 - DNA, 66 bp, Artificial
  Hairpin sequence MQbrain_521, macaque
gcaaggcgcccgtccgccatcctgggccaactggcctctctaggggtggccgagagctcactttgt

SEQ ID NO: 6955 - DNA, 74 bp, Artificial
  Hairpin sequence MQbrain_522, macaque
caagaagaagcagtggtgtgccaactgcaagaaggaggccatcttttactgctgttggaacaccagctactgtg

SEQ ID NO: 6956 - DNA, 91 bp, Artificial
  Hairpin sequence MQbrain_523, macaque
tcgtggccgagctggaccgagagatgagcaggagcgtggacgtgaccaacactaccttcctgctcatggctgcctctgtctatctccacga

SEQ ID NO: 6957 - DNA, 106 bp, Artificial
  Hairpin sequence MQbrain_524, macaque
gtgaggccacggccacggctccaccttcccctgctgcggagaccgaggtgtattccctgcctcccttttcgaccccgacaggacagggtggagaggccatgcccac

SEQ ID NO: 6958 - DNA, 61 bp, Artificial
  Hairpin sequence MQbrain_525, macaque
ggccaccacactccagggagcccagggcaggaggcagctctgggtgttctggccgtgggcc

SEQ ID NO: 6959 - DNA, 111 bp, Artificial
  Hairpin sequence MQbrain_526, macaque
attgaaagtggcattctggattatccttttccaagtgatggaatctgcatttatcagactacattgcagtttttccttatgtggtgcaaggttataaaaatgccatccagt

SEQ ID NO: 6960 - DNA, 110 bp, Artificial
  Hairpin sequence MQbrain_527, macaque
aggctgaaggggatgctaaaggagataaagccaaggtgaaggatgaaccacagagaagatctgcgaggttgtctgctaaacctgctcctccaaagccagagcccaagcct

SEQ ID NO: 6961 - DNA, 75 bp, Artificial
  Hairpin sequence MQbrain_528, macaque
gaccaagagcaggcacaggtggaaagtgaaggctcagagcattgctctgagacttgtcctgggaggctcctggtc

SEQ ID NO: 6962 - DNA, 72 bp, Artificial
  Hairpin sequence MQbrain_529, macaque
gcacccccatccccgccctcctcgtctgtgtaagttgggggacctgggccaggcagggtgtggaggcagggc

SEQ ID NO: 6963 - DNA, 83 bp, Artificial
  Hairpin sequence MQbrain_53, macaque
tggagctgcgggaggcccaggtggacgcagaggcccagcggaggctggagcatctgagacaggtaggaggcctgcagtggcca

SEQ ID NO: 6964 - DNA, 109 bp, Artificial
  Hairpin sequence MQbrain_530, macaque
tctgtatctgaggaggtaggatctgatacaggtattaggatttgggtctatgtctgaggaagtagcatctgatacaggtattaggacctgggtctctttaagtgtctga

SEQ ID NO: 6965 - DNA, 67 bp, Artificial
  Hairpin sequence MQbrain_531, macaque
tcctcttcgccctccacatgagctgagcgccctgggtgtttcacaggggctggctgtgggcaatgga

SEQ ID NO: 6966 - DNA, 117 bp, Artificial
  Hairpin sequence MQbrain_533, macaque
ccgtggctgtggctctgtttcccgcagtggagcggaggcgaagggacaagatcaacaactggatcgtccagctttcgaaaatcattccagactgtaatgcagacaacagcaagacgg

SEQ ID NO: 6967 - DNA, 101 bp, Artificial
  Hairpin sequence MQbrain_534, macaque
ggggtcctctcctgctccctcagtgacccctccgcccggtcctggcccccggggagcagagtagagggggctgaggatgaggaagaggaggaatccttccc

SEQ ID NO: 6968 - DNA, 79 bp, Artificial
  Hairpin sequence MQbrain_535, macaque
gagcaagggactcgcggctgacgggacacggagccacttaggcccagagtgtcccgagtagcggcagtggggagtgctc

SEQ ID NO: 6969 - DNA, 110 bp, Artificial
  Hairpin sequence MQbrain_537, macaque
ctgctcacctggagagcagcctgtgctcctcatgggagagagccagcgtgactacctgctgccactctgccagcttgggagttgctcaggcttgtcctccagggaggtgg

SEQ ID NO: 6970 - DNA, 116 bp, Artificial
  Hairpin sequence MQbrain_538, macaque
gggcaagctgagcctctggaggccacaggggaaagcttgggggacaactttgggtatgacaaaggctcccctttcttccctcttgcagtgtctccaagcagccagccatcatgccc

SEQ ID NO: 6971 - DNA, 119 bp, Artificial
  Hairpin sequence MQbrain_54, macaque
agagacggccgacagctacggccctaccaccacgctcaaccaggagcagaatgccggccccatggcgggcctgcccctggcgggcatcatcggtggggccgtggctctggtcttcctct

SEQ ID NO: 6972 - DNA, 79 bp, Artificial
  Hairpin sequence MQbrain_540, macaque
cgcagatgacctgaaggctgtggacgggaagccggctggatggcaggtgggcggggccacgggctgcggagaatgtgtg

SEQ ID NO: 6973 - DNA, 119 bp, Artificial
  Hairpin sequence MQbrain_541, macaque
acacatgtgtttgtggtttcagggatcagtgacattcagggatgtggccattgacttctctcaggaggagtgggagtgcctgcagcctgatcagaggaccttgtacagggatgtgatgt

SEQ ID NO: 6974 - DNA, 80 bp, Artificial
  Hairpin sequence MQbrain_543, macaque
gggcattaccttgtggggttggagagctggctggtccagcccctcagacgctctcccctccctgcagggtgaggaggtcc

SEQ ID NO: 6975 - DNA, 116 bp, Artificial
  Hairpin sequence MQbrain_544, macaque
tccttcttgttgccacagaggatgaccacgatgttggggctggccagggtgcgggcatccgtcagccaggcagccagtgagttgtacgtctcccggctgtggagaagggagagggg

SEQ ID NO: 6976 - DNA, 91 bp, Artificial
  Hairpin sequence MQbrain_545, macaque
cctggacatttggtgctgggagatctggggactttctggttggcttctagaagaggtgtagggagccctggtgtccagaggctggaggggg

SEQ ID NO: 6977 - DNA, 87 bp, Artificial
  Hairpin sequence MQbrain_546, macaque
cagcaccggtccaaccccttcacccccagctgctcctaggactggcccatgggcaggcgggtggggggatgggaagggggtaccctg

SEQ ID NO: 6978 - DNA, 59 bp, Artificial
  Hairpin sequence MQbrain_547, macaque
ggggtcggaagggaggagtggtggtagaggaagaacacgccggcctcctggggggcccc

SEQ ID NO: 6979 - DNA, 112 bp, Artificial
  Hairpin sequence MQbrain_548, macaque
atagggcgagtatctggggtctggaggcctggcagcctgtggccaggtcatgagactgtccacccctccgcaggccaggacctcaacaatgccctgggtgacctcgtcctat

SEQ ID NO: 6980 - DNA, 117 bp, Artificial
  Hairpin sequence MQbrain_549, macaque
gggaggctgaccagggtccacatgatgtgagctggccctgacctgtgggcagacgtgggctctgacctccaggcttcaaggtcagctcacgccaggtcctgttcattaagggtcccc

SEQ ID NO: 6981 - DNA, 94 bp, Artificial
  Hairpin sequence MQbrain_55, macaque
gtcagttctctaggcctcgggcctcctgtccacagaatgggagcacagtttgtcctccctgtgggccagggttggcaggaggctgtataaagac

SEQ ID NO: 6982 - DNA, 104 bp, Artificial
  Hairpin sequence MQbrain_550, macaque
actttgatgggggcagtgagggagacagccccaacccttttctccaatcccccttccccaggttcctgggctccccttctctctaccttctccccaacgtctgt

SEQ ID NO: 6983 - DNA, 118 bp, Artificial
  Hairpin sequence MQbrain_551, macaque
gcgggggccatatttcccgcgcattcacggggcaactggactctcgcaggcgtttcgcgggtatcttgggaaatggagtccatttgctctgtggaggcgtgggaattttggctcaggc

SEQ ID NO: 6984 - DNA, 83 bp, Artificial
  Hairpin sequence MQbrain_552, macaque
ggtgagtggggcacggaggctgctgctcccctcggccaccatgagcaaggagcagccctcacaccccctcctccccacagacc

SEQ ID NO: 6985 - DNA, 80 bp, Artificial
  Hairpin sequence MQbrain_553, macaque
cctggagtcggggtggaggactggaagcccaggaaggtggaagaactgggtcttatttccttctccccttgttctttagg

SEQ ID NO: 6986 - DNA, 88 bp, Artificial
  Hairpin sequence MQbrain_554, macaque
gaggtgtggaaaggtgtagtctggcaggatgtctccgttttccccttctgtgaaatggattcatcctccaattttcctgagaagcctc

SEQ ID NO: 6987 - DNA, 79 bp, Artificial
  Hairpin sequence MQbrain_555, macaque
ggtggagaacaagaaggctcagctggtggtgattgcacacaacacggatcccatcaagctggttgtcttcttgtctgcc

SEQ ID NO: 6988 - DNA, 71 bp, Artificial
  Hairpin sequence MQbrain_556, macaque
gcagagcggaaggaggcggtgacgtcactgcgggagcaagtgcagcggccacatcctcgtcctagtcgggc

SEQ ID NO: 6989 - DNA, 103 bp, Artificial
  Hairpin sequence MQbrain_557, macaque
cacttaggtctagtcgccagattccccgttttcccaagaagagggtttgagcccttggtggggagagcccgggagatggcagagcaggctggaacctgggctg

SEQ ID NO: 6990 - DNA, 92 bp, Artificial
  Hairpin sequence MQbrain_558, macaque
gtttctgaagctggtggccgccatcaaagccgccttggcccagggctaatgcgccctgaaggcagaggtgagggggcccactagacagggac

SEQ ID NO: 6991 - DNA, 91 bp, Artificial
  Hairpin sequence MQbrain_559, macaque
gcagtttggctgtgctgggaggttggggctggatgaagaggaaggggctgtcttcccaacccagccgcctcctcactccacaggagcctgc

SEQ ID NO: 6992 - DNA, 77 bp, Artificial
  Hairpin sequence MQbrain_56, macaque
ccagatgaaaagagctggtgaggggacttccactggttcttaacgaattccaggtctcggttcctcatcagccctgg

SEQ ID NO: 6993 - DNA, 82 bp, Artificial
  Hairpin sequence MQbrain_560, macaque
gcgggaacaccgagggcagggcaccaggccagggctccactggaacccttcagccttccctccctgcccccgtgctttctgt

SEQ ID NO: 6994 - DNA, 82 bp, Artificial
  Hairpin sequence MQbrain_561, macaque
cgggatggggggggctcggcaactcctgggggcctggcgaggaggcgggcttcccggggggggacacgggaccgcttacctg

SEQ ID NO: 6995 - DNA, 117 bp, Artificial
  Hairpin sequence MQbrain_562, macaque
cctatgtggctggcagtggtcgggcaggcaagaggggccgctggtcgggggtcaaggaggagccctccaaggtcagcagctgcctctggagcctggactgagcagggcttgggtggg

SEQ ID NO: 6996 - DNA, 114 bp, Artificial
  Hairpin sequence MQbrain_563, macaque
tctttgcacctctcagagtctgcagcctgttctggaccagggagcacccaggtgctgggggcagggcctgggtacctggggaagtgaaagtgctacaggctcgaggtgggaagg

SEQ ID NO: 6997 - DNA, 73 bp, Artificial
  Hairpin sequence MQbrain_564, macaque
ggtgcagagcccagctgcccccagggctcctgggccttctcagtgagtctgggggagctcaagtccatccgcc

SEQ ID NO: 6998 - DNA, 73 bp, Artificial
  Hairpin sequence MQbrain_565, macaque
gtgtcctgtgcaggctggggcggaaggccgagagggtgaggcctgcggcacggtggggctgctgctggagcac

SEQ ID NO: 6999 - DNA, 96 bp, Artificial
  Hairpin sequence MQbrain_566, macaque
tcccgtgggccccctgctccttgacagatgagtggtttggatccagccagaactgctggatttacaatggtggagaagtggcggggctcggcgggg

SEQ ID NO: 7000 - DNA, 72 bp, Artificial
  Hairpin sequence MQbrain_567, macaque
gtagatgagggtgggccctgagccatgctgtcagagggtggcaggctcagggcctcaagttgctcttgggac

SEQ ID NO: 7001 - DNA, 119 bp, Artificial
  Hairpin sequence MQbrain_568, macaque
ctttgacacccgggggtctgaggggccctgactctggggagggctcatggggtgtcttgactgccctgcaccttactgaccttccctcccctgtgccctcctgcctccaggtgctgaag

SEQ ID NO: 7002 - DNA, 86 bp, Artificial
  Hairpin sequence MQbrain_569, macaque
cagaaccacagcttctggcctcattctctcctgtgtccctgctgagactggggacacaagagagaatgagtgtcctgagtgttctg

SEQ ID NO: 7003 - DNA, 74 bp, Artificial
  Hairpin sequence MQbrain_57, macaque
ttcaaaggagagggcccagatgtggatgtgaacctgcccaaggctgacattgatgtctcaggccccagggtgga

SEQ ID NO: 7004 - DNA, 108 bp, Artificial
  Hairpin sequence MQbrain_570, macaque
ggccttcacggccgccttccgggctctctctgacaccgaaatcagtgaggacatcatcagtgtcctggggaaggtgcagagggaggaaccagagaggcccagagggtc

SEQ ID NO: 7005 - DNA, 101 bp, Artificial
  Hairpin sequence MQbrain_571, macaque
gcccatatagcgtaagcctggcgcgcgcgcgcatcattgtgtggctggactcggccgccgctgtggtgtgaggcgcgtgttcgggctcttgccgtccccgc

SEQ ID NO: 7006 - DNA, 110 bp, Artificial
  Hairpin sequence MQbrain_572, macaque
gcacattatgttcctttctttttataagtaggagtctctttctgccctgttgtcaccatgtaggggcaagggaaagagccctggactgtggagagtgaagtgaaaatagc

SEQ ID NO: 7007 - DNA, 96 bp, Artificial
  Hairpin sequence MQbrain_574, macaque
aagtccagagactttcagatttcagccctggaactgtctcccattctcagaggagacagggcagagccagaggctgaccaggctgtgggtggactt

SEQ ID NO: 7008 - DNA, 66 bp, Artificial
  Hairpin sequence MQbrain_575, macaque
ctccatgggcctggaggcagccacggctgtggtgagtgcgggggctgggccattgggggcctggag

SEQ ID NO: 7009 - DNA, 102 bp, Artificial
  Hairpin sequence MQbrain_576, macaque
ggcgtttgacatgagtggggtcaggggatctctggctgaggctgtgggcagcccccaacctgcagccacgccaactcccacgccccccacccggaagacgcc

SEQ ID NO: 7010 - DNA, 113 bp, Artificial
  Hairpin sequence MQbrain_577, macaque
gaagatgaggatgagtttggagagttccgggaaccgtctgtgcctggtgagaacagggactgggagtcagaggtaggcctggaatggcagcccgaggagctggtcctctcttc

SEQ ID NO: 7011 - DNA, 71 bp, Artificial
  Hairpin sequence MQbrain_578, macaque
taacctagagaacaaaggcacctaccaggggttatttagaccctctggtggggatctggtgccggaggttg

SEQ ID NO: 7012 - DNA, 89 bp, Artificial
  Hairpin sequence MQbrain_579, macaque
ctgggtggggggacggggtctgggatgggtacccttctgctcagtaagatccaggaggagtacccagacaggatcataaacacattcag

SEQ ID NO: 7013 - DNA, 116 bp, Artificial
  Hairpin sequence MQbrain_58, macaque
ggcaagttacaggggagtggggtgtccctggcctctaagaagtcccgactgtcttcctcttctagcaatgacagtgggaataaggttggcatccagcttcctgaggtggagctgtc

SEQ ID NO: 7014 - DNA, 103 bp, Artificial
  Hairpin sequence MQbrain_580, macaque
aagaggaggctgttgaggatgagggtggagaagaggatttggccagtgagctaagggtatctggtgaaaatggctctctggaaatgcccagcagtcatatctt

SEQ ID NO: 7015 - DNA, 120 bp, Artificial
  Hairpin sequence MQbrain_581, macaque
accaaggctattattaattgaattttgtgtttgactagagcccttgaatacttataacttttcagtatcaaggctctggatgatacatcactaactattgttcaaccttgatagagaggt

SEQ ID NO: 7016 - DNA, 117 bp, Artificial
  Hairpin sequence MQbrain_582, macaque
tctgttttccctccatcctcttctaatctttctcctttttctcctagcactctcatcgtcccccccagaagagggtttgaatagagtcaggaagactttgggattgggagccataga

SEQ ID NO: 7017 - DNA, 102 bp, Artificial
  Hairpin sequence MQbrain_583, macaque
gccagctgtatgaccatccagggataaagggggaaaaccaggtgattccatttctggaatcaaccaaatcatgttttcctcttggatggaagtgccaaaggc

SEQ ID NO: 7018 - DNA, 95 bp, Artificial
  Hairpin sequence MQbrain_584, macaque
ggtttctctgggtgaattccaactaagcatacctagggctatcagtgggcctacctgggtttttgttttggtaaggatttatgtagtgtctggct

SEQ ID NO: 7019 - DNA, 80 bp, Artificial
  Hairpin sequence MQbrain_585, macaque
agggatcttgcccgcctcctctttgactctgtggattgtccatccatctgctcactgtgaagatggagaggcagtgccct

SEQ ID NO: 7020 - DNA, 85 bp, Artificial
  Hairpin sequence MQbrain_587, macaque
gtgaactgagtcatgtgccacttgtgtgtaatttggtacaggtacccctgtccttcacagacaagtgacacacctccttattcat

SEQ ID NO: 7021 - DNA, 77 bp, Artificial
  Hairpin sequence MQbrain_589, macaque
gtgaaggtgagtaattctacatggctcttgagaacatccctctcttaaggacatgtcgaagatttactgacctgaac

SEQ ID NO: 7022 - DNA, 65 bp, Artificial
  Hairpin sequence MQbrain_59, macaque
tcagcaggaggctgccctgaggggctggggagggggttacctcttgaggaccagggtggagctga

SEQ ID NO: 7023 - DNA, 98 bp, Artificial
  Hairpin sequence MQbrain_590, macaque
gcagggagcaggtcttacccattgagcctgtagcattcctggcctggctcaggagagccagtggaggctgctggccctgggatggtgcctcccccagc

SEQ ID NO: 7024 - DNA, 106 bp, Artificial
  Hairpin sequence MQbrain_591, macaque
agtcctgtgagtgcgtggcggtcatgttcgcctccatcgccaacttctccgaattctacgttgagctggaggccaacaacgagggtgtcgagtgcctgcggctact

SEQ ID NO: 7025 - DNA, 68 bp, Artificial
  Hairpin sequence MQbrain_592, macaque
agtgtcgtccgtgaggtttgggcaggtgttcaagtgcatcttgcagcctgagaccacatggactcgct

SEQ ID NO: 7026 - DNA, 72 bp, Artificial
  Hairpin sequence MQbrain_594, macaque
cctttcttccttcactggttgcagggggagggagcctgccagctgtgagggcctctgtggtggaggagttgg

SEQ ID NO: 7027 - DNA, 66 bp, Artificial
  Hairpin sequence MQbrain_595, macaque
ttttcaaatgtgtgaggggacacaggaggagtctgaggcttttggtcccacttgcacaggtgagaa

SEQ ID NO: 7028 - DNA, 95 bp, Artificial
  Hairpin sequence MQbrain_596, macaque
acttggatgcctgcagccagctctcagctgggccacacaggagccacctccatcctgggtccagcgggagagagcgctgttctcctccaccaggt

SEQ ID NO: 7029 - DNA, 76 bp, Artificial
  Hairpin sequence MQbrain_597, macaque
gtcccacctaaaaacaggcacattgggttagttccatcagacccactgatggaccgtgcctgtacagccccaggac

SEQ ID NO: 7030 - DNA, 88 bp, Artificial
  Hairpin sequence MQbrain_598, macaque
ctgggctctttccactgctacacagcactcacctgcgaaccgggctatgccctcaaggatggcgagtgtgaaggtgagaagggcccag

SEQ ID NO: 7031 - DNA, 71 bp, Artificial
  Hairpin sequence MQbrain_599, macaque
cgcccgggctctcgacgcgccgacggccgggcggacggacggacggacgccgagcgcagcgccccgcggtg

SEQ ID NO: 7032 - DNA, 70 bp, Artificial
  Hairpin sequence MQbrain_6, macaque
cccagctggtggatccagtggcgctgagcttcaagaagctgaagaccattttggagtgccgagggttggg

SEQ ID NO: 7033 - DNA, 103 bp, Artificial
  Hairpin sequence MQbrain_60, macaque
catcttgctgctggatggtgcagcctggctcaccctttggatctttgggacatcctttttgcccttccttctctgtgccgtgctgctcactgcagctcaggtg

SEQ ID NO: 7034 - DNA, 116 bp, Artificial
  Hairpin sequence MQbrain_600, macaque
acctaccaggatgctgtcttctgtgcctcccatctgcctgtggcttgctgcagagtacggctgctctcactgctgcgcaggccacggccggagcaatgcactggacaggggagggt

SEQ ID NO: 7035 - DNA, 97 bp, Artificial
  Hairpin sequence MQbrain_601, macaque
gtggggtaaaaccccggatgccatgaaagccgccatggccctggagaaaaaactgattcaggcccttttggatcttcatgccctgggttctgcccac

SEQ ID NO: 7036 - DNA, 86 bp, Artificial
  Hairpin sequence MQbrain_602, macaque
gaggagttaaatagcgccactgatctggcaacggctgtacttaaaagtggtgccatcagcctgggccagagcagaacagcctcctc

SEQ ID NO: 7037 - DNA, 79 bp, Artificial
  Hairpin sequence MQbrain_603, macaque
agcagcttcctttgagagctacctgtgaggcaggacttgctcctgtgcctaacacagtagctggcagataacagatgtt

SEQ ID NO: 7038 - DNA, 75 bp, Artificial
  Hairpin sequence MQbrain_604, macaque
cttcaaaggagacttctgtgctgggtgggcctttgtggtctttcccagtctcattgggctgaggtttcctggaag

SEQ ID NO: 7039 - DNA, 55 bp, Artificial
  Hairpin sequence MQbrain_605, macaque
gcaccttctctgtcccagcctggcatctgatgtaggggtggcaagatgaaggtgc

SEQ ID NO: 7040 - DNA, 70 bp, Artificial
  Hairpin sequence MQbrain_606, macaque
gcgggcacctcctacctgggcaaggaacactggaagacgtgctttgtggttctcaggtgggagccctggc

SEQ ID NO: 7041 - DNA, 88 bp, Artificial
  Hairpin sequence MQbrain_607, macaque
ccctggatcagggaaagcccaggaggggctgccctgtcttctggccgcacattgacagaaaagctcctcaagggctccaagctcaggg

SEQ ID NO: 7042 - DNA, 115 bp, Artificial
  Hairpin sequence MQbrain_608, macaque
ttttgatatataagccagtttaatgttttctgtacagaccctggcttttcttaaattttatatattggaaagcccatgtttgtattggaaactgctggtttctttcatattgaaa

SEQ ID NO: 7043 - DNA, 70 bp, Artificial
  Hairpin sequence MQbrain_609, macaque
atgtaaaataaactcagggctgcgggtgatgagggctgggattacccaggccccagccactgagctacat

SEQ ID NO: 7044 - DNA, 106 bp, Artificial
  Hairpin sequence MQbrain_61, macaque
gggcttgaccttgcctggttgaggctgcagtccccaaatacccaactgcccttgctcttggttgggctgagggactgctgcctgggcattcaaagagttggggacc

SEQ ID NO: 7045 - DNA, 108 bp, Artificial
  Hairpin sequence MQbrain_610, macaque
tcaggccatgttttaaccctcttgttgtcactgctgtaggtcagaggcctggcttcaagtactggtatgacaaggagtggctgagcaggggacatatgcatggcctgg

SEQ ID NO: 7046 - DNA, 82 bp, Artificial
  Hairpin sequence MQbrain_611, macaque
gtaattgtctggaagagtggaagggcacagcttcttagggatggggagttggccagcttcagtatgtttcagactaattggc

SEQ ID NO: 7047 - DNA, 106 bp, Artificial
  Hairpin sequence MQbrain_612, macaque
ctactggccagaagcatcctgagaaggcagcccacccctcctttctgcagtcattgattaaggcagaagctgagcagtgggcagtcatcccagatgctcaccgtgg

SEQ ID NO: 7048 - DNA, 68 bp, Artificial
  Hairpin sequence MQbrain_613, macaque
agagactatagctggagatctgggtgggaaatatgacttttcctacagctgggaggctgctggtctct

SEQ ID NO: 7049 - DNA, 108 bp, Artificial
  Hairpin sequence MQbrain_614, macaque
gaagggaagactgccttggagcagcagaaggcagcccatgaggaggaggtgaaccggctccgggagaaatgggtaagtggtcgatgtggccggggatggtctcccttc

SEQ ID NO: 7050 - DNA, 90 bp, Artificial
  Hairpin sequence MQbrain_615, macaque
gataagcattagcctgaaggccttggtgtggtgatgatgtccatttctgcatggcttcacacataggccttcaccaattcaatgtatgtc

SEQ ID NO: 7051 - DNA, 110 bp, Artificial
  Hairpin sequence MQbrain_616, macaque
ttccatatcaataacaacgtcaaaataaaaactcatcagtatcaatctgctgcaaagaaacagcagaaaaataggtaacagatacgaagagtgagttgacaggagtggaa

SEQ ID NO: 7052 - DNA, 85 bp, Artificial
  Hairpin sequence MQbrain_617, macaque
ctgagtttttttggatcttattcaatgggagaggagtctggagggaataccacttgacttcactaccaaaggttttatgacttag

SEQ ID NO: 7053 - DNA, 113 bp, Artificial
  Hairpin sequence MQbrain_618, macaque
gggggtgtgctcgggccatgggcagtgccaggacaggttcctgggcagcggggagtgccactgccatgagggcttccatggaacggcctgtgagatgtgtgagctgggccgct

SEQ ID NO: 7054 - DNA, 117 bp, Artificial
  Hairpin sequence MQbrain_619, macaque
gcccacttgtatttttcccaccactctcaggacccaagtgcccgcattggccagaactgcagcattggccccaatgtgagcctgggacctggcgtggtggtcgaagatggtgtgtgt

SEQ ID NO: 7055 - DNA, 87 bp, Artificial
  Hairpin sequence MQbrain_62, macaque
tagagcacagcctctcacctctcacgcactcataagcctgtcaacccagggcttgtgagcgcgccaggtagtatttgttagtttcta

SEQ ID NO: 7056 - DNA, 111 bp, Artificial
  Hairpin sequence MQbrain_621, macaque
gagggctcgggcccgagaccgttcacctccccttatcccttgttctcctcttcaggatggagctgacctcaagggaaggagggaggggacagcctctgccctgggaacttc

SEQ ID NO: 7057 - DNA, 68 bp, Artificial
  Hairpin sequence MQbrain_622, macaque
ctgccctggagcgccgggccacctttgaacgctaccaatgccatgaggagggtctggtgcccagcaag

SEQ ID NO: 7058 - DNA, 87 bp, Artificial
  Hairpin sequence MQbrain_623, macaque
gggccttcagggggcctcttttcattttctcccacaggcctctctttctttctaggttgctggggagagatgggtgccctatggtcc

SEQ ID NO: 7059 - DNA, 107 bp, Artificial
  Hairpin sequence MQbrain_624, macaque
ggcgaggcacctgtggttgtggttggggtggagtgaggagggagtggagggggctgatccctcccacttttccctcttttttaccctttttgagagggatgcctgct

SEQ ID NO: 7060 - DNA, 95 bp, Artificial
  Hairpin sequence MQbrain_625, macaque
gggattcagctaacagctgtggcagtcaccgtggaagatggacacaccattgctttcctgggtgatagtcaagggcagctgcacagggtgagccc

SEQ ID NO: 7061 - DNA, 110 bp, Artificial
  Hairpin sequence MQbrain_626, macaque
tttgtgctcaaactggactcagaaaaacgcaagctttttcagaccaccacagtaagagctgtggggggatgggagatggggaagaaaagggccaggaagaaagacacaaa

SEQ ID NO: 7062 - DNA, 48 bp, Artificial
  Hairpin sequence MQbrain_627, macaque
gggcggggctgagttcggattcgaaagactcccaggccagccctaacc

SEQ ID NO: 7063 - DNA, 119 bp, Artificial
  Hairpin sequence MQbrain_628, macaque
tcattgtagactgagggcggtggcagcgaggctcctctgtgtccgggcccccctgctggggaggagccggccatctctgaggcagcgcctgaagctggcgcccccacttcagccagtgg

SEQ ID NO: 7064 - DNA, 119 bp, Artificial
  Hairpin sequence MQbrain_63, macaque
ggtgtacccggctgtgggccagcgtgtcagctgggggaaggaggggtggccccaggaggccctgccctgccatgcctcctgccctcagctccaggagctgcaccgagctgggggcgacc

SEQ ID NO: 7065 - DNA, 61 bp, Artificial
  Hairpin sequence MQbrain_630, macaque
gccccctacttcctggcggcagctgaatccggagagcattcggccagggggacctgggggc

SEQ ID NO: 7066 - DNA, 98 bp, Artificial
  Hairpin sequence MQbrain_631, macaque
agctacaggaatgatggagatggtgatggtggctgtgggcaacgcctttgggcctcactgtcctggccgctctagaccagctccaacaggccagggct

SEQ ID NO: 7067 - DNA, 115 bp, Artificial
  Hairpin sequence MQbrain_633, macaque
ttgcctttggctttccctgggatttctgtcttctcttgggaaggctggggccttggctcctggctttgagaattaagattgtgacagaaggactgggcagggctggccttggtga

SEQ ID NO: 7068 - DNA, 105 bp, Artificial
  Hairpin sequence MQbrain_634, macaque
atgactgggcctccttcccttcttctgctgcctgccttcctggcttttctcaccttcccaccaggacttcaggcccagaggtcctgaagagtagttctgtgtcat

SEQ ID NO: 7069 - DNA, 94 bp, Artificial
  Hairpin sequence MQbrain_635, macaque
cctgtccacctcccaagcctgtcagggatccctggcctcatcctcacactgggatggggagaaggcttgatggtaagttgggagatgggaaagg

SEQ ID NO: 7070 - DNA, 114 bp, Artificial
  Hairpin sequence MQbrain_636, macaque
cctactcaatggcaaggcctggggctgggggtgggggtgcttgttgaatgccacagagcaagtcactagagccagtgccctgactcccagcccaggcctctcagggatatcagg

SEQ ID NO: 7071 - DNA, 69 bp, Artificial
  Hairpin sequence MQbrain_638, macaque
gggagcctcagacctcagcctgctcatttgctgaggcaggggtgggcaggcagagtgtgtagggcaccc

SEQ ID NO: 7072 - DNA, 67 bp, Artificial
  Hairpin sequence MQbrain_639, macaque
gacgccatccctctagaatgcagctgtcttgggtggaggctctgggacagctgcttctggctaagtc

SEQ ID NO: 7073 - DNA, 107 bp, Artificial
  Hairpin sequence MQbrain_64, macaque
gggtgtggagggctctggtctcctgtggggcctctgcctgtgagtttgcaatgtaggactaactggagaaggtggagtggcccacaggaggtggtctaggtacgttc

SEQ ID NO: 7074 - DNA, 95 bp, Artificial
  Hairpin sequence MQbrain_640, macaque
ccgcggtggcttccgcggaggtttcggcagtggcatccggggccagggtcacggccgtggactggccggagccgaggccgcggaactcgctgagg

SEQ ID NO: 7075 - DNA, 110 bp, Artificial
  Hairpin sequence MQbrain_641, macaque
cttctcactgccatcatgtctaagtcagagtctcctaaagaacctgaacagctgaggaagatcttcattggagggttgagctttgaaacaaccaatgagagcctgaggag

SEQ ID NO: 7076 - DNA, 102 bp, Artificial
  Hairpin sequence MQbrain_642, macaque
ttctcctcttccttctccccagggtggagtccatgtccctggccgacagagggaaccctggaaatattacttcacgcttgatggagaaggagaaggccagag

SEQ ID NO: 7077 - DNA, 55 bp, Artificial
  Hairpin sequence MQbrain_643, macaque
gccttgcttccggctggtgtcatgccttggggccaggcagcagctgagaagctgc

SEQ ID NO: 7078 - DNA, 117 bp, Artificial
  Hairpin sequence MQbrain_644, macaque
ctctcacaggtactgagctgtcaaaagtgcatgaaggcctctcactgcaccctagtcctgacttggggtgcagagggctgcttgcaatcctgtttgtaaggctgtgcctgctcagag

SEQ ID NO: 7079 - DNA, 76 bp, Artificial
  Hairpin sequence MQbrain_645, macaque
ggcgaaggcggcagcggcggcgacagctctggggtttgcgtctcggggtgtgtcggccgccgctgctgctcgggcc

SEQ ID NO: 7080 - DNA, 61 bp, Artificial
  Hairpin sequence MQbrain_646, macaque
gtggttccatcagcatgtcccagtccatgggggctggggagagcaggcttcctgggaaggc

SEQ ID NO: 7081 - DNA, 60 bp, Artificial
  Hairpin sequence MQbrain_647, macaque
aaattgcctgcagggtgatgcgcacagccagaaaactgggtgtacagtctgtggcagttt

SEQ ID NO: 7082 - DNA, 94 bp, Artificial
  Hairpin sequence MQbrain_648, macaque
aggagtggtggaaggcacttgagtcaggaatctctgaatggcaagagtgatcagagaagtttgaaggataggaggatgctgggctgtggctgct

SEQ ID NO: 7083 - DNA, 116 bp, Artificial
  Hairpin sequence MQbrain_649, macaque
acacacagatagttgaatggaatataacctagtctcattttctcaagcggcagaatgaattcatgtgcaaggtgaagatgagacatagggttcctatttcttatatatcttttggt

SEQ ID NO: 7084 - DNA, 78 bp, Artificial
  Hairpin sequence MQbrain_65, macaque
ccacggcctgtacccagcagagcagtggcaccaccgtggttccagtggatgccccaaggctctgcttggtaaacgtgg

SEQ ID NO: 7085 - DNA, 117 bp, Artificial
  Hairpin sequence MQbrain_650, macaque
ctggcatcttgtccatggcaaatgctggacccaacacaaacagtttccagttttgcaactgcactgccaaaactgggtgtttggatggcaagcatgtggtctttggcaagatgaaag

SEQ ID NO: 7086 - DNA, 92 bp, Artificial
  Hairpin sequence MQbrain_651, macaque
gacgacttttcatctcatttaataaccggctagcattgttggcaatgaaaagtgatgccagcaagagggtgaaaagccatgagaaagcagtc

SEQ ID NO: 7087 - DNA, 95 bp, Artificial
  Hairpin sequence MQbrain_652, macaque
cgtccaatcttggatttccagagtcttacaatgtagtctcaccttctgggtgcaggagaggctggtgatggctacggaggaccattagttggatg

SEQ ID NO: 7088 - DNA, 114 bp, Artificial
  Hairpin sequence MQbrain_653, macaque
attctggagagtctaggtttgcaggaatccagccacggacaaggctttgcatttttaaaaaagtctgatatttgttttggtgtttcattgcagagacctagatttaatttgaat

SEQ ID NO: 7089 - DNA, 116 bp, Artificial
  Hairpin sequence MQbrain_654, macaque
agagatcttctatgcaaggagaaacacttcacattctgttcccacttcttaatgaaacttcttataaaagtggttctgaagagaaggtgatgcttgtgaccttggacaagatttct

SEQ ID NO: 7090 - DNA, 107 bp, Artificial
  Hairpin sequence MQbrain_655, macaque
ggcccccgcgctccctccccctcccgctcctctataacttggctggcgtggaggaggcgccgccggagtcggagggcggggagctaggaggagggagctcgagagtt

SEQ ID NO: 7091 - DNA, 98 bp, Artificial
  Hairpin sequence MQbrain_656, macaque
ccaggtgggctggcagtgccccgggtgcaccttcatcaacaagcccacgcggcctggctgtgagatgtgctgccgggcacgccccgaggcctaccagg

SEQ ID NO: 7092 - DNA, 46 bp, Artificial
  Hairpin sequence MQbrain_657, macaque
ggcgaggttctctggtcctcaggtgtggggggccagggaagtcgcc

SEQ ID NO: 7093 - DNA, 92 bp, Artificial
  Hairpin sequence MQbrain_658, macaque
cacagtgtctgagcttggatgtcttttatagatttttaaattattttagtgattgttattttattaaaggggtctgggctcactgcctcgtg

SEQ ID NO: 7094 - DNA, 81 bp, Artificial
  Hairpin sequence MQbrain_659, macaque
tgctcccggaggtttggggagctggagctgtggtcacaactggggcctgggctcatgcattgaactaacctggctggggca

SEQ ID NO: 7095 - DNA, 110 bp, Artificial
  Hairpin sequence MQbrain_66, macaque
gggagcagctgcagttgaaggagacgatggtgtggatggtgtgggactcaggagcgaggcacggtcactgttcccaatccattcccaacggattctgtctggctgctccc

SEQ ID NO: 7096 - DNA, 106 bp, Artificial
  Hairpin sequence MQbrain_660, macaque
tgtcatgtcggggtgccaccagcttcccttggtcctgtgcctttggagccttgggctcctggggttaagggcacttggggctggctgttggagcccaccaatgcca

SEQ ID NO: 7097 - DNA, 68 bp, Artificial
  Hairpin sequence MQbrain_661, macaque
ggagacggtgagtagtggcgcgcggcggcccggagtaccgccgccgcgcgcatccgctcaccgtgccc

SEQ ID NO: 7098 - DNA, 84 bp, Artificial
  Hairpin sequence MQbrain_663, macaque
tgttctgtgcttttctctaacaggcaaccattgggattgacttcttgtcaaaaaccatgtacttggaggaccgcacggtgagca

SEQ ID NO: 7099 - DNA, 97 bp, Artificial
  Hairpin sequence MQbrain_665, macaque
tttggagctgccatcattcttttcctggctgctgtggcctctgttccaatcccaggtaagccacaggctcagccagaaaaagcatggtcacgccaga

SEQ ID NO: 7100 - DNA, 72 bp, Artificial
  Hairpin sequence MQbrain_666, macaque
ggctgcagcccgggcggacgcgcggagccgagcggggcacggcggcggcggcgacagcggccgggatgagtc

SEQ ID NO: 7101 - DNA, 68 bp, Artificial
  Hairpin sequence MQbrain_668, macaque
ggtggggaggttagatgcctagtgaaagcttctagtagaagctttggggtggtctagactcccatgcc

SEQ ID NO: 7102 - DNA, 77 bp, Artificial
  Hairpin sequence MQbrain_669, macaque
ctgtgccatggaggggagtacagtaattttcagacagagctgaaatgtttgtggccgtgtctcccagaccatgccag

SEQ ID NO: 7103 - DNA, 85 bp, Artificial
  Hairpin sequence MQbrain_67, macaque
tgcctgacgccgcggcctgtaattgggagttgctggagtcggtgcttcactcttaaggttccgaccacagactgcggagtcggta

SEQ ID NO: 7104 - DNA, 91 bp, Artificial
  Hairpin sequence MQbrain_670, macaque
atttacgcttgttggatggagcacttaaactttcagctaaggatcttagatcccaggtggttagagaagcttgtattactgtagcgtaagt

SEQ ID NO: 7105 - DNA, 63 bp, Artificial
  Hairpin sequence MQbrain_671, macaque
ggagaggcccagcccaggcgtcgccgctcctgctggtgcagcctgggtggagcctgactttcc

SEQ ID NO: 7106 - DNA, 83 bp, Artificial
  Hairpin sequence MQbrain_672, macaque
cctgcctctggcctgggtcctgggtggggcctgtggctggagtagtgcccccaggccctgccctgggtgaccagacggggagg

SEQ ID NO: 7107 - DNA, 111 bp, Artificial
  Hairpin sequence MQbrain_673, macaque
ggaagtgcctgggtttgcgacaggctggaagggagaaacagggcagtgctggccagcccagcacagcagggactgctctcctccaggtgtgtgggcagatcaggcatgtcc

SEQ ID NO: 7108 - DNA, 61 bp, Artificial
  Hairpin sequence MQbrain_674, macaque
cccaccttgcagaccgacaccacggcacgcccatgctgctggacggtgtcaagtgcgtggg

SEQ ID NO: 7109 - DNA, 75 bp, Artificial
  Hairpin sequence MQbrain_675, macaque
tccatagtcactgacaggtttcagcagagtccacgaaagtatctgtagttgcctgtcaggccaaaggattctgga

SEQ ID NO: 7110 - DNA, 65 bp, Artificial
  Hairpin sequence MQbrain_676, macaque
tccccatgctggccactgccgtccatatagccgagaacaaccatggcggcctgaggcccaggggg

SEQ ID NO: 7111 - DNA, 113 bp, Artificial
  Hairpin sequence MQbrain_677, macaque
ggtgcgcggcggcggtggcggcgcgctcaaagccaagccgcacgtgaagcggcccatgaacgctttcatggtgtgggcgcaggcggcgcgccgcaagctggccgaccagtacc

SEQ ID NO: 7112 - DNA, 101 bp, Artificial
  Hairpin sequence MQbrain_678, macaque
ggccgggaggagccaggggcctggagctggctgtgtcaaggacaggcttcctcggaggcctcactgacacggcgggggtggggtctgcggcgagagaggcc

SEQ ID NO: 7113 - DNA, 75 bp, Artificial
  Hairpin sequence MQbrain_679, macaque
ggccccgctctcagcacctctgcaagccaggtgcatcttctgggcatggctctcagcctgtgttgctgtggggcc

SEQ ID NO: 7114 - DNA, 117 bp, Artificial
  Hairpin sequence MQbrain_680, macaque
cagaggctcctccagccaacctgactgggccccctctctcagggtgttagaggcaacttcagtgtccctgttagagcaacatgggtccctccatggggggctgggggcggctccctg

SEQ ID NO: 7115 - DNA, 88 bp, Artificial
  Hairpin sequence MQbrain_681, macaque
gccttgatcccgaggacggcgttctgcccacgcgactgcaaaggcggccccgttgggctgagcgccgagtgcttgggaagcgaatggc

SEQ ID NO: 7116 - DNA, 114 bp, Artificial
  Hairpin sequence MQbrain_682, macaque
ttgttcgtaagagtacctgaggtggaagaactcaccctgtgttttgcgtttgctccacctcatggtgcacacgtaccacccagggtgagaagcagccgaggagctgtgcggcag

SEQ ID NO: 7117 - DNA, 110 bp, Artificial
  Hairpin sequence MQbrain_683, macaque
gccccagagacctgacctgggcttctgtagagcagtcttgtcaggtcctgggcttggctggggccacggaccgcgttgctgctagactgcccaggcagggcccctggggc

SEQ ID NO: 7118 - DNA, 69 bp, Artificial
  Hairpin sequence MQbrain_684, macaque
ggcctgtagtgggcactgggcaatgggaccctgtggtgaggcagggtctgctcaggtaacaggaaggtc

SEQ ID NO: 7119 - DNA, 80 bp, Artificial
  Hairpin sequence MQbrain_685, macaque
ctgtggcaggtctgaggagctctggccatggatggcgcacgtgctgctgccctatgtccacgggaaccagtccagcccag

SEQ ID NO: 7120 - DNA, 66 bp, Artificial
  Hairpin sequence MQbrain_686, macaque
ccttcttcctggtcaatgactggctgtcggtggagacggaggccaacgggggcctggtggagaagg

SEQ ID NO: 7121 - DNA, 74 bp, Artificial
  Hairpin sequence MQbrain_687, macaque
tcccaacaagcaggcttctgacagcccgtggcccgcacactggccaccgtggaaaagcagccttctgcacggga

SEQ ID NO: 7122 - DNA, 117 bp, Artificial
  Hairpin sequence MQbrain_688, macaque
ctgatgtgctgtgggaggggctgttgtgaggtctggatgggcaagctctcactcatcggggacagatgtgtgtgcaggggggacattcagaggcagccagggcctgggcaggttgag

SEQ ID NO: 7123 - DNA, 109 bp, Artificial
  Hairpin sequence MQbrain_689, macaque
ggcctttgtggcctttgcactccctgaagtggctttctgcagtgacttcgtccattgatctgtttactgccttccctggggccacgagggagcctgccagggtggggcc

SEQ ID NO: 7124 - DNA, 112 bp, Artificial
  Hairpin sequence MQbrain_69, macaque
gcatggattcaccgcctctgctttgatcctcgtgttgtcgctaagtccctatattaatttgctggggctgccacaacaaaggaccatgagctgggtggtttaaacaacaggc

SEQ ID NO: 7125 - DNA, 70 bp, Artificial
  Hairpin sequence MQbrain_690, macaque
ggacccgggctggaggaaggggactgacccctctctttatctcaccctttcctgcccagaacctctgtcc

SEQ ID NO: 7126 - DNA, 86 bp, Artificial
  Hairpin sequence MQbrain_691, macaque
agttgcttttgccctctttggagccagggtgaattgagggtgatgggcctagtctggcttggccaaggagacaggacttaagtact

SEQ ID NO: 7127 - DNA, 90 bp, Artificial
  Hairpin sequence MQbrain_692, macaque
ctggccgtggcactgctgggggaaaagctgacttggcttatggctgtcagtgccgagtaagcaccttcccacagcagtgccagtttgcag

SEQ ID NO: 7128 - DNA, 94 bp, Artificial
  Hairpin sequence MQbrain_693, macaque
gcatctgcccctccagggcagctccatgggccagatggcggctcagatgggacagcttggccagatggggcagccggggctgggggcagacagc

SEQ ID NO: 7129 - DNA, 120 bp, Artificial
  Hairpin sequence MQbrain_694, macaque
cttcttatgttgacaccagtttttcctttagtctcctggggttagctagctgaatggggcagcttccctgccagccagcagtgggcctgggtagcagaatctgatgttggccatgtgagg

SEQ ID NO: 7130 - DNA, 108 bp, Artificial
  Hairpin sequence MQbrain_695, macaque
gctgggcctggcctgggcagcgccccctgcagaggccttcgggtccttggttctgtaccaggaaggggaggctagctggggacgactgaccacaggctgggacacagc

SEQ ID NO: 7131 - DNA, 86 bp, Artificial
  Hairpin sequence MQbrain_697, macaque
tggtcatgggcttgaggctgagtgccctgtccttgcatgctggagacaggagcagaggaccgggtcatgtgcctggctctctgcca

SEQ ID NO: 7132 - DNA, 88 bp, Artificial
  Hairpin sequence MQbrain_698, macaque
cgggcagtgcacagagagtgagtgggggttctggggaggggtctctgcccgcccctgccttgccctgggccctcacctggcctccccg

SEQ ID NO: 7133 - DNA, 93 bp, Artificial
  Hairpin sequence MQbrain_699, macaque
aggggggaagacctcttcctgggtagacgccacctcagggctacagccatatggtgggtggtgtgatgcctgggaagccaagtgtttgctgct

SEQ ID NO: 7134 - DNA, 54 bp, Artificial
  Hairpin sequence MQbrain_7, macaque
gaggctcgaggaggtgtgaagccaggccgctgagctcacacggtcttgggtctc

SEQ ID NO: 7135 - DNA, 104 bp, Artificial
  Hairpin sequence MQbrain_70, macaque
aggcaggatggtggggacagcagggggctactgccatccagaagttacagctggattgggaagaagcagccagatcccccgctgttctcctcactcatcttctt

SEQ ID NO: 7136 - DNA, 108 bp, Artificial
  Hairpin sequence MQbrain_701, macaque
ctgcggcagaggcacaggctagcaggaatggatgtgccctgggctgctgcaagctcccgtccccagtcacatccattcacgcagcccgactgcctccaggggccttag

SEQ ID NO: 7137 - DNA, 69 bp, Artificial
  Hairpin sequence MQbrain_702, macaque
agaatgtgacctccttgctgaaggagtccacgcaaggagtgagcagcctgttcagggagatcacagcct

SEQ ID NO: 7138 - DNA, 116 bp, Artificial
  Hairpin sequence MQbrain_703, macaque
gcgtgctggggtgtgaaaagtagtatggaggcagcggtggtcgagtttctgtgtggttgctgggtctccatggagaagcggctcgccagtgtcccaggctgctgagctctagccgc

SEQ ID NO: 7139 - DNA, 102 bp, Artificial
  Hairpin sequence MQbrain_704, macaque
agccttactggatatcctgttctgtccccttctctctccctcctccagccccagcagccaggggcctggaggttggcagagggctgagcagcccagcttgct

SEQ ID NO: 7140 - DNA, 109 bp, Artificial
  Hairpin sequence MQbrain_705, macaque
atttaaaaagtatgtcctcagaaaactgtactggaaggatgggtggcaggaacttgtatagttcagctaccaacactttggaacagattaaaaagggaatcttttaaat

SEQ ID NO: 7141 - DNA, 103 bp, Artificial
  Hairpin sequence MQbrain_706, macaque
gctagacccactcattggcaggatcctgtgaggccccggggaggagggtcttggaggtcagtttccttgggcagcctcccagcagcatcctggtgagggcggc

SEQ ID NO: 7142 - DNA, 99 bp, Artificial
  Hairpin sequence MQbrain_707, macaque
ggtctgaggcccaggctgctgctggaggggagggggctggctgtgcctctcaccctgggcccccttcgctccagctctgcgccgaggacgtgaaggact

SEQ ID NO: 7143 - DNA, 97 bp, Artificial
  Hairpin sequence MQbrain_71, macaque
gaagtctcggcaggcgctcttgccagtctctgtgcctgctccctgtggagctgtgcagggcctggcagttctgaggctttgctgctgtgatgtgatc

SEQ ID NO: 7144 - DNA, 118 bp, Artificial
  Hairpin sequence MQbrain_710, macaque
gggtggggatggccacgtgtgcagcctgctgtgggcagtggggaaactaaaggagtccttgacttgctcccccactcccttagctggcagctcaagtggtcttggtcacttcttgcct

SEQ ID NO: 7145 - DNA, 74 bp, Artificial
  Hairpin sequence MQbrain_711, macaque
gatcacagagatctgttgacctccaggagtcctccgctcctaggaggtatgtagaatggatcactctctaggtc

SEQ ID NO: 7146 - DNA, 76 bp, Artificial
  Hairpin sequence MQbrain_713, macaque
gggagctgggtgctgctggctctcggtgtccatggggtcatcttttgttggagcctgacagtgcctggggcctcct

SEQ ID NO: 7147 - DNA, 95 bp, Artificial
  Hairpin sequence MQbrain_714, macaque
ccccagatcccctcctcctggccatcccactctgccccctccacaccctgggtacagaaagggactgaagtgttgggcagagaggggacttaagg

SEQ ID NO: 7148 - DNA, 118 bp, Artificial
  Hairpin sequence MQbrain_715, macaque
ggttgtgttgaagtcccctggacagtgggcagggtggcagaggacacgagcagccactgcccgtaccccctctcctctctgtaagcccatgccccgtcctcccagggacttgtgagcc

SEQ ID NO: 7149 - DNA, 102 bp, Artificial
  Hairpin sequence MQbrain_717, macaque
ccagtgctgggcctgccccagggcctgtggtcactgctgagggactgcatccatcccttccctcacccactggcaacagcaccccattgggttccagcaagg

SEQ ID NO: 7150 - DNA, 116 bp, Artificial
  Hairpin sequence MQbrain_718, macaque
ttcttaaatgcagaacttagtgttttaagggtgggctaattcctctgtgcacaaagttgagcatgcagggaggggctgaggctactgaggaggggctgagacactgcagccaagga

SEQ ID NO: 7151 - DNA, 104 bp, Artificial
  Hairpin sequence MQbrain_719, macaque
ccttgggccctagctcctcccctccacttccattgcctgtctgttttctctccacagctgaactctggctactatgtgtctgggagctcctcaggcttccaggg

SEQ ID NO: 7152 - DNA, 109 bp, Artificial
  Hairpin sequence MQbrain_72, macaque
ctcctcctcttgggcctctccttccgggtgctggctctgttggggtcttggggtctctcaccttctcctgactttgtgctgctcccttggacagtctttagtggagggg

SEQ ID NO: 7153 - DNA, 80 bp, Artificial
  Hairpin sequence MQbrain_720, macaque
gctcggcagtgtggatgcctgtgccagttctctagtcctaactgaggtttgcttcacagtggcttctacccactgccagc

SEQ ID NO: 7154 - DNA, 108 bp, Artificial
  Hairpin sequence MQbrain_721, macaque
gatcagctaccctcctgtgagagtctgaaggacactattgccagagctctgaccttctggaataaagaaatagttccccagatcaaggagaggaaatgtgtactgatt

SEQ ID NO: 7155 - DNA, 84 bp, Artificial
  Hairpin sequence MQbrain_722, macaque
aggaattcagcttcctctcaaaggccatggttgcgacgtcgcgtgtttaacctcgcactgggtactgaggggattaacaggcct

SEQ ID NO: 7156 - DNA, 70 bp, Artificial
  Hairpin sequence MQbrain_724, macaque
gcctgggggtagtgagtagggtgtggggtgtgcatgtgcatatagatcacactgatattggtcatcaggc

SEQ ID NO: 7157 - DNA, 118 bp, Artificial
  Hairpin sequence MQbrain_725, macaque
gtagcagacggttcaagcaggttgataggagaaagacagcaaggtgaacaggagaccagtggaggcgtttcgatactgggtgttgtaaatatcagccacacagagccgttctgtctgc

SEQ ID NO: 7158 - DNA, 116 bp, Artificial
  Hairpin sequence MQbrain_726, macaque
tggatagcatgtgtctctggacaacggacccttccagttgctttccatctagcacagtgtccttactgtggttggctggagagagtgggtctgttgtcctgcagaatatctgacca

SEQ ID NO: 7159 - DNA, 72 bp, Artificial
  Hairpin sequence MQbrain_727, macaque
ggaaagtgacagaccttggaagctgaagaggtgggaggacccacccgctggcttccacggtgatggatatct

SEQ ID NO: 7160 - DNA, 85 bp, Artificial
  Hairpin sequence MQbrain_728, macaque
cttgcacgatgtgtgtcctcgggccctgccccatcctggtcccaggactgcgggcagcctggcggagcgggcacactcctgctgg

SEQ ID NO: 7161 - DNA, 119 bp, Artificial
  Hairpin sequence MQbrain_729, macaque
cagccctggctgaatgaacgaggatgactccccacccagcacccttccctcccctttgatggggacggatttcgggagtgtgcatcagactggtcatcttccattttatctgcaggctg

SEQ ID NO: 7162 - DNA, 106 bp, Artificial
  Hairpin sequence MQbrain_73, macaque
tctctcagtgctttcatagatattatcttattggagctctataatgatgcaatgagttgcatcgtttgtccaaaagactaaatgtcttgtcccagccactgccaga

SEQ ID NO: 7163 - DNA, 106 bp, Artificial
  Hairpin sequence MQbrain_730, macaque
ggtcctctctgacagctgttccttcttgggtcctggctggagatctctgctgcccccagactcagaggagccactccaggactcagggagtggctggctttgggcc

SEQ ID NO: 7164 - DNA, 70 bp, Artificial
  Hairpin sequence MQbrain_731, macaque
tcctgggtggggttctcctagtggcctgagtgtgccaccaggtctgcagggagcaggaatccatgcagga

SEQ ID NO: 7165 - DNA, 91 bp, Artificial
  Hairpin sequence MQbrain_732, macaque
gcctctgtcactgtggccagctgctgtgccacacaggatgaggttctgtctgtgtctgtgggcatccagctctgccacagggccagctggc

SEQ ID NO: 7166 - DNA, 114 bp, Artificial
  Hairpin sequence MQbrain_733, macaque
ttctctcaaactcagatggcagctgtggccagctgctgtgccacacaggatgaggttctgtctgtgtctgtgggcatccagctctgccacagggccagctggccatagggaggg

SEQ ID NO: 7167 - DNA, 80 bp, Artificial
  Hairpin sequence MQbrain_734, macaque
gcgggaggggcgcgagcgggcgggcagaggaggcggcggcgtggagctgcctcctgccggcgggccgggccgggccgagc

SEQ ID NO: 7168 - DNA, 116 bp, Artificial
  Hairpin sequence MQbrain_735, macaque
tcggggataatgcacctgctgaggacggggtggtgagtgaggggctgtgggctcactgggggtgtgaggtaggggtgaggggctcatggcctctgtccagcaggggcaattcttga

SEQ ID NO: 7169 - DNA, 119 bp, Artificial
  Hairpin sequence MQbrain_736, macaque
ctgaggtggcctcattcactcttttggcaggggctgggagcataggcagggtggccaccctaggccctgccacttgcatccttcctgccccagccacagtccaggcctttttcctgcag

SEQ ID NO: 7170 - DNA, 115 bp, Artificial
  Hairpin sequence MQbrain_737, macaque
gggcacgctgggccaggaagtgggtgaggcgggcacgcagggctggggcgagctcatgcttggccaagctccgcaggctctcctcagctgcccagctccggcgctccagctgccc

SEQ ID NO: 7171 - DNA, 73 bp, Artificial
  Hairpin sequence MQbrain_739, macaque; PT_from_MQbrain_739, chimp
tggcccacctcaggtgcctactgccgcctctgcactgtccctggagctgcaggaagtggagcccctggggcta

SEQ ID NO: 7172 - DNA, 110 bp, Artificial
  Hairpin sequence MQbrain_74, macaque
tcatcttctgccttctgcatttcagacctatgagcagaggaaaatcgtggagttcacctgccacacagccttcttcgtcagtatcgtggtggtgcagtgggccgacttgg

SEQ ID NO: 7173 - DNA, 118 bp, Artificial
  Hairpin sequence MQbrain_740, macaque
gaatttgagcagtcttttcattaaagcgcacttggtctaaatgagtttggagtgactgtaatagccattcctgcactgttatttataaaggtgaaatctgatgtgagtattgttgttc

SEQ ID NO: 7174 - DNA, 117 bp, Artificial
  Hairpin sequence MQbrain_741, macaque
aattgttagagtcaggtttctttctgttactgactctaggtctatccagatggcattcggcacatacgagcagacaagagagtcaatgagtggaagacccctggaaagaaaacaatt

SEQ ID NO: 7175 - DNA, 99 bp, Artificial
  Hairpin sequence MQbrain_742, macaque
cgtcgggcagggaggccggcggaggcggggccgtggccgcccccgagaggcgcccaggcggcggcggcccagcctcttctttcctcgcacagtcaggcg

SEQ ID NO: 7176 - DNA, 54 bp, Artificial
  Hairpin sequence MQbrain_743, macaque
cctaggaaggcccctgtcctcacagttactgggaggggcagggagtgtgctggg

SEQ ID NO: 7177 - DNA, 95 bp, Artificial
  Hairpin sequence MQbrain_744, macaque
gcatttgaaggaattagagggttacgctgaatgaaaatgtaagtaaagaaagattatatgttccgttacagcagcctagagaattcagcaggtgc

SEQ ID NO: 7178 - DNA, 96 bp, Artificial
  Hairpin sequence MQbrain_745, macaque
tggttgttctctcccccgcatcctgcaggagagcgaagaggaactttactcctcctgtcgccagctaaggaggcggcaagaagaactgaacaacca

SEQ ID NO: 7179 - DNA, 72 bp, Artificial
  Hairpin sequence MQbrain_746, macaque
gctcagtggccatgtggacccctcagaggacaccagcccccctcacagccctgagtggccacctgctgatgc

SEQ ID NO: 7180 - DNA, 77 bp, Artificial
  Hairpin sequence MQbrain_747, macaque
ttcgccgtcctcaggcaaccagctgaggggaggggacatttgcgatgtcttctgaaagctggtgttggagagctgaa

SEQ ID NO: 7181 - DNA, 68 bp, Artificial
  Hairpin sequence MQbrain_748, macaque
tgatgagttttggtaacactgggttccctgctgtcccagactcccaggccagcccacagagcttatca

SEQ ID NO: 7182 - DNA, 95 bp, Artificial
  Hairpin sequence MQbrain_749, macaque
cttgaaggagcctgaggctgggacacctcctgggagagtccaggttccaagtggaaaggggcctcttcctcccagccaactgctcctctttcagg

SEQ ID NO: 7183 - DNA, 73 bp, Artificial
  Hairpin sequence MQbrain_75, macaque
cttccctggtgttctgtctgtttgggaaatggttgagaattccattcttccagctctcggggttttagggaag

SEQ ID NO: 7184 - DNA, 99 bp, Artificial
  Hairpin sequence MQbrain_750, macaque
gggctgctggccgggagactagccagagcacgagggggtcagagctgtgtggttttggcctgattctgcatttggttgttcctggaggccatgtagcct

SEQ ID NO: 7185 - DNA, 110 bp, Artificial
  Hairpin sequence MQbrain_751, macaque
ccgtgggtaccgatggatgtggccgagagccctgaacgggatcctcgctctccagaggatgaagagcagccacaggggctctcggacgacgacattctgagggacagcgg

SEQ ID NO: 7186 - DNA, 77 bp, Artificial
  Hairpin sequence MQbrain_752, macaque
gcttgctgtggggccgtgcagggagccctgcagctgcccaggtgtcaggagagctccctgccgagtgcttcagctgc

SEQ ID NO: 7187 - DNA, 100 bp, Artificial
  Hairpin sequence MQbrain_753, macaque
agctcaccgctcgtgctcaggccagggcttagggtggagccgcagcccgtgcaattcacctgctcctcccacaccctggccacaggacaagtgagaagct

SEQ ID NO: 7188 - DNA, 62 bp, Artificial
  Hairpin sequence MQbrain_754, macaque
ctgggcctcagcttccacccaccatgcaggtctttgcatggatggagtggcggtggccacag

SEQ ID NO: 7189 - DNA, 68 bp, Artificial
  Hairpin sequence MQbrain_755, macaque
accgagggctgcttttctccaaccccagccctgaggggggattggcaggagaagcagcccagcccggt

SEQ ID NO: 7190 - DNA, 60 bp, Artificial
  Hairpin sequence MQbrain_756, macaque
cctgcctgctgggtgccctctgtgtgttccactgaggccacggggtcctggccgggtagg

SEQ ID NO: 7191 - DNA, 106 bp, Artificial
  Hairpin sequence MQbrain_757, macaque
gggccttccatgtgagttctagtgttcagctggtgccagggaatagaattagagaaacctctgacccaccgggtgccagggaccagtggaggtggatggcaggtcc

SEQ ID NO: 7192 - DNA, 59 bp, Artificial
  Hairpin sequence MQbrain_758, macaque
tctgggaactggagggaagccaccagaagaaacctggagcctccactgaaggacccgga

SEQ ID NO: 7193 - DNA, 80 bp, Artificial
  Hairpin sequence MQbrain_759, macaque
aggaaggcccatccacaggcctggctctgggccgtgtgccccagaagcaggtgtgtccagagccagctgagggctctcct

SEQ ID NO: 7194 - DNA, 79 bp, Artificial
  Hairpin sequence MQbrain_76, macaque
tgtggatttgggtggaaagggctcttaaggtacctggggtgcaccccctgaggcactggggcccagccttctgttccca

SEQ ID NO: 7195 - DNA, 99 bp, Artificial
  Hairpin sequence MQbrain_760, macaque
ggcttcggtgctgcccttgacctgccccctgtccctattgctgcaggcctatgaaggggtgctgcagctggtggaggctcgagggcgttacgaggagct

SEQ ID NO: 7196 - DNA, 75 bp, Artificial
  Hairpin sequence MQbrain_761, macaque
ggcagggactgcgggctgtcagcgcaaaggatgagaagacagggcctcctgcattggcagccagtggtccctgtc

SEQ ID NO: 7197 - DNA, 74 bp, Artificial
  Hairpin sequence MQbrain_762, macaque
cggcacaggcattccaaaggtggtggttttgagtcccacagagccaccaacctttctttcccacctgaaatacg

SEQ ID NO: 7198 - DNA, 112 bp, Artificial
  Hairpin sequence MQbrain_764, macaque
accgctaagaggctgatgcaatgacagactcggcctgtctctggggcagagacgctgcagagagcagtgtctcctttccaggacggcagagaactgggcaaggccaggcggt

SEQ ID NO: 7199 - DNA, 91 bp, Artificial
  Hairpin sequence MQbrain_765, macaque
gcgccaggagaaagacagagaagggagcaggaggcctttgttgctcagcagggggctccgccctccctccttccttcttgcttcttatagc

SEQ ID NO: 7200 - DNA, 111 bp, Artificial
  Hairpin sequence MQbrain_766, macaque
catgcgcctgcgccaggagacagacatagaagggagcaggaggcctttgttgctcagcagggggctccgccctccctccttccttcttgcttctggtagccctggtacatg

SEQ ID NO: 7201 - DNA, 53 bp, Artificial
  Hairpin sequence MQbrain_767, macaque
cactttgggtggctttctgggatttcagccaatcccagagaggcctggagatg

SEQ ID NO: 7202 - DNA, 85 bp, Artificial
  Hairpin sequence MQbrain_768, macaque
gaatgctctttggtgccaagctgtgttggatttgaaatgtcctgtcaagtttcagattcacagcttgacatttatatggttattt

SEQ ID NO: 7203 - DNA, 84 bp, Artificial
  Hairpin sequence MQbrain_769, macaque
gcttctcatttgacagtaactcgatgcaattcactttgtggaaccaagccacaaagtgaaaagcatcgaattgcagagaacagt

SEQ ID NO: 7204 - DNA, 101 bp, Artificial
  Hairpin sequence MQbrain_77, macaque
agctccagttgcagctggaacaactgaccgtcctgggggctgtgttgctgatcaccttcagcatggcagccccaggaatttccagccaggccgactttgct

SEQ ID NO: 7205 - DNA, 78 bp, Artificial
  Hairpin sequence MQbrain_770, macaque
gcatttcacatctctgggctggggatccacagggcactggggtgtcctgggattggaaagccccatctatgtctgagt

SEQ ID NO: 7206 - DNA, 106 bp, Artificial
  Hairpin sequence MQbrain_771, macaque
tgctgcaggggggttgtccttttaactctcacacaggatggatgtaggcagtgtcgcattcattgtgctgagagtgaaggttcatcactcctatatcgtggtagca

SEQ ID NO: 7207 - DNA, 94 bp, Artificial
  Hairpin sequence MQbrain_772, macaque
gaacaaaaaataactcatataaggcattccctggtagtttcatggatcttttcatgagactaccagggaatgccttgtgtgagttttttggttt

SEQ ID NO: 7208 - DNA, 70 bp, Artificial
  Hairpin sequence MQbrain_774, macaque
aatttgttttgcagctccccaaggaccagttgtttctcaaataactggtccttggggaactcagtggatt

SEQ ID NO: 7209 - DNA, 100 bp, Artificial
  Hairpin sequence MQbrain_775, macaque
gccagcaggggggcctgggtttccttgtttggagctgcaggatatttgttctatcctgtttacagccaatggggggccctttttcttccctacagtgagc

SEQ ID NO: 7210 - DNA, 118 bp, Artificial
  Hairpin sequence MQbrain_776, macaque
tcggcgcgcccgggccgtcctccgggctcccagctctgtccagccgcccgcgaccgctgcaggcgcctggacagctcctcctgggaacccggggaagcgctctcgggacccaggccga

SEQ ID NO: 7211 - DNA, 100 bp, Artificial
  Hairpin sequence MQbrain_777, macaque
gttgtgttgggttaagacagttttcggtgtaccgtaaatgttgtgttttcagaaaaagacaaaacgatggtgctgactggttttctgtatattgcacaac

SEQ ID NO: 7212 - DNA, 73 bp, Artificial
  Hairpin sequence MQbrain_778, macaque
acaggccagggccggattcgggcggggacccagctccgggtgctgggccctgaggacgacctggctggcgtgt

SEQ ID NO: 7213 - DNA, 93 bp, Artificial
  Hairpin sequence MQbrain_779, macaque
tcccagaataaaaaaggccaggccctgtcttttccttctctaagcaccatccttgcttagcagagacacggctgcgcctctcgggctctgggg

SEQ ID NO: 7214 - DNA, 120 bp, Artificial
  Hairpin sequence MQbrain_78, macaque
tccagttaggttcttgttttacagatgcagacactgacaaccagatctttgatttgatttgctgatatcctaagatctggttcttggtgtctgcatctgtaagacaacatgggactgaga

SEQ ID NO: 7215 - DNA, 92 bp, Artificial
  Hairpin sequence MQbrain_780, macaque
gcatctgtaagattcagaaagagccagtgacaattccagcacccgcttccaatgagcatgctgatgtcacaggcttggtattcggcgggtgt

SEQ ID NO: 7216 - DNA, 75 bp, Artificial
  Hairpin sequence MQbrain_781, macaque
aggtcatgcctcttggttccagcaggagggtgggctctcccctggctcccctcatctctggaactagagccacct

SEQ ID NO: 7217 - DNA, 98 bp, Artificial
  Hairpin sequence MQbrain_782, macaque
cttcagccctttccttcctctccctgccctgccctgcccctgtcccgcaggcgagcgaggacaaggtgaggcagctggtgaaggagatcggccgggag

SEQ ID NO: 7218 - DNA, 97 bp, Artificial
  Hairpin sequence MQbrain_783, macaque
gggagctctccagacttaaggaggtgagaggctgcaaggagggcgggccgtgaccacccacaccccttctccacagcccggcctgatctggaggacc

SEQ ID NO: 7219 - DNA, 65 bp, Artificial
  Hairpin sequence MQbrain_784, macaque
gggacagggatgggtgagcctggtggcatctcccactctgggggccaaggccaccccctccaccc

SEQ ID NO: 7220 - DNA, 118 bp, Artificial
  Hairpin sequence MQbrain_785, macaque
ggagttcacgtgctggagaaggtgcagagagcaagtccagctaggagtgggggctgtggccaaccctcagtcatgtcctgccgtcacttggtcctacctctgccagctccctttctcc

SEQ ID NO: 7221 - DNA, 77 bp, Artificial
  Hairpin sequence MQbrain_786, macaque
atttgtgtgtgcccatgtaagagtatgtgcatgcacatgtgtgcatgcaggtgtgtggcatgtgtgcacatacaagt

SEQ ID NO: 7222 - DNA, 91 bp, Artificial
  Hairpin sequence MQbrain_787, macaque
gcccctgggtgtcctctaagccagctgggagacagcagcctgggtccacatctgcttctgtattctgtgtggttttagaggatccctgggc

SEQ ID NO: 7223 - DNA, 67 bp, Artificial
  Hairpin sequence MQbrain_788, macaque
gcatgtgcatgcatgcgtgttcctgtgcacgttctgggagtgtgcatgtgcgtgtgtctgcatgtgc

SEQ ID NO: 7224 - DNA, 82 bp, Artificial
  Hairpin sequence MQbrain_789, macaque
gtcttagggatcttgggagtggtgggcctggcctcgaggggttttccaggggccctgcccccactcccctttctcaagccac

SEQ ID NO: 7225 - DNA, 102 bp, Artificial
  Hairpin sequence MQbrain_79, macaque
aggcaagggctgcttgtggttcagagggccctgattaaaaagacttgcagttggaagttttgtttggaatttaaggagcctggtgaacttgtggttgtgttt

SEQ ID NO: 7226 - DNA, 105 bp, Artificial
  Hairpin sequence MQbrain_790, macaque
cgggaggctctcagccaactccgggtgctctgctgtgagtggctgaggcccgagctgcacacaaaggagcagatcctggagctgctggtgctggagcagttcctg

SEQ ID NO: 7227 - DNA, 119 bp, Artificial
  Hairpin sequence MQbrain_791, macaque
caggggagggagtgtggacagtatctggaagttctgggattcaggttgttattaaaataataataataattaaaaattctgaagaaacttgaatttggaggttgacatctcgttcgttg

SEQ ID NO: 7228 - DNA, 115 bp, Artificial
  Hairpin sequence MQbrain_792, macaque
aggtggactggtggagtgtggtctggcaagccctcagcctagcccatcagtatctcttttcccccttactagctgctccgaaggccgagggcccacaactccattttctccacct

SEQ ID NO: 7229 - DNA, 67 bp, Artificial
  Hairpin sequence MQbrain_793, macaque
cagtgttctggagtgagggtgggcggaggctatcttgtctccttaccgccctcccttccacctcctg

SEQ ID NO: 7230 - DNA, 110 bp, Artificial
  Hairpin sequence MQbrain_794, macaque
ttgggcctcccacccagtggtgcttggcctggctcctatggcctgggtgtgttgtagacccaggcactggggcctgtcaccaaggctcctccaacatgcgggaggcttag

SEQ ID NO: 7231 - DNA, 90 bp, Artificial
  Hairpin sequence MQbrain_795, macaque
tggatccagaagatgctcaaccctcaaggcctctactgccactgacagctggcactggaggcaggacaggccctgcctcttctccctcta

SEQ ID NO: 7232 - DNA, 120 bp, Artificial
  Hairpin sequence MQbrain_796, macaque
ggggaccttccaggccccatgccagcttggctcctccccagaccccaggatcttcatctattagtgaagtctcccgggctttggggaggggcccgcagttgccagggcactgagatcctt

SEQ ID NO: 7233 - DNA, 74 bp, Artificial
  Hairpin sequence MQbrain_797, macaque
cgggcggcgttggaggatgctgcgggcctggagccgagaggaaagtgctggcccagccctctgagcgctcctcg

SEQ ID NO: 7234 - DNA, 56 bp, Artificial
  Hairpin sequence MQbrain_798, macaque
gcggccagcaggaggctgatgaaggtaaaagccattctctggcctcggtcgggcgt

SEQ ID NO: 7235 - DNA, 52 bp, Artificial
  Hairpin sequence MQbrain_799, macaque
cgggcgaggttctctggtcctcaggtgtggggggccagggaactcgcgcccg

SEQ ID NO: 7236 - DNA, 87 bp, Artificial
  Hairpin sequence MQbrain_8, macaque
ctgtggcttctccttaggtgctggtgtttgtccactcccggaaggagactggaaagacggccagggccatccgggacatgtgcctag

SEQ ID NO: 7237 - DNA, 89 bp, Artificial
  Hairpin sequence MQbrain_80, macaque
ttaatgatgctggggaccagggaaattccaaactgctggacttcctatgcaggaaaccaggagctggaccctgggacccttaatcttgg

SEQ ID NO: 7238 - DNA, 87 bp, Artificial
  Hairpin sequence MQbrain_800, macaque
cagtcatccatagtctctggcaggaacacagctggggctcagaaagctttaaaatgggctccagacttgtgggagtccctgggtttg

SEQ ID NO: 7239 - DNA, 88 bp, Artificial
  Hairpin sequence MQbrain_801, macaque
gctgggctcagaagaggcaggggaggctccaggctttggggccgtgacagcagcgtgggtctctcctgcttccacaggtacttccagt

SEQ ID NO: 7240 - DNA, 62 bp, Artificial
  Hairpin sequence MQbrain_802, macaque
gggcctggagctgcaggatcccaggggaggggtctctctccccatcccaagtcatccatccc

SEQ ID NO: 7241 - DNA, 82 bp, Artificial
  Hairpin sequence MQbrain_803, macaque
ctcttgcgagcggcttttgtagccagttgcttcctgggtgctttaccaccggtcgattggcaggcagtctgctttgtacgag

SEQ ID NO: 7242 - DNA, 89 bp, Artificial
  Hairpin sequence MQbrain_804, macaque
gtagactttgcagtgggtcagctttgggctgctgagatgggcagcgtgaaggccagcttccagagccctggctggcctttgtagtgaac

SEQ ID NO: 7243 - DNA, 94 bp, Artificial
  Hairpin sequence MQbrain_805, macaque
agaaccaggcaactggacatcagaaacagtgagcagagggctaaatgtcctccttgctttgtctctacttgtttttgcccatccacctgaatct

SEQ ID NO: 7244 - DNA, 76 bp, Artificial
  Hairpin sequence MQbrain_806, macaque
ttttgctttacaccccagtggtcatgctgggtgggtaccacttggcatatggcttcctctggcggtgggggttggg

SEQ ID NO: 7245 - DNA, 108 bp, Artificial
  Hairpin sequence MQbrain_807, macaque
gcccacagcacagtgagtgtgcaggacatccaggcgcacctggctcagggccatgtggccatcgtgctggtgaactctggggtgctgcactgtgacctgtgttccagc

SEQ ID NO: 7246 - DNA, 87 bp, Artificial
  Hairpin sequence MQbrain_808, macaque
cagtcatccatggtctctggcaggaaccaagctggagctctgaaagctttaaaatatgctccagacttgtgggagtccctgggtttg

SEQ ID NO: 7247 - DNA, 89 bp, Artificial
  Hairpin sequence MQbrain_809, macaque
agtcatccatggtctctggcaggaaccgatctggagttcagaaagctttaaaatgggctctagacatgtgggagtccctgggtttgatt

SEQ ID NO: 7248 - DNA, 115 bp, Artificial
  Hairpin sequence MQbrain_81, macaque
ggtgccatgtggatgtggaggaggggaagggaagtctaggcccagtcacaggaaggctggtcactgccttgtgggtgggtttggactaggctttcaggggtccaggtctgggatt

SEQ ID NO: 7249 - DNA, 76 bp, Artificial
  Hairpin sequence MQbrain_810, macaque
caggcaggcttctctggggatggaaggaggctggggagcatcttcacagctccatcctctcctgtgcatgggcgtg

SEQ ID NO: 7250 - DNA, 104 bp, Artificial
  Hairpin sequence MQbrain_811, macaque
ggggtcacatttgatggacatgagaacacccctataaggaactgcaggaccttatctgatccagcctcctgggggaggtctcatcccatgcagagggggacccc

SEQ ID NO: 7251 - DNA, 108 bp, Artificial
  Hairpin sequence MQbrain_812, macaque
ggtgactgaagctgtgggaaggttaatagttgatactagtgcagctcctccaattaagtgtatgtgtgactggctgtaatgttgactgttaaacgtacagctagtgcc

SEQ ID NO: 7252 - DNA, 58 bp, Artificial
  Hairpin sequence MQbrain_813, macaque
gcatgctggctccgtctccagggcagtagctctgccctgctttgctgtcagtcactgc

SEQ ID NO: 7253 - DNA, 114 bp, Artificial
  Hairpin sequence MQbrain_814, macaque
ccagcctcctgatctgccagggtctgctctgggtgggcactgaccagggtgtcatcgtcctgctgcctgtgcctcggctggagggcatccctaagatcacaggtgaggctttgg

SEQ ID NO: 7254 - DNA, 117 bp, Artificial
  Hairpin sequence MQbrain_815, macaque
gtcagaaacatctcagcccagggaagaagactgcatccttatctttacacctgcacggtggatctgacatctcagggtgtgtggggagcaggactgggctgctgggtgcatcctgac

SEQ ID NO: 7255 - DNA, 99 bp, Artificial
  Hairpin sequence MQbrain_816, macaque
ttcccagggaaggcagcaacttgcagctgggttctaaataagatttccagttttgtccagtccatcccagatgtacccaggtgctctcttcctgtagag

SEQ ID NO: 7256 - DNA, 74 bp, Artificial
  Hairpin sequence MQbrain_817, macaque
gcatgcagatctcaaagcaaggtgtctctggggctccagggtgggggccccaagcccagttagtcatggcctgt

SEQ ID NO: 7257 - DNA, 95 bp, Artificial
  Hairpin sequence MQbrain_818, macaque
gtcagaagagggagaggaggggctgaggatgaggggcagaccatggccaaggggccagctgccacctcattcatcactctgaccttcacagggac

SEQ ID NO: 7258 - DNA, 59 bp, Artificial
  Hairpin sequence MQbrain_82, macaque
caggtgctcacctggtgttggcctcagcattggggcagtcagcactgaggtggcttctg

SEQ ID NO: 7259 - DNA, 103 bp, Artificial
  Hairpin sequence MQbrain_820, macaque
ggaggcctcacggtggggaccactgtgctgtcgtcacaccctgtggcagcagattgttgcccaggagggtgctgcttcagttgctggtttctgcccttcctct

SEQ ID NO: 7260 - DNA, 72 bp, Artificial
  Hairpin sequence MQbrain_821, macaque
taacttctaacttctctgtaaccttcgaccttacaaggtaggcttggagtgcagaggagtgcaatgaagttg

SEQ ID NO: 7261 - DNA, 100 bp, Artificial
  Hairpin sequence MQbrain_822, macaque
ggtggagctgggtcaatttcaggcacagcccaggcgagtcgggcgaggttcagaaaggcctgactcgcctggcagcctcaacggacttatcctcgcagcc

SEQ ID NO: 7262 - DNA, 100 bp, Artificial
  Hairpin sequence MQbrain_823, macaque
ggtggagctgggtcaatttcaggcacaggccaggcgagtcgggcgaggttcagaaaggcctgactcgcctggcagcctcaacggacttgtccccgcagcc

SEQ ID NO: 7263 - DNA, 98 bp, Artificial
  Hairpin sequence MQbrain_824, macaque
aggcaaggctggccctgcccacctctctggacctctaaccccagccccctagctggatacccgggtctacgaagggcagggttcaccttcaaatccct

SEQ ID NO: 7264 - DNA, 117 bp, Artificial
  Hairpin sequence MQbrain_825, macaque
accaacccgagattccaaggagccaggggctgccggggctgtgagccagaggggcaagctccatgctcaccattcaggcacagcttctgtggctgctctggctctgtttcctttggt

SEQ ID NO: 7265 - DNA, 100 bp, Artificial
  Hairpin sequence MQbrain_826, macaque
ctaggatggctctgccattggggttgtaagctgaaacatgactgaggcaggtctcagtcaatagaggttttcattagctgaggtggagggttcatctagg

SEQ ID NO: 7266 - DNA, 120 bp, Artificial
  Hairpin sequence MQbrain_827, macaque
cggcagtgtcagatggtagcagcagctggctgtgccggggcctaatgttccccattaaaggaacatctgttggctggggctcccggggcatgggccagacgcagccacgctccacggccg

SEQ ID NO: 7267 - DNA, 109 bp, Artificial
  Hairpin sequence MQbrain_828, macaque
caggagctgccttcattcaggcgggtagctgcactgggcgcggggtggtggtggggagcttaccgccacctattcaagctctcagccactcctgaaatgggcagagatg

SEQ ID NO: 7268 - DNA, 49 bp, Artificial
  Hairpin sequence MQbrain_829, macaque; PT_from_MQbrain_829, chimp
gggcagggtcctcgcggcccatgctggccgctggggacccgcgcagccc

SEQ ID NO: 7269 - DNA, 95 bp, Artificial
  Hairpin sequence MQbrain_83, macaque
cccccttctccggccacagtctctgggatggtcgcggagagtcggaacctcgcccccggcctccatccactgcgcgggcctgcggggagggaggg

SEQ ID NO: 7270 - DNA, 74 bp, Artificial
  Hairpin sequence MQbrain_831, macaque
gtaattttggcatccatgtttttgtgcctgccctccctcttggggaggccatgcttggctctgctgaaagctgc

SEQ ID NO: 7271 - DNA, 53 bp, Artificial
  Hairpin sequence MQbrain_832, macaque
tcgggcgaggttctctggtcctcaggtgtggggggccagggaagtcgcactgg

SEQ ID NO: 7272 - DNA, 81 bp, Artificial
  Hairpin sequence MQbrain_833, macaque
ggccttcgggcggttggtctcgttctaccagagcttgctgtcggaagagagaaatggtagaatgacaagccacgtctggcc

SEQ ID NO: 7273 - DNA, 114 bp, Artificial
  Hairpin sequence MQbrain_834, macaque
ctggaggtggagcgccgcttccacctggtgctccttcaggagtacttcgacgagtcgctggtgctgctgaaggacctgctgtgctgggagctggaggacgtgctctacttcaag

SEQ ID NO: 7274 - DNA, 92 bp, Artificial
  Hairpin sequence MQbrain_835, macaque
gacccctcatgctctctggctaggctggtgggcagccctggcctcccttggatggagctgccctgctggtgcctaggcagagaagaggcatc

SEQ ID NO: 7275 - DNA, 79 bp, Artificial
  Hairpin sequence MQbrain_836, macaque
tcatgtctggacagtttcccaggggagttctgggttcaaccagccagaactttccctcctgcagacctggctggcctgg

SEQ ID NO: 7276 - DNA, 88 bp, Artificial
  Hairpin sequence MQbrain_837, macaque
tacacctgaatacagtggcaccagcagcccaaggcttccatgtggtttcagagccttgggctggtgtgagctactgtactcctctgta

SEQ ID NO: 7277 - DNA, 69 bp, Artificial
  Hairpin sequence MQbrain_838, macaque
tgtagagctttatgctgaaaaggtggccactagaggtctgtgtgccattgcccaggcagagtctctgcg

SEQ ID NO: 7278 - DNA, 108 bp, Artificial
  Hairpin sequence MQbrain_839, macaque
ctcccctgccatcatgtctaagtcagagtctcctaaagagcccaaacagctgaggaagctcttcattggagggttgagctttgaaacaactgatgagagcctgaggag

SEQ ID NO: 7279 - DNA, 103 bp, Artificial
  Hairpin sequence MQbrain_84, macaque
aggcatttcctgggctgggtgggttttttcctgccctggtgtgagcttccttagggaggatccagagcaaggcttagagctcacagcaggctagaaaaggcct

SEQ ID NO: 7280 - DNA, 95 bp, Artificial
  Hairpin sequence MQbrain_840, macaque
ggtctggtgtgcaaaggagggtggtcctttggctaacggtggacctgctcctaggcctatgccagagtccctcagctctcctagcacaccaaatc

SEQ ID NO: 7281 - DNA, 113 bp, Artificial
  Hairpin sequence MQbrain_841, macaque
ggcctggggtcaggaaacagctagagagttaggggccttagggcaaggggctgttgttcccttgaagctgactctggccctggcccttacttgcttccccagccccctgggcc

SEQ ID NO: 7282 - DNA, 119 bp, Artificial
  Hairpin sequence MQbrain_842, macaque
gtgatggcttccacggaggtttcggcagtggcatccggggccggggtcggccgtggacagggccgggaccccagagctcgcggaggcaaggccgaggataaggagtggatgctcgtcac

SEQ ID NO: 7283 - DNA, 58 bp, Artificial
  Hairpin sequence MQbrain_843, macaque
ggggaacgcgaggctgcttcccctctgcgcaatcagggtacgcagcctccagttctct

SEQ ID NO: 7284 - DNA, 115 bp, Artificial
  Hairpin sequence MQbrain_844, macaque
cttagaagactggagggataaagaaagcgggggggtgctgcagaggggaaacagggaagaataaggacttttctccacttaagtagctcaagccttcgtcctagtgtgcaatgag

SEQ ID NO: 7285 - DNA, 109 bp, Artificial
  Hairpin sequence MQbrain_846, macaque
caagtgaagtgtattcagtggtctcagtttctcctttgtacatacactcatttcccttctctgaggtgcacttggagagacttaatgcctactggacaccctcaccctg

SEQ ID NO: 7286 - DNA, 106 bp, Artificial
  Hairpin sequence MQbrain_847, macaque
cttttttttatatagtttaatcttaaaaccaatacgatattgtcagacaatacaatgtgtgacaatgttgtatcctttttactgaatacttgatacttggagaaag

SEQ ID NO: 7287 - DNA, 115 bp, Artificial
  Hairpin sequence MQbrain_848, macaque
cttatactccttcccaccaaagcttccactcttcagtctaggtagatcattgttctgtatccccttgatctatacccttggttgaggaatggaagttctgtggccagcagatagg

SEQ ID NO: 7288 - DNA, 100 bp, Artificial
  Hairpin sequence MQbrain_849, macaque
ggtgccctctatgtgacccttctgcccccaggtcccgcctaagcacgtgtaccgcgtgctacagtgccaggaggaggagctcacgcagatggtctccacc

SEQ ID NO: 7289 - DNA, 69 bp, Artificial
  Hairpin sequence MQbrain_85, macaque
tctgggatgcctgggcttttctggccagagccatatactgacaggaccagaagggctgagatgctggga

SEQ ID NO: 7290 - DNA, 106 bp, Artificial
  Hairpin sequence MQbrain_850, macaque
catggggcagctcagctgcacacgcaagaagtgaaggagagagactcggtcgaatgtgacttctttttctttattcttgaaagtggtgagggtttggcagctcgtg

SEQ ID NO: 7291 - DNA, 114 bp, Artificial
  Hairpin sequence MQbrain_851, macaque
tttgtttctaaagtatgttttgcttaacacaaaacacacgctaatgcaaaataaaactccccaaaagttttgtttccaattgcttgtgaggtgggaagctgacaccgagacaga

SEQ ID NO: 7292 - DNA, 91 bp, Artificial
  Hairpin sequence MQbrain_854, macaque
ttgcttgactggaggaagtgggtgagttgtggctgcttcggttgacccattgtagacgcctcgtcacccttcttccttccacttcaaggag

SEQ ID NO: 7293 - DNA, 58 bp, Artificial
  Hairpin sequence MQbrain_855, macaque
gcggcctgccagcagcatgtgcacttggtacagcgctacctggctgacggcaggttgt

SEQ ID NO: 7294 - DNA, 61 bp, Artificial
  Hairpin sequence MQbrain_856, macaque
gccttcatggtgtgggcgcaggcggcgcgcaggaagctcgcggaccagtacccgcacctgc

SEQ ID NO: 7295 - DNA, 105 bp, Artificial
  Hairpin sequence MQbrain_857, macaque
ggttgagtggtatgtatagctttttacattcaatcatacctcaaaaaataaaggttagctaaatgggggtgggagagtgtagggagactgaatttactctgaact

SEQ ID NO: 7296 - DNA, 68 bp, Artificial
  Hairpin sequence MQbrain_858, macaque
ggagccccacggccctccagctcttccttcagatctcagaggaggaagagaagggtcccagaggcgct

SEQ ID NO: 7297 - DNA, 97 bp, Artificial
  Hairpin sequence MQbrain_86, macaque
ctcaggggagtcatggtggggtcacagtgggcagggaggagtgcaggggtgtttagagagcatctctcccttccacctgtgggtgactgaggttgag

SEQ ID NO: 7298 - DNA, 94 bp, Artificial
  Hairpin sequence MQbrain_860, macaque
gaatcgggttggctgggtttcttcaaatgccagtgagatgagaaataaaaaggtaggctggatggggagaggctgatgtagactaacaagattc

SEQ ID NO: 7299 - DNA, 95 bp, Artificial
  Hairpin sequence MQbrain_861, macaque
gttagaggccaagcatgggttcctgagggaaggacacacagagcatgggagccctgtctgtctgcacagccctaggaatccgtcagtggagtagc

SEQ ID NO: 7300 - DNA, 93 bp, Artificial
  Hairpin sequence MQbrain_862, macaque
gggtgtctgggtctgctcaggatcatgttttctagcacctcctgttggaggggtggagggatgttcccctgagctaggctgagactaaaaccc

SEQ ID NO: 7301 - DNA, 103 bp, Artificial
  Hairpin sequence MQbrain_863, macaque
ccaggctgcgagcatgtccctggagctctggctccttttcaccctctcttgcctggtgtgggaagggtgtcctggggcttacaggggccctctctcctcctgg

SEQ ID NO: 7302 - DNA, 108 bp, Artificial
  Hairpin sequence MQbrain_864, macaque
tttgtagaagtgccccccaggatggaggccagcagtctaagttgcaatgccttggcagtgtcgcactcacagctggtgcaatctggaggatgattggcacccaacaaa

SEQ ID NO: 7303 - DNA, 58 bp, Artificial
  Hairpin sequence MQbrain_865, macaque
cccagtgtcctgcagagctctcatggctgaaggtcctcctgtgagctgcagggctggg

SEQ ID NO: 7304 - DNA, 89 bp, Artificial
  Hairpin sequence MQbrain_866, macaque
ggaggtaaagatgttgtgcagttgtggaaacgctcactctgcagggggtggggagggagagtcccgcagctgaggcatcccttggctcc

SEQ ID NO: 7305 - DNA, 117 bp, Artificial
  Hairpin sequence MQbrain_867, macaque
ccagctcataaactctgacttaaaagccagtctcagttactctccctggcacttggaggtcccagtgccagaagagtgactgagactagcttataagttggagtttctccaggctgg

SEQ ID NO: 7306 - DNA, 114 bp, Artificial
  Hairpin sequence MQbrain_868, macaque
acctgccactctgccacctctctggggttggctcagcctccaaccgcagctactctgctgatggcaagggcactgagagccacccgccagaggacagctggctcaagttcaggt

SEQ ID NO: 7307 - DNA, 103 bp, Artificial
  Hairpin sequence MQbrain_869, macaque
ggccctctggagccaggagaggagtctgcaggcctcggctgggccacattccccagattctggccttaggtcctgaatgcctggtgagttactgagaaaggcc

SEQ ID NO: 7308 - DNA, 84 bp, Artificial
  Hairpin sequence MQbrain_87, macaque
ctagtggggttcagggggctgtttgggtggctcagctgctctctcagttctgagcttattcaccagctatgcacagccacctag

SEQ ID NO: 7309 - DNA, 73 bp, Artificial
  Hairpin sequence MQbrain_870, macaque
ctcaagggtgaaatgagctggatggctgcagtcagaggtgctctgtggctgcacggctcattcataaaacgag

SEQ ID NO: 7310 - DNA, 111 bp, Artificial
  Hairpin sequence MQbrain_871, macaque
ctgtgggtaaggctgtgggaagggggcagggggggaaagtatgacctgggctgtgagggaagggtgatgaggttgttccctgtgttgttcttccctgtgttgttgctatgg

SEQ ID NO: 7311 - DNA, 100 bp, Artificial
  Hairpin sequence MQbrain_872, macaque
gcagtgacctaagaacaggatatggtgaggatgtcatggaagagaagagctctttccgtggtattcttgggcaagagccatgtctactaagaggttaggt

SEQ ID NO: 7312 - DNA, 119 bp, Artificial
  Hairpin sequence MQbrain_873, macaque
cgccccgccacgcgtgcgcttaggcgccgctgagcgccgactgggtgcgagcggggaagccgctaacctgacccggattggcgctgaggtggcccgtggggcaggtgagtgcggggacg

SEQ ID NO: 7313 - DNA, 102 bp, Artificial
  Hairpin sequence MQbrain_874, macaque
ttccttggttttgtataagcattaaatctctgcagaggtggatatttaaggtggggagtagtagcagctctgcagaggaaaagaaaggcaagatggggagaa

SEQ ID NO: 7314 - DNA, 53 bp, Artificial
  Hairpin sequence MQbrain_875, macaque
gtgggctccagccacatcctcagtgcactgtgctgtgtgtgctgggtgctcac

SEQ ID NO: 7315 - DNA, 91 bp, Artificial
  Hairpin sequence MQbrain_876, macaque
agaggagaaaggtattatcagtccacgaaactgccttgtgagtcagacctaacaaagtaatttcctgggaatgtgccttactttttccttt

SEQ ID NO: 7316 - DNA, 69 bp, Artificial
  Hairpin sequence MQbrain_877, macaque
cctaaagaaaactgaggagaggggctaagatgaagagaccttgaccctgcttgcccctcccctcttagg

SEQ ID NO: 7317 - DNA, 115 bp, Artificial
  Hairpin sequence MQbrain_878, macaque
aagcggctgggtgggaggcagggccatgctgagaaggaagtcctgggtggaaggaggctctgatttaccctattctatttcagcatgctctcctgccctgctctgccctgccctt

SEQ ID NO: 7318 - DNA, 86 bp, Artificial
  Hairpin sequence MQbrain_879, macaque
ctcaagatgatgtcagaggcaaagagaggccatcccgctctaatcccacagcgggtctcctctctaatgcctcaactcataaaggg

SEQ ID NO: 7319 - DNA, 112 bp, Artificial
  Hairpin sequence MQbrain_88, macaque
ggccaaaaagatagtgtctcttgtgaggtcagcgtgcagcttccctggccttgaagcccaaggcacagaggtaatcacacctgtagctttagatgcactgtttccttgtgcc

SEQ ID NO: 7320 - DNA, 117 bp, Artificial
  Hairpin sequence MQbrain_880, macaque
ttatattacattagtagtagatgctgaactccaggaaggcagtctgttggtgaggcctaagtcacccacatggtgcctggcccagagggtgtctgcttgctgaaaggtgaaatgtga

SEQ ID NO: 7321 - DNA, 98 bp, Artificial
  Hairpin sequence MQbrain_881, macaque
gggaacggatggctcagccatgttgagctgcagaggaggccttgtggaaaagttccaggaggtcatcccgcagctgctgcctgtccactgtgtggccc

SEQ ID NO: 7322 - DNA, 117 bp, Artificial
  Hairpin sequence MQbrain_882, macaque
cattgacatggtggccgccatccccttcgacctgctcatcttcggctctggctctgaggaggtggggttagcaaggaggcaggtggtgtggggagaggagaggccaggaaggtggtg

SEQ ID NO: 7323 - DNA, 70 bp, Artificial
  Hairpin sequence MQbrain_883, macaque
tcctgggcctgggcttttccaggcactggtggatggcacttctgtgcctggaggatgttttggttaaaga

SEQ ID NO: 7324 - DNA, 109 bp, Artificial
  Hairpin sequence MQbrain_884, macaque
tgtataaataagaatggatgtcggttcctttagctacatatttcatgtcgtctcttaccgggggatggcgtgtgttatcaggaggagcagtggtctgtgtctgttaaca

SEQ ID NO: 7325 - DNA, 112 bp, Artificial
  Hairpin sequence MQbrain_885, macaque
gtgacggccgcggcagcggcttccaagggaccaagctcctgcacgaagtgaggcggcggctaggcttgctggaggagaaggaccagatggaggccgtgcggtgagcacccgc

SEQ ID NO: 7326 - DNA, 91 bp, Artificial
  Hairpin sequence MQbrain_886, macaque
cttgactgacggcactggcgcctgtctgtgccctgcagcattctgccaaggctgcgtgggttcaggcaggtggcagtttcccaagtattag

SEQ ID NO: 7327 - DNA, 91 bp, Artificial
  Hairpin sequence MQbrain_887, macaque
taaaaatgagcagaatgatagctatggggtacatgctgttagaacagtctaccttgtgtacccttggctttgtgtctgttgacagtttttg

SEQ ID NO: 7328 - DNA, 118 bp, Artificial
  Hairpin sequence MQbrain_888, macaque
atgtaaagaggttctgttaagtttatggtttgcctttgtaactcgttctttgtatctggatgacaaagaaagagttacaaaggcaaactataaatgtaggtgggcttaggggttaggt

SEQ ID NO: 7329 - DNA, 87 bp, Artificial
  Hairpin sequence MQbrain_889, macaque
gtttctggttcgaatggtgacaacatgctggagccaagtgctaacatgccttggttcaagggatggaaggtcacccgtaaggatggc

SEQ ID NO: 7330 - DNA, 69 bp, Artificial
  Hairpin sequence MQbrain_89, macaque
cacgcagtgcaagtcccgcagtctgacaccatcttggcaattcaggctgatgggacagtggcaggtctg

SEQ ID NO: 7331 - DNA, 74 bp, Artificial
  Hairpin sequence MQbrain_890, macaque
gggtgggacccagggtctccgggtcttgtgagacttcactcctggcccggagaccccagacccatagctgcccc

SEQ ID NO: 7332 - DNA, 104 bp, Artificial
  Hairpin sequence MQbrain_891, macaque
catgtttatgacggtggtgacagcagtggtgatgtgtgcttgtcagtgctgcttccttgcacacacaccgtgcaccacacactgtactccacactttaaatatg

SEQ ID NO: 7333 - DNA, 85 bp, Artificial
  Hairpin sequence MQbrain_892, macaque
tccctggctgttctaacagatggatctccctgaagatctgctgctctccagagagatcaacacaagctagaagcagctggaggga

SEQ ID NO: 7334 - DNA, 83 bp, Artificial
  Hairpin sequence MQbrain_893, macaque
ggcatcagcggaggccgtgattgagggcggagatgagacattggatctctcttgtgtggcttccgcatggccgtcgtggttcc

SEQ ID NO: 7335 - DNA, 50 bp, Artificial
  Hairpin sequence MQbrain_894, macaque
gggggtgagggggaggaccgcggtacccgcctgtccccaccgccgccccc

SEQ ID NO: 7336 - DNA, 109 bp, Artificial
  Hairpin sequence MQbrain_895, macaque
tgcgaggtcgtggtgtctgggaaactctgaggacacagggctaaatccatgaagtttgtggatggcctgatgatccacagcagagaccctgttaactactacattgaca

SEQ ID NO: 7337 - DNA, 106 bp, Artificial
  Hairpin sequence MQbrain_896, macaque
gaatccactgaagggttggagtatagctgcgatatcatcctagatactactaccacgttaatggtttctgtgggtgatgattcagcactcgaatcttagggggttc

SEQ ID NO: 7338 - DNA, 80 bp, Artificial
  Hairpin sequence MQbrain_897, macaque
gcagtccgtagctggccatggcctgtgctctgtcggctggtgcctgtggatggcacagagctcatggagtgacggagtgc

SEQ ID NO: 7339 - DNA, 79 bp, Artificial
  Hairpin sequence MQbrain_899, macaque
cctgtggaggcctgctgggaacaggacttctgaaaggaaatatgtctggaaggctgtggtccaaggccatttttgctgg

SEQ ID NO: 7340 - DNA, 87 bp, Artificial
  Hairpin sequence MQbrain_9, macaque
caggagagcctgcgtttccggagtcatgcccttgttagcctgcatatgcaggctggctgctgtgtgaggcgcatgtgttctcgactg

SEQ ID NO: 7341 - DNA, 108 bp, Artificial
  Hairpin sequence MQbrain_900, macaque
tgcagccaatggtttatcttctggagtaggtggtggaggtggcaagatgagacgagaaagaacacgctttgttgcttctaaatctccggaggaggaggtagggttgta

SEQ ID NO: 7342 - DNA, 89 bp, Artificial
  Hairpin sequence MQbrain_901, macaque
gccttcctgagcatgtaacggtgcaggtggtggtcgtgcgggtgagtataaccgagcggtcggcctgcccgtaactccgccagagaggc

SEQ ID NO: 7343 - DNA, 119 bp, Artificial
  Hairpin sequence MQbrain_902, macaque
gatgagaagagagaagtacacacctactgatccccagttctcctctcccaccctgactgcctaaggtgggagagaagacctggggatcagtaggtgtgtacccagactctgaactcatc

SEQ ID NO: 7344 - DNA, 72 bp, Artificial
  Hairpin sequence MQbrain_903, macaque
ccgcctttccgtataacgggcttgtttctcagagctgagagtggctgggtggtgctaggaggagtggggtgg

SEQ ID NO: 7345 - DNA, 120 bp, Artificial
  Hairpin sequence MQbrain_904, macaque
gagttttgatgatgctgggaaaagtgactgcgattctgaagaaccgctgccttgcaagggcaaggacattcagtggttgctggggtccgcaggctactgccacccactcatcatcaactc

SEQ ID NO: 7346 - DNA, 103 bp, Artificial
  Hairpin sequence MQbrain_905, macaque
ggtcactgctaggagtgtagttctaccatttccaggggccaggttccactctgcatgtgagtatgcagtctgggaggccccactgctctcactgggaaggacc

SEQ ID NO: 7347 - DNA, 115 bp, Artificial
  Hairpin sequence MQbrain_906, macaque
cctgtgctctgtgacgggtggacagagcacagtctgtcctcgggaagctcacagtctcctgtgaagaattagatatggacatctgtgccgtggtaaacactctcacagaggctgg

SEQ ID NO: 7348 - DNA, 89 bp, Artificial
  Hairpin sequence MQbrain_907, macaque
cacagcctttgtacccaacgacgtttgcttgaactttattgaggaaaacgatgaagttctggttgctggatttggtcgcaaaggtcatg

SEQ ID NO: 7349 - DNA, 87 bp, Artificial
  Hairpin sequence MQbrain_908, macaque
ggtttaatttagggaaagccactgaaggaggcacatggagaaattctctattccgcctttttcctagagtggttctctgaggaagcc

SEQ ID NO: 7350 - DNA, 101 bp, Artificial
  Hairpin sequence MQbrain_909, macaque
attctattttcatttctgtcctgttcaccactttgtttcgtttccttgaggaaatgagctgaagtgtaaagcaaagaatagcagaagcagcttggtaggat

SEQ ID NO: 7351 - DNA, 79 bp, Artificial
  Hairpin sequence MQbrain_910, macaque
ggtggagaacaagaaggctcagctggtggtgattgcacatgacgtagatcccatcgagctggttgtcttcttgcctgcc

SEQ ID NO: 7352 - DNA, 100 bp, Artificial
  Hairpin sequence MQbrain_911, macaque
ttatataccccttttccttttgccatcatgattctccttggcagcagcgttagcagccgccagagggtgaaaatgtgggtgatggggaagttggtaatga

SEQ ID NO: 7353 - DNA, 97 bp, Artificial
  Hairpin sequence MQbrain_912, macaque
tgacacaaaggaggtggcagagctgagggcagacccagtttgggagattccaaaacctggctgtctctgcagtgccatccttgagcctgaacagtca

SEQ ID NO: 7354 - DNA, 114 bp, Artificial
  Hairpin sequence MQbrain_913, macaque
gtctttggaaaggccagcttctcacagatctaagggatgcaatttgctggcaagtctttagattgccagtcttgactacatctgatcaaagttgggaagtgagctgttggagat

SEQ ID NO: 7355 - DNA, 58 bp, Artificial
  Hairpin sequence MQbrain_914, macaque
actgccctgtgctccttcctgttcctgggtctcccgacagggactgagacagggttgt

SEQ ID NO: 7356 - DNA, 120 bp, Artificial
  Hairpin sequence MQbrain_915, macaque
gctggcagagacctgggacttcttcttcagtgacgtgctacccatgctgcaggccatcttctacccggtgcaggtgggcggcccagccctggggagggaagcccagtgcccctgccgtgc

SEQ ID NO: 7357 - DNA, 118 bp, Artificial
  Hairpin sequence MQbrain_916, macaque
cacgtgagaaaactgcgagccagcattgcccccaggaccattctgatcatcctcactggacgccacaggggaaagatggtggttttcctgaagcagctggctagtggcttgttacttg

SEQ ID NO: 7358 - DNA, 119 bp, Artificial
  Hairpin sequence MQbrain_917, macaque
accctatcaagatcatccttatgcctggctgcagctctgtctccacgctggtggctgaggctgctaggatgtggaacctcattgtggtaagcagggctatgggggtcaaaagatggggt

SEQ ID NO: 7359 - DNA, 111 bp, Artificial
  Hairpin sequence MQbrain_919, macaque
gaggagttcaggacctacctggagggcgagtgcctggagttgctccgcagatacctggagaacgggaaggagacgctacagcgcgcaggtaccaggggccatgggcgcctt

SEQ ID NO: 7360 - DNA, 110 bp, Artificial
  Hairpin sequence MQbrain_92, macaque
ggaccttcggagccccccgactcctttggatgggcctggtactggtgctggcgctggcgctggctctggctctgtctgactctctggttctctgggctccggcagaggct

SEQ ID NO: 7361 - DNA, 78 bp, Artificial
  Hairpin sequence MQbrain_920, macaque
ctacgtggagatggagtttgagtttgaccggctgagggccttccaggccatgcaggtgagtgagtccggctctcgagg

SEQ ID NO: 7362 - DNA, 72 bp, Artificial
  Hairpin sequence MQbrain_921, macaque
gaggggtgccatctcgccggggccgaggaggagggaggccccctcctcaagtctgccccggctggagccctc

SEQ ID NO: 7363 - DNA, 94 bp, Artificial
  Hairpin sequence MQbrain_922, macaque
gccgggcagctgccaagtctcctgatctgtcaaaccagaactcagaccaagccaatgaggaatgggagactgcatcagagagcagtgacttcgc

SEQ ID NO: 7364 - DNA, 62 bp, Artificial
  Hairpin sequence MQbrain_923, macaque
tccggcagttccaggggatgatcagcagagatgcagacgcccacagttgctggggcgctgga

SEQ ID NO: 7365 - DNA, 76 bp, Artificial
  Hairpin sequence MQbrain_924, macaque
ggtcttctgtccccactgtggggaggatgcttctgaagctcaagaagtgaccatcccccggggtgatggggtgacc

SEQ ID NO: 7366 - DNA, 71 bp, Artificial
  Hairpin sequence MQbrain_925, macaque
tctgggcaggggcttattgtaggagtctcagaagagagctgtggactgacctgctttaccccttccccagg

SEQ ID NO: 7367 - DNA, 117 bp, Artificial
  Hairpin sequence MQbrain_926, macaque
gcagcaggggcctccctgtgggtgtcaagaatatttatttattttgtcccacagtttaactggggccgcagtttaagtaaatattcctttgatgcttaggggggggtgtgtgtgtgt

SEQ ID NO: 7368 - DNA, 119 bp, Artificial
  Hairpin sequence MQbrain_927, macaque
gtgattcagactcaggctaaggggtcaggccagatggggcaggaaggctccgcaggaccggacccctagaccaccctgccccacctgccctttccccctttgctgtgacacttcttcat

SEQ ID NO: 7369 - DNA, 79 bp, Artificial
  Hairpin sequence MQbrain_928, macaque
aggaagatttttgcagcgctctctggagctgaggggagtggaatttggtccagagaaggcagaaggaaatagttttcct

SEQ ID NO: 7370 - DNA, 87 bp, Artificial
  Hairpin sequence MQbrain_929, macaque
acatttgttaatggtctgagtgtgttttgactgggctagtgtaataatatactaccctgaaagggcagttttgattgttgttggtgt

SEQ ID NO: 7371 - DNA, 55 bp, Artificial
  Hairpin sequence MQbrain_93, macaque
ccttttgggactggcctttgaagctctggccagggatagggtgggggccaaaagg

SEQ ID NO: 7372 - DNA, 74 bp, Artificial
  Hairpin sequence MQbrain_931, macaque
ggcctcatggagccttcctgcggccctgccatttgccccatcctgtagacagggccgcaggaagcagcccagcc

SEQ ID NO: 7373 - DNA, 73 bp, Artificial
  Hairpin sequence MQbrain_932, macaque
tgcagtgtgcaggcacctgcctgtctgtgcccagctgggctctggggacgtccaggaagtggcagcagctgca

SEQ ID NO: 7374 - DNA, 68 bp, Artificial
  Hairpin sequence MQbrain_933, macaque
cagagcagagctgctggaggacagggacctggaccaagtggcctccattgtcctctgggagctttctg

SEQ ID NO: 7375 - DNA, 119 bp, Artificial
  Hairpin sequence MQbrain_934, macaque
tgatggtggtggtggtgcactgatgagttgggcttagctttggccattagggatgtaggagtgtgtccttcctttggagagaagctcagtttgtcaggaccgtcctgctcccaccttca

SEQ ID NO: 7376 - DNA, 112 bp, Artificial
  Hairpin sequence MQbrain_936, macaque
ggaagcttcttggtggggtctggactggggagtctcatctttctgaccacccaggagcctgtgtggagagagtggctgggcccactgtccagccagcgccgagaggatttct

SEQ ID NO: 7377 - DNA, 67 bp, Artificial
  Hairpin sequence MQbrain_937, macaque
ttagtcccagtagccaggatacctgatggccatgtgtgccttggccacaggaggctgctgagattgg

SEQ ID NO: 7378 - DNA, 105 bp, Artificial
  Hairpin sequence MQbrain_938, macaque
ctccagctgcttccggaagggaacggcgccccggagcgagcctgtctcggactcccaaccgtcagcctcgctccgggccgcacccctggagcagctcccccggag

SEQ ID NO: 7379 - DNA, 105 bp, Artificial
  Hairpin sequence MQbrain_939, macaque
tgtggatgtaaaaagtgggtttgctgtgccaggcagctcatggtccatggggagaacacctaccctgggagagacgcttggcatggggcaatgcttacgttgaca

SEQ ID NO: 7380 - DNA, 53 bp, Artificial
  Hairpin sequence MQbrain_94, macaque
tcaggcgaggttctctggtcctcaggtgttgggggccagggaagtcgtgctgg

SEQ ID NO: 7381 - DNA, 69 bp, Artificial
  Hairpin sequence MQbrain_940, macaque
cggtcctcccatccactcccaccttccattttgtccatcttgtgctggccttggtggatgggatggctg

SEQ ID NO: 7382 - DNA, 79 bp, Artificial
  Hairpin sequence MQbrain_941, macaque
ggtgttggggaagatgggaggttgtgggtgaggcctctaaaggtcctctcccaaaccggccaagctgtcaacctaaccc

SEQ ID NO: 7383 - DNA, 53 bp, Artificial
  Hairpin sequence MQbrain_942, macaque
ctagagctggccagtggctctagtgctagatgccactgtagccagatctccag

SEQ ID NO: 7384 - DNA, 98 bp, Artificial
  Hairpin sequence MQbrain_943, macaque
ctctggtgcttttccatgggggtgtgggggaagaggagagaggacataagttcctggatccttgtttctccctcccaggcttccacaaggtcatggag

SEQ ID NO: 7385 - DNA, 65 bp, Artificial
  Hairpin sequence MQbrain_944, macaque
ggtaggagagggccatgggaggagagggcatccctaccagccttgctcatggctccctcctgtcc

SEQ ID NO: 7386 - DNA, 92 bp, Artificial
  Hairpin sequence MQbrain_945, macaque
agccaagccctccccctgccaaccagggaggccagcttgctgacctcaggcaacaagcctctctggttggtcaacagaaagagaggacggct

SEQ ID NO: 7387 - DNA, 107 bp, Artificial
  Hairpin sequence MQbrain_947, macaque
ccctgtctgcccagaaccgcccctcctgtgccccctggccttggaaggggtacgaaatttctgtcccctttcctcgttcgggcccaggaggagtggagggtccaggg

SEQ ID NO: 7388 - DNA, 120 bp, Artificial
  Hairpin sequence MQbrain_948, macaque
agaacctaggatttgaattcccagcctggccaacccttgcagccttgtcttggcctcaagtggaacaagggctccttgaggccagcagggttgggggagttggggtgggcctgagcctct

SEQ ID NO: 7389 - DNA, 93 bp, Artificial
  Hairpin sequence MQbrain_949, macaque
gccagcagggttgggggagttggggtgggcctgagcctctttcctgctagagctcttggtcctccctgtctccaccacccatccctgctctgc

SEQ ID NO: 7390 - DNA, 69 bp, Artificial
  Hairpin sequence MQbrain_95, macaque
ggtgggagcagcggggcagcagagctggattggggtattgagtccaggctgagtcgggggcagcccact

SEQ ID NO: 7391 - DNA, 89 bp, Artificial
  Hairpin sequence MQbrain_950, macaque
cctttttagtaagtcttgctgcagtccattgctgaatgattttaggtacctttaatctcaggggattggagtgagaatgacatcaatgg

SEQ ID NO: 7392 - DNA, 89 bp, Artificial
  Hairpin sequence MQbrain_951, macaque
ttagagaggaaccagagctcctgctcaactgccaatcacgatgaattgtggactttggtcagtgagcagacacaggtgaatgctgctaa

SEQ ID NO: 7393 - DNA, 53 bp, Artificial
  Hairpin sequence MQbrain_952, macaque
ttgggcgaggttctctggtcctcaggtgtggggggccagggaaatcgcgccgg

SEQ ID NO: 7394 - DNA, 64 bp, Artificial
  Hairpin sequence MQbrain_953, macaque
tagggagaggagatggcaggacacactaaactggggacacatttgcctgcttctcttttgccta

SEQ ID NO: 7395 - DNA, 89 bp, Artificial
  Hairpin sequence MQbrain_954, macaque
tgtccagtgcttgggtgctgctgtggcaagggaaacctgccctgcggaagggttggttcctcttggctgtgtctccgttgcttggtata

SEQ ID NO: 7396 - DNA, 95 bp, Artificial
  Hairpin sequence MQbrain_955, macaque
tgcctgtggtgatggaacaaaaaaagccatatagagggatgaggaaagcttttcttaccaagtgtgtgagctgagttttggaggagaattaggca

SEQ ID NO: 7397 - DNA, 98 bp, Artificial
  Hairpin sequence MQbrain_956, macaque
agaagagctgtaaaattttcttgccatgtgttcaattaactatatcatgtgatgtactttggccactggcacactgaaaaatgtgtgcagctagggct

SEQ ID NO: 7398 - DNA, 108 bp, Artificial
  Hairpin sequence MQbrain_957, macaque
tttttagtttagataaagctcttcattcagctggaatagattctggtttcataatttttggagcaaacctgagtaatccactgaatatgcttttgcctttactacaaa

SEQ ID NO: 7399 - DNA, 117 bp, Artificial
  Hairpin sequence MQbrain_958, macaque
gcctgtttatgtgcggagggtttcctggaggaaggaaagggttggggacactctgttacctcagaggtgtcaacccgccctgcaccatctacaggaagtcccccactcagcatcggt

SEQ ID NO: 7400 - DNA, 118 bp, Artificial
  Hairpin sequence MQbrain_959, macaque
ggcctctggaggtggggagtggtggccgaggccctgtgatgctgagagcccacgaggtctcggtgtcactggcaatggggagaggcctcggcccagagcagggctgcttctgtaggcc

SEQ ID NO: 7401 - DNA, 74 bp, Artificial
  Hairpin sequence MQbrain_96, macaque
ctactttaggggggcatgtttgctgggcagctgaccaaggtgggcatgcagcagatgtttgccttgggagagag

SEQ ID NO: 7402 - DNA, 117 bp, Artificial
  Hairpin sequence MQbrain_960, macaque
gggtttgggagaaaaagagagagaggggaagagagggtggcagagaatgttaacagtgtagtcagatctcaattattcctcctctactccatctctttccttttatccattctacct

SEQ ID NO: 7403 - DNA, 94 bp, Artificial
  Hairpin sequence MQbrain_961, macaque
ggcaacatttattggtgctgagatgcaggtctccctgtagataacctaagtggtttctgtgacctagttccctctgtaccatgtaaatctggcc

SEQ ID NO: 7404 - DNA, 110 bp, Artificial
  Hairpin sequence MQbrain_962, macaque
aggctgaaggggatgctaaaggagataaagtcaaggtgagggacgaaccacggggaagatccgcgaggttgtctgctaaacctgctcctccaaagccagagcccaagcct

SEQ ID NO: 7405 - DNA, 84 bp, Artificial
  Hairpin sequence MQbrain_963, macaque
tgatttttacatgggaaatatcaaccacttcagagctgagtaaggaaccttggtccttctgagtggatgaggctgtgtgtgtca

SEQ ID NO: 7406 - DNA, 95 bp, Artificial
  Hairpin sequence MQbrain_964, macaque
caactttggtatcgtggaaggactcatgaccacagtccacaccatcgctgccacccagaagactgtggatgactcctatcggaaactgtggcgtg

SEQ ID NO: 7407 - DNA, 113 bp, Artificial
  Hairpin sequence MQbrain_965, macaque
ggagatgggtgtatccaggaggccaatggaggaaggacaggaaggttttctgggaagccagctgacatgtcatgctttgtcattggggccactgcatggattccccccagtcc

SEQ ID NO: 7408 - DNA, 73 bp, Artificial
  Hairpin sequence MQbrain_967, macaque
ttgatcctcactgagaagaccccagggccagtggtcttctccatctctgctgttttggggtcttagggtacag

SEQ ID NO: 7409 - DNA, 93 bp, Artificial
  Hairpin sequence MQbrain_968, macaque
ctttccattctctggtctctgcctttctcagatgcaaggcttaagaaagccttacaagtctggctataacaggaccagggagcacgtgggcag

SEQ ID NO: 7410 - DNA, 118 bp, Artificial
  Hairpin sequence MQbrain_969, macaque
ggtcactgactcctggcctaggacccctcgccttcaggataatctacacacatgtatgcatgcacaaacatgtgtgtacatgtgcttgccatgtgtaggagtctgggcacaagtgtcc

SEQ ID NO: 7411 - DNA, 94 bp, Artificial
  Hairpin sequence MQbrain_97, macaque
gctgccagaaccgagtccttgtcctgagtcctgacacgctgcagctggaggtagcagggggtgggggggatggaattggtaccgtgggatgagc

SEQ ID NO: 7412 - DNA, 94 bp, Artificial
  Hairpin sequence MQbrain_970, macaque
cattgtgtctgggaaactctgaggacagagggctaaattcatgaagtttgtggatggcctgatgatccatagctgggaccctgttaatactatg

SEQ ID NO: 7413 - DNA, 114 bp, Artificial
  Hairpin sequence MQbrain_971, macaque
gcctccgccttggtggccagagggcagggacagaagctccaggagccttctggttctccaggctcccatctgctgccgtccctgcatgcttcttgccactcccagccctggggc

SEQ ID NO: 7414 - DNA, 81 bp, Artificial
  Hairpin sequence MQbrain_972, macaque
ggtggagagcaagaaggctcagctggtggtgattgcacatgacgtggatcccatcgagctggttgtcttcttgcctgccct

SEQ ID NO: 7415 - DNA, 79 bp, Artificial
  Hairpin sequence MQbrain_973, macaque
gttgggccgacccgctgagcgctggaaggacacctgggaccgggtgaaggctgcacagcgcctcgaaggccggccagac

SEQ ID NO: 7416 - DNA, 107 bp, Artificial
  Hairpin sequence MQbrain_974, macaque
gaagcccccaaactgggcatgctggtggggaaggagaaggcagcgtggcccagggtcagcaggcccaccacacagtcctctccatcctcttggtgcctggtgggctc

SEQ ID NO: 7417 - DNA, 99 bp, Artificial
  Hairpin sequence MQbrain_975, macaque
tgggtaaccaggtggctgaagtgattggtcacttacatggactgcgtttggtgcagtgtgtgttgtgactcatcgggaatgggggatgcctgggttcca

SEQ ID NO: 7418 - DNA, 64 bp, Artificial
  Hairpin sequence MQbrain_976, macaque
gcagtttgccttacagtacaggcctgctcattccttctgtgccaggcctgtttgtgaatgctgt

SEQ ID NO: 7419 - DNA, 117 bp, Artificial
  Hairpin sequence MQbrain_978, macaque
tcagcattaaaacactgctggttctaaggttgaatagtggagtcaagtggatttggaaagatcaaattcaaaaatgaaactggggattggggaaagcaagcaggtattgatgagtgg

SEQ ID NO: 7420 - DNA, 120 bp, Artificial
  Hairpin sequence MQbrain_979, macaque
actgtttttgcccgttgctgctatggaaggacaggagtgagctcccgctcctgacaggaaactctccaggagcagcagctataacttcctcatctttgcatcatcagcacccagcccagt

SEQ ID NO: 7421 - DNA, 100 bp, Artificial
  Hairpin sequence MQbrain_98, macaque
cacacaggaattgggactggctgccacaaagctagatagggacaagacagcactttcttccctgtggccacatggatagtccctggatattcttgctgtg

SEQ ID NO: 7422 - DNA, 88 bp, Artificial
  Hairpin sequence MQbrain_980, macaque
tgtcatcggggtagggaataaagaagatgcccagagagagtcactacttctttactgtggtagtgaaagggagccctcccctgtggca

SEQ ID NO: 7423 - DNA, 114 bp, Artificial
  Hairpin sequence MQbrain_981, macaque
ctgagaatttgaaattggaatggggtgtgcatggtgtgtgtcgaaagggctggaagcgagtttgattttgacacgcggcctgtcaccacctcagaacgagatcgatgagctgag

SEQ ID NO: 7424 - DNA, 83 bp, Artificial
  Hairpin sequence MQbrain_982, macaque
ggctgcagaacagctccctgactgagttggccctgaacactcatggggttggctatggtcagggaagatgaagggagcagacc

SEQ ID NO: 7425 - DNA, 90 bp, Artificial
  Hairpin sequence MQbrain_983,MQbrain_2429,MQbrain_2463, macaque
atctatgaaggccaagtggaggtgactggtgatgaatacaatgtggaaagcattgatggtcagccaggtgcctttacctgctatttggat

SEQ ID NO: 7426 - DNA, 67 bp, Artificial
  Hairpin sequence MQbrain_985, macaque
gcttgtgccatccaccctactggttatctggtagaacaagctggtggctggtgggtgactgctaggc

SEQ ID NO: 7427 - DNA, 80 bp, Artificial
  Hairpin sequence MQbrain_987, macaque
tgcacttgactaaatcgccttcagccaagccgtctctagcagtggcagtggactcggctccggaggtggcagttaaggta

SEQ ID NO: 7428 - DNA, 90 bp, Artificial
  Hairpin sequence MQbrain_988, macaque
cgctgcagcagcactgcctggcgccaccccacctcgccgccaccagaaaaggtgtgggtacgctggctgttgtgctgggcactttcggcg

SEQ ID NO: 7429 - DNA, 112 bp, Artificial
  Hairpin sequence MQbrain_989, macaque
gcaggaacatcagaggtgcctgagagaccctggctctggggcagaggcctgagcaagggggccttgctggggtgtctctgccttagccatgcttggtgtttctgggtcctgt

SEQ ID NO: 7430 - DNA, 75 bp, Artificial
  Hairpin sequence MQbrain_99, macaque
ctactggctgtgcagcctctgctgcttgccaagtttgggaatccagagaggggcagtagcagagtgggccagtgg

SEQ ID NO: 7431 - DNA, 98 bp, Artificial
  Hairpin sequence MQbrain_990, macaque
tcctgaggcagcttggggaagaggtgcgggaacgtgccctggtgcaggccttggtctgacgttctcccgcctctgctccccagcaaacagccaccgga

SEQ ID NO: 7432 - DNA, 91 bp, Artificial
  Hairpin sequence MQbrain_991, macaque
gtctccttcatgggcacctgggctccttcctctgtttcagggctccaaggtcctggccaagaaagagctggcctacgttccaattatcggc

SEQ ID NO: 7433 - DNA, 112 bp, Artificial
  Hairpin sequence MQbrain_992, macaque
ttctacagtgtgaccctgtgaactcgccttttctacagtgtgaccctgtgaactaggcttttctacagtgtgaccctgtgaactaggcttttctacagtgtgaccctgtgaa

SEQ ID NO: 7434 - DNA, 119 bp, Artificial
  Hairpin sequence MQbrain_993, macaque
tcccaatgtcagattccccacctgtgaaatgaaaatgggagtggagtggatcagtggttttcaaaccacattcctcctgtcctagacttttcaggggtgccccaggagctgctgtgggg

SEQ ID NO: 7435 - DNA, 115 bp, Artificial
  Hairpin sequence MQbrain_994, macaque
ccagtgagtatggatacacagaggggatgaattgcagccatttttttcaacagaggtatttggtctggggaagagaaggtatgaggttagttcccaactgctgagtgctttctgg

SEQ ID NO: 7436 - DNA, 70 bp, Artificial
  Hairpin sequence MQbrain_995, macaque
ggtggagtgaagaccattgaagccaacgggcggatggttattcccggaggtatcgatgtcaacacgtacc

SEQ ID NO: 7437 - DNA, 104 bp, Artificial
  Hairpin sequence MQbrain_996, macaque
ctgtgctgtagcattggggatctgcagcaaagggtggaggaggaggctgggaagaaagcttcacttctctcagctcagctgcctcatccgcagcgctcccacag

SEQ ID NO: 7438 - DNA, 112 bp, Artificial
  Hairpin sequence MQbrain_997, macaque
cttctgccaaattctaagcatctggatggctgggtttaagttgcatctctttgtccttcagaccatatgccatagtgccttgtgcctcacagtgacttgtattttgcagaag

SEQ ID NO: 7439 - DNA, 52 bp, Artificial
  Hairpin sequence MQbrain_998, macaque
gccttctgggatctgggcgtctacctggcagacttgcccatggcccagaagc

SEQ ID NO: 7440 - DNA, 92 bp, Artificial
  Hairpin sequence MQbrain_999, macaque
ggctggtaaccaggcaagtgggtggggagggggccaggagagcccagaacaagcatcctgccccaccccaccacacagaatgaccaccagct

SEQ ID NO: 7441 - DNA, 82 bp, Artificial
  Hairpin sequence PT_1, chimp
gtggcagctgaagcgggacaagccagtgaccgtggtgcagtccattggcacggaggtcatcggcaccctgcggcctgactat

SEQ ID NO: 7442 - DNA, 59 bp, Artificial
  Hairpin sequence PT_101, chimp
ccaggggagggaaggggagccgaggtgaacgctgcgcctcggtccctacccccctccgg

SEQ ID NO: 7443 - DNA, 73 bp, Artificial
  Hairpin sequence PT_102, chimp
gagttggaggggggtctcattctacaaagagagaggtggcccccctttcttgacctcctcctccttcaagctc

SEQ ID NO: 7444 - DNA, 92 bp, Artificial
  Hairpin sequence PT_104, chimp
gctccgggaggcgggcttagaacgccaccgacttgaggaaccccagtacatttcaagttggccgcggcttgggctccgctctggggaggggc

SEQ ID NO: 7445 - DNA, 103 bp, Artificial
  Hairpin sequence PT_105, chimp
ggaatcaatatctaggctctggggggtgccagagcctgaccgtgcagggtcttctctctccctccaccctgactgtgctctgtccccccagggctggacatcc

SEQ ID NO: 7446 - DNA, 81 bp, Artificial
  Hairpin sequence PT_108, chimp
gcttggggcaggagtgggctaaggaaacctgctctatgataaatacaggacaggttctcttagctcactcccgcaaatagc

SEQ ID NO: 7447 - DNA, 82 bp, Artificial
  Hairpin sequence PT_109, chimp
tccacgtttatgaagtacagtactgaatgaatgtatggtgcagtaatgaatatacaaagtacagtacagtaatgaatgtgga

SEQ ID NO: 7448 - DNA, 92 bp, Artificial
  Hairpin sequence PT_11, chimp
acttagcgtctttctacctggcagagaagggaggagttggcaagaatttggctcacccattccccctgcaatcctccagcgtcgcggtaagt

SEQ ID NO: 7449 - DNA, 63 bp, Artificial
  Hairpin sequence PT_110, chimp
aatggagagagccgtggagtcttcaacagcttcactgaagaccaagacggactctctgctatt

SEQ ID NO: 7450 - DNA, 62 bp, Artificial
  Hairpin sequence PT_112, chimp
cagaggaagggggtctggcgggatggcagcacattgctgctgtgcccctagcccaccggctg

SEQ ID NO: 7451 - DNA, 111 bp, Artificial
  Hairpin sequence PT_115, chimp
acggttctgcagggggacagagggctggacgcaagaggtggccaggtggccagatggtgctggccccatggtcatgtctgggcgcttgcctgtccctgtgcagagagcagt

SEQ ID NO: 7452 - DNA, 119 bp, Artificial
  Hairpin sequence PT_121, chimp
ctgagcttctgcccccagcagggccactcggaatctgagcctctgcccccagcagggccacttggaatggcatgtgggaggggagcagaagagggccctgtggggcacagcaggcctgg

SEQ ID NO: 7453 - DNA, 119 bp, Artificial
  Hairpin sequence PT_122, chimp
ctggccttcatggggcccctccatatcccaggagctgatgctgcagatgaacctgctggaactcatccggaagctgcagcagaggggctgctgggcagggaaggcagccctggggctag

SEQ ID NO: 7454 - DNA, 116 bp, Artificial
  Hairpin sequence PT_123, chimp
gctgaatcaaatgggagccctccagacataaggaggccagaggctgcaaggagcggggccgtgaccgcttacaccccttctccacagcccggcccgacctggagggcccccggggc

SEQ ID NO: 7455 - DNA, 91 bp, Artificial
  Hairpin sequence PT_126, chimp
tcctcattagtgtcctctggggactcagcttgctctggctgctggattgaattagctgcaggaccaagatgagcccttggtggagacagga

SEQ ID NO: 7456 - DNA, 74 bp, Artificial
  Hairpin sequence PT_127, chimp
ggcctcgtcatcggccaggtaacccgagtggtggcggcacctggccatgtggtcacctggcaggtgaccgggcc

SEQ ID NO: 7457 - DNA, 72 bp, Artificial
  Hairpin sequence PT_128, chimp
gggcggcttgctcctgccagccatgccttcagggtaggctctgagcaagctggcaaacagccctggctgctc

SEQ ID NO: 7458 - DNA, 79 bp, Artificial
  Hairpin sequence PT_13, chimp
aatttctctggtttcaatgggtacgattattgtaagcaggatccattcaataatcggacccatttaaaccggagatttt

SEQ ID NO: 7459 - DNA, 115 bp, Artificial
  Hairpin sequence PT_134, chimp
gttccatgaggcaggacggggttggtggggtcgggcaggagggccggggattggaaggttggccagctctacctcctgcccttcccaccgcaccccaaacttagccttgacaaac

SEQ ID NO: 7460 - DNA, 91 bp, Artificial
  Hairpin sequence PT_135, chimp
catgagtgccgacaccagaattgggaggaatgaccgtctcaatccaactttaagtcagtcggtcattcttcctggtggtttggtgtccatg

SEQ ID NO: 7461 - DNA, 114 bp, Artificial
  Hairpin sequence PT_136, chimp
gggaagggcaggtcagcaaggccggagtgggtctgcagcgtctggaggaaatcttcaagattttccagattgccgcagacctagtctggagttgtttggaatcctgggcttctc

SEQ ID NO: 7462 - DNA, 118 bp, Artificial
  Hairpin sequence PT_138, chimp
gtagcctatggtgttctgcctctgagtgtgtcagagcaggagagggagcagccctggcttccccagcctctcctgccaggcccacctcagaggatgaacacagcagctgtgggaatgc

SEQ ID NO: 7463 - DNA, 78 bp, Artificial
  Hairpin sequence PT_139, chimp
acacttcaggtggggatcacatccctttgtcaagcttcccggttcccaggacagggttggggcctccaccctctgtgt

SEQ ID NO: 7464 - DNA, 102 bp, Artificial
  Hairpin sequence PT_14, chimp
ccctggtcagggaggacaccttggtcagggtggacaccttggtcagagagaataccctggtcagggtggacaccccagtcagggaggacacctcggtcaggg

SEQ ID NO: 7465 - DNA, 76 bp, Artificial
  Hairpin sequence PT_140, chimp
catgccaggtaccttcagactcagctgtccacttgggtcaccttcccagtgggcggctgtgttgcctgcctgggtg

SEQ ID NO: 7466 - DNA, 95 bp, Artificial
  Hairpin sequence PT_141, chimp
gtggaagataatttatcatatattatgattatcataataagctgggcgtggtggattgtcatatattatgataatcataatttattatttatcat

SEQ ID NO: 7467 - DNA, 118 bp, Artificial
  Hairpin sequence PT_143, chimp
cagggagtggagaaatgagaaatgaactttgaggctgaatgtctgaaaatgcagaattaggattcaaactcagatattcagcctcaaagttcatttctaatttctttattgaattctg

SEQ ID NO: 7468 - DNA, 102 bp, Artificial
  Hairpin sequence PT_144, chimp
gtgggtctctctgtcctctgatctgtgcttggctgaggagaatggagggtttctgcagtccttgaaggctctaggatcattaggggatggagaaaattccac

SEQ ID NO: 7469 - DNA, 117 bp, Artificial
  Hairpin sequence PT_147, chimp
caaaaggtaattccagctgtgttgaagatatccaaaactcacttcctttttctggggtaggaggaaaaaggaagtgagttttggatatcttcaacacagctagaattttcctaagtg

SEQ ID NO: 7470 - DNA, 98 bp, Artificial
  Hairpin sequence PT_149, chimp; PT_150, chimp
gttctatttctattctttcctgttctatggatgtcattgaacataatggttaagccacctgtccatggtttaatgacatccacagaacagaatagaac

SEQ ID NO: 7471 - DNA, 117 bp, Artificial
  Hairpin sequence PT_151, chimp
ttgtggttctgaaatgaattttaatgttgatgcctctgatcagtccatgacttacgagtcacaaggacctgatgagaaaatggtgaaatatattgattcagaagataagagctgtgg

SEQ ID NO: 7472 - DNA, 113 bp, Artificial
  Hairpin sequence PT_153, chimp
tggcccaaacaattgattttatctaaaccttttcaggtgttagaattgtaaatattttgcaattaccatagcaccattttggaaatcaatttggattattactattgaagcca

SEQ ID NO: 7473 - DNA, 104 bp, Artificial
  Hairpin sequence PT_155, chimp
gttccgccgccccacccaccaggatctcatgctgcggcacggttggcgcacaggcgccatcatccccgagctggaacgcgagatccgcatcatcaacacggagc

SEQ ID NO: 7474 - DNA, 74 bp, Artificial
  Hairpin sequence PT_156, chimp
gcccccggggcattgtcaagcatctggagggcctctctgaagaggctatcatggagctgaacctgcccattggt

SEQ ID NO: 7475 - DNA, 81 bp, Artificial
  Hairpin sequence PT_157, chimp
tttcctgcatgctggatagggaggcctgaaacccagaatctactagatctgtgctccttgggcttccctgtccttaggaag

SEQ ID NO: 7476 - DNA, 91 bp, Artificial
  Hairpin sequence PT_158, chimp
caggccttggaggctccctggagatggtgagggcagggagtgtgctgagtcataccttgccctctccctctaggacctcagcacggccctg

SEQ ID NO: 7477 - DNA, 116 bp, Artificial
  Hairpin sequence PT_161, chimp
ggatgaatgccccaaaaggccaaactgggaactctagccgtggtccaggagacggagggaacagagaccactggaaggagtcagataggaaagatggcaaaaaggatcaagactcc

SEQ ID NO: 7478 - DNA, 76 bp, Artificial
  Hairpin sequence PT_163, chimp
ggcttcgcattccttcattgaaccagctgtgctaacccagggcttggctggagagatgaaggaccaaggctcagcc

SEQ ID NO: 7479 - DNA, 109 bp, Artificial
  Hairpin sequence PT_165, chimp
ttcaggattatgccaaaataagaaaacataccttaaaattaaaatcaatgtggtttgattttaattttaaggtatgtttccttatttcaataacattaattatcctgaa

SEQ ID NO: 7480 - DNA, 62 bp, Artificial
  Hairpin sequence PT_168, chimp
ttgtgactggacctctggtcctcattcaaattctgtgggaaacacaccagaggtcatcacaa

SEQ ID NO: 7481 - DNA, 115 bp, Artificial
  Hairpin sequence PT_172, chimp
ccatttgatctttaaaaatgtatgttttaatagtgtattttaagtctctatatttttcttattagaatatatagaggctataacctactaccaagcataacagatgtcactatgg

SEQ ID NO: 7482 - DNA, 100 bp, Artificial
  Hairpin sequence PT_173, chimp
ctgagacccagacggccaggttccgggcctgggagccgggccttctccctggtgcagctccctcggcctggaaaccccacccgcgccctctcatctccag

SEQ ID NO: 7483 - DNA, 104 bp, Artificial
  Hairpin sequence PT_174, chimp
ttctgaattaagttataagataaaaccaagatttggatgacaatgacaatattgtccatcattgttatccaaatcctggttttatcttataactggttttaggg

SEQ ID NO: 7484 - DNA, 75 bp, Artificial
  Hairpin sequence PT_176, chimp; PT_from_HSbrain_223, chimp
ggggtagagcagctctcggcggcccggggggcgggcggccgtgcccgtcccggggctgcgcgaggcacaggcgcc

SEQ ID NO: 7485 - DNA, 120 bp, Artificial
  Hairpin sequence PT_177, chimp
gagtccttgagtgagcattaggggagacactcatgaatcagattagccctgaggattagcctctaacagcccagggtcctgcttttatgaacccactccccccaacaagtcagtcaactc

SEQ ID NO: 7486 - DNA, 91 bp, Artificial
  Hairpin sequence PT_178, chimp
cgcgctggtctcttcggtgctgagggatggcgcggaagtcgaacttgcctgtgcgtctcgtgccgtttctgctctgccaggccctagtgcg

SEQ ID NO: 7487 - DNA, 105 bp, Artificial
  Hairpin sequence PT_180, chimp
ctggcggacaggcccacagcacccagggcaagactgggccactttcagagcctgaaataggaagaggcccactctggcctcagcgtgctttctggccctctctag

SEQ ID NO: 7488 - DNA, 117 bp, Artificial
  Hairpin sequence PT_187, chimp
taggtatttaccatgagatggttgtggtcagttgcacctgataccatgtatccctgaatcatgtgtatttttattagtaatgctgccactaccattgctgatggggtctgtgtccta

SEQ ID NO: 7489 - DNA, 96 bp, Artificial
  Hairpin sequence PT_190, chimp
ggtgagaacgtgcgcctgtgttgaggaggctgggggaggtggatggagcattcggctccacagccttggatgcagacttgtggggcctttctcact

SEQ ID NO: 7490 - DNA, 70 bp, Artificial
  Hairpin sequence PT_194, chimp
tggtgccccaggacctgggcctgcagggccacagacatctcccgagctggccccagctcctctggtatca

SEQ ID NO: 7491 - DNA, 74 bp, Artificial
  Hairpin sequence PT_196, chimp
aggagcctcctctctcagcatggaagtgcttgggtccactcagaccccagaacatccattgtttgggggttttt

SEQ ID NO: 7492 - DNA, 92 bp, Artificial
  Hairpin sequence PT_197, chimp
ctggtctggggaatcgtgggcaagaggcactggggaggacagccatgacaggaagtggaactcacccgctttgctgcccttcccagattgag

SEQ ID NO: 7493 - DNA, 109 bp, Artificial
  Hairpin sequence PT_199, chimp
tacaaaaaggcacccaggctggagcacagatggccagggcactcacacagggaggagaggccctgcagggtgtctgtcccattggcccctcagcctgggatactctgta

SEQ ID NO: 7494 - DNA, 114 bp, Artificial
  Hairpin sequence PT_20, chimp
agaggcaacttggtgagttatagagattgactgggtgcttgacatgtggtgctgctccattgaaacagtgggcagttggtactggggaggtttaggagaatttaagttgtcttt

SEQ ID NO: 7495 - DNA, 115 bp, Artificial
  Hairpin sequence PT_201, chimp
tagggacagcagggatggccgtggctctctgcccagtgtataacaagtctcttttttttttcagggaaggcactggtgcttcagagtcaacggacagagtttccatatgttcctg

SEQ ID NO: 7496 - DNA, 70 bp, Artificial
  Hairpin sequence PT_205, chimp
ccattgagcacttgaatggcctgtttgtctatggtcttgcaaaggacaagcagagttcacacagctcagg

SEQ ID NO: 7497 - DNA, 74 bp, Artificial
  Hairpin sequence PT_207, chimp; PT_from_HSbrain_785, chimp
gcaactcgcctggcttccttctttccgtctgcctcctggccgcggggcccggagagctgggagccagagggtgt

SEQ ID NO: 7498 - DNA, 82 bp, Artificial
  Hairpin sequence PT_208, chimp
gggcggcaggagatcttcctgcagcgccatggacccctatctgtccacatggcctgcctctccttcttctttctggctgcct

SEQ ID NO: 7499 - DNA, 109 bp, Artificial
  Hairpin sequence PT_21, chimp
tcatcctaaagcatacaggtcctggcatcttgtccatggcaaatgccgggcccaaaacaaatggttcccagtttgtcatctgcactgccaagactgagtggttggatgg

SEQ ID NO: 7500 - DNA, 85 bp, Artificial
  Hairpin sequence PT_211, chimp
caggtgttggccatcagaagacacactggagcacatgggcctcttcactgtgtgccaagctcagtcacctctgattcagcccctg

SEQ ID NO: 7501 - DNA, 118 bp, Artificial
  Hairpin sequence PT_214, chimp
cccttccaaccaggctgtcaaggccccaactctggggcagaggcagtggcagggcagccagggttgcgccagagcctgagcaggttgaggtggggtcaggcagggctgggaatcaggg

SEQ ID NO: 7502 - DNA, 94 bp, Artificial
  Hairpin sequence PT_216, chimp
ggggattgcctgcctccctgcgatggtggtctcaagagccagcgggggaagaggggttggctctgagtccccgcctcgcggggggtgcctcccc

SEQ ID NO: 7503 - DNA, 66 bp, Artificial
  Hairpin sequence PT_217, chimp
ttggctctgagtccccgcctcgcggggggtgcctccccctcctgcgatgggggtcctcagagccag

SEQ ID NO: 7504 - DNA, 97 bp, Artificial
  Hairpin sequence PT_218, chimp
tttaggaaggctttctactaatggaattcctggccttgagaggatattactttcgaaggaaaggacttttttgttattaaaaggtaagattcttgga

SEQ ID NO: 7505 - DNA, 115 bp, Artificial
  Hairpin sequence PT_219, chimp; PT_220, chimp
ccgcagtgtcaggggctgcccagtggtggtgagagcgcagcgtgggtgcagccctggtgaagggcctgggactcacggctctgtgctctgatcatgggctggcccgcgctgtcgg

SEQ ID NO: 7506 - DNA, 74 bp, Artificial
  Hairpin sequence PT_22, chimp
gcctccggggcattgtcaagcatctggagggtctctctgaagaggctatcatggagctgaacctgccgactggc

SEQ ID NO: 7507 - DNA, 101 bp, Artificial
  Hairpin sequence PT_222, chimp
tgaatggtgccagtggccctgtgctcctggttgatacagcatttatacccaatttgtcttactagctaatttaaactctgagcacatccctgtcaccttca

SEQ ID NO: 7508 - DNA, 115 bp, Artificial
  Hairpin sequence PT_224, chimp
tcctacagaatgcacttttgctttcagatagcagccttcacctcttcttacagagccatctgaattcagaagacattgaggcgtgtgtttctgggcagactaagtactctgtgga

SEQ ID NO: 7509 - DNA, 75 bp, Artificial
  Hairpin sequence PT_228, chimp
ggtgctgggagaagggacagctttagaagagaaggatgagctgtttcatcttcttgcttccctttctccaggttc

SEQ ID NO: 7510 - DNA, 103 bp, Artificial
  Hairpin sequence PT_234, chimp
agatatcactagattgtgagcatcttgtttgcagaagtgatgttcctggagtctagtaccaggcacatcatttgtgttctcttaatgcttatggagggaatct

SEQ ID NO: 7511 - DNA, 117 bp, Artificial
  Hairpin sequence PT_235, chimp
ggatgaatgtcccaaaaggccaaactgggaactctagccgtggtccaggagacggagggaacagagaccactggaaggagtcagataggaaagatggcaaaaagggatcaagactcc

SEQ ID NO: 7512 - DNA, 101 bp, Artificial
  Hairpin sequence PT_237, chimp
tgcacccgtgtctaaaaccccgcgtttctccccacccccgccaggcgcagcaccccctccctcggctgcgcccggaggggagcagagcggacaggggcgcg

SEQ ID NO: 7513 - DNA, 98 bp, Artificial
  Hairpin sequence PT_242, chimp
gctcttgcttctctccagctactccctgtgaaaggctgctgtgtccctcatgagttcacagtggctaaagtgctgtggcagtggaggagaaagagagt

SEQ ID NO: 7514 - DNA, 76 bp, Artificial
  Hairpin sequence PT_243, chimp
tgggtctccgagctggggtcagcgcccgtctgggacactcacattccctaacggtctcctgacctcaggaaactca

SEQ ID NO: 7515 - DNA, 117 bp, Artificial
  Hairpin sequence PT_244, chimp
ttccactgggttgaggggtgcacttgtgagggaggggctggcccaggggactttaggaggtcagggggtggctgttctagggatgggcatggtgccctctcaatccagcacacggaa

SEQ ID NO: 7516 - DNA, 116 bp, Artificial
  Hairpin sequence PT_246, chimp
atggagcctaaaacaggacaccagagaatgccccctgcccaccaacgttgggctagcaaattggctcagttcagcagaagtaccagtgaggggcactggtgtttattgggtttgat

SEQ ID NO: 7517 - DNA, 85 bp, Artificial
  Hairpin sequence PT_250, chimp
ctgtgcccagtgtctctcccaggcacacttgcccctcctgcccattggggctggggaggctgcccgggagagacggggccaccag

SEQ ID NO: 7518 - DNA, 95 bp, Artificial
  Hairpin sequence PT_251, chimp
gctgggccctggctgtaggcagctgggcttactgccgggccctgcatacacagcgcctccagtgggagtgacagttggatacagccaggcagggt

SEQ ID NO: 7519 - DNA, 113 bp, Artificial
  Hairpin sequence PT_253, chimp
ctgccagcaagacaaaaggaacaggggacacttgtaatggagaacactaagctatggactgctatggactgctagtgctctccattacaagtatcccctgttaccttggccag

SEQ ID NO: 7520 - DNA, 59 bp, Artificial
  Hairpin sequence PT_255, chimp
tgcccagagaagtggggaagtcctcgcagaaaggactgtttccactgggtgcgtgggca

SEQ ID NO: 7521 - DNA, 90 bp, Artificial
  Hairpin sequence PT_257, chimp
caacctagtggacaggagagtatgtgtagatttcatgtaatggtgaaagggcaaataacatgaaatctacaaggcatcagtcatgggctg

SEQ ID NO: 7522 - DNA, 82 bp, Artificial
  Hairpin sequence PT_258, chimp
caggggctactctgggggctgaggggagctgggctggtaaagcctgaaaaccccatcatcagccagagtagttttctttctg

SEQ ID NO: 7523 - DNA, 86 bp, Artificial
  Hairpin sequence PT_26, chimp
agtaactgcggagtcaggcgcagaggggaacagcgtctctaaccacggcgaccctgttcttctctgcgcgcttccactgagttatt

SEQ ID NO: 7524 - DNA, 116 bp, Artificial
  Hairpin sequence PT_262, chimp
ggatgaatgtccccaaaggccaaactgggaactctagccatggtccaggagacagagggaacaaagaccactggacggagtcagataggaaagatggcaaaaaggatcaagagtcc

SEQ ID NO: 7525 - DNA, 82 bp, Artificial
  Hairpin sequence PT_266, chimp
cttcagatgccagaagggcagagggaatcccacacgggctggtggatcatgtgtgtgcatctctctcccttctaatctgagg

SEQ ID NO: 7526 - DNA, 103 bp, Artificial
  Hairpin sequence PT_268, chimp
aggaaggcagcaaagcacacactgcccacagactgatggtgaagttaaatttcaaatattgatcgagcttaggaccattaaggcaggaagtgtgctgcagact

SEQ ID NO: 7527 - DNA, 90 bp, Artificial
  Hairpin sequence PT_27, chimp
gcctagctcatgcctacagctccatgccttcagctccatgccttcaggatatggctgggggctgagggagaagcccaaggagggcttggc

SEQ ID NO: 7528 - DNA, 106 bp, Artificial
  Hairpin sequence PT_270, chimp; PT_from_MQbrain_1594, chimp
ctgtacacccttctctcccttcccctaccagccggttcgcggcgcctcttggagctaacctgtggccggctaggagaggacacgggagcgtggggtttaatctcag

SEQ ID NO: 7529 - DNA, 108 bp, Artificial
  Hairpin sequence PT_271, chimp
gcgctgtggtcgtttggaggtgagccgtgaagccccttccactggtaggtgctatccctgcctttgttggggtgctctccttttgcctttccaacacgactgcattgc

SEQ ID NO: 7530 - DNA, 83 bp, Artificial
  Hairpin sequence PT_282, chimp; PT_from_HSbrain_432, chimp
gctcggcatctgctgagtaccgccatgtctgttgggcatccacagtctcccaccaggcactgtggtctccgctgacgctttgc

SEQ ID NO: 7531 - DNA, 93 bp, Artificial
  Hairpin sequence PT_283, chimp
ttgctgagcccggggcaggggaattgcacctgcaggaaagagatgcagcatgctcctcactcctgagtgcccacctgtcctgcttctctgcag

SEQ ID NO: 7532 - DNA, 63 bp, Artificial
  Hairpin sequence PT_284, chimp
gagaaaaggggtgactgtccctcagccaggctgcctggcctggggcagcatccacatttcatc

SEQ ID NO: 7533 - DNA, 119 bp, Artificial
  Hairpin sequence PT_287, chimp
caggcgagtgtaaacagtgcacgggtgtgtgtgctcactgtgtgcacaggcgagtgtaaactgcacgggcgcgtgtgctcaccgtgtgcgcaggcaactgtgaacagtgcacgggtgtg

SEQ ID NO: 7534 - DNA, 119 bp, Artificial
  Hairpin sequence PT_288, chimp
caggcgagtgtaaactgcacgggcgcgtgtgctcaccgtgtgcgcaggcaactgtgaacagtgcacgggtgtgtgtgctcactgtgtgcacaggcgagtgtaaactgcacgggcgcgtg

SEQ ID NO: 7535 - DNA, 93 bp, Artificial
  Hairpin sequence PT_289, chimp
ggcgagacacaggtgcatagctcctggccccagctgtggtacaggtacacacaggcacacacctggaggcagacgagacacaggtgcatagct

SEQ ID NO: 7536 - DNA, 118 bp, Artificial
  Hairpin sequence PT_290, chimp
cttcatgcgggtccccatcaacgacaactactgtgaaaaactgctgccctggctggacaagtccatcgagttcatcggtgagtctgcggtgggcggagggtggggacctggctagagg

SEQ ID NO: 7537 - DNA, 111 bp, Artificial
  Hairpin sequence PT_294, chimp; PT_from_HSbrain_330, chimp
taggtggcgtgtgtgagtggagacgggcctgggtcttggggactggagggcgggagtccttctgcccctggggtcccagggtgctctgcctgctcagccaggcctctcctg

SEQ ID NO: 7538 - DNA, 68 bp, Artificial
  Hairpin sequence PT_295, chimp
gcccagacagaggacagggaagtgtgcaagggtggggaccctcatcacagcccttgactctgtaaggc

SEQ ID NO: 7539 - DNA, 112 bp, Artificial
  Hairpin sequence PT_299, chimp
ccacccagaggcctgggagggactttgatctggagggtctcctgctgtcaggccttgcctagggctctgcaccctccctccagcccttgagccctccaccttcctcaggtgg

SEQ ID NO: 7540 - DNA, 96 bp, Artificial
  Hairpin sequence PT_30, chimp; PT_from_MM_20, chimp
gaggagggtctcctggaggggtctccgcctctacccaggactctttcatgaccaggaggctgaggcccctcacaggcggcttcttactctctcctt

SEQ ID NO: 7541 - DNA, 117 bp, Artificial
  Hairpin sequence PT_300, chimp
cctagtagctgagaaatacattaatatggaagggagaaaagctttaatgctctgaaaatgactcccatcattaaagctcttctcccttccatattaataaatttcgcactcaagagg

SEQ ID NO: 7542 - DNA, 89 bp, Artificial
  Hairpin sequence PT_303, chimp
gatgctggcgtcggtgctggggagcggcccccgggcgggcctctgctctggcccctcctggggcccgcactctcgctctgggcccgctc

SEQ ID NO: 7543 - DNA, 90 bp, Artificial
  Hairpin sequence PT_308, chimp
agagctgagcctgcggggctggccctggcctggctgctgctgcctgcagcccccagctcaggctccctccacctcacagtccacggcttt

SEQ ID NO: 7544 - DNA, 71 bp, Artificial
  Hairpin sequence PT_31, chimp
tggggtctccttcaatctcctgcacagtgctcctgctccagggagggctgtgttgagagggtagagacaca

SEQ ID NO: 7545 - DNA, 78 bp, Artificial
  Hairpin sequence PT_310, chimp
agattaatggggatgaggcagagtaactcaaaatagaacaaacagttttgagttactttgccttatccccattaattt

SEQ ID NO: 7546 - DNA, 77 bp, Artificial
  Hairpin sequence PT_315, chimp
cgtaaagacgttaggtcaaggtgtagcccatgaggtggcaagaaatgggctacattttctaccccatgaaaattacg

SEQ ID NO: 7547 - DNA, 115 bp, Artificial
  Hairpin sequence PT_317, chimp
ggcctcatggagagtctgcccagcccaaggcggactgtcttagagtggtaatgtcccttgttgtagccacccaggaccagtctgcccagggcttagcaggctagagcctggggtc

SEQ ID NO: 7548 - DNA, 116 bp, Artificial
  Hairpin sequence PT_319, chimp
gtggcgtgtgccacccctgcgcccgcgcccgccggcggggctcggagccgggcttcggccgggctccgggccctcgaccggaccggtgcgcgggcgctgcggccgcacggcgcgac

SEQ ID NO: 7549 - DNA, 88 bp, Artificial
  Hairpin sequence PT_325, chimp; PT_from_MQbrain_1422, chimp
gggccagcttccctgccctgcctgttttctcctttgtgattttatgagaacaaaggaggaaataggcaggccagggaaacgctctctc

SEQ ID NO: 7550 - DNA, 113 bp, Artificial
  Hairpin sequence PT_330, chimp; PT_from_HSbrain_1337, chimp
tctttgagccaccctttggtacttaaagagaggataccctttgtatgttcacttgattaatggcgaatatacagggggagactctcatttgcgtatcaaactgtcggggaaga

SEQ ID NO: 7551 - DNA, 113 bp, Artificial
  Hairpin sequence PT_331, chimp
tacacggcagggtctgagcctcggccgtgtgtgtccgcgagtgcacggcagggtctgagcctcggccgtgtgtgtccgcgagtgcacggcagggtctcagcctcggccgtgtg

SEQ ID NO: 7552 - DNA, 120 bp, Artificial
  Hairpin sequence PT_332, chimp
ggctcggccgtgtgtgtccgtgagtgcacggcagggtctgagcctcggccgtgtgtgtctgtgagtgcacggcagggtctcagcctcggccgtgtgtgtctgtgagtacacggcagggtc

SEQ ID NO: 7553 - DNA, 99 bp, Artificial
  Hairpin sequence PT_333, chimp; PT_from_MM_50, chimp; PT_from_MQbrain_1312, chimp; PT_from_MQbrain_601, chimp
gtggggtaaaaccccagacgccatgaaagctgccatggccctggagaaaaagctgaaccaggcccttttggatcttcatgccctgggttctgcccacac

SEQ ID NO: 7554 - DNA, 90 bp, Artificial
  Hairpin sequence PT_335, chimp; PT_from_HSbrain_1425, chimp
ggcggccctgcagagtcgagagtgggagaagagcggagcgtgtgagcagtactgcggcctcctctcctaacctcgctctcgcggcctacc

SEQ ID NO: 7555 - DNA, 113 bp, Artificial
  Hairpin sequence PT_336, chimp
agaaaataacattgtcagacgtgtcatccccagatacaacggacaatatgctattataatcgtatggcattgtccttgctgtttggagataatactgctgactttattcctct

SEQ ID NO: 7556 - DNA, 95 bp, Artificial
  Hairpin sequence PT_338, chimp; PT_from_HSbrain_198, chimp
tgagtccagtggctctggtccatttccctgccattcccttggcttcaatttactcccagggctggcagtgagatgggtcaaggctcacaccttca

SEQ ID NO: 7557 - DNA, 104 bp, Artificial
  Hairpin sequence PT_339, chimp
tcagtgagttccaggctgggattgagaagggagcagtgaagggaccgggaggttatactttcctctgatgacttcctgttagtgccacgtgtctgggccactga

SEQ ID NO: 7558 - DNA, 111 bp, Artificial
  Hairpin sequence PT_34, chimp
caggaaatgctcaggccgcattccccgtttcccgcctatcgccctccaaactcaggtctgggcttggggggcgagaggcgggaaatggggaacaaaagttggcagtgcctg

SEQ ID NO: 7559 - DNA, 94 bp, Artificial
  Hairpin sequence PT_340, chimp
aggtgatctttgtgctgtacatgatgacaactggctccctctactgaactgctatgaggaaactgccatgtcacccttctgactacagccacct

SEQ ID NO: 7560 - DNA, 113 bp, Artificial
  Hairpin sequence PT_35, chimp
cgcctcgtggggggtgcctccccccctgcgatgggggtcctgagagccagggtcgaaagagcggctggctctgagtccccgcctcgcggggggtgcctcccccgcgtcctgcg

SEQ ID NO: 7561 - DNA, 104 bp, Artificial
  Hairpin sequence PT_36, chimp; PT_from_HSbrain_583, chimp
ctggcttgctgggttcagagcactgggcaccaagtctgtgtcttggtgtcattgctattcacacagacattgtgtccaggttcctgcatccagaaacattccag

SEQ ID NO: 7562 - DNA, 98 bp, Artificial
  Hairpin sequence PT_37, chimp
cctctcctacattgagcatatctttgagatctcccgccgtcctgacctactcactatggtggttgactacagaacccgtgtgctgaagatctctgagg

SEQ ID NO: 7563 - DNA, 101 bp, Artificial
  Hairpin sequence PT_38, chimp
ccttcgcctctagaccccagcttggttgctttcttgagatctcacagccgcacgcaagagcaaacaggagagacagcctctgaggagcagaggccaggagg

SEQ ID NO: 7564 - DNA, 72 bp, Artificial
  Hairpin sequence PT_4, chimp
accccactatgcttagccctaaactccaatagttaacaacttaactattggatttcggttagggattagggt

SEQ ID NO: 7565 - DNA, 104 bp, Artificial
  Hairpin sequence PT_40, chimp
tcagagcagggggcctgaggaatggctcctctgtttacaacacacccaacaggaatctgggatcattgtgacgagaggtaccaaaacttgtaggcttcctatga

SEQ ID NO: 7566 - DNA, 90 bp, Artificial
  Hairpin sequence PT_41, chimp
gccctgcctcggcggcgcctggcgcgtctggaatgcggggcctccctccgcccccctccccacgccgcctcgccccgctcccgctagggc

SEQ ID NO: 7567 - DNA, 66 bp, Artificial
  Hairpin sequence PT_43, chimp
cacggagtgagtgaggtgccctgggcggtgtggacgcctctgggcctctgactcacacatgccttg

SEQ ID NO: 7568 - DNA, 84 bp, Artificial
  Hairpin sequence PT_44, chimp
agggtgaggtggagtggggttggggtgggagttgggggaaggatccctgagctctcgctggaccctggatctccacttcacact

SEQ ID NO: 7569 - DNA, 106 bp, Artificial
  Hairpin sequence PT_50, chimp
ggtggcaggtctttgttatctagctgtcacagtactgggtgggctcatcctgagtggatgcccttgcctcttcttctgggacttcttagtggtagcacctgctccc

SEQ ID NO: 7570 - DNA, 95 bp, Artificial
  Hairpin sequence PT_53, chimp
atggggggccctgccgaggcatcagctgctctgctcagttagtttttattcccggggtaccaagcagctgcacagtcggtgcctgggaggcacgt

SEQ ID NO: 7571 - DNA, 77 bp, Artificial
  Hairpin sequence PT_54, chimp
gtgcacctggggatccccctaaactgtgaattctgccctggacagggctttgcccttggaggatccccaggtggcat

SEQ ID NO: 7572 - DNA, 114 bp, Artificial
  Hairpin sequence PT_55, chimp
tctttgaatcacagccttcagatgccagaagggcagagggaatcccacacaggctggtggatcatgtgtgtgcatttctctcccttctagtctgaggaaactaagcatcaaaga

SEQ ID NO: 7573 - DNA, 101 bp, Artificial
  Hairpin sequence PT_56, chimp
taggcttgaggcagggttagccttggttccagcgcagtctccagcaagtgattaccagcctggaggggagcctgggaccaatggctttccaccttctcctg

SEQ ID NO: 7574 - DNA, 82 bp, Artificial
  Hairpin sequence PT_57, chimp
ttccaccctctcctcttccagcctcagtgggatgataatctcaagactcctcccttagctactcaggaggccgagggcggaa

SEQ ID NO: 7575 - DNA, 82 bp, Artificial
  Hairpin sequence PT_59, chimp
cttcagacgccagaagggcagagggaatcccacacgggctggtggatcatgtgtgtgcatttctctcccttctaatctgagg

SEQ ID NO: 7576 - DNA, 97 bp, Artificial
  Hairpin sequence PT_60, chimp; PT_from_HSbrain_690, chimp
gggcctggcactggagcctgggtcaggggagctcaggggcttacctgttgataagctcctctgtcctctccctttcccaggcttcagggaaagtccc

SEQ ID NO: 7577 - DNA, 115 bp, Artificial
  Hairpin sequence PT_63, chimp
cctcccagcctcctactacttctgtttccaaagggagatctctgtggccctctgttgtgccctccgctttgtcattgatctctccatgagtgactgatgtgagtggggtgggggg

SEQ ID NO: 7578 - DNA, 92 bp, Artificial
  Hairpin sequence PT_66, chimp
catccctggttctgtgtgctccaagtgccatcaaggccctggggacctcagctcccccaccccctggcttctgggccactccccagggactg

SEQ ID NO: 7579 - DNA, 63 bp, Artificial
  Hairpin sequence PT_70, chimp
ctccactttgcccctttgggtacaaagaaggaatagaagattccgtggccttgggggcaggag

SEQ ID NO: 7580 - DNA, 95 bp, Artificial
  Hairpin sequence PT_71, chimp
aggagggtgtgagtgaaggaggtggggccttgaggggttgtctgcagctctgccccgctcccctctgtgcccccttcctcttctctctagctact

SEQ ID NO: 7581 - DNA, 117 bp, Artificial
  Hairpin sequence PT_72, chimp
tcttgctttagctgtgctttcctgggatgagaagatcttggtgtttttaacacataagctttgttagaaatcgcctctgaagatcatttcattttctcactttgggttgttgcaaga

SEQ ID NO: 7582 - DNA, 80 bp, Artificial
  Hairpin sequence PT_73, chimp; PT_from_HSbrain_4, chimp
tctttggaaggatagcagcatgaacctgtctcactgcagaattattttgagacaggcttatgctgctatccttcaaaaga

SEQ ID NO: 7583 - DNA, 66 bp, Artificial
  Hairpin sequence PT_74, chimp
gttcaacctttagtacgtgtggcttggtcacttcgtggctgaggtaagaacgtgcttgtggaagac

SEQ ID NO: 7584 - DNA, 84 bp, Artificial
  Hairpin sequence PT_81, chimp
tgggtccctcccgcctgtgacctgcctggtcatagacaagacaagcccctgaccaggcatgggcctaggggtggccgtgaccca

SEQ ID NO: 7585 - DNA, 93 bp, Artificial
  Hairpin sequence PT_84, chimp
aaatatctaggattgatggcatcatcctggcacctggtttgatgccaggcatcatcctggcacctggtttgatgccatcattcccagatgttt

SEQ ID NO: 7586 - DNA, 79 bp, Artificial
  Hairpin sequence PT_86, chimp
tccttactccaaatccagaagtcagagccaactcccatcttggttctgacccaaatcctgttctggactctggagagga

SEQ ID NO: 7587 - DNA, 74 bp, Artificial
  Hairpin sequence PT_89, chimp
ttggggctgaggctgggggcagggtggagccttgcctgtggtgagagtccctctctctgtcccccctaccccag

SEQ ID NO: 7588 - DNA, 113 bp, Artificial
  Hairpin sequence PT_91, chimp
ccccaccccttccaggactcagattcagactctgagggaggagccgctggtggagaagcagacagtgagtatcttcctggagggacagggagcagggttcgggggggcggggg

SEQ ID NO: 7589 - DNA, 88 bp, Artificial
  Hairpin sequence PT_92, chimp
tgtgggaggctgcagggaggtgtggggagaaggtccgctttagagcttggtccctctgtgctcacctcccagccccaagcccccagca

SEQ ID NO: 7590 - DNA, 81 bp, Artificial
  Hairpin sequence PT_93, chimp
cctggggcgggcgggagggcgggcggaaggccgggtggtggggccggcctgagagccctagccaggccctcccgccacagg

SEQ ID NO: 7591 - DNA, 77 bp, Artificial
  Hairpin sequence PT_95, chimp
gccacctgggccagcccctcgtcctctgccttctgctggcagaggagcagctggattggggcctttggcacagcagc

SEQ ID NO: 7592 - DNA, 75 bp, Artificial
  Hairpin sequence PT_99, chimp
gtgtcctgggtttggaaagggccctgttggccacttcactgcaggctgcaccctttctttcccagctattatcgc

SEQ ID NO: 7593 - DNA, 82 bp, Artificial
  Hairpin sequence PT_from_HS_1, chimp
acaggcgaaggccctcgtgttgcagtgctaggccaagggggagccaggcctggccctgggatgctggggagccatgggctgt

SEQ ID NO: 7594 - DNA, 81 bp, Artificial
  Hairpin sequence PT_from_HS_10, chimp
gcacaatgttatactggagagcaggaagagctgttgcatataagtaacagacttttctttatcttctatgtgactgtttgc

SEQ ID NO: 7595 - DNA, 78 bp, Artificial
  Hairpin sequence PT_from_HS_100, chimp
tcttgatcccacccctgccagaaggggtaaggattcacaccccttgctaccttctcagaatgtggaccatgatggaga

SEQ ID NO: 7596 - DNA, 89 bp, Artificial
  Hairpin sequence PT_from_HS_101, chimp; PT_from_HS_102, chimp
gattcgggagtgagggagagcaggggtggaggtgtcagagcgaagtctgactgctgatcctgtctgttctccccaggttgctcttattc

SEQ ID NO: 7597 - DNA, 89 bp, Artificial
  Hairpin sequence PT_from_HS_103, chimp
ccaggtctgatggcccagatggcaaccactgcagctggcgtggctgtgggctctgctgtggggcacacactgggtcatgccattactgg

SEQ ID NO: 7598 - DNA, 68 bp, Artificial
  Hairpin sequence PT_from_HS_104, chimp
ggcttccgccccgcagccccgaggggtccgggtgcgctgaagacctcttcggctgctgggccaacgcc

SEQ ID NO: 7599 - DNA, 106 bp, Artificial
  Hairpin sequence PT_from_HS_105, chimp
ggtcttttacgtcggccttcgcgagcgtttggtcgggtggtaggtgagtgggtattgcgggccagtatccgagcaaaagatggtggcgcaggccgagttaagagct

SEQ ID NO: 7600 - DNA, 103 bp, Artificial
  Hairpin sequence PT_from_HS_106, chimp
ccaacctgtgggaaggcaggtggactccagcagtaggtaggtaacatccaaggtagccatacacagctggtgtttgtgaatctgcacttcccctgggcaatgg

SEQ ID NO: 7601 - DNA, 93 bp, Artificial
  Hairpin sequence PT_from_HS_109, chimp
aggcggttaagccatgggacagggccacagacggagactgctcaaggtcaaagcggtctccagctgggaccctgcacctggttcgtagcccct

SEQ ID NO: 7602 - DNA, 116 bp, Artificial
  Hairpin sequence PT_from_HS_11, chimp
gtctgtctacactggctgggccagtgtgtggtgcaggcagtctgtctacactggtggggccagtgcatggggcaagcagtccgcctacactgacggagccagcaagtgggtcaggc

SEQ ID NO: 7603 - DNA, 81 bp, Artificial
  Hairpin sequence PT_from_HS_110, chimp
cctggcggacaggtgggagccacagcgtacaccccagggttccctctgtgctgtgcgtagtgcctgctgcttgcttccagg

SEQ ID NO: 7604 - DNA, 79 bp, Artificial
  Hairpin sequence PT_from_HS_111, chimp
ctgtgacgtcacgaggctccacctcccgcgaggctttgtgtcggctgggcctggcgcgagggtggaggttggcgggcag

SEQ ID NO: 7605 - DNA, 97 bp, Artificial
  Hairpin sequence PT_from_HS_114, chimp; PT_from_HS_118, chimp
gggcagaggtgggacagtgagctgggaggtggcgaggaggccctttattgaggggccagcttagatcccccagccccaaggtcctctgtcctccccc

SEQ ID NO: 7606 - DNA, 59 bp, Artificial
  Hairpin sequence PT_from_HS_117, chimp
gcggagggggcggccccacggtgccaccgcaccaagaggccgcctctggggagctccgc

SEQ ID NO: 7607 - DNA, 91 bp, Artificial
  Hairpin sequence PT_from_HS_121, chimp
tccccatctccacacccctggtgattcttgtgcacataataatgtgaaaagcattgcattaaagaattgctaaagggtgtcagaaaacgga

SEQ ID NO: 7608 - DNA, 76 bp, Artificial
  Hairpin sequence PT_from_HS_123, chimp
cggtgcagcggcggatggatgctgcgggaaggggctgccatttgctgcccctgccagcggcgcgcggacctgcccg

SEQ ID NO: 7609 - DNA, 96 bp, Artificial
  Hairpin sequence PT_from_HS_124, chimp
atggggtaacaaaaagaacatgggttgagccagacaggtctgggtctgtgggacctcagataaagcacataacccattggggcttggttttcccat

SEQ ID NO: 7610 - DNA, 67 bp, Artificial
  Hairpin sequence PT_from_HS_126, chimp; PT_from_HSbrain_1263, chimp
gccagtagtcgtccccgccctgcttcaaacatttgggtttcaggagccgggcggaggtgactgccgc

SEQ ID NO: 7611 - DNA, 118 bp, Artificial
  Hairpin sequence PT_from_HS_127, chimp
gacttggatttctttggaagaaactgctgaagctgccatgtctaagaagaaaactttggagaaaaaatttcttcttagacatggcaacgtcaacagtttctaagctcttgattccgtc

SEQ ID NO: 7612 - DNA, 93 bp, Artificial
  Hairpin sequence PT_from_HS_129, chimp
ggagtccaaaggagtgtttgcggggagggcccgaggtcgctgtgtccggggcagagcggccggttcgtcccgagtctgcgctcgttcgggtcc

SEQ ID NO: 7613 - DNA, 94 bp, Artificial
  Hairpin sequence PT_from_HS_13, chimp; PT_from_HSbrain_1400, chimp
acgtggtgacgggtggcgaagatgacctggtcaccgtgtggtccttcaccgagggccgtgtggtggctcgaggccatggccacaagtcctgggt

SEQ ID NO: 7614 - DNA, 73 bp, Artificial
  Hairpin sequence PT_from_HS_130, chimp
gccttttgactcatccggttcttggaccaggacgctgtcttgctctgtaagccagggagagattttattaggc

SEQ ID NO: 7615 - DNA, 100 bp, Artificial
  Hairpin sequence PT_from_HS_131, chimp
ctgcctgtgagcgcgagcctctttcggctttccagtttgtctcggtcctttggaacgtggcaaacgtggaagccgagagggctctcgcgagcgttggcag

SEQ ID NO: 7616 - DNA, 85 bp, Artificial
  Hairpin sequence PT_from_HS_132, chimp
acatccactccaggctgtgtggagccttccctctgtgaagttgctggtctgtgagggtggccacgctgcactggggtggagaggt

SEQ ID NO: 7617 - DNA, 101 bp, Artificial
  Hairpin sequence PT_from_HS_135, chimp
gggccttggtggcctgcccagaccagccaggagccaggctggggccaacttagcactcagtgtggctcgtgatgggtgggtggtgggctgggctcaggcct

SEQ ID NO: 7618 - DNA, 91 bp, Artificial
  Hairpin sequence PT_from_HS_137, chimp
tccatgttagtattcctggattcctaacctttcacacgtgcagccatcactgtgggaacactgaggacttcaggaatggctctttacagga

SEQ ID NO: 7619 - DNA, 100 bp, Artificial
  Hairpin sequence PT_from_HS_138, chimp
gggaaacaagggcagcgggagaaacggcccggaaagggacgaagaggcttccagctttcgccaagtcgcggctcccagtttttccctgggtctccttcct

SEQ ID NO: 7620 - DNA, 57 bp, Artificial
  Hairpin sequence PT_from_HS_14, chimp
ccatggaggccctgggcggctcgagctagtcttcaggccgaatctcccgcctccagg

SEQ ID NO: 7621 - DNA, 77 bp, Artificial
  Hairpin sequence PT_from_HS_142, chimp
gcccagggcttggagtggggcaaggttattggtgatatgacttcctctcccttcctgccctggctaggccctggagc

SEQ ID NO: 7622 - DNA, 92 bp, Artificial
  Hairpin sequence PT_from_HS_145, chimp
gagcggtggccaggaagacaggatgccagcacccaagggcactgacttccatccagcccaggtgtcttccattctgtccccctgcctccctc

SEQ ID NO: 7623 - DNA, 94 bp, Artificial
  Hairpin sequence PT_from_HS_148, chimp; PT_from_HSbrain_1247, chimp
gggccttagggccctggctccatcccgcagatgaggagctctggaaaagggcaaagtcccggaggctgaggagtggcgcgggctctaagtgtcc

SEQ ID NO: 7624 - DNA, 75 bp, Artificial
  Hairpin sequence PT_from_HS_15, chimp
ggaagcggatcgcgtggagtgaaggtcacgccgcggcgcgtgagtttccctttgtgtaaattaatctgcgcttcc

SEQ ID NO: 7625 - DNA, 90 bp, Artificial
  Hairpin sequence PT_from_HS_152, chimp
gggtggggcccgcgcgtataaagggggcgcaggcgggctgggcgttccacaggccaagtgcgctgtgctcgaggggtgccggccaggccc

SEQ ID NO: 7626 - DNA, 75 bp, Artificial
  Hairpin sequence PT_from_HS_153, chimp
gctcctggctgccttgtgttgatctctggccctaggtaatgaccagaaatctcactggcaggcaagcaggcaggc

SEQ ID NO: 7627 - DNA, 79 bp, Artificial
  Hairpin sequence PT_from_HS_154, chimp
gaggtagggaaaaggaagggggaggagaaggtgagaccaatgtcctgggtgccactcctgcccagtgcctcccttcctc

SEQ ID NO: 7628 - DNA, 86 bp, Artificial
  Hairpin sequence PT_from_HS_158, chimp; PT_from_HSbrain_1434, chimp
ggtgggtggtttctccgtttgcctgtttcgctgatgtacattcaactcattctcagcaaaataagcaaatggaaaattcgtccatc

SEQ ID NO: 7629 - DNA, 84 bp, Artificial
  Hairpin sequence PT_from_HS_159, chimp
ccaggccttcttgctcccccaccgcccaccctccacccttgcttcttggcagggagaagggctgggagggagaagaaattctgg

SEQ ID NO: 7630 - DNA, 87 bp, Artificial
  Hairpin sequence PT_from_HS_16, chimp; PT_from_HSbrain_1401, chimp
tctcaggctgtgagtctgcaaagggaagccctttctgttgtctgaaagaaaagaaatcgcttccctttggagtgttacggtttgaga

SEQ ID NO: 7631 - DNA, 119 bp, Artificial
  Hairpin sequence PT_from_HS_160, chimp; PT_from_HSbrain_1286, chimp
cttcatatcagattctcacctgaacgcatgactcttcaacctcaggacttgcagaattaatggaatgctgtcctaaggttgttgagttgtgcatttctgggcatttcatctctatggag

SEQ ID NO: 7632 - DNA, 83 bp, Artificial
  Hairpin sequence PT_from_HS_162, chimp
gtatgtggggaaaatgggtgggttgatgaggccaagctgacaagtcaggcatcaaatctagacccacaatatgttcccaaaac

SEQ ID NO: 7633 - DNA, 78 bp, Artificial
  Hairpin sequence PT_from_HS_166, chimp
ctgacttctgcgaggggcgcggtggggttccgcggggtcggaaagactccccaggtccccgcgcggccccagacccag

SEQ ID NO: 7634 - DNA, 116 bp, Artificial
  Hairpin sequence PT_from_HS_167, chimp
ctctactccctcagcttgctctgctaccactttcctgtctctccctctcccaaagcagataaaagatgaggggacaaagacagtgtgtgtctgggaagctgggctgagaggaggag

SEQ ID NO: 7635 - DNA, 96 bp, Artificial
  Hairpin sequence PT_from_HS_168, chimp
cttccccagaccacagaactgtccttgagggccccctgccttggatgtggctttgaaggccagccgggggtgatttgagaaggtggatgggggaag

SEQ ID NO: 7636 - DNA, 53 bp, Artificial
  Hairpin sequence PT_from_HS_17, chimp
gttctcccaccgcccccgctgtgggtctcggcagctcgggcggcgggaggagc

SEQ ID NO: 7637 - DNA, 92 bp, Artificial
  Hairpin sequence PT_from_HS_173, chimp
ctgcctggaccctgccctgcctccaccccgcctggcctgacccagccagggctctaggagggttgggtggaggcaaagtgggaagaagggag

SEQ ID NO: 7638 - DNA, 67 bp, Artificial
  Hairpin sequence PT_from_HS_175, chimp
ctccatcagccttctctggcctgtctcctgcagccccaccgctgcactgaagcccagggctgtggag

SEQ ID NO: 7639 - DNA, 112 bp, Artificial
  Hairpin sequence PT_from_HS_178, chimp
gagaacgaacttgagaaataaggcttctgtctactactggagacactggtagtataaaacccagagtctccagtaatggacgggagccttatttctatcactcagtgttttc

SEQ ID NO: 7640 - DNA, 112 bp, Artificial
  Hairpin sequence PT_from_HS_180, chimp
gtctacaaatgttgtctccttaatccttgcaacgaacctgagccattgattcagtaaaatactcagtggcacatgtttgttgtgggggtcaaaagagataatctctacaggc

SEQ ID NO: 7641 - DNA, 78 bp, Artificial
  Hairpin sequence PT_from_HS_182, chimp
gtggacaaccctagggtggggccggaggtggggctgaggctgagtcttcctccccttcctccctgcccaggggtccac

SEQ ID NO: 7642 - DNA, 79 bp, Artificial
  Hairpin sequence PT_from_HS_183, chimp
accccccggaggaaccgccaacagcgccccggcaccatcaagcatggatcggcgctggacgtgcttctctccatggggt

SEQ ID NO: 7643 - DNA, 93 bp, Artificial
  Hairpin sequence PT_from_HS_186, chimp
ggggctcctgggaagggcctggctcctcctgcagctgttcctttgctcccttgggcagagaagctggcgttcggagccagcctttccagcctc

SEQ ID NO: 7644 - DNA, 93 bp, Artificial
  Hairpin sequence PT_from_HS_189, chimp
catgctcaagagcaaaagcaaatgttgggtgaacagctgtttcctcttattcaagccatgcaccctactcttgctggtaaaatcactggcatg

SEQ ID NO: 7645 - DNA, 114 bp, Artificial
  Hairpin sequence PT_from_HS_19, chimp
tcctttagagcctagcgagggggcgtggcccagccaggagggcgggagaggcagcgaagatcttccctcagagcctggcgagggggcgcggcccagccaggagagctggagaga

SEQ ID NO: 7646 - DNA, 70 bp, Artificial
  Hairpin sequence PT_from_HS_193, chimp
ggcgcccgcggcggccgtggcggcctgagcgtgatgctccgggttctcggcggcggctgtggccttggcc

SEQ ID NO: 7647 - DNA, 74 bp, Artificial
  Hairpin sequence PT_from_HS_194, chimp; PT_from_MQbrain_2633, chimp
cgtttgtgggggcaggagctggggtctgcaggttcgcactgatgcctgctcgccctgtctcctgctagctgatg

SEQ ID NO: 7648 - DNA, 109 bp, Artificial
  Hairpin sequence PT_from_HS_195, chimp
tgctctggttgctttcctatgagattctctcagcgattcaaaaacacaaaagcaaggcagtggttgtgtttgggaaggtgagggaagagagagaatggaacactaagca

SEQ ID NO: 7649 - DNA, 104 bp, Artificial
  Hairpin sequence PT_from_HS_197, chimp
tccggggtcgcggatctgcccgccccgctctcccgaagctgttcgggcagtgtccgaacggcttcggaggggcgagaagccggcatctgagcggcctctctgga

SEQ ID NO: 7650 - DNA, 112 bp, Artificial
  Hairpin sequence PT_from_HS_2, chimp; PT_from_HSbrain_1168, chimp
ccagcggagaggagagccgggagggagagctgggaggcggtcggttctgagtcatcccagcctatgtcacttctcagaaacctccgccacccccccccatcccggcccctgg

SEQ ID NO: 7651 - DNA, 79 bp, Artificial
  Hairpin sequence PT_from_HS_20, chimp
tcgcctcccaacccgcgttgtcctcgcgccttcgccctgggtaggtgaggccgagaaggcaaccgcgaaaaggaggcgg

SEQ ID NO: 7652 - DNA, 83 bp, Artificial
  Hairpin sequence PT_from_HS_200, chimp; PT_from_HSbrain_1325, chimp
ctaccgggttctcctggggagtgcctggggagcagacagacccaacctcatgctccctggcctctgcccccagctcccggtgg

SEQ ID NO: 7653 - DNA, 118 bp, Artificial
  Hairpin sequence PT_from_HS_202, chimp
tatttgagaaaggacattgttttgacagataaagtaggcatttgataaattgaaacaggttttgaattattttgagagaatgtgtgctacatctgtctgctgattttccactgaagta

SEQ ID NO: 7654 - DNA, 100 bp, Artificial
  Hairpin sequence PT_from_HS_203, chimp
gcggcggcacttcagctcccagcggcggcggcggccatgttggccctgatcacgtgatctgccgccgtcgcgcgctgggggtgaaagttcacaatgcggc

SEQ ID NO: 7655 - DNA, 71 bp, Artificial
  Hairpin sequence PT_from_HS_205, chimp
ggctctaggccaccctggcagctgggccgcactctgccggcctggacgccggggtcggcctctgattggtc

SEQ ID NO: 7656 - DNA, 74 bp, Artificial
  Hairpin sequence PT_from_HS_206, chimp
tcccggaagctggcggagcaggagctgattgagaccagcgagcgggtgcagctgctgcattcccaggtgagggg

SEQ ID NO: 7657 - DNA, 99 bp, Artificial
  Hairpin sequence PT_from_HS_21, chimp
tagaagttcagaagagggctaggcggagccgagcccacatccgggagaggagagcggaagtggcgttggtctggccggagcccttgggtgaaattgtta

SEQ ID NO: 7658 - DNA, 88 bp, Artificial
  Hairpin sequence PT_from_HS_211, chimp
gcttccagaagtgcacgctctagcgaggattccaatattgggggaattggcccaatattggaatccccgctagagcgtgcacctaagc

SEQ ID NO: 7659 - DNA, 109 bp, Artificial
  Hairpin sequence PT_from_HS_217, chimp
gatggctaccatcagggaagagatcagcatctgtgtcagttttctgtacggctccatgggattaaaggaagcaatgacatcctgatctgttccttgatctttgggcatt

SEQ ID NO: 7660 - DNA, 85 bp, Artificial
  Hairpin sequence PT_from_HS_218, chimp
atgctcctttctggccttccacccacagggcgagtccaagggaagtatggactcgccctatgggtgggaacccaggaaggtgcat

SEQ ID NO: 7661 - DNA, 103 bp, Artificial
  Hairpin sequence PT_from_HS_219, chimp
gggtgggggtgtgtggcagcacggctgatggagggctgtcttgccttgctttacaggttggttttgaccctcatcccccgatgcgggccacaggcctcccctc

SEQ ID NO: 7662 - DNA, 87 bp, Artificial
  Hairpin sequence PT_from_HS_22, chimp
tcccacacgtgctcaggcccctcaaccaaggaaggcagcaggcccactggcctccttattcagaggggctgcactgcaccctaggga

SEQ ID NO: 7663 - DNA, 68 bp, Artificial
  Hairpin sequence PT_from_HS_220, chimp; PT_from_HS_223, chimp; PT_from_HS_225, chimp; PT_from_HS_229, chimp; PT_from_HS_235, chimp; PT_from_HS_237, chimp
gggcaccagctccagcatcactggcagcagacactcccaggcctgccatggtccaggacctggtgtcc

SEQ ID NO: 7664 - DNA, 105 bp, Artificial
  Hairpin sequence PT_from_HS_221, chimp; PT_from_HS_222, chimp; PT_from_HS_224, chimp; PT_from_HS_226, chimp; PT_from_HS_233, chimp; PT_from_HS_234, chimp; PT_from_HS_236, chimp
ggactcgcagacgttactgccctcttgcgtgccccggccacccccgggcagcttgtagccagtgcgcggggtggctgggactacgtgcagagctgtcgcggagcc

SEQ ID NO: 7665 - DNA, 105 bp, Artificial
  Hairpin sequence PT_from_HS_227, chimp; PT_from_HS_230, chimp; PT_from_HS_238, chimp
ggactcgcagacgttactgccctcttgcgtgccccggccacccccgggcagcttgtagccggtgcgcggggtggctggggctacgggcagagctgtcgcggagcc

SEQ ID NO: 7666 - DNA, 82 bp, Artificial
  Hairpin sequence PT_from_HS_232, chimp
caggaactggagccaggctgaagggtccttaaccattcaaagtgtcagaagtggggaaggtagtcagtttgggtttatcctg

SEQ ID NO: 7667 - DNA, 76 bp, Artificial
  Hairpin sequence PT_from_HS_239, chimp
gagctgaggttggccccggcaggtgtgcagtcctcacacagaacgggcagggctcctgtcagagccaaaccagctc

SEQ ID NO: 7668 - DNA, 100 bp, Artificial
  Hairpin sequence PT_from_HS_240, chimp
ggcctctccagtctgcagctcccggcagcctcgggtcacactcccgggatccccagggactggcctgggactactgggggtggcggccgtggttctggct

SEQ ID NO: 7669 - DNA, 92 bp, Artificial
  Hairpin sequence PT_from_HS_241, chimp
gggggtccaggaggctccagggtgagcccacccctccccctagatacaagggagggccctgggaccctgtctgctgttcctcctggactcct

SEQ ID NO: 7670 - DNA, 81 bp, Artificial
  Hairpin sequence PT_from_HS_242, chimp; PT_from_HS_245, chimp
gctcggctctatcctgagaaggcacagcttgcacgtgaccttctgggcctggcggctgtgtccttacagggagccgacagc

SEQ ID NO: 7671 - DNA, 60 bp, Artificial
  Hairpin sequence PT_from_HS_243, chimp
gcagggcagggtgaaggcccggcggagacactctgcccaccccacaccccgcctatgggc

SEQ ID NO: 7672 - DNA, 71 bp, Artificial
  Hairpin sequence PT_from_HS_25, chimp
ccgcccccggccccactccaccttcctcccaccccgcgaacccggaagtggaggaggaggcgcggcggcgg

SEQ ID NO: 7673 - DNA, 120 bp, Artificial
  Hairpin sequence PT_from_HS_250, chimp
gggcctcggcgccaggagcggggctgggggcggcgccatggggcctcgcagccccgatcggcggccgccaggtccctggagccgccgcctcccctctcccggcctcagctgtcgttgtcc

SEQ ID NO: 7674 - DNA, 76 bp, Artificial
  Hairpin sequence PT_from_HS_253, chimp
gaggcgcgccggctggttcaactccggccgccgcgccgaaaccagcagcggtccgggtcgaaccagcaccggcctc

SEQ ID NO: 7675 - DNA, 89 bp, Artificial
  Hairpin sequence PT_from_HS_254, chimp
ggaatgaagcgcggagctgttcgccgctccaggtgctgagtctgagggaggctccggacccgagagccgcgagagccgcgagagccgcc

SEQ ID NO: 7676 - DNA, 117 bp, Artificial
  Hairpin sequence PT_from_HS_256, chimp
aggaggcagtgaacctctcctgccctttccttccatctccatcaccttgagcatcttctgggcagctgaggtggccgcagatgggaaggaagggcccagagacgagcattttcttct

SEQ ID NO: 7677 - DNA, 83 bp, Artificial
  Hairpin sequence PT_from_HS_257, chimp
gcctccggcgtcttagcccgctcttctggccccgccccgcgctacgcgtagggaggcggggcctcggggcgagacgccggagc

SEQ ID NO: 7678 - DNA, 59 bp, Artificial
  Hairpin sequence PT_from_HS_260, chimp
tggcgttgcagcccaggagcctcggccgacacggcagcgacgttcccgagccaacgcca

SEQ ID NO: 7679 - DNA, 71 bp, Artificial
  Hairpin sequence PT_from_HS_261, chimp
cagagtggccagtgacaagccccaggctatgaggctgctggcctttttcctgtgctgtgctgccccttttg

SEQ ID NO: 7680 - DNA, 116 bp, Artificial
  Hairpin sequence PT_from_HS_264, chimp
gtagacaaacatctggcacgacctcctggcacagggggtgcccatccagaaactcggggtccagaataggatcccagggccatgtggggcctcctgagccagtgtccaggttctat

SEQ ID NO: 7681 - DNA, 115 bp, Artificial
  Hairpin sequence PT_from_HS_265, chimp
tctccgtccacgctgctgaccggctcggcaactgcctccctgctgtgagcaggagaacaggaagtctgcccgacagggaggtggccgggcgggagcggcagagtcggcgttgaga

SEQ ID NO: 7682 - DNA, 93 bp, Artificial
  Hairpin sequence PT_from_HS_267, chimp
ccgcgctctgggcctgcggccgctgtcgattcccccagtcaccgagcgagagggaagaaacaagatggcggctgaaggcgatccggagtgggg

SEQ ID NO: 7683 - DNA, 98 bp, Artificial
  Hairpin sequence PT_from_HS_27, chimp
tgaccagtcggaatggtgattctgatggtgaactgattttcattcacactctctcctactccccatccattcaccatcctgaggatcccatttggtta

SEQ ID NO: 7684 - DNA, 84 bp, Artificial
  Hairpin sequence PT_from_HS_278, chimp
cgcggcgaggcttccggctctgcggcctgcaggtagcgcgcaagtcctgcgcgtcccaggtgcccaactcaaagctccgctgcg

SEQ ID NO: 7685 - DNA, 91 bp, Artificial
  Hairpin sequence PT_from_HS_299, chimp; PT_from_HS_300, chimp; PT_from_HS_46, chimp
tcaccaagcaagtgcagtggggcttgctggcttgcaccgtgactccctctcaccaagcaagtgcagtggggcttgctggcttgcaccgtga

SEQ ID NO: 7686 - DNA, 96 bp, Artificial
  Hairpin sequence PT_from_HS_30, chimp
ttccataaagcaggatgcatgctcaagctcaagtcaagggaaggacccccatccacagagggctgaaatgcaaatccatgcaacaaatatatggag

SEQ ID NO: 7687 - DNA, 54 bp, Artificial
  Hairpin sequence PT_from_HS_304, chimp
gaagctctaaggttccgcctgcgagcaggaagcggaggaaccttggagctcttc

SEQ ID NO: 7688 - DNA, 92 bp, Artificial
  Hairpin sequence PT_from_HS_33, chimp
tgagcctgtgtgtgggtctgtgtgttcccgaaccctcccctgctggccatggatgctgggaggtctgggcacactcaccagcaccgggagca

SEQ ID NO: 7689 - DNA, 89 bp, Artificial
  Hairpin sequence PT_from_HS_34, chimp
gagtctcttgtgggtctgtgtgtgcccgtcccctccccggctggccatggatgctgggaggtctgggcacactcaccagcaccgggatc

SEQ ID NO: 7690 - DNA, 103 bp, Artificial
  Hairpin sequence PT_from_HS_36, chimp
gcactttgtaacctgtagagggcagcctgtgaggagagactggggctttggagtccacagatttagtctcaaattccaggccctgcaccttgcggggatgtgt

SEQ ID NO: 7691 - DNA, 78 bp, Artificial
  Hairpin sequence PT_from_HS_37, chimp
gtgtgtcctctgcagtgtcatggcgagacagtccttcctgcttgtgcagggaccctccctgaactgcagctgacagat

SEQ ID NO: 7692 - DNA, 112 bp, Artificial
  Hairpin sequence PT_from_HS_39, chimp
ttaggcgctgatgaaagtggagttcagtagacagcccttttcaagccctacaagaaactggggtttctggaggagaaggaaggtgatgaaggatctgttctcgtgagcctga

SEQ ID NO: 7693 - DNA, 95 bp, Artificial
  Hairpin sequence PT_from_HS_40, chimp
aaaattttgaatcttttgtagtttcttctgatagtggttgggtaggggtggaagccatgaggtgagaagaggctatgggacgaatttatagtttt

SEQ ID NO: 7694 - DNA, 109 bp, Artificial
  Hairpin sequence PT_from_HS_41, chimp
ggtaagcttactcaaaggaactcagtccaggctctccccacaggcctatgtgagaaggactttgtggagggggagatggaacatgaagtcctgatgaggaactgcagcc

SEQ ID NO: 7695 - DNA, 97 bp, Artificial
  Hairpin sequence PT_from_HS_44, chimp
ggaaacttctgcaggggaaaagagctaggaaagagctgcaaagcagtgtgggctttttcccttttttgctccttttcattacccctcctccgttttc

SEQ ID NO: 7696 - DNA, 104 bp, Artificial
  Hairpin sequence PT_from_HS_48, chimp
tcagactctgggtggatggagcaggtcgggggccaggggacaggaaggctggggccccagagacctgtcctggaccccatgtccagctctgcccttagtgctgg

SEQ ID NO: 7697 - DNA, 89 bp, Artificial
  Hairpin sequence PT_from_HS_5, chimp
gaggaaaagatcgaggtgggttggggcgggctctggggatttggtctcacagcccggatcccagcccacttaccttggctactctcctt

SEQ ID NO: 7698 - DNA, 79 bp, Artificial
  Hairpin sequence PT_from_HS_50, chimp
atgccagatggagggtggcaatgtgtaggcgcaggttgcagtaggcaatctggcaggttgaacaagctctccacagcat

SEQ ID NO: 7699 - DNA, 75 bp, Artificial
  Hairpin sequence PT_from_HS_54, chimp
agtcgctgggaaggaaggagacgcctaaaccgcggcactgcccggtttgagcgtagccacacctgcccaccggct

SEQ ID NO: 7700 - DNA, 104 bp, Artificial
  Hairpin sequence PT_from_HS_56, chimp
ggcaagctggctgtctgctgcctggccaggcctcctggtgcccactgtgctcctgattagttggcgctggcaatggcaggagcagcagacggcctctcccagcc

SEQ ID NO: 7701 - DNA, 68 bp, Artificial
  Hairpin sequence PT_from_HS_57, chimp
gagggcacggacagccaggaaggtccggggaagcccggaaccatcatcccgttccttgtccgtccttt

SEQ ID NO: 7702 - DNA, 87 bp, Artificial
  Hairpin sequence PT_from_HS_61, chimp; PT_from_HSbrain_1411, chimp
gagaaacactttgcctttttacaggtgtttattatgttttggacatagaaacataacaaacacctgtaaaatagcaaagtgtttctc

SEQ ID NO: 7703 - DNA, 85 bp, Artificial
  Hairpin sequence PT_from_HS_62, chimp
gttttctccccaggaacaacagctcagcaggtaagccaggagactaacctttccttctgcttcctgttggtcctccaggcataac

SEQ ID NO: 7704 - DNA, 115 bp, Artificial
  Hairpin sequence PT_from_HS_63, chimp
ctgtcctgggctccacacttggtgggttgcagattcccagagtgggacagggaggctccacattgcctgccctccttgggaatctacaaccccccaagtttgcagcatcattcag

SEQ ID NO: 7705 - DNA, 68 bp, Artificial
  Hairpin sequence PT_from_HS_68, chimp
tctctggctgtgcttgctgcagctgcctgggaagaaaaatgttcccaggtactcaaagcctccagtgg

SEQ ID NO: 7706 - DNA, 98 bp, Artificial
  Hairpin sequence PT_from_HS_69, chimp
gtaggaggcaaccctggtatttcctagtctgactggtggacttgcatatacaaggctgccattgatcaaactaaaaattggaaaggtttgcctttgac

SEQ ID NO: 7707 - DNA, 54 bp, Artificial
  Hairpin sequence PT_from_HS_7, chimp
ggggcctcctgcccagacttgaagccacacaggcaggtcgggcaggcgggtccc

SEQ ID NO: 7708 - DNA, 78 bp, Artificial
  Hairpin sequence PT_from_HS_70, chimp
ctcattctctcttgtcccatactggagtttggggagccactttcccgtccctccactgtggagctgcgttcctgtgag

SEQ ID NO: 7709 - DNA, 96 bp, Artificial
  Hairpin sequence PT_from_HS_71, chimp
gggcaggcttctctgggatgcccaccttctccacccctccttctcctcccggcaggttccactgctcctggtgctggcacacctggcagtctgccc

SEQ ID NO: 7710 - DNA, 104 bp, Artificial
  Hairpin sequence PT_from_HS_72, chimp
gtgggcctggggaggctggcagcatgggccatgctggcggggcccctgggtacaggggaagggcctgggcggagggacagactgtcaccacctggggatcccac

SEQ ID NO: 7711 - DNA, 115 bp, Artificial
  Hairpin sequence PT_from_HS_73, chimp
gaagcactgaagcaggtcgttctcaagcagttgtcaggaggcctctgtgaatttcacctctgtgcacatccctgctacaactgcctccagagaatcacagcttctcctgctcttc

SEQ ID NO: 7712 - DNA, 83 bp, Artificial
  Hairpin sequence PT_from_HS_74, chimp
gcggcgctccagggtgctgaggagaccggaaaggcggccaggaccttccggttgcctcggcccaccacccacccagtgtccgc

SEQ ID NO: 7713 - DNA, 71 bp, Artificial
  Hairpin sequence PT_from_HS_76, chimp
ggaagggggaaaggaggaggatccttgaaacacctgcacgcccacggtcccactccttctcctcctcagcc

SEQ ID NO: 7714 - DNA, 70 bp, Artificial
  Hairpin sequence PT_from_HS_77, chimp
aggccgggcagcgcagggcgaaaggaggctgtgtcctcagcctcctccctcggcacgcgcctcccatcct

SEQ ID NO: 7715 - DNA, 99 bp, Artificial
  Hairpin sequence PT_from_HS_78, chimp
ggcggcagcggcggaggagcggatggcagaggaaggaggcggcggccaaggcgacggcggctcctctttggcctccggctctacccagcgacagccccc

SEQ ID NO: 7716 - DNA, 87 bp, Artificial
  Hairpin sequence PT_from_HS_79, chimp
ctccaggcaggatctgtgcagtactcaccccctccgtctgctccctccaaggtgtgggggtgggcagtgctcagggcctcctcggag

SEQ ID NO: 7717 - DNA, 117 bp, Artificial
  Hairpin sequence PT_from_HS_80, chimp
ctggtcgcagcatccggggccgcccctttcgccccgcgcgtggctccggaggcaggtcggcttgcctctggggatccgcgcgcctctgggggtccgcgccggccctgccttctccag

SEQ ID NO: 7718 - DNA, 95 bp, Artificial
  Hairpin sequence PT_from_HS_81, chimp
ctggagacagcgctgaacgaggatggaagtcaaattaggttattcctatggagggatatccggtctttgttttggggccgctggcttacctctgg

SEQ ID NO: 7719 - DNA, 95 bp, Artificial
  Hairpin sequence PT_from_HS_82, chimp
gagccccccatagggtggccctgaccagggctggcaggggcaagtgtggatgcccggctccttgcccaggctgggaccactctgagggacaactc

SEQ ID NO: 7720 - DNA, 86 bp, Artificial
  Hairpin sequence PT_from_HS_83, chimp
ggtggggttgcgggggttagagctgtgggtgatcagaagggaagggcttcatttctacgctctgcctccgctacctcttccccacc

SEQ ID NO: 7721 - DNA, 105 bp, Artificial
  Hairpin sequence PT_from_HS_85, chimp
ggataaagctgggatgtgtcaggtaggcagtgtattgctagcggctgttaataattttaacagttgctagttgcactcctctctgttgcatttcagaagcacgcc

SEQ ID NO: 7722 - DNA, 86 bp, Artificial
  Hairpin sequence PT_from_HS_86, chimp
tgtatgtgtggatggggtgcatgggtgtgtgagtgtgcaagagagaaagtgcacacactcaatcctccaacaccaaccacagaaca

SEQ ID NO: 7723 - DNA, 74 bp, Artificial
  Hairpin sequence PT_from_HS_87, chimp
gccccggcagccaggtctgatggcccagatggcaaccactgcagctggcgtggctgtgggctctgctgtggggc

SEQ ID NO: 7724 - DNA, 107 bp, Artificial
  Hairpin sequence PT_from_HS_89, chimp
caggcgaggggcggggccttgcgggggtggtcgcgggcggcggggaggtctcgcttccctcctctccacccgctcccagtcccggcctgggtctcagccccgccctg

SEQ ID NO: 7725 - DNA, 83 bp, Artificial
  Hairpin sequence PT_from_HS_9, chimp
gtgtcaaatgggatggggtgccgagtgggctggggccaagcaggacccctgacctcactcccgcctctagacatgtactgcac

SEQ ID NO: 7726 - DNA, 96 bp, Artificial
  Hairpin sequence PT_from_HS_91, chimp
atccgtcgcagcagtcgctgcagccgctgcagcccgagccgactgagggcgggaggcagctcgggtggcggggcggggcgaacagcgaggccggat

SEQ ID NO: 7727 - DNA, 110 bp, Artificial
  Hairpin sequence PT_from_HS_92, chimp
ggcgtgcttgggagttggcactaagtacagctgtaattagtcagttttctgtcctgtccacacagaaaactgtctaattacagttgtaagttgtgccagacctaatcgct

SEQ ID NO: 7728 - DNA, 94 bp, Artificial
  Hairpin sequence PT_from_HS_94, chimp
cagatgtctcccgccccttatcctatccagttcccgcattcacactcgttgccaaagagtggggagcgggaatggatacacccgggaacgactg

SEQ ID NO: 7729 - DNA, 78 bp, Artificial
  Hairpin sequence PT_from_HS_95, chimp
gggtgggggcagtgctacagtgttctggtgtcacgcttatcaaccagtgccagctgcactctagcacctcccttccct

SEQ ID NO: 7730 - DNA, 114 bp, Artificial
  Hairpin sequence PT_from_HS_96, chimp; PT_from_HSbrain_1412, chimp
gatctgttcatttatgatctcaccgcgtcctgtgaggttggcattgttgtctggcattgtctgatatacaacagtgccaacctcacgggactcagtgaggtgaaactgaggatt

SEQ ID NO: 7731 - DNA, 96 bp, Artificial
  Hairpin sequence PT_from_HS_98, chimp
gggctggggttcggggacaccctctcagcgctgccctcccccaggctccttctacaagggagtggcagagggagaggtggacccagccttcggccc

SEQ ID NO: 7732 - DNA, 64 bp, Artificial
  Hairpin sequence PT_from_HSbrain_1, chimp
tgtgcttgcgcataactggggccgcctggccccccgcgggcggcctttttaaccgcgagcgaca

SEQ ID NO: 7733 - DNA, 106 bp, Artificial
  Hairpin sequence PT_from_HSbrain_10, chimp
agagactcaggcttggaggggtgggggtggggttgtcagggccaaggcaaaacctctggcccttaaagagctcctgagccaccctgccccccaacccaaggactct

SEQ ID NO: 7734 - DNA, 98 bp, Artificial
  Hairpin sequence PT_from_HSbrain_100, chimp; PT_from_HSbrain_99, chimp
gcgcttctcgaacttctctctcggcggttcaggaggctctgccgcagccggggccctcctgtgacctgcatgtactgggggattcgcagggaggatgt

SEQ ID NO: 7735 - DNA, 116 bp, Artificial
  Hairpin sequence PT_from_HSbrain_101, chimp; PT_from_HSbrain_424, chimp
ctccgactgggttgcattttagtctcttgtttttggggtttggcaagggtacatttacctaggttgatggtaaagtcagagatggggggaggagggatttgcggattcaatcggag

SEQ ID NO: 7736 - DNA, 67 bp, Artificial
  Hairpin sequence PT_from_HSbrain_102, chimp
ccccgcctgcccccagtgggccctccaggtgtctgcagggccctaggtgctggctggccaggtgggg

SEQ ID NO: 7737 - DNA, 88 bp, Artificial
  Hairpin sequence PT_from_HSbrain_103, chimp
gtccaccttccagcagatgtggatcagcaagcaggagtttgatgagtcaggcccctccattgtccaccgcaaatgcttctaggtggac

SEQ ID NO: 7738 - DNA, 98 bp, Artificial
  Hairpin sequence PT_from_HSbrain_104, chimp; PT_from_HSbrain_105, chimp; PT_from_HSbrain_107, chimp; PT_from_HSbrain_108, chimp
tcgctgtccaccttccagcagatgtggatcagcaagcaggagtttgatgagtcaggcccctccattgtccaccgcaaatgcttctaggtggactctga

SEQ ID NO: 7739 - DNA, 74 bp, Artificial
  Hairpin sequence PT_from_HSbrain_109, chimp
cacccggtgaggatatggcagggaaggggagtttccctctattcccttcccccagtaatcttcatcatgcggtg

SEQ ID NO: 7740 - DNA, 104 bp, Artificial
  Hairpin sequence PT_from_HSbrain_11, chimp; PT_from_HSbrain_406, chimp
gatcaaaaggaagaggttttcttcaaaggcaatttttttacttgcttttttccccctgcaggttgaaattctgcctctgagaagctaacagtcttcctgtggtc

SEQ ID NO: 7741 - DNA, 79 bp, Artificial
  Hairpin sequence PT_from_HSbrain_111, chimp; PT_from_HSbrain_16, chimp; PT_from_HSbrain_214, chimp; PT_from_HSbrain_238, chimp; PT_from_HSbrain_706, chimp
cggctgcatttcttcatgcctggctttgccccactgaccagccggggcagccagcagtaccgggccttgactgtggctg

SEQ ID NO: 7742 - DNA, 61 bp, Artificial
  Hairpin sequence PT_from_HSbrain_113, chimp
gagcgcagctcctgcctttgcaggaaaagtttgctatttttgcaggcggtagttgaggttt

SEQ ID NO: 7743 - DNA, 89 bp, Artificial
  Hairpin sequence PT_from_HSbrain_115, chimp
cctgcgatcctgtttaggcttctctcctggatcctggataatgtttccagggtgttaggaaggcctgcgtctcaggtcacaattgtggg

SEQ ID NO: 7744 - DNA, 90 bp, Artificial
  Hairpin sequence PT_from_HSbrain_1174, chimp
ggcacaatgttatactggagagcaggaagagctgttgcatataagtaacagacttttctttatcttctatgtgactgtttgcattgtgct

SEQ ID NO: 7745 - DNA, 79 bp, Artificial
  Hairpin sequence PT_from_HSbrain_120, chimp
gccggcacccgagatagcccagcagccagtgcctgagatagcccagcagctggcacctgagccatctctggcagccggc

SEQ ID NO: 7746 - DNA, 80 bp, Artificial
  Hairpin sequence PT_from_HSbrain_122, chimp
tggagactgcctggctgtgtcctctcagccaggtgccgtgttggcctcggctgggacccagagccacactgcagcctccg

SEQ ID NO: 7747 - DNA, 89 bp, Artificial
  Hairpin sequence PT_from_HSbrain_123, chimp
tccggccactgaggacatgcagcctgcagggtccaggcctgtccagggcctgggaaatgctgggggcaaggatggaaggtggcagtggg

SEQ ID NO: 7748 - DNA, 76 bp, Artificial
  Hairpin sequence PT_from_HSbrain_1236, chimp
gcagtcgctgcagccgctgcagcccgagccgactgagggcgggaggcagctcgggtggcggggcggggcgaacagc

SEQ ID NO: 7749 - DNA, 86 bp, Artificial
  Hairpin sequence PT_from_HSbrain_124, chimp
tctttcttgaggccaggctgtggctgtggagtgcacgggaggctccaggggcctatgctgttcagtgacaaactggcccacgtgga

SEQ ID NO: 7750 - DNA, 116 bp, Artificial
  Hairpin sequence PT_from_HSbrain_129, chimp
tcaaaaggagtctactcttcatcttgtgttgagacttcgtggtggtgctaagaaaaggaagaagtcttacaccactcccaagaagaataagcacaagagaaagaagactaagctgg

SEQ ID NO: 7751 - DNA, 115 bp, Artificial
  Hairpin sequence PT_from_HSbrain_13, chimp; PT_from_MQbrain_2441, chimp
gagggctctgtcccctaggcatggaatcttgcggcatccacgaggccgccttcaactccatcatgaagtgtgacgtggacatccgcaaagacctgtatgccaacacggtgctgtc

SEQ ID NO: 7752 - DNA, 117 bp, Artificial
  Hairpin sequence PT_from_HSbrain_132, chimp
ggcagctgccctcactgaggtgtcgttcccacagctacctcgggctcgggctgatgtcggcacgcctggcgatcctgggcggcgtggaggggcagcctggtgagtggacatgttgcc

SEQ ID NO: 7753 - DNA, 76 bp, Artificial
  Hairpin sequence PT_from_HSbrain_134, chimp
ggttcgcgggggagagcgagggtttccgccggccaccgcggtggtggccgagcgcggctcgtcgcctactgtggcc

SEQ ID NO: 7754 - DNA, 79 bp, Artificial
  Hairpin sequence PT_from_HSbrain_135, chimp
cctgtagcatctttgccttgggctgctcctcatggcgggttcaggggactcagccctgaggtgaaagggagctatcagg

SEQ ID NO: 7755 - DNA, 115 bp, Artificial
  Hairpin sequence PT_from_HSbrain_137, chimp
cggagctgcagctgctggagaaggtgcccacgctggagcggctgcgggccgcccagaagcgccgggcccagcagctgaagaaatgggcacagtacgagcaggacttgcagcaccg

SEQ ID NO: 7756 - DNA, 104 bp, Artificial
  Hairpin sequence PT_from_HSbrain_1377, chimp
gtctgcacctccaggcaggatctgtgcagtactcaccccctccgtctgctccctccaaggtgtgggggtgggcagtgctcagggcctcctcggagccaaaggac

SEQ ID NO: 7757 - DNA, 78 bp, Artificial
  Hairpin sequence PT_from_HSbrain_138, chimp
gagcgggagttggcatgtgggtggctgatggctggtagctgtccacagccatgagccagtgtgtcatgtccacagctt

SEQ ID NO: 7758 - DNA, 118 bp, Artificial
  Hairpin sequence PT_from_HSbrain_14, chimp
gcttctcgaggctccggcggctcagctcactggcttctcgaggctccggcggctcagctcactggcttctcgaggcttctggaggctccggtggctcagctcactggcttctggaggc

SEQ ID NO: 7759 - DNA, 63 bp, Artificial
  Hairpin sequence PT_from_HSbrain_1409, chimp
tgtccgaagctctaaggttccgcctgcgagcaggaagcggaggaaccttggagctcttcagca

SEQ ID NO: 7760 - DNA, 105 bp, Artificial
  Hairpin sequence PT_from_HSbrain_1419, chimp
ggttgccaaccctactctgggaaggtgccattctgagggccaggagtttgattatgtgtcactctggctgctatggccccctcccagggtctgggcatcacaccc

SEQ ID NO: 7761 - DNA, 111 bp, Artificial
  Hairpin sequence PT_from_HSbrain_1420, chimp
ggaggtggagttcgaaggggaggagagatgtgagcgaggcagccagggaagctctgctcgcccactgcccaatcctcacctctcttctcctccaccttctgtctctgccct

SEQ ID NO: 7762 - DNA, 87 bp, Artificial
  Hairpin sequence PT_from_HSbrain_1426, chimp
cactagcccagggcttggagtggggcaaggttattggtgatatgacttcctctcccttcctgccctggctaggccctggagcgactg

SEQ ID NO: 7763 - DNA, 77 bp, Artificial
  Hairpin sequence PT_from_HSbrain_143, chimp
ctgtgagggtgaagggccctgggctgggtcaggctgaaatgggtccctctccccagcccttggctctgtcatcatgg

SEQ ID NO: 7764 - DNA, 86 bp, Artificial
  Hairpin sequence PT_from_HSbrain_144, chimp
ggtcccctgggctcgggctccacatcagtcctgagctgctggcaagcacccctggcctgcagccagggagagccagagcctttgcc

SEQ ID NO: 7765 - DNA, 94 bp, Artificial
  Hairpin sequence PT_from_HSbrain_145, chimp
ctcctgctctggggagtctaggccgtggggactgttctggggaggcccatgctgtctccatgacgtctgtggcaggagtccctgaggacgggag

SEQ ID NO: 7766 - DNA, 111 bp, Artificial
  Hairpin sequence PT_from_HSbrain_149, chimp
ctagggccgattggctcactcctgggttccgccagcctagaggctgtgccctgatgccctgggcagccttttgggctgagttttcacaggtgaaccaagtcccagccttgg

SEQ ID NO: 7767 - DNA, 116 bp, Artificial
  Hairpin sequence PT_from_HSbrain_15, chimp
ctggcttctcgaggccccggcggctcagctcactggcttctcgaggctccggcggctcagcgcactggcttctcgaggctccggcggctcagctcactggcttctcgaggctccgg

SEQ ID NO: 7768 - DNA, 112 bp, Artificial
  Hairpin sequence PT_from_HSbrain_150, chimp
tcctggttcaagcagtgttctttctctatcaggcctggtggctgttgcatggggctccccaaggcaaggggtggccccaggccagtgggttggaagacagggtgaccagaga

SEQ ID NO: 7769 - DNA, 90 bp, Artificial
  Hairpin sequence PT_from_HSbrain_151, chimp
ctggtgtgagggaagagggaaaggaaggacacattgaacgatcccaatggcttgtctcatggtgacctctcccttcctgccctggcctgg

SEQ ID NO: 7770 - DNA, 68 bp, Artificial
  Hairpin sequence PT_from_HSbrain_152, chimp
gtgtgtgtgggcacacagccaggcaggaggcacacggaggcctgcccgcttgctgtgcccatagacgc

SEQ ID NO: 7771 - DNA, 98 bp, Artificial
  Hairpin sequence PT_from_HSbrain_153, chimp
tcgctgtccaccttccagcagatgtggatcagcaagcaggagtatgatgagtcaggcccctccattgtccaccgcaaatgcttctaggtggacgctga

SEQ ID NO: 7772 - DNA, 64 bp, Artificial
  Hairpin sequence PT_from_HSbrain_155, chimp
gggggcggtgtgggctgcaggaggctgctgtccctggagcctcccagttccagaccaggacccc

SEQ ID NO: 7773 - DNA, 80 bp, Artificial
  Hairpin sequence PT_from_HSbrain_159, chimp
ggggaacccagctggcccaggatttgtggattgcttaaaaagatccttttgggcagcctgaagactggggagggttttcc

SEQ ID NO: 7774 - DNA, 84 bp, Artificial
  Hairpin sequence PT_from_HSbrain_162, chimp
cccttaggggatagagtgcaagggaaatgggacagaaggggtgtttttcctcctgtcttcctcttcccattctcctcttttggg

SEQ ID NO: 7775 - DNA, 120 bp, Artificial
  Hairpin sequence PT_from_HSbrain_164, chimp
caggtgtagagtcggcacctggccagaggagaggataggggttgcttcctcgaggccagcgtggtctgcactgctgcctgggccctctgccttccttctggccagcgtgggaggcagctg

SEQ ID NO: 7776 - DNA, 119 bp, Artificial
  Hairpin sequence PT_from_HSbrain_167, chimp
gctggagccagttggggagcacggttctgggagctctgcaaaatcagtagcaagtgctgggaaaggcgcatgctgaagatactcaagagctcccaagatttgcttgaggctagcccagt

SEQ ID NO: 7777 - DNA, 107 bp, Artificial
  Hairpin sequence PT_from_HSbrain_17, chimp
cgggtcatggcacagagcatccttgtgaacccagaatctctctgtcacatgtgtggggtacagagggcaagagggagggtcgccttggatgctgtgctacaagtctg

SEQ ID NO: 7778 - DNA, 119 bp, Artificial
  Hairpin sequence PT_from_HSbrain_171, chimp
aggatagctgtgtttgcacaccatgctccatgttcatttggagccaggagggcttctcagtggagcctggcttagggaacagggagcgatggaagaatgccaacattagcgttggtctt

SEQ ID NO: 7779 - DNA, 95 bp, Artificial
  Hairpin sequence PT_from_HSbrain_172, chimp
cccagcaagacatgggccccagtttccaaaccctgacacctctcatttaaccagaagacgtggaggggtgagttggagacgggggcttgactggg

SEQ ID NO: 7780 - DNA, 112 bp, Artificial
  Hairpin sequence PT_from_HSbrain_174, chimp
ggcattgtgggtctttgaagttgctgggataaattaatataattaaataaaagactgaatttaattgtgtaagttgtatttggtggcaattaacaaaaggacccagatggct

SEQ ID NO: 7781 - DNA, 79 bp, Artificial
  Hairpin sequence PT_from_HSbrain_177, chimp
gggcgccactgctgcctgccatcctcagacagcctcagcttggctgacgtctggatgagatgaggctcaggagcaaacc

SEQ ID NO: 7782 - DNA, 98 bp, Artificial
  Hairpin sequence PT_from_HSbrain_18, chimp
gcagtgcgcgtggccgtggcggctggtgtggggttgagtcagttgtgggacccggagctgctgacccagcgggtggcccaccgaaccggtgacacagc

SEQ ID NO: 7783 - DNA, 118 bp, Artificial
  Hairpin sequence PT_from_HSbrain_181, chimp
ttagttcagaaataccatactgtgaatggccacaactgtgaagttagaaaagccctgtcaaagcaagagatggctagtgcttcatccagccaaagaggtatgcttgttgcttaattaa

SEQ ID NO: 7784 - DNA, 61 bp, Artificial
  Hairpin sequence PT_from_HSbrain_182, chimp
ggccttctctgttttattgcaccctctagtggaggagaaggtgaaggagcagctggaggcc

SEQ ID NO: 7785 - DNA, 81 bp, Artificial
  Hairpin sequence PT_from_HSbrain_188, chimp
cgtcacagccatcatcttctgtgtagccttgagcgcctatgacttggtgctagctgaggacgaggagatggtgagaggatg

SEQ ID NO: 7786 - DNA, 88 bp, Artificial
  Hairpin sequence PT_from_HSbrain_19, chimp
ggggcagctgtgtgagtcccacatcctgggcagagggcctggtggggccccttgctaggagaagggaagacgcctgagatgctgcttc

SEQ ID NO: 7787 - DNA, 68 bp, Artificial
  Hairpin sequence PT_from_HSbrain_192, chimp
gggacctggaggaggctggatggagtgctctgcaggcagaacaagccacagcctggactccagtttcc

SEQ ID NO: 7788 - DNA, 104 bp, Artificial
  Hairpin sequence PT_from_HSbrain_194, chimp
ggacttggactgtgggctcttgggggacaaggttggaaaagcttccctgtatcctactctggcaggggagctagtctaggtcctcaggtgtaacacccaagttt

SEQ ID NO: 7789 - DNA, 103 bp, Artificial
  Hairpin sequence PT_from_HSbrain_195, chimp
gttggggtgtggggtgctagaggccttgctgctgaggaaagttaccatggttaccagcaccgtggctctcagaaggagaaggctagcatgttagcacctcagc

SEQ ID NO: 7790 - DNA, 96 bp, Artificial
  Hairpin sequence PT_from_HSbrain_201, chimp
ggaaaatgatactctagcacagaattcagtggaatccttagggcccatgcccaaatcttctccattgcttctcaggttagaatgatcttcacctcc

SEQ ID NO: 7791 - DNA, 76 bp, Artificial
  Hairpin sequence PT_from_HSbrain_208, chimp
acatggtgtagttaagctctacccccgtggtggatagagccataccacggggaagccaagagcttgccacttttgt

SEQ ID NO: 7792 - DNA, 118 bp, Artificial
  Hairpin sequence PT_from_HSbrain_21, chimp; PT_from_HSbrain_576, chimp; PT_from_HSbrain_623, chimp
gaggcagaggagaggcaaggccggtggcccccggcgtccagggacctggcagccaccactgaggcccacctgcttgtccctcagccgggtgctcactggcagccacactccaggtctc

SEQ ID NO: 7793 - DNA, 118 bp, Artificial
  Hairpin sequence PT_from_HSbrain_213, chimp
gtccatagtgtttgcagaaaaatccgactcagaggacagagtgccacttactgaaaggtttttttctctcggtaagtggcactctgtcttctgagttggtacctgtggaccattggat

SEQ ID NO: 7794 - DNA, 86 bp, Artificial
  Hairpin sequence PT_from_HSbrain_216, chimp
ctgcagccaccaactgccttctgcattcctgcgtgtgctgtgggagctgcggggacagcagggaggacgtggtggagcgtctgcgg

SEQ ID NO: 7795 - DNA, 114 bp, Artificial
  Hairpin sequence PT_from_HSbrain_217, chimp
gagacagcaggggtgggtggggtccgcaggaggccaaggcaggaagtgagcaggaccgtcccatcctcactccctgccaggcctcctgctgacccagcgtgcccactgcagctc

SEQ ID NO: 7796 - DNA, 113 bp, Artificial
  Hairpin sequence PT_from_HSbrain_218, chimp
gtgcctcttagtggccacggtgggcgccctgccctgttcctccaccttgtgctgaggaagctttgacgtgggtgacagggcacgcagccccatgtggcccacgtgactggtac

SEQ ID NO: 7797 - DNA, 114 bp, Artificial
  Hairpin sequence PT_from_HSbrain_219, chimp
cttcgttcccaggagcggccattgtccctgttgggccctccttcaggctgtcagatgtgtctacctttccttctgttcctgactggggcctggtggctggccctggagatgagg

SEQ ID NO: 7798 - DNA, 88 bp, Artificial
  Hairpin sequence PT_from_HSbrain_220, chimp; PT_from_MQbrain_2630, chimp
tcgctctgcttggtggcttcaggagtgcggccctccccaggactccacttcatcctgggcttgcaccctccttgagccaatgcactga

SEQ ID NO: 7799 - DNA, 89 bp, Artificial
  Hairpin sequence PT_from_HSbrain_222, chimp
ttgattatatcagctgagctagggatatctcctgagaatgtctcctccctattctcaggaaaaatccctagcttggttgaagtcatcag

SEQ ID NO: 7800 - DNA, 101 bp, Artificial
  Hairpin sequence PT_from_HSbrain_225, chimp
catgaccagtactgaaattgtgtgcccaggatttagccaagtggttctcactctttccttccacttagctaggtcctgacatatttcttactcctgcgatg

SEQ ID NO: 7801 - DNA, 117 bp, Artificial
  Hairpin sequence PT_from_HSbrain_228, chimp
ctgcacttacctttctgctctgagaagcacagctacctgccttcactgaaatatacctcgggctgagagatttgggttgggagagcaggtcagttcatcttctgcaggaaggtgcag

SEQ ID NO: 7802 - DNA, 116 bp, Artificial
  Hairpin sequence PT_from_HSbrain_23, chimp
ctgaccttttcaatattctaatctttgctttgctgacctctcaggcctcttcctggcaacagttaggcttttgagaggagggagagctgagactgttgggtaagtgaacagagtgg

SEQ ID NO: 7803 - DNA, 115 bp, Artificial
  Hairpin sequence PT_from_HSbrain_230, chimp
ctgtcgaaatgcaccatgaagctttgagtgaagttcttcctggggacaatgtggccttcgatgtcaagaatgtgtctgtcaaggaggttcatcatggcaatgttgctggtgacag

SEQ ID NO: 7804 - DNA, 66 bp, Artificial
  Hairpin sequence PT_from_HSbrain_231, chimp
cagggcctccgctggggccaggaggtgacgaacagtggccggctctccccaggcaaggaggcgatg

SEQ ID NO: 7805 - DNA, 77 bp, Artificial
  Hairpin sequence PT_from_HSbrain_232, chimp
ggagggattcctggagaagctgcagtgtggggatgctctagaccgagtactgcccccagtgtctttccacctcctcc

SEQ ID NO: 7806 - DNA, 116 bp, Artificial
  Hairpin sequence PT_from_HSbrain_233, chimp; PT_from_HSbrain_779, chimp
tctgtgtgaccgtcatgcaggcctgtctgtgtgaccgtcaggaggcctgtctgtgtgaccgtcaggaggcctgtctgtgcgaccgtcatgcaggcctgtctgtgtgatcgtcagga

SEQ ID NO: 7807 - DNA, 114 bp, Artificial
  Hairpin sequence PT_from_HSbrain_234, chimp
catgcaggcctgtctgtgtgaccgtcaggaggcctgtctgtgcgaccgtcatgcaggcctgtctgtgtgatcgtcaggaggcctgtctgtgcgaccatcatgcaggcctgtctg

SEQ ID NO: 7808 - DNA, 114 bp, Artificial
  Hairpin sequence PT_from_HSbrain_235, chimp; PT_from_HSbrain_236, chimp
tctgtgcgatcgtcaggaggcctgtctgtgtgaccgtcatgcaggcctgtctgtgcgaccgtcaggaggcctgtctgtgtgaccgtcaggaggcctgtctgtgtgaccgtcagg

SEQ ID NO: 7809 - DNA, 81 bp, Artificial
  Hairpin sequence PT_from_HSbrain_237, chimp
atttatttatttcatggtttagccatcctatcaatatttcccttaattgataggatggctgaaccatgaaataaattaaat

SEQ ID NO: 7810 - DNA, 84 bp, Artificial
  Hairpin sequence PT_from_HSbrain_239, chimp
gggatcagtgttgggcctctgagccaaagcaggccaggctgtaggctggccagcaaagtggctggcaggaagagatgagatgtc

SEQ ID NO: 7811 - DNA, 117 bp, Artificial
  Hairpin sequence PT_from_HSbrain_240, chimp
agatgcaaagttttctttttcttttggtgaggacaggagggtgggagtctttacagtgacaaattttggctcccactctcctctccccaccaaaagaaaaataaaatctgtgcatct

SEQ ID NO: 7812 - DNA, 65 bp, Artificial
  Hairpin sequence PT_from_HSbrain_241, chimp
gcagacaaagagctgtggtagaaagtaaggttgcaaatcactttctaccacagctgtttgtttgc

SEQ ID NO: 7813 - DNA, 103 bp, Artificial
  Hairpin sequence PT_from_HSbrain_242, chimp
gttcaataagagtttatagtaagaagaattggcctactcaggtgtcagcaaagccttcctctctgaataggtcagttcccctcactataaactttttcagaac

SEQ ID NO: 7814 - DNA, 76 bp, Artificial
  Hairpin sequence PT_from_HSbrain_246, chimp
ctccttctctctgccattgacccattattgatttcttgggagagatcaataatgggccaatggcagagagaaggag

SEQ ID NO: 7815 - DNA, 113 bp, Artificial
  Hairpin sequence PT_from_HSbrain_251, chimp
ggcaccagggcgtgatggtgggcatgggtcagaaggattcctatgtgggcgacgaggcccagagcaagagaggcatcctcaccctgaagtaccccattgagcatggcattgtc

SEQ ID NO: 7816 - DNA, 118 bp, Artificial
  Hairpin sequence PT_from_HSbrain_253, chimp
gctatcacttggaggtgaacagcctcttttgccggtattcagtgaagaaaggcaagtctaaatatgcagttctctcactggagtgaaagatgttttgttcatttctaatcaactatgc

SEQ ID NO: 7817 - DNA, 93 bp, Artificial
  Hairpin sequence PT_from_HSbrain_254, chimp
gaattcatccatgcctgggactggaacacatatatacggttttggagaaaaccccaagagcatatacatgtgctccagtccccatctgttttt

SEQ ID NO: 7818 - DNA, 78 bp, Artificial
  Hairpin sequence PT_from_HSbrain_255, chimp
caagaagctaagtgccaggatggctgcatggctaaggagaaacacatagcttgtggctatctttcagcactcctcttg

SEQ ID NO: 7819 - DNA, 88 bp, Artificial
  Hairpin sequence PT_from_HSbrain_258, chimp
ttttgctcgctttctacgctgtcacgtctccatcctgcaacactgaatacgtagatggaacgtggatcagctaataactgcagcaaaa

SEQ ID NO: 7820 - DNA, 116 bp, Artificial
  Hairpin sequence PT_from_HSbrain_261, chimp
tttgtgggtcgggatgattttgatgatgctgaccagctgaggataggaaatgatgggattttcatgttaacttttttcagtaagtatgtatgcatatcagaaccacgccctacaaa

SEQ ID NO: 7821 - DNA, 99 bp, Artificial
  Hairpin sequence PT_from_HSbrain_268, chimp
ggtgtgttggagcctgcagggcaggtcaggctggttcagaggcccatgctgaggggtgggtgctctgaagtggagtgaagcctcaagcccatgaatgcc

SEQ ID NO: 7822 - DNA, 85 bp, Artificial
  Hairpin sequence PT_from_HSbrain_269, chimp
cacccctccgtttgcgccagttgcctgcaggttggatggaacacagtgccccacttttctgcaagtagctggcttgtaaagggtg

SEQ ID NO: 7823 - DNA, 91 bp, Artificial
  Hairpin sequence PT_from_HSbrain_271, chimp
cctggagaacttctacgctgactactataccacggccagcatcgcgctggtgtcctgcctggccatgtgcgtggtggtccggttcctcggg

SEQ ID NO: 7824 - DNA, 72 bp, Artificial
  Hairpin sequence PT_from_HSbrain_273, chimp
cctgccctcaaaccttgcctgccacctccccattcaggcatggtggcaggaagggacaagctgtggagctgg

SEQ ID NO: 7825 - DNA, 65 bp, Artificial
  Hairpin sequence PT_from_HSbrain_274, chimp
ttcctaggggtctttttaacatgtatatgtgtaaatacttacatattgaaacaggctcctgggga

SEQ ID NO: 7826 - DNA, 73 bp, Artificial
  Hairpin sequence PT_from_HSbrain_275, chimp
gcgtggagggcccgggaaggcggcctagggacgcaagcaggctcggccgcctctttaggccacggagctgcgc

SEQ ID NO: 7827 - DNA, 110 bp, Artificial
  Hairpin sequence PT_from_HSbrain_278, chimp
ccagtgcagtggggctccgctgatgctcaggatcaccagcgtgcagcggggactccactgatgcctgggattgattgccagcgtgcagcggggactccactgatgcctgg

SEQ ID NO: 7828 - DNA, 95 bp, Artificial
  Hairpin sequence PT_from_HSbrain_280, chimp
cactgtgggctgggccagggagcagctggtggctgggaagtaagatctgacctggaccccatcccacctaccccctgtttcctggcccacaggtg

SEQ ID NO: 7829 - DNA, 106 bp, Artificial
  Hairpin sequence PT_from_HSbrain_281, chimp
gaatggattccctcaagtgggaccagcctatctctagcactcaagagtctgggagactggaggctggaggggccagtcccaaactcggatgggatcatgtggattc

SEQ ID NO: 7830 - DNA, 118 bp, Artificial
  Hairpin sequence PT_from_HSbrain_282, chimp
catttcgtgctggagtggagcagcctctagaacgagctggaggattctgcctaccgatacagagccttcgagtcgtccggggccgccattacaatccacctccatccacttggaaatg

SEQ ID NO: 7831 - DNA, 68 bp, Artificial
  Hairpin sequence PT_from_HSbrain_284, chimp
ctccgaggttctagggcagggaagtggggaggggaggttccctgagatctctgtctttgagtttggag

SEQ ID NO: 7832 - DNA, 62 bp, Artificial
  Hairpin sequence PT_from_HSbrain_289, chimp
tgcccgtggaggatggagcatctgtatctgctccagaaggtgcagatgcccagacctcggca

SEQ ID NO: 7833 - DNA, 77 bp, Artificial
  Hairpin sequence PT_from_HSbrain_293, chimp
ggattggctactccatcctggcctccacgtccaccttccagcagatgtggatcagcaagcaggagtaggacgagtcc

SEQ ID NO: 7834 - DNA, 76 bp, Artificial
  Hairpin sequence PT_from_HSbrain_295, chimp
ctcttttatgtagttacatctccacttactgaaatgttgagatttcagtaagtggagatgtaactacataaaagag

SEQ ID NO: 7835 - DNA, 111 bp, Artificial
  Hairpin sequence PT_from_HSbrain_298, chimp; PT_from_HSbrain_416, chimp
tgaggactttttctctgcccttcgtcaatatgcagcctgtgaacagcgtctgggaaagtagtggtcattggttgcataatttgatttgaggcttgtggaggaaaggaccca

SEQ ID NO: 7836 - DNA, 119 bp, Artificial
  Hairpin sequence PT_from_HSbrain_299, chimp
cggggcagtgctgcccgggccaggcggagcagggaggacgtggtggggtgtttggaaggcggagcaagaacctaataaatgtgagccctggactctgaggccgggcagtgaatgttctg

SEQ ID NO: 7837 - DNA, 87 bp, Artificial
  Hairpin sequence PT_from_HSbrain_30, chimp
gggaacagccctcctgcgggaggctggggaggggggcgggcctgcggttccaggctcctctctctcaccctcctgtcagggcctccc

SEQ ID NO: 7838 - DNA, 116 bp, Artificial
  Hairpin sequence PT_from_HSbrain_300, chimp; PT_from_HSbrain_301, chimp; PT_from_HSbrain_403, chimp; PT_from_HSbrain_788, chimp
ggtgagcgcacactgggacactatgatgaggctaggtgagcgcacactggggcactatcatgaggctaggtgagcgcagactggggcactatgatgaggctaggtgagcgcacact

SEQ ID NO: 7839 - DNA, 104 bp, Artificial
  Hairpin sequence PT_from_HSbrain_303, chimp
catctactggcactgccaaggctgtgggcaaggtcatccctgagctgaacaggaagctcactggcatggccttccatgtccccatcgccaatgtgtcagttatg

SEQ ID NO: 7840 - DNA, 120 bp, Artificial
  Hairpin sequence PT_from_HSbrain_305, chimp; PT_from_HSbrain_306, chimp
gctgacggaggaggggtgctggtctgccttctctgtgagctgagctttgggtactgcaccatcctgctttgtgtgaggctgctgatggaggaggggtgctggtttgccctccctgtgagc

SEQ ID NO: 7841 - DNA, 118 bp, Artificial
  Hairpin sequence PT_from_HSbrain_307, chimp
ctgacggaggaggggtgctggtctgccttctctgtgagctgagctttgggtactgcaccatcctgctttgtgtgaggctgctgatggaggaggggtgctggtttgccctccctgtgag

SEQ ID NO: 7842 - DNA, 112 bp, Artificial
  Hairpin sequence PT_from_HSbrain_309, chimp
ctgccctgttctccaccctgggcctcaccggagctttgccagagcagcacttgagccgggggccatagtgcttgtggacaaggacggcgaggccaaggagagccagcagcag

SEQ ID NO: 7843 - DNA, 107 bp, Artificial
  Hairpin sequence PT_from_HSbrain_312, chimp
ctgcttttctcttgttctctccctgtagttactgggtcttccggatgcagatgacgatgcgtttgaagagtacagtgctgacgtggaagaagaggagccagaggcgg

SEQ ID NO: 7844 - DNA, 89 bp, Artificial
  Hairpin sequence PT_from_HSbrain_313, chimp
ctgattcctctcatttccagcttctcagtttctgcctgggcaatggccaggggccaggagtggggagagttgtgatggaggggagaggg

SEQ ID NO: 7845 - DNA, 114 bp, Artificial
  Hairpin sequence PT_from_HSbrain_315, chimp
atttttgggtggtgggtgaggggctgcgtgagagagggaggctgggggaggattactcttcgggtggccccaccctcactcattcccatcccctcatccttctaggacagaagt

SEQ ID NO: 7846 - DNA, 109 bp, Artificial
  Hairpin sequence PT_from_HSbrain_316, chimp
cagtgctttgacctggagtcgtatctgcagctcaactgtgagcgggggacttggaggtgtcctgtgtgcaagtgagtctcagatgcagcgtgtgatggaggaggggctg

SEQ ID NO: 7847 - DNA, 115 bp, Artificial
  Hairpin sequence PT_from_HSbrain_318, chimp
gacacccaggaccctggtcagtccatggaagggcctgggaggatgtgggccagacagagggaactccttgggctgtgtccccagcagccctacgtggtgagcagagtcccgagtc

SEQ ID NO: 7848 - DNA, 103 bp, Artificial
  Hairpin sequence PT_from_HSbrain_319, chimp
agctctgtcagggccccattcccagcagaggcttcaggtgctttgtgtagagtccagggcagccggagctttgttggggagacttctggacccaaagggagct

SEQ ID NO: 7849 - DNA, 99 bp, Artificial
  Hairpin sequence PT_from_HSbrain_322, chimp
ccactgtctgaggcctctcctgcccgcttcccatgcagaagaaatcatgatcatcatctgctgtgtgatcctgggcatcgtcatcgcctccactgttgg

SEQ ID NO: 7850 - DNA, 67 bp, Artificial
  Hairpin sequence PT_from_HSbrain_324, chimp
ggctgtggtagacggaggtgccatcccagcattcatttctctgttggcatctccccatgctcacatc

SEQ ID NO: 7851 - DNA, 80 bp, Artificial
  Hairpin sequence PT_from_HSbrain_325, chimp
tttcttgtcatgtcagaatgggatagaaaaacatctcctgagagagacgtttgaggattccaatctgatacccaaagaga

SEQ ID NO: 7852 - DNA, 104 bp, Artificial
  Hairpin sequence PT_from_HSbrain_327, chimp
tgtttctgggctcctaggcctgtatgaactcaatctcaccaccgatagccctgccaccacgggagcggtggtgaccatctcggccagcctggtggccaaggaca

SEQ ID NO: 7853 - DNA, 81 bp, Artificial
  Hairpin sequence PT_from_HSbrain_328, chimp
tggcgaagatggcggaggtgcaggtcctggtgcttgatggtcgaggccatctcctgggccgcctggcggccatcgtggcta

SEQ ID NO: 7854 - DNA, 97 bp, Artificial
  Hairpin sequence PT_from_HSbrain_33, chimp
tcttcatgggttaccagaacgtggaggatgaggccgagaccaagaaggtgctgggccttcaggataccatcacggcggagctggtggtcatcgaaga

SEQ ID NO: 7855 - DNA, 74 bp, Artificial
  Hairpin sequence PT_from_HSbrain_332, chimp
cctcagcgcccaggagctgcggtccggagccggccccgagctgggcccaggtcgcaggctcctcaggccaaagg

SEQ ID NO: 7856 - DNA, 77 bp, Artificial
  Hairpin sequence PT_from_HSbrain_335, chimp
tggctctggcttgggactggactggggctggccggataactccgcagccgctctcagctcaatcctgggtggaaacg

SEQ ID NO: 7857 - DNA, 93 bp, Artificial
  Hairpin sequence PT_from_HSbrain_341, chimp
ctacacatctgcattgctctcatggtagctatgtggaggttcagttcccatacacatctgcattgctctcatgatagctgtgtggaggttgag

SEQ ID NO: 7858 - DNA, 92 bp, Artificial
  Hairpin sequence PT_from_HSbrain_35, chimp
gctgatctctgagaccatggtccgatgggctcaggagtctgtcattgaagaccccgagctggtgagggccatgtttgtgttgctccatcggc

SEQ ID NO: 7859 - DNA, 90 bp, Artificial
  Hairpin sequence PT_from_HSbrain_350, chimp
gcctgctcgctgcctttgaccagtggagggaatgggccgacagcaagtcctgctgtgactactctctgcatgtggacatcagcgagtggc

SEQ ID NO: 7860 - DNA, 97 bp, Artificial
  Hairpin sequence PT_from_HSbrain_354, chimp
ccttgggaaatataaatgcaagtaaaacaggtttgaacttcttaacttccagaagataggaggatgggacctgtgatactgtgctgctggtgggagg

SEQ ID NO: 7861 - DNA, 114 bp, Artificial
  Hairpin sequence PT_from_HSbrain_355, chimp
aggactctgaggagtactcttgctccacggattaaactctcagcagcaacttcaacaatcatttttctataggggcctgggaggaattctggaggagagtaaagtcgaagttct

SEQ ID NO: 7862 - DNA, 54 bp, Artificial
  Hairpin sequence PT_from_HSbrain_358, chimp
gcctctgaagcctcatggaggacatgtggtcagtcctccttgagattcttaggc

SEQ ID NO: 7863 - DNA, 55 bp, Artificial
  Hairpin sequence PT_from_HSbrain_36, chimp
gcctccggaagctgttgtctcctctctggggacagcagctcctgcctttggaggc

SEQ ID NO: 7864 - DNA, 83 bp, Artificial
  Hairpin sequence PT_from_HSbrain_361, chimp
tttggggtgatgggtggggcaatgggatcaggtgcctcaaagggcatcccacctgatcccacagccccacctgtcaccccaaa

SEQ ID NO: 7865 - DNA, 107 bp, Artificial
  Hairpin sequence PT_from_HSbrain_364, chimp
tgcaggtggggaggggccctcctacacagcctcttttcctgcagcattctggatggccactgtggtgtgaaaggaggaatacgagggaggtgcacagtcatcatgca

SEQ ID NO: 7866 - DNA, 108 bp, Artificial
  Hairpin sequence PT_from_HSbrain_365, chimp
cctgggttccagacaccccgaccccccaccaggcccacagtgtgaatcctgaacccatcagggaggcagggataggtgggccaccggggtgtgggtgctgagctgggg

SEQ ID NO: 7867 - DNA, 94 bp, Artificial
  Hairpin sequence PT_from_HSbrain_369, chimp
gtgtaatctttcttagctgagaacgttatggaacaaaggcccgcaagggcctggcagttgagacacttcaggcagttaagaaaattcatttcac

SEQ ID NO: 7868 - DNA, 96 bp, Artificial
  Hairpin sequence PT_from_HSbrain_373, chimp
ctgaggagagggcagtcagggcatgaagctgcagtcgccaccgctgcttctgcaaaatctaagcactgggctgcagccatgtcctactgccagcag

SEQ ID NO: 7869 - DNA, 107 bp, Artificial
  Hairpin sequence PT_from_HSbrain_374, chimp
agttgaagtgttattttggaaactgagatggggttcctggagtcttgatcttctcactttacctactctcagactcccaccccctccaccccaccccacacttgact

SEQ ID NO: 7870 - DNA, 117 bp, Artificial
  Hairpin sequence PT_from_HSbrain_375, chimp
ctcgctggctgcttcgctcgcgctctacgcgctcagtccccggcggtagcaggagcctggacccaggcgccgccggcgggcgtgaggcgccggagccccggtgagcagcgcagatag

SEQ ID NO: 7871 - DNA, 109 bp, Artificial
  Hairpin sequence PT_from_HSbrain_376, chimp
aagaatgaggggtgggagggatttatagttagaaacgacagtgcaggaaggggtattttcttgttgtcggggctggaatgaatcactgctgctcaagtcaaaggttctt

SEQ ID NO: 7872 - DNA, 118 bp, Artificial
  Hairpin sequence PT_from_HSbrain_378, chimp
tttcagttttgaggctcctgtcctcaggcagtgtggactcaggccctgggagtcatgtggatgccagtagcctgggcccacagagctgctgggacgtggggggcatatcaagttgaag

SEQ ID NO: 7873 - DNA, 91 bp, Artificial
  Hairpin sequence PT_from_HSbrain_379, chimp
ggctcggctcgggccttgctgggactcgggctcccagggtctgctcggtctctctcggggcacacgggtcttgctgggcccggcgccggcc

SEQ ID NO: 7874 - DNA, 77 bp, Artificial
  Hairpin sequence PT_from_HSbrain_38, chimp
cgggactttgtggaggcgccctcgcagatgctggagaactgggtgtgggagcaggagccgctgctgcggatgtcgcg

SEQ ID NO: 7875 - DNA, 106 bp, Artificial
  Hairpin sequence PT_from_HSbrain_380, chimp
cggagcagcccttgcccctcagagcacactccctccatcaccccagcagcggctctcctgatattggtattggcgagtgtgtgcgtgcctggcgcagcgtgctctg

SEQ ID NO: 7876 - DNA, 115 bp, Artificial
  Hairpin sequence PT_from_HSbrain_383, chimp
ttcttagatctagtttaaaaaaaaaaaaacacataacaattctttgaagaaaggaagggattaaataatttttttccctaacactttcttgaaggtcaggggctttatctatgaa

SEQ ID NO: 7877 - DNA, 92 bp, Artificial
  Hairpin sequence PT_from_HSbrain_385, chimp
ctgagttcccgggagctgggccctgcctgcagccagggctggggttgccagaggccctggaaggaaggacagttcctgctagggaagaacag

SEQ ID NO: 7878 - DNA, 74 bp, Artificial
  Hairpin sequence PT_from_HSbrain_387, chimp
ggggttcgttctctccctgaagcacttgttcaactgctgttaaagccgcgtgcctcaaggggaggctggacccc

SEQ ID NO: 7879 - DNA, 86 bp, Artificial
  Hairpin sequence PT_from_HSbrain_39, chimp
ctttaaacatcagctgcggcctccaggatcctgacagcgcctggcccatggggctcagcggtccagggggttgcagggacataaag

SEQ ID NO: 7880 - DNA, 100 bp, Artificial
  Hairpin sequence PT_from_HSbrain_391, chimp
gtgggcaccaatctgcagaggggtgtgggtgctgggctgggatttgcagccccccgaggctgcccaagcccatccttcccaccagcagggcacagcctac

SEQ ID NO: 7881 - DNA, 72 bp, Artificial
  Hairpin sequence PT_from_HSbrain_395, chimp
atggctgcctgcgacccccgccatggccgctacctgaacggttgccgccgtgttcaggggccgcatgtccat

SEQ ID NO: 7882 - DNA, 79 bp, Artificial
  Hairpin sequence PT_from_HSbrain_397, chimp
agaaccacagccatttccccaggcagtgttgggtcgagaatccagttttctaaacccacacagcctagctggcttgtct

SEQ ID NO: 7883 - DNA, 116 bp, Artificial
  Hairpin sequence PT_from_HSbrain_398, chimp; PT_from_HSbrain_500, chimp
cctgcggggcccggcgctcagaagtgatgaattgatcagatagacgaggccgggcttgtccctggccactgattatcgaggcgattctgatctgggcacagccaccgggctgcggg

SEQ ID NO: 7884 - DNA, 60 bp, Artificial
  Hairpin sequence PT_from_HSbrain_400, chimp; PT_from_HSbrain_508, chimp; PT_from_HSbrain_511, chimp
agatccctctgtcctcactctctgatttcattgaggatcttgggtgagagagagggacct

SEQ ID NO: 7885 - DNA, 68 bp, Artificial
  Hairpin sequence PT_from_HSbrain_401, chimp
cctcaagatggcctgtggtctgcctcttggccaacaaagaagtctgcagtgccataggagccctgagg

SEQ ID NO: 7886 - DNA, 68 bp, Artificial
  Hairpin sequence PT_from_HSbrain_407, chimp
gccatcctgcctggcactggctgatgggcacttctgttggttccatcagccagagctctgccaaaggc

SEQ ID NO: 7887 - DNA, 76 bp, Artificial
  Hairpin sequence PT_from_HSbrain_408, chimp
tttctgtaattcttctgctgatctgtgagcagggcactgccctgctcccaatcaaacttagtctttttatgagaaa

SEQ ID NO: 7888 - DNA, 110 bp, Artificial
  Hairpin sequence PT_from_HSbrain_413, chimp
tgatgacccagattcagttgtaatccaagatgttattgaggacgttgttatagaagatgttcagtgcccagatatcatggaagaagcagatgtgtctgaaaccgtcatca

SEQ ID NO: 7889 - DNA, 92 bp, Artificial
  Hairpin sequence PT_from_HSbrain_414, chimp
tagcctaccatgtgggtgtgatttgaaagttaggttttcagtttgggttctttctggacgagctgttctgtccacccacacctgtagtgctg

SEQ ID NO: 7890 - DNA, 77 bp, Artificial
  Hairpin sequence PT_from_HSbrain_42, chimp
ggtgcagaggagcctcccaggcgccggttacaacaacaccttcccctactcctggggcggcttctccgacatggact

SEQ ID NO: 7891 - DNA, 105 bp, Artificial
  Hairpin sequence PT_from_HSbrain_420, chimp
gccactcacctccctgtacctccaacaaccccaccccttccccactgtttctctcctcagctggtggctgggggtcagttccgggtggtcaaggagcccctcggc

SEQ ID NO: 7892 - DNA, 116 bp, Artificial
  Hairpin sequence PT_from_HSbrain_421, chimp
ggctccgccgacggcgtccccgccccgctcctgcccggacttggagcagccccgcctccctgcgcggcggccatgttgactccgggcgagcggggtgggggtcgcggctcggcgcc

SEQ ID NO: 7893 - DNA, 85 bp, Artificial
  Hairpin sequence PT_from_HSbrain_425, chimp
gtgcctcttccccctttgctaggagttatgtgggaagagagggtggcctctgtgttctgggttgtcagtgaaggggaaggggtat

SEQ ID NO: 7894 - DNA, 95 bp, Artificial
  Hairpin sequence PT_from_HSbrain_426, chimp
cctctcccaacatggtggcctcagcaaaaaagaagaagaagtagaagactctccctaacatactttctggctgaggatgggaggattggtggagg

SEQ ID NO: 7895 - DNA, 95 bp, Artificial
  Hairpin sequence PT_from_HSbrain_429, chimp
gtagatttcactcccaaggctgggaatgagtccaccagctccacatgtaaaaatgaggctggtactgatgcctggttctgggctggggaagaggc

SEQ ID NO: 7896 - DNA, 109 bp, Artificial
  Hairpin sequence PT_from_HSbrain_43, chimp
gcccagcgtagccaggtgagcccagggctgggggctggggctggggctggatacgttccctgcctggtcccctgcttactgctcccacctctgccatctcccgccaggc

SEQ ID NO: 7897 - DNA, 48 bp, Artificial
  Hairpin sequence PT_from_HSbrain_431, chimp
ggggagcaggaggggagggcaccaagtgctcttactctcctgagctcc

SEQ ID NO: 7898 - DNA, 106 bp, Artificial
  Hairpin sequence PT_from_HSbrain_434, chimp
atgttctattcttcatgtggtactcttctcaagagggaggcaatcatgtgtaattagatatgattgacacctctgtgagtggagtaacacatgatatatacatcat

SEQ ID NO: 7899 - DNA, 119 bp, Artificial
  Hairpin sequence PT_from_HSbrain_437, chimp; PT_from_HSbrain_438, chimp
gcttctgcagcaggttcccaggtccaccccgagggactcctggccagtgttcccaacagtgtctgagtgctggcctcagtccctggccatagattttggggaaccgcgctctgaggggc

SEQ ID NO: 7900 - DNA, 117 bp, Artificial
  Hairpin sequence PT_from_HSbrain_44, chimp
ggctgggcagagcctgtcccctcccccttctccaggagccagggggtgactggagagacagacccacccccaagcagggctcctctccccagggtgggcacaggacctctgtaagct

SEQ ID NO: 7901 - DNA, 71 bp, Artificial
  Hairpin sequence PT_from_HSbrain_440, chimp
ggagttgtggagctgtgagggtggaggagagcccagctgatggctctgtccctccctcagatgccccttcc

SEQ ID NO: 7902 - DNA, 77 bp, Artificial
  Hairpin sequence PT_from_HSbrain_441, chimp
caggcttgaggcccagggtgctgggggtggtcacacagccgtcagccacctccagctcttccagggcattctagatg

SEQ ID NO: 7903 - DNA, 104 bp, Artificial
  Hairpin sequence PT_from_HSbrain_443, chimp
tgtttttgaaatattaaaccctggatcagtcctttgatcagtataatttttaaaagttactttgtcagaggcacaaaagggtttaaactgatttataataaaca

SEQ ID NO: 7904 - DNA, 117 bp, Artificial
  Hairpin sequence PT_from_HSbrain_447, chimp
gttacaactgaaggaaagtctgttgaaatgcatcatgaagctttgagtgaagctcttcctggggacaatgtgggcttcgatgtcaagaatgtgtctgtcaaagatgttcgttgtggc

SEQ ID NO: 7905 - DNA, 83 bp, Artificial
  Hairpin sequence PT_from_HSbrain_452, chimp
caggctttattctgcctgggccatcacagctctgaggatacttctgttctcctcactcccagtccagggctcaccccagcctg

SEQ ID NO: 7906 - DNA, 89 bp, Artificial
  Hairpin sequence PT_from_HSbrain_456, chimp
ctctgtgtggttttggaggggtgtggaaagaggcagaacattcgttcactttcctgccttcctctgcaccagctaaaaagtttgcagag

SEQ ID NO: 7907 - DNA, 109 bp, Artificial
  Hairpin sequence PT_from_HSbrain_457, chimp
aaattcagcagttcagagtggtgtgtgggtgggaaggactggatttgaaatggtcccactcctgacaatcctgtccctgtctcctacagacctcttcttgggtgaattt

SEQ ID NO: 7908 - DNA, 119 bp, Artificial
  Hairpin sequence PT_from_HSbrain_458, chimp
ttctagagtaaggagttttgctggcctcaagccttccaggagaaatggagaccctatacatacctgtttccatgcctcctagaaattccgaagccagggtaaggtttctcattctagaa

SEQ ID NO: 7909 - DNA, 87 bp, Artificial
  Hairpin sequence PT_from_HSbrain_459, chimp
tgttcacaattattcttgcatttgaacctcagtgcgcacagaacccttctgtgcgcgggagaaacagggcgggagtctcttgggata

SEQ ID NO: 7910 - DNA, 83 bp, Artificial
  Hairpin sequence PT_from_HSbrain_464, chimp
tgagaacacggcaggtgagcaggcgaggctgggctgaacccgtgagtgaggagtgcagcccagctgaggtctctgctgtctta

SEQ ID NO: 7911 - DNA, 64 bp, Artificial
  Hairpin sequence PT_from_HSbrain_467, chimp
tcagaaggtgggtcctggcgtggcccgatgggaaaagctgctggccaggtcaggcctgccctga

SEQ ID NO: 7912 - DNA, 113 bp, Artificial
  Hairpin sequence PT_from_HSbrain_473, chimp
cttcagtctatccatctttaatactaacctgcaaccttagaacttactcatttctttggaaatgagttttattgagaatgctaattattatttaagacctcaaggactaggag

SEQ ID NO: 7913 - DNA, 95 bp, Artificial
  Hairpin sequence PT_from_HSbrain_476, chimp
tggctgtccccgttcagtgccttttgcacacgtgcatttgcatgcacgcatgtgggtgtgtctgtggcatctcggcacctgtgcgtggattctca

SEQ ID NO: 7914 - DNA, 98 bp, Artificial
  Hairpin sequence PT_from_HSbrain_479, chimp
cattgggagccatgaagttgtcttgttgataggtctagggcagctgttggcagctgctggccttgtggatggtaagctgacggtgttggcatttaatg

SEQ ID NO: 7915 - DNA, 119 bp, Artificial
  Hairpin sequence PT_from_HSbrain_48, chimp
gtctggttgtggtgggctgggcagggcagggggcacttctttgtccagtaagccagatgttggactacctggggaaggcagcctccctcccttcctccctccctccccccatccgaggc

SEQ ID NO: 7916 - DNA, 99 bp, Artificial
  Hairpin sequence PT_from_HSbrain_480, chimp
tttgttgaattttaaaataaaagttgttcagcacttaggtgaaatgctgaacgacttcacgtaagtgctgcacgacccttttctttaaaaaacaaggag

SEQ ID NO: 7917 - DNA, 93 bp, Artificial
  Hairpin sequence PT_from_HSbrain_482, chimp
ggcctccagctgttcgggactggcgagcgcggcgcagcggttcattttgcgccacgtgggcgagctgggcgccgagcagctggagcggctgcc

SEQ ID NO: 7918 - DNA, 74 bp, Artificial
  Hairpin sequence PT_from_HSbrain_483, chimp
gaaccgagccagggagttaggataattgggagagttgaaaatctccgaggtgccctgagctgtgctcatggttc

SEQ ID NO: 7919 - DNA, 101 bp, Artificial
  Hairpin sequence PT_from_HSbrain_485, chimp
ggtccaggccaacctgcaaagctcagccagagccccccaagtgagcaagtgagattgcagctggggaggcaaagggcaatgcgggtccaggcactctgacc

SEQ ID NO: 7920 - DNA, 103 bp, Artificial
  Hairpin sequence PT_from_HSbrain_489, chimp
gtcataaagcagcacatctggttttttctcatcatgcacagttccgcagattccctccaggatgccatgagacatgagtaccaagaacgtgctgtcagaggac

SEQ ID NO: 7921 - DNA, 82 bp, Artificial
  Hairpin sequence PT_from_HSbrain_490, chimp
gggtcggtggctccgtcctggcctcgctgtccaccttccagcagatgtggatcagcaagcaggagtatgatgagtcaggccc

SEQ ID NO: 7922 - DNA, 78 bp, Artificial
  Hairpin sequence PT_from_HSbrain_491, chimp
tcatgtactgcagttgcctttttgttcccatgctgtttaagcccagcataggcaccaaaaagcaacaacagtatatga

SEQ ID NO: 7923 - DNA, 54 bp, Artificial
  Hairpin sequence PT_from_HSbrain_494, chimp
gcacgcacacacagatggtcatttctccttagatgaccatctgtgtgtgtgtgt

SEQ ID NO: 7924 - DNA, 119 bp, Artificial
  Hairpin sequence PT_from_HSbrain_498, chimp
agacggaaggggctgtcccagaagtgggcaggaagatccaggctgttatgccatgtgggcatgtggcacaacagcctggttcttcctgccccaacttctggggcaccctgtttccctct

SEQ ID NO: 7925 - DNA, 80 bp, Artificial
  Hairpin sequence PT_from_HSbrain_499, chimp
gtgcctgggtttgggggcatgcagagtatgcccatggaggtgcccatgaatgccatgcagaggcccgtgagaccaggcat

SEQ ID NO: 7926 - DNA, 116 bp, Artificial
  Hairpin sequence PT_from_HSbrain_5, chimp
ccctagcctaggcaagcttgatgagtgaggcatgacaccatcacagcccagatgtggtggcaaagggctgtgatggtgtcaggcctcaaaaagctcaggaaggcctcacactgggg

SEQ ID NO: 7927 - DNA, 64 bp, Artificial
  Hairpin sequence PT_from_HSbrain_50, chimp
ctctgccgagacagaaggtggcagacccttccagctgtgccatcctctttgtccctggccagag

SEQ ID NO: 7928 - DNA, 116 bp, Artificial
  Hairpin sequence PT_from_HSbrain_503, chimp
gctcggagctgctgcttctgtttctcttgtggccgccgtcgctgtccggctgccttgggctgccgaacagacaaggcgtgggccacagcacctcagaagccgacgcagctcgacgc

SEQ ID NO: 7929 - DNA, 74 bp, Artificial
  Hairpin sequence PT_from_HSbrain_505, chimp
gaattcttaatctggggtccagggaatctgtggatgttttcatgggatccttgatctcccagatattatatttc

SEQ ID NO: 7930 - DNA, 116 bp, Artificial
  Hairpin sequence PT_from_HSbrain_506, chimp
tggccaatgaaaggacactggaatggaagccaggaatcctgctgtggtggagaggcatagactcatgaatccaccacaatcggatacttgcttctttttaacagccctatcagccg

SEQ ID NO: 7931 - DNA, 68 bp, Artificial
  Hairpin sequence PT_from_HSbrain_51, chimp
gcctagacacaatgcccaagtttgccttctcatcagaggatgagggggcaggcccaggccctgcaggc

SEQ ID NO: 7932 - DNA, 100 bp, Artificial
  Hairpin sequence PT_from_HSbrain_510, chimp
gggtgcaggacagagggagaggatctgtgggtctcctgggtgtggttttaatctgtctccccctgcccagttcctccagctcctccatcctgccgtctcc

SEQ ID NO: 7933 - DNA, 118 bp, Artificial
  Hairpin sequence PT_from_HSbrain_512, chimp
gttctcttgtgtgtgtctcccatttagaggcagatggggccagagtgttctagagatccagactctagagctccgatcccatccacccctcagctgtggtcacacaccaacccggagc

SEQ ID NO: 7934 - DNA, 90 bp, Artificial
  Hairpin sequence PT_from_HSbrain_513, chimp
tccaagccagagctcagagcaatcaagcccagcagtattcggggataaccctgagcaaggctggtgagtgagagtgctttagggtaagga

SEQ ID NO: 7935 - DNA, 113 bp, Artificial
  Hairpin sequence PT_from_HSbrain_514, chimp
aagagtgaaggaacaagagaagtatataattgggtggagactggtgtggaagaagctaattttcctccggtcactccagaatgattgtgtagagttactagaatttcagtctt

SEQ ID NO: 7936 - DNA, 102 bp, Artificial
  Hairpin sequence PT_from_HSbrain_515, chimp
ggagaaagtgccacagtcaagcctttgtgtccccctctccttcttgctgtgtgctctgcagaggaggggataaaaggctcatctgaggtcctggctggctct

SEQ ID NO: 7937 - DNA, 94 bp, Artificial
  Hairpin sequence PT_from_HSbrain_518, chimp
tgcaggttgaagacaggattggggaagaggccatgggagctgtggaagtgaccagagtcttccaggctggtccttagcccaagtgcatcctgca

SEQ ID NO: 7938 - DNA, 65 bp, Artificial
  Hairpin sequence PT_from_HSbrain_52, chimp
gctctgcctcggcctggccttgtccagtctaccctggacaagatgccgtgtgtttgaggcccagc

SEQ ID NO: 7939 - DNA, 98 bp, Artificial
  Hairpin sequence PT_from_HSbrain_520, chimp
caccccccgccctaaggagcctggcctggggtgacgtggccaggcagactgtctgccccactccttcacacaagcccagctcctctgcccaaggggtg

SEQ ID NO: 7940 - DNA, 115 bp, Artificial
  Hairpin sequence PT_from_HSbrain_524, chimp
gtgcagatcgtgggatgaaacgcgtgggccatcgcacctgcctttggaatgatcagctttacctggttgggggttttggtgaggatggcaggacagccagtccacaggtttgcat

SEQ ID NO: 7941 - DNA, 63 bp, Artificial
  Hairpin sequence PT_from_HSbrain_527, chimp
tcgaggaccccccctgcctggccttcgagtctggagggaggccgcggggaggaggccctgtga

SEQ ID NO: 7942 - DNA, 85 bp, Artificial
  Hairpin sequence PT_from_HSbrain_533, chimp
ccatttcccaggctgcatttcttcatgcctggctttgccccactgaccagccggggcagccagcattaccaggccctgactgtgg

SEQ ID NO: 7943 - DNA, 38 bp, Artificial
  Hairpin sequence PT_from_HSbrain_534, chimp
ggtagatgcagcggagtgtgagctctgctgcatctgtc

SEQ ID NO: 7944 - DNA, 91 bp, Artificial
  Hairpin sequence PT_from_HSbrain_535, chimp
gctctggagtctttctgtggaatatgacatgatcagtatcctctcaggatagtatatgatcacatcctattccgcagaaaggtctttgagc

SEQ ID NO: 7945 - DNA, 113 bp, Artificial
  Hairpin sequence PT_from_HSbrain_537, chimp
cctctgatccccacttccaagccttggccaccacacctaccccttgtgaatgtcgggcaatgggtgatgggtgtggtgtccgcaggcaacaggggagaaggaggagatggagg

SEQ ID NO: 7946 - DNA, 78 bp, Artificial
  Hairpin sequence PT_from_HSbrain_538, chimp
gctgtcctaactgactgtaaggacctggtcttgagtcttcccataggatctctaggtccttaaggtatgggttttggc

SEQ ID NO: 7947 - DNA, 96 bp, Artificial
  Hairpin sequence PT_from_HSbrain_54, chimp
tgaatgggcgcggcggacttgggaggcggaatactcagtccccccgggaaggagggagctggggtccagatctttgctctgaaggagcctagggca

SEQ ID NO: 7948 - DNA, 91 bp, Artificial
  Hairpin sequence PT_from_HSbrain_541, chimp; PT_from_HSbrain_544, chimp; PT_from_HSbrain_545, chimp
ctggccacatatgcccctgtcatctctgctgagaaagcctaccatgaacagcttactgtagcagagatcaccaatgcttgctttgagccag

SEQ ID NO: 7949 - DNA, 73 bp, Artificial
  Hairpin sequence PT_from_HSbrain_55, chimp
tgggtgtcaggcaaggcgccagacaccccttgcaggctggaggacggggtggctgggcctttgcacacacgca

SEQ ID NO: 7950 - DNA, 108 bp, Artificial
  Hairpin sequence PT_from_HSbrain_552, chimp
cactggccttgctgtccccagggcggaccaggcactggccactcttaccatgcggaaattctgcgaggacaaggtggccacagaactgcagccctcccagcgtcggtg

SEQ ID NO: 7951 - DNA, 116 bp, Artificial
  Hairpin sequence PT_from_HSbrain_557, chimp
ggtggctccagccttctgcaaccttgacccaggttgggcaagggcgaaggtgaggaatctttgaggaccaagcccagtggtctgggaatcgggaggtagagagggaagggtctgcc

SEQ ID NO: 7952 - DNA, 112 bp, Artificial
  Hairpin sequence PT_from_HSbrain_559, chimp
tgggcctgcgaggtgtgccgcttctggaatgggagacagaggtggaaatggacaagtaaggccatgattttgctcatgtcctagtttcagaatatataagctctgaggccta

SEQ ID NO: 7953 - DNA, 76 bp, Artificial
  Hairpin sequence PT_from_HSbrain_56, chimp
tggaggctggaacatggcagagggcatactaggggttaacctcctgccctttctcatgtcccccagtgtgcaccca

SEQ ID NO: 7954 - DNA, 90 bp, Artificial
  Hairpin sequence PT_from_HSbrain_561, chimp
agaaaagaggacattttacccagatccgtggcctattcagaaatgtgccctgtgattaggccgcagatctgggtgaaatgtcctccttct

SEQ ID NO: 7955 - DNA, 117 bp, Artificial
  Hairpin sequence PT_from_HSbrain_564, chimp
gttgtcatcaattcagaatctttttgataagcattttctttctttccaaatagtttgtggagaagtttctaatggggaggaagaaggtgaaggtgaaactggttggattgaaggagc

SEQ ID NO: 7956 - DNA, 69 bp, Artificial
  Hairpin sequence PT_from_HSbrain_565, chimp
ccacagccttccacccaggccttgctgctgcagcctctgccagagccagctcctggtggacccatgtgg

SEQ ID NO: 7957 - DNA, 72 bp, Artificial
  Hairpin sequence PT_from_HSbrain_566, chimp
gtttaccccgcaggagacgcctcggcagtcctcaacttgtgtgcgccggtggccctctcctgtgggacttgc

SEQ ID NO: 7958 - DNA, 115 bp, Artificial
  Hairpin sequence PT_from_HSbrain_567, chimp
gagtccagatgatgctcataccaatggcttcagtgatggcggtgactgaaccgaaatgggtctcggtctggggccgcttcctctgggtgacgctgctgagcatggtgctggggtc

SEQ ID NO: 7959 - DNA, 90 bp, Artificial
  Hairpin sequence PT_from_HSbrain_568, chimp
cctggctgggtttacgtgcaggtcacatgaggtttaaaaatagcaccatccttcattccttggcctgagattgcttaagaccaggccagg

SEQ ID NO: 7960 - DNA, 78 bp, Artificial
  Hairpin sequence PT_from_HSbrain_570, chimp
ggggccatggagcagcctgtgtagacggggacctgccctgcatgggcaccccctcactggctgcttccctcggtctcc

SEQ ID NO: 7961 - DNA, 59 bp, Artificial
  Hairpin sequence PT_from_HSbrain_575, chimp
gcaggggcctggggtcagagctggggtcctcctgaggcctcactcttccttcctcctgc

SEQ ID NO: 7962 - DNA, 111 bp, Artificial
  Hairpin sequence PT_from_HSbrain_577, chimp
tggggactttttctctgcccttcgtcattatgcagcctgtgaacagcgtctgggaaagtcgtggtcattggttgcataatttgatctgaggcttatggaggaaaggactca

SEQ ID NO: 7963 - DNA, 111 bp, Artificial
  Hairpin sequence PT_from_HSbrain_579, chimp
tgaggactttttctctgcccttcgtcattatgcagcctgtgaacagcgtctgggaaagtcgtggtcattggttgcataatttgatctgaggcttatggaggaaaggaccca

SEQ ID NO: 7964 - DNA, 76 bp, Artificial
  Hairpin sequence PT_from_HSbrain_581, chimp
cggcattttttccttttctccagcggcctcaggttcttgttacaactgagtccgggttggaggaggtgcggggccg

SEQ ID NO: 7965 - DNA, 75 bp, Artificial
  Hairpin sequence PT_from_HSbrain_582, chimp
ggtttggattgttgtacttttttttttgttcgttgcatttttaggaacaaaaaaaaaagcccaacccttcacacc

SEQ ID NO: 7966 - DNA, 84 bp, Artificial
  Hairpin sequence PT_from_HSbrain_585, chimp
ggccttaaagtgggaaataatagaagggtcacttaggagcctgcagtggcatggtgaccagtctgttattactcatagatgacc

SEQ ID NO: 7967 - DNA, 90 bp, Artificial
  Hairpin sequence PT_from_HSbrain_587, chimp
gagacaccagtccacggggtccggatccaagtgcgcagttatcctcaaatccagtccacagggtccagatccgagtgtgctgttatcctc

SEQ ID NO: 7968 - DNA, 79 bp, Artificial
  Hairpin sequence PT_from_HSbrain_590, chimp
cacaggtcctatggtaggtcttcaggaaggtgctccccaggtgggcatggggtggcacattgaggccatgggactggtg

SEQ ID NO: 7969 - DNA, 86 bp, Artificial
  Hairpin sequence PT_from_HSbrain_591, chimp
gctgccgaagatggcagaggtgcaggtcctggtgctcgatggtcaaggccatctcctgggccgcctggcggccatcgtggctaagc

SEQ ID NO: 7970 - DNA, 91 bp, Artificial
  Hairpin sequence PT_from_HSbrain_595, chimp
tgggcgttcctgcttggctgctgccctcttctgtcccttttcctatattgggagggatgaagggggaacccagcgctggacgtggcgctta

SEQ ID NO: 7971 - DNA, 113 bp, Artificial
  Hairpin sequence PT_from_HSbrain_597, chimp
ggtgcagcctcagatcccctgttcatctggagaagcctcctgccacagcttaggacagaactgggcgcagggcaaaggcctctccccagaggatggattagaaggcctgggcc

SEQ ID NO: 7972 - DNA, 117 bp, Artificial
  Hairpin sequence PT_from_HSbrain_598, chimp
gttacaactgaaataaagtctgttgaaatgcaccatgaagctttgagtgaagctcttcctggggacagcatgggcttcaatatcaagaatgtgtctgtcaaagatgttcattgtggc

SEQ ID NO: 7973 - DNA, 100 bp, Artificial
  Hairpin sequence PT_from_HSbrain_6, chimp
ttcccagagagtttgttcatttatttctcttctctatattctcagaaattctttctgtctcagagatgttagggaagaggttggggcatgctgatgggaa

SEQ ID NO: 7974 - DNA, 109 bp, Artificial
  Hairpin sequence PT_from_HSbrain_60, chimp
gatggtactttagaatgctgacatctacaggattctagaatccagaaggctttagaatcttgacacctttgaagttctagaaccgtgatggtgttagcatgctagcatc

SEQ ID NO: 7975 - DNA, 80 bp, Artificial
  Hairpin sequence PT_from_HSbrain_600, chimp
ttgtttttatgctggtactctgtgggagttaagtgtcaactttctcctgttttctcctatggagtatccgtccaaggcaa

SEQ ID NO: 7976 - DNA, 102 bp, Artificial
  Hairpin sequence PT_from_HSbrain_603, chimp
catgaactgggagctctagcacatgaatagtgggtaatgatgggaagtagccacattcctgttattaacccctgccttccctgttagcttcctgcttacatg

SEQ ID NO: 7977 - DNA, 95 bp, Artificial
  Hairpin sequence PT_from_HSbrain_604, chimp
gtaagaatagtatgccagcaatccctgattctctgcttgttgttctctggcagcactaagacaaaggaacagggactaggagtttatgtgcttat

SEQ ID NO: 7978 - DNA, 95 bp, Artificial
  Hairpin sequence PT_from_HSbrain_606, chimp
agagctgcctggctcagctgggacactgtgggctaaggcagctggcacttccttggcccacagtgtcccagcttggctttggctttcttggctct

SEQ ID NO: 7979 - DNA, 82 bp, Artificial
  Hairpin sequence PT_from_HSbrain_607, chimp
ggcggtcctggtggggagtgcgtagcagggtggagtcgctgtctggtcgcgcttcacttctgcgttggcctccctgctcccc

SEQ ID NO: 7980 - DNA, 106 bp, Artificial
  Hairpin sequence PT_from_HSbrain_608, chimp
cctcaccactcgctcctcctccatcacagcaccccggccctccctgtccctggcctccctggctggggcatttgggggtccgttgggaggagtgcatcgctgaagg

SEQ ID NO: 7981 - DNA, 101 bp, Artificial
  Hairpin sequence PT_from_HSbrain_610, chimp
gccactggagatttcagtcccaaggctgggaatgagtccatcagctccacatataaaaatggggctggtattgatgcctgggtctgggctgaggaagaggc

SEQ ID NO: 7982 - DNA, 101 bp, Artificial
  Hairpin sequence PT_from_HSbrain_611, chimp
gggcagagggatctacgccagcaggtggaggctcgtcagggggtggcggctttcggccctctggcttggcctttgcttcacacgtgtaaatatccctcccc

SEQ ID NO: 7983 - DNA, 92 bp, Artificial
  Hairpin sequence PT_from_HSbrain_613, chimp
gtgatggaaggctgttgtcttggtgtatcccttgcctcatagtcaatatattttttttttggtgagtcaccagtgacccgagccctccacac

SEQ ID NO: 7984 - DNA, 98 bp, Artificial
  Hairpin sequence PT_from_HSbrain_614, chimp
agcacttctgtgagccctgagggagtggagtccaggcagaggggagtcatggcctgagcgttctgccactgtctcctcccacggggctccggcatgct

SEQ ID NO: 7985 - DNA, 95 bp, Artificial
  Hairpin sequence PT_from_HSbrain_615, chimp
ggctgcggttccattctccgagccaatttcctcatcgtcttcctcactgcctgttgtgaatttgatgaggtcattggcactggtcttggcgcacc

SEQ ID NO: 7986 - DNA, 75 bp, Artificial
  Hairpin sequence PT_from_HSbrain_616, chimp
ggtataggacttgaaatacgcgaccttggccacagtgtcgcgctgcggcatggtctggttcagtgaggatgtgct

SEQ ID NO: 7987 - DNA, 79 bp, Artificial
  Hairpin sequence PT_from_HSbrain_617, chimp
ggacgtatgcagagccgctcactgctgccatggtggagttctacaccatgtctcaggtacgcagtttctttgctcttcc

SEQ ID NO: 7988 - DNA, 105 bp, Artificial
  Hairpin sequence PT_from_HSbrain_618, chimp
ctgcatatttctcatctctgagtgtgggctttgctctttaggtagaagaactgcgtcgtgacttgaggataaagagccaagagctggaggtgaagaatgcagcag

SEQ ID NO: 7989 - DNA, 99 bp, Artificial
  Hairpin sequence PT_from_HSbrain_619, chimp
tgtctagtgtgaagactgtggtgaggaaagagaacttcaggagagggaacggtgtccccagctgaagggtcgtttaaaagcgttagtattacacagaca

SEQ ID NO: 7990 - DNA, 69 bp, Artificial
  Hairpin sequence PT_from_HSbrain_626, chimp
gccagggcatggcagggggagctgcggggccgtcggaggggccccagtgtctgagccatgtcctctggc

SEQ ID NO: 7991 - DNA, 72 bp, Artificial
  Hairpin sequence PT_from_HSbrain_628, chimp
ctcaggccccagctggaggccttctcctcaggctcactatggggtgggggcttttcctggctgcaggatgag

SEQ ID NO: 7992 - DNA, 95 bp, Artificial
  Hairpin sequence PT_from_HSbrain_631, chimp
gtgtggatcggcagctccatcctggcccggctgtccaccgtccagcagatgtggatcagcaagcaggaatatgatgagtcaggcacctccatcat

SEQ ID NO: 7993 - DNA, 63 bp, Artificial
  Hairpin sequence PT_from_HSbrain_632, chimp
tgtggaggctgctcagcctaccccttctcatagttctgggaggggctgggtttggtctcaaca

SEQ ID NO: 7994 - DNA, 72 bp, Artificial
  Hairpin sequence PT_from_HSbrain_633, chimp
tgggtggttggctcgtgcttccgagttaagtaaaacataaggcttaacagggtcacagggaccagccacgca

SEQ ID NO: 7995 - DNA, 90 bp, Artificial
  Hairpin sequence PT_from_HSbrain_635, chimp
gcccctcgtgagctggatagacttgggatggggagggagggagttttgtctgtctccctcccctctcagaacatactgattgggaggtgc

SEQ ID NO: 7996 - DNA, 52 bp, Artificial
  Hairpin sequence PT_from_HSbrain_636, chimp
gactcgcgagcccggccaaggggccttgtcttggctgggtttgtcagaggtc

SEQ ID NO: 7997 - DNA, 102 bp, Artificial
  Hairpin sequence PT_from_HSbrain_637, chimp
ttcctgggatttggggaggggcatgccatcctgcctgcagagaggctgagaccagctcttctccctcaggaggacctctccatgcccctgatcgaagaggaa

SEQ ID NO: 7998 - DNA, 88 bp, Artificial
  Hairpin sequence PT_from_HSbrain_638, chimp
tcctggttaggtcgcggccttcccagccggcgctgaccctgagagtaagggctgcgtcccagcttggaggcccctgcttagcgcagga

SEQ ID NO: 7999 - DNA, 91 bp, Artificial
  Hairpin sequence PT_from_HSbrain_639, chimp
ctgccactctctagcatcctggacactctggtaaccaggccttaaggcttcttcacacttaagagttctggggtgatggagcaacggacag

SEQ ID NO: 8000 - DNA, 114 bp, Artificial
  Hairpin sequence PT_from_HSbrain_64, chimp
cccttcctcccgcctcagcctctaggctggttcgggccgagccgccattttgtgtcaattcctgattgcggcgggggccgggcagccggggcacccaggacgggcagacaaggg

SEQ ID NO: 8001 - DNA, 91 bp, Artificial
  Hairpin sequence PT_from_HSbrain_644, chimp
ggctagagctgtgtgcagggccagcgcggagcccgagcagccgcggtgaagcgcctgtgctccgccgagactgccgtgcccattgctcgcc

SEQ ID NO: 8002 - DNA, 78 bp, Artificial
  Hairpin sequence PT_from_HSbrain_648, chimp
ttctggtttcctggggctgcggcccatttcggcggacccagcgctgaggcggcggcggcgaggcccaggaaataagaa

SEQ ID NO: 8003 - DNA, 92 bp, Artificial
  Hairpin sequence PT_from_HSbrain_649, chimp
ggtacccggtggagacctggccaaggtacagagagctgtgtgtatgctgagcaacaccattgccattgctgaggcctgagctcacctggacc

SEQ ID NO: 8004 - DNA, 77 bp, Artificial
  Hairpin sequence PT_from_HSbrain_650, chimp
cataatcacctcagaggtcctgagccagattccagagattctttctgagattctggcaaggccccggggtactgatg

SEQ ID NO: 8005 - DNA, 114 bp, Artificial
  Hairpin sequence PT_from_HSbrain_654, chimp
tctggaccagggctgtcccctgggcggtgagtgccaggcgtggagagctggtgtagatgacatttgtggctccacatgccctggcctgggcgccaaggacagccgcagagaaga

SEQ ID NO: 8006 - DNA, 114 bp, Artificial
  Hairpin sequence PT_from_HSbrain_655, chimp
gcatgtgtgccgtcaccgcatgccatgtgtacacacgtgccaggcgctgtcttgagacattcgtgcagtgcacggcactggggacacgtggcactggctgaactgccacacagc

SEQ ID NO: 8007 - DNA, 74 bp, Artificial
  Hairpin sequence PT_from_HSbrain_656, chimp
ggcgcgggtgggcccagcctcgagctcttcagcacagtgatggtgacggggcagcggtggcggcacggccagcc

SEQ ID NO: 8008 - DNA, 87 bp, Artificial
  Hairpin sequence PT_from_HSbrain_657, chimp
tctgtcccaaccccagctgtcccctgcccagggagctggcataaaagcacgaggcccggctccctggggcagctgcttgagaacaga

SEQ ID NO: 8009 - DNA, 69 bp, Artificial
  Hairpin sequence PT_from_HSbrain_660, chimp
cagcttcgtggcggccgggtcctctgtgcccttttgggggcagctggccacgggcaccaatgtgagctg

SEQ ID NO: 8010 - DNA, 98 bp, Artificial
  Hairpin sequence PT_from_HSbrain_661, chimp
tggcgcttatggcctccaccccctcctagggaacctggaatgcctctgtcacacactgccctcccagtccctggggcttgggttttccattcaagtca

SEQ ID NO: 8011 - DNA, 82 bp, Artificial
  Hairpin sequence PT_from_HSbrain_662, chimp
tctggccctcagaactctcaggtatagaagcccaggatgtctaataccctgtcccagtgcccgagagctgcctggtgtcagg

SEQ ID NO: 8012 - DNA, 69 bp, Artificial
  Hairpin sequence PT_from_HSbrain_663, chimp
cagaatgtattaggcaccttctgtagccagagccaaaaaaagtctggctacaggagaaacctggcactg

SEQ ID NO: 8013 - DNA, 60 bp, Artificial
  Hairpin sequence PT_from_HSbrain_664, chimp
gggtcactcccaaccaccctgctcaggctgccctgggcagggtgtcaagggtcttgacct

SEQ ID NO: 8014 - DNA, 80 bp, Artificial
  Hairpin sequence PT_from_HSbrain_668, chimp; PT_from_HSbrain_688, chimp
ctgggaagttcgggtggggggagtctgggcttcaggctggggtggggtctgtggagctgaggcggccccctgcccaccag

SEQ ID NO: 8015 - DNA, 114 bp, Artificial
  Hairpin sequence PT_from_HSbrain_669, chimp; PT_from_HSbrain_673, chimp; PT_from_HSbrain_677, chimp; PT_from_HSbrain_680, chimp; PT_from_HSbrain_684, chimp; PT_from_HSbrain_687, chimp
gctgttggcgactctgcctacaggtgggtgccgtaggggtcgggacagcctcttcctgcccagcccttcctgcccctcagcctcacctgtgtggcctcctctcctccacacagc

SEQ ID NO: 8016 - DNA, 69 bp, Artificial
  Hairpin sequence PT_from_HSbrain_67, chimp
ggctcttaagatcggggtgctagggggtgagaggtaacatcttccaccccttacacctgctctagtgct

SEQ ID NO: 8017 - DNA, 82 bp, Artificial
  Hairpin sequence PT_from_HSbrain_672, chimp
cttcagatgccagaagggcagagggaatcccacacaggctggtggatcatgtgtgtgcatttctctcccttctagtctgagg

SEQ ID NO: 8018 - DNA, 82 bp, Artificial
  Hairpin sequence PT_from_HSbrain_676, chimp; PT_from_HSbrain_679, chimp; PT_from_HSbrain_685, chimp
cctgggaagttcgggtggggggagtctgggcttcaggctggggtggggtctgtggagctgaggcggccccctgcccaccagg

SEQ ID NO: 8019 - DNA, 95 bp, Artificial
  Hairpin sequence PT_from_HSbrain_682, chimp
cagggaggacaagatcaacaggcttattagaaaaatgaactaaggtgtctaccatgattatttttctaagctggttggttaataaacagtacctg

SEQ ID NO: 8020 - DNA, 113 bp, Artificial
  Hairpin sequence PT_from_HSbrain_69, chimp
gccggccttgccggcctctgagcaagacaatgcgcttcaacgtgctccaggtcaccaaggctgccggcaccaagaagcagttccagaagttctgaggctggacatcggcccgc

SEQ ID NO: 8021 - DNA, 98 bp, Artificial
  Hairpin sequence PT_from_HSbrain_691, chimp
ggggaccgtcagcagcgccttagctacaatcgttcagctattctcggaagagagaagggagagggaggaggccggggcgggagtgggggctgtcaccc

SEQ ID NO: 8022 - DNA, 76 bp, Artificial
  Hairpin sequence PT_from_HSbrain_694, chimp
ggctctgcctcagggaactcgggtttggggaaatgtttatttcagaagtactggagtggccagtgtggcagtggcc

SEQ ID NO: 8023 - DNA, 119 bp, Artificial
  Hairpin sequence PT_from_HSbrain_695, chimp
ccatgccccaccccctgcctctacggcctgcctcagccagggccacagggaactgagcctgaagtaactccctgacctcaaggctgagccaggccaggttgggtgaacagggccattgg

SEQ ID NO: 8024 - DNA, 83 bp, Artificial
  Hairpin sequence PT_from_HSbrain_698, chimp
caggcagtggggctagccggctgtctggaggtctgggtgacctggcagcacggctgcttctccaccccccgccccactccttg

SEQ ID NO: 8025 - DNA, 97 bp, Artificial
  Hairpin sequence PT_from_HSbrain_70, chimp
gggcctgggggatggaggggagcccatcagggctcagggattggatggaggtgatgggggcaggggatgggtctcaccctcccttcttcctgggccc

SEQ ID NO: 8026 - DNA, 69 bp, Artificial
  Hairpin sequence PT_from_HSbrain_708, chimp
gccattcagtggacacgggagcagggggtttagtgggaacacagggcttcctgacccctgtcctgaagc

SEQ ID NO: 8027 - DNA, 77 bp, Artificial
  Hairpin sequence PT_from_HSbrain_711, chimp
gcccccgacgtttccctgttcctcaggcgtctgcaaccctcctgggttgcggcgtctgctcgcccttctgcgtccgc

SEQ ID NO: 8028 - DNA, 82 bp, Artificial
  Hairpin sequence PT_from_HSbrain_712, chimp
aggaagccagcagttgtaccttggtggggggaggtggcagccttttccctacttccctccccaaccaaacactttgcttctt

SEQ ID NO: 8029 - DNA, 69 bp, Artificial
  Hairpin sequence PT_from_HSbrain_713, chimp
tgagctggaaggggggtctcattctacagagaggtggccttcctttcttgacctcctcctccaagctca

SEQ ID NO: 8030 - DNA, 111 bp, Artificial
  Hairpin sequence PT_from_HSbrain_714, chimp
gcggcggacaccatcttctttaaaccctcagtccgtattggtctctatggcatccatagaggccattcggctatgaggtcctcagtaaagaaacttagatggtattactgt

SEQ ID NO: 8031 - DNA, 118 bp, Artificial
  Hairpin sequence PT_from_HSbrain_717, chimp
gatcctgagtgagatgggagctggggcagggaaaggctgatgctgtgggtcggtcacttatcactaataagcccattttcctgccttgccttgccccatcttttagtttttcagggtt

SEQ ID NO: 8032 - DNA, 67 bp, Artificial
  Hairpin sequence PT_from_HSbrain_718, chimp
gggagggggcttggaggccaggtacctgggagccctctggctcgtcctgaccccattgtcctcttcc

SEQ ID NO: 8033 - DNA, 90 bp, Artificial
  Hairpin sequence PT_from_HSbrain_721, chimp
gtatcagaacactggcccagccagaggagttgtccgaagatggagttcttcagacagctcctctgatcagtatggtgtgaaatgtagtac

SEQ ID NO: 8034 - DNA, 65 bp, Artificial
  Hairpin sequence PT_from_HSbrain_722, chimp
gtggcaaacgtggcatagaggtgtgccaggagcctgttggaagacttctggtacagcccgaccac

SEQ ID NO: 8035 - DNA, 49 bp, Artificial
  Hairpin sequence PT_from_HSbrain_724, chimp
gggcccctctgcccatgtttcctcccaggaagagcgggcagagtggccc

SEQ ID NO: 8036 - DNA, 79 bp, Artificial
  Hairpin sequence PT_from_HSbrain_727, chimp
caccctctgccttgagtcctccactccagagtctcagagccgctgagcattctggggttggtcagctctaaccttggtg

SEQ ID NO: 8037 - DNA, 94 bp, Artificial
  Hairpin sequence PT_from_HSbrain_732, chimp
ggtcccagtccactccctggtcactctgagttgctcctgtgcctgttacagcatcaggatcatcacagatgagccggggagcctcctggcagcc

SEQ ID NO: 8038 - DNA, 108 bp, Artificial
  Hairpin sequence PT_from_HSbrain_733, chimp
gccttgcatgggagctgttagggaggcacgtgcacacacacgcacactcacatgtgtgtgtgttcatgggctgcctccaagagcttcgatcctgttttatgtgatggc

SEQ ID NO: 8039 - DNA, 93 bp, Artificial
  Hairpin sequence PT_from_HSbrain_735, chimp
ggtatggacttctcgggagctctgggaggggctgggtttggcaggacagtttccgagccctgtctcctcccatcttccagtttaccagcagcc

SEQ ID NO: 8040 - DNA, 79 bp, Artificial
  Hairpin sequence PT_from_HSbrain_737, chimp
actaagatgaactgtcttacagatggctttgtgcttttggtcataagcgaggccatgtgaaagtatggttcagtgaagt

SEQ ID NO: 8041 - DNA, 68 bp, Artificial
  Hairpin sequence PT_from_HSbrain_738, chimp
tgactgcaccctttttctcccggcagtcgtccctggggatgagcccagggagaagatggacttggtca

SEQ ID NO: 8042 - DNA, 80 bp, Artificial
  Hairpin sequence PT_from_HSbrain_74, chimp
gggtcgggagctggttggggtggcttagcagatccggacagggccctctgtccctgtgtcgtccccagccccctcttccc

SEQ ID NO: 8043 - DNA, 84 bp, Artificial
  Hairpin sequence PT_from_HSbrain_743, chimp
caggaagttggatctgggatgggaagagacccgggacactgccccattgtcccttctcttcccaccacccctcagtccctcctg

SEQ ID NO: 8044 - DNA, 69 bp, Artificial
  Hairpin sequence PT_from_HSbrain_745, chimp
gctgcggctgtgcccggccgagcgggggagggcgccgccactcagagccagggagggagccgccggagc

SEQ ID NO: 8045 - DNA, 115 bp, Artificial
  Hairpin sequence PT_from_HSbrain_747, chimp
gctctcaggggaccttgttttcccaggcaggctggcttctcagggcaaggactgttttctctctggttccagcctcttgtcatgcctgggtggacaaatggggagccggtgaggt

SEQ ID NO: 8046 - DNA, 64 bp, Artificial
  Hairpin sequence PT_from_HSbrain_749, chimp
ctctggctggtcccagggattctcaaggccaggccatggaggaaagcctggggctggcacatag

SEQ ID NO: 8047 - DNA, 68 bp, Artificial
  Hairpin sequence PT_from_HSbrain_75, chimp
ggagcgaagtgattaggaggatgagccctggattccactggggttcacagctttgagcaaatcactcc

SEQ ID NO: 8048 - DNA, 95 bp, Artificial
  Hairpin sequence PT_from_HSbrain_750, chimp
ccacgtgcgggaggcggccagttatcaggaggcgctggcgcggctggaggaagaggggcagagcctcaaggacgagatggcccgccacttgcagg

SEQ ID NO: 8049 - DNA, 95 bp, Artificial
  Hairpin sequence PT_from_HSbrain_751, chimp
gggtaatgccaggtgggttttgagagctgggtcggtactgcagacatctcttctccattgtcgggtgccgtctctgctccatgtggttattgctc

SEQ ID NO: 8050 - DNA, 78 bp, Artificial
  Hairpin sequence PT_from_HSbrain_754, chimp
ggggctaatcgcctggactgcttggagaaagcgaagctagtaccccctttctccaacagtccttagtttccaggccct

SEQ ID NO: 8051 - DNA, 61 bp, Artificial
  Hairpin sequence PT_from_HSbrain_757, chimp
tagatgactctcagatgtgatcctttgcacatatatatggatcacatctgagagtcatcta

SEQ ID NO: 8052 - DNA, 76 bp, Artificial
  Hairpin sequence PT_from_HSbrain_758, chimp
gcctcagcgcccaggagctgcggtccggagccggccccgagctgggcccaggtcgcaggctcctcaggccaaaggt

SEQ ID NO: 8053 - DNA, 95 bp, Artificial
  Hairpin sequence PT_from_HSbrain_759, chimp
ttggcgctccctctccttggtcctcctgatatctgtgatctcctgaatgggatgatgaagcagactcaggtggtgccaggaaggcggtggctcaa

SEQ ID NO: 8054 - DNA, 76 bp, Artificial
  Hairpin sequence PT_from_HSbrain_760, chimp
gtgggacctaggctaggggttcttagcataggagatcttcccgtgccaagaactcccagactaggagtcctcccat

SEQ ID NO: 8055 - DNA, 73 bp, Artificial
  Hairpin sequence PT_from_HSbrain_761, chimp
ggtctgatggctggctctccttccctcccctcttcctgggaagttcgggtggggggagtctgggcttcaggct

SEQ ID NO: 8056 - DNA, 120 bp, Artificial
  Hairpin sequence PT_from_HSbrain_764, chimp
ggcttctcgaggctccggcggctcagctcactggcttctcgaggctccggcggctcagctcactggcttctcgaggcttctggaggctccggtggctcagctcactggcttctggaggct

SEQ ID NO: 8057 - DNA, 118 bp, Artificial
  Hairpin sequence PT_from_HSbrain_765, chimp
gcctcagccttgaggctccggtggctcagctcactggcttctcgaggctccggtggctccgctcactggcttctcgaggctccggcggctcagctcactggcttgtcgaggctccggc

SEQ ID NO: 8058 - DNA, 96 bp, Artificial
  Hairpin sequence PT_from_HSbrain_768, chimp
aagccgtacccaaagtcttgcttctgccgaggtgtccctgatgccaagattcgcatttttgacctggggcggaaaaaggcaaaagtggatgagttt

SEQ ID NO: 8059 - DNA, 116 bp, Artificial
  Hairpin sequence PT_from_HSbrain_769, chimp
gctgagagcgaagcagaaggggctccctgtccggccgcacgtgccctttccctcgacgacagtcgagggctcgggctctgtgggactgtgggagctagggtctgcggggcgcctgc

SEQ ID NO: 8060 - DNA, 108 bp, Artificial
  Hairpin sequence PT_from_HSbrain_770, chimp
ttgtgtctgtagtgtcagcgtgatcattcgttgtgtctgtagtgtcagcgtgatcatttgttgtgtctttagtgtcagcgtaatcattcgttgagtctgtagtgtcag

SEQ ID NO: 8061 - DNA, 115 bp, Artificial
  Hairpin sequence PT_from_HSbrain_772, chimp
ctgccggctgatgaccactgtggtgggatgggtagagaaggagctcagaggacggtgcgccttgtttcccttgagcccttcctctctcatcccacctgtggctctaggcttccag

SEQ ID NO: 8062 - DNA, 97 bp, Artificial
  Hairpin sequence PT_from_HSbrain_773, chimp
ccatagcagatttgaggcgctgttgaggactgaattattctccaagttgagagatgtctttgggttaaattaaaagccctacctaaaactgaggtgg

SEQ ID NO: 8063 - DNA, 116 bp, Artificial
  Hairpin sequence PT_from_HSbrain_775, chimp
tctgtgctgtggactccatagagtggactgtctgtgctgtggactctatagagtggactgtctgtgctgtggactccataaagcagactgtctgtgctgtggactccacaggcagg

SEQ ID NO: 8064 - DNA, 119 bp, Artificial
  Hairpin sequence PT_from_HSbrain_776, chimp
gcgtgtggaaggtctgtccgcgtgtggaaggtccgtccgcgtgtggaaggtctgtcagcatgggaaggtctgtccgcgtgtggaaggtccgtccgcgtgtggaaggtctgtccgcgtgt

SEQ ID NO: 8065 - DNA, 110 bp, Artificial
  Hairpin sequence PT_from_HSbrain_777, chimp
tgaaatgagctccagtactctgaccagccccatagaggcatcctgggtcagcagccagaatgattccccagatgatgccagtgaggggcctgagtacctggccattggca

SEQ ID NO: 8066 - DNA, 116 bp, Artificial
  Hairpin sequence PT_from_HSbrain_780, chimp
ctgtgtgaccgtcatgcaggcctgtctgtgcgaccgtcaggaggcctgtctgtgtgaccgtcaggaggcctgtctgtgtgaccgtcaggaggcctgtctgtgtgaccgtcatgcag

SEQ ID NO: 8067 - DNA, 119 bp, Artificial
  Hairpin sequence PT_from_HSbrain_791, chimp; PT_from_HSbrain_792, chimp
cgctctgtccggctcagggctcgccctccgtgggacttgcgctctgtccggctcagggctcgccctccgtgggacttgcgctctgtccggctcagggctcgccctccgtgggacttgcg

SEQ ID NO: 8068 - DNA, 92 bp, Artificial
  Hairpin sequence PT_from_HSbrain_793, chimp
catacacatctgcattgctctcatgatagctgtgtggaggttgagttcccatacacatctgcattgctctcatggtagctgtgtggaggttg

SEQ ID NO: 8069 - DNA, 92 bp, Artificial
  Hairpin sequence PT_from_HSbrain_797, chimp
agtggagcagggctgaggctggggttgggccttttatggcggatggaagtcagggatggaggccgaatttagctgactttcctgctgctgct

SEQ ID NO: 8070 - DNA, 97 bp, Artificial
  Hairpin sequence PT_from_HSbrain_798, chimp
gctcttcttccaccagctggtcggtgatcctctcaaacgctacgcccatgctctggtgtttggaatcctgctcacctgccgcctgctgattgctcgc

SEQ ID NO: 8071 - DNA, 76 bp, Artificial
  Hairpin sequence PT_from_HSbrain_8, chimp
ggagaatctgcataagccccacgcttcttgggtctgggtgactgggctgggggaaggaggggggatgcaatttacc

SEQ ID NO: 8072 - DNA, 115 bp, Artificial
  Hairpin sequence PT_from_HSbrain_80, chimp
ccagtgtttgtctccctctgcacggtcacaggctccacggtcactggctctgtgagaacacttgctccagagcctcgcctggggccctgtgtgccaggcctgagttgggtaccgg

SEQ ID NO: 8073 - DNA, 110 bp, Artificial
  Hairpin sequence PT_from_HSbrain_806, chimp
aaggcactctttccacctccccccaggcattatccccaggtgctgaaatggctgtggccccagcacctgaggcaggggtacgctacctggggtagcagtagaaaggtctt

SEQ ID NO: 8074 - DNA, 76 bp, Artificial
  Hairpin sequence PT_from_HSbrain_807, chimp
ctgcagggcttgttctcaaactggctgtcagagtgtgcatggcaggctgcagccacttggggaactggctctgtgg

SEQ ID NO: 8075 - DNA, 78 bp, Artificial
  Hairpin sequence PT_from_HSbrain_808, chimp
ttcttcagtgagacgggtgctggcaagcatgtgccccgggcagtgtttgtagacttggaacccacagtcattggtgag

SEQ ID NO: 8076 - DNA, 114 bp, Artificial
  Hairpin sequence PT_from_HSbrain_809, chimp
gcacactgtcctgcatccagtctgtgtcctcctgtctttctcatccaggtcaggcactgacactttgtaagaaagggggtaggggacacagctgggcaggtggagtgggtgggc

SEQ ID NO: 8077 - DNA, 89 bp, Artificial
  Hairpin sequence PT_from_HSbrain_83, chimp
gccttatgttccagcccgaggcctctgtgacgtcacggtgtctgcgggaggagaccatgacgtcacagaggcttcgcgccctgagaggt

SEQ ID NO: 8078 - DNA, 104 bp, Artificial
  Hairpin sequence PT_from_HSbrain_85, chimp
tctgcttatttcctggaggggagcccgtgaggctgtgaggaggataggtcatctggttccttctttcctatggcacccatgctccttccctgttgttctgcaga

SEQ ID NO: 8079 - DNA, 103 bp, Artificial
  Hairpin sequence PT_from_HSbrain_86, chimp
ctgccctctagccttgctgccttggctttctgaccccttccaggcttcaggggcctgggagatctcatgcctaagcccaggaaacatttaatagggaaagcag

SEQ ID NO: 8080 - DNA, 70 bp, Artificial
  Hairpin sequence PT_from_HSbrain_87, chimp
gattttccctgccagggaagctaacccagagcacgcacctgtgctcatgagtgtttccgcaggataattc

SEQ ID NO: 8081 - DNA, 103 bp, Artificial
  Hairpin sequence PT_from_HSbrain_90, chimp
ccccactggcagagaatgaggggctacttgtggctgctctggaggaactggctttcaaagcaagcgagcaggtgggcctggatggctgggtagaaggtgtggg

SEQ ID NO: 8082 - DNA, 97 bp, Artificial
  Hairpin sequence PT_from_HSbrain_92, chimp
gtgtgacctgtggagcaggacctctgatgtgtgcccctcctgtgttgtatccagggacagggtgccttatcggagagactgcggagcttcagcatgc

SEQ ID NO: 8083 - DNA, 95 bp, Artificial
  Hairpin sequence PT_from_HSbrain_96, chimp
gcagcccgaccgcggtcagtgcctgaggctggggaacgcgctggcccgcgccggtcgcctccccgtggccctgggcgcgttctgtgtcgccctgc

SEQ ID NO: 8084 - DNA, 87 bp, Artificial
  Hairpin sequence PT_from_MM_10, chimp
ccgtgtgagtttgtactgcagagctccttggcatccttgcctgagttgggtgttgggaagctcaaattgcagctacaaactggctgg

SEQ ID NO: 8085 - DNA, 113 bp, Artificial
  Hairpin sequence PT_from_MM_101, chimp
agcatagttgtagcatgtggttgtattaatgaacgttacaggagagctttataatcatttataaatctgtaacattcaataaagaaacacatgttgcaatgattaattatgtt

SEQ ID NO: 8086 - DNA, 112 bp, Artificial
  Hairpin sequence PT_from_MM_102, chimp
tcccttttcagtgatgaatgtatattggtaaggagggtgaggttgaaggggcaggaacctctcaaatgaagtgactttctttaccagcacattcagaacacatagtccagga

SEQ ID NO: 8087 - DNA, 115 bp, Artificial
  Hairpin sequence PT_from_MM_105, chimp
gagagaaggcttgagctaggggggtaacctcaagctatggaaaaaattagggttagacatgaagtattttttcatagcctgaggaagtccccatgggcagcagcaggctgatttt

SEQ ID NO: 8088 - DNA, 102 bp, Artificial
  Hairpin sequence PT_from_MM_106, chimp
tgccagggcagcaatttgtgtcagatttcaatctattttgagtggaaaccaatgtaagcctggttgaaaaatggtgagtaaattgctgtcctaatcaaggta

SEQ ID NO: 8089 - DNA, 90 bp, Artificial
  Hairpin sequence PT_from_MM_108, chimp
agggttgatgcaaaagaaaggaaaacatctttgaagttctgaaaaataggacttcaaagatattttcctttcttctccatcgaatctcct

SEQ ID NO: 8090 - DNA, 117 bp, Artificial
  Hairpin sequence PT_from_MM_112, chimp
ggggcgggcgggtgggggtagggcggcttaccataggggttcatgtggtcacctggcatttggggcggcgtgaggccctgctggaaggggtcgctgctgccgtaggggctctgttcc

SEQ ID NO: 8091 - DNA, 109 bp, Artificial
  Hairpin sequence PT_from_MM_115, chimp
ccatttcaagaatcttctgacaatgaaggtaggcggacaacgaggagattgctgtcacgcatagcttctagcatgtcatctacttttttttcacgaagatctagtcagg

SEQ ID NO: 8092 - DNA, 106 bp, Artificial
  Hairpin sequence PT_from_MM_124, chimp
ggagggctgatgagcagttcaagttccctgcatagaaatagcctcagaatagttccagtgttgtttctaattgcaatggatgagcagactgtctcattaatcctcc

SEQ ID NO: 8093 - DNA, 118 bp, Artificial
  Hairpin sequence PT_from_MM_127, chimp
gctatataaaggcttgtcagaatgaattctagggtgccaagagacattttgcatatttaagagtatgcaaagtgtctcatggcacattagaattcattctgacaaacctttatatagc

SEQ ID NO: 8094 - DNA, 102 bp, Artificial
  Hairpin sequence PT_from_MM_136, chimp
gtcattactagcagttaatgattggtttgttagttaatggcccaaggcaaagctgagggcggttaagactctaacaaacgagttgtgaattgtagcaatggc

SEQ ID NO: 8095 - DNA, 114 bp, Artificial
  Hairpin sequence PT_from_MM_14, chimp
gtatttttaatatcttctctgccatttgactgcatctgattgacctcactgcaacccacagaggaggcagatttagaagcaaaccagtatgacagggaaatagcccaattatgc

SEQ ID NO: 8096 - DNA, 110 bp, Artificial
  Hairpin sequence PT_from_MM_143, chimp
gcagtgtatgccagatacaagtgaatttaagcccacatgtattgaagctgcaagcttagtttgcaatttatgtgcaagtggttttgtatttattgatctggatcgagtgc

SEQ ID NO: 8097 - DNA, 94 bp, Artificial
  Hairpin sequence PT_from_MM_145, chimp
ttcggttcgccgccccgccaggtggcggggcctactaggcctccgggcatccccggtctcaagtaggcctcatctgccggcaagggcgcccgaa

SEQ ID NO: 8098 - DNA, 77 bp, Artificial
  Hairpin sequence PT_from_MM_146, chimp
gcaaaaaggaaaacagatgggcaatatccagtaagaaaattttgctcggtgttgcccatctgcttctctctgcctgc

SEQ ID NO: 8099 - DNA, 83 bp, Artificial
  Hairpin sequence PT_from_MM_151, chimp
tgtgccatatcatattcttaccaaaacatttgctttgattggtggcccggtcaacaaagactttggctgagatgacgtggcca

SEQ ID NO: 8100 - DNA, 117 bp, Artificial
  Hairpin sequence PT_from_MM_153, chimp
gacttcagcctgggcatagttggacgagagggcgtcttggcaggtctctgtgtttaaagagcacaggtgtgagacactgggacgcacgctttcggctcaacattgccttctggggtt

SEQ ID NO: 8101 - DNA, 118 bp, Artificial
  Hairpin sequence PT_from_MM_157, chimp
cttcaagtgaaaagtgttaaaataaatggctcatgacttatgaagtgttaacataaacgtttatttcaacactatacatgtcataagccatttatttcaacactccctacttcagaag

SEQ ID NO: 8102 - DNA, 116 bp, Artificial
  Hairpin sequence PT_from_MM_158, chimp
gctactccatcccctgctgcactaaattgacacttgggcaagcaatggctctcgtcagtcactccgaagctgctacttccagaagtgtcgatttagtgcagcaggggatgaggtgc

SEQ ID NO: 8103 - DNA, 100 bp, Artificial
  Hairpin sequence PT_from_MM_160, chimp
cgtcaaggatttggcatttcaatcgatgggaaatgatgtgtgatcattctaatttattacacatcatttccccatcaatcgacgaactaaagccttgacg

SEQ ID NO: 8104 - DNA, 81 bp, Artificial
  Hairpin sequence PT_from_MM_165, chimp
tggcagctaatgacctgctggaggacttatgtgcctaaggcaaagctgaaggccattagcccaacaggtcattaactgaca

SEQ ID NO: 8105 - DNA, 118 bp, Artificial
  Hairpin sequence PT_from_MM_166, chimp
agctgtctagatggtgcattagggagaatagctgatggattacaaatctctgcatttcaccaacaaaaatgaatttgaatccatcaattttattcccgtatgcccaatttaggaagtt

SEQ ID NO: 8106 - DNA, 107 bp, Artificial
  Hairpin sequence PT_from_MM_169, chimp
cctcaggtgctgggcgaggccatgactggcatctcccaaaatgccaagaacggaaacctgccagagtttggagatgccatttccacagcctcaaaggcactttgtgg

SEQ ID NO: 8107 - DNA, 79 bp, Artificial
  Hairpin sequence PT_from_MM_174, chimp
actgaagtggggccagttctccgcctcttttaactttactgccaaggcaggagaggggtggagtggcctggaagacagt

SEQ ID NO: 8108 - DNA, 77 bp, Artificial
  Hairpin sequence PT_from_MM_175, chimp
ggatggcaagcggaggagcagcagggtgaaactgacacagttctggtgagtttcactttgctgctcctcctgattct

SEQ ID NO: 8109 - DNA, 86 bp, Artificial
  Hairpin sequence PT_from_MM_179, chimp
ctatgacagaaggtactctgtgggagggaggagataatagccaatgattatattcctccttcatacttgcagtacctctgagagag

SEQ ID NO: 8110 - DNA, 76 bp, Artificial
  Hairpin sequence PT_from_MM_18, chimp
acatgcagctaattatacccacaattggctaattgtcggtgcaattagccaattgcaggcccaattggccacttgt

SEQ ID NO: 8111 - DNA, 103 bp, Artificial
  Hairpin sequence PT_from_MM_181, chimp
gtatgtgaatgaccagctcacaggaagtggccttcaatagtccgatagcttcctgtatcctgacattgtgaaggcccacttcctgtgctgtctctgaaaatac

SEQ ID NO: 8112 - DNA, 100 bp, Artificial
  Hairpin sequence PT_from_MM_193, chimp
ctgttttcacttccaggtaatctaattccaaggcatcaggagcttttttataaaaatcctgtgtttgctggagtaaggttgcctgaaatcaaggaaagag

SEQ ID NO: 8113 - DNA, 112 bp, Artificial
  Hairpin sequence PT_from_MM_214, chimp
gctatgaataagctgacgctgcccattccctccacgtgccccgagccctttgcccgcctcctggagggtgagccggggccccgtgacgagggtaggctcagcttggagtggc

SEQ ID NO: 8114 - DNA, 111 bp, Artificial
  Hairpin sequence PT_from_MM_218, chimp
gggacctgtgactcaggcgcgggttggggaggatgttttggatgccgctctgctgacgctggtgccctctgttcttacatcctccttaatttactgcctgaggagggggcc

SEQ ID NO: 8115 - DNA, 98 bp, Artificial
  Hairpin sequence PT_from_MM_219, chimp
cccattaagcaaagctggcatttcggagcacgtcagaagcgctggcttccagccctggaagtcagcgtctggcctctgagccagcactgcctatccgg

SEQ ID NO: 8116 - DNA, 111 bp, Artificial
  Hairpin sequence PT_from_MM_226, chimp
ccagacagatgatgagttatcttttcctgagggagcaataatccgtatcttgaacaaagaaaaccaagatgacgatggcttctgggaaggggaattcaatgggcgtattgg

SEQ ID NO: 8117 - DNA, 118 bp, Artificial
  Hairpin sequence PT_from_MM_230, chimp
tccttgggtttcttccagtcatcctgaggtagatatcatccaggaatgctgaggccttatggcttacggcaatccagtaatgatataaaaggtgattggaggttagatttacattggg

SEQ ID NO: 8118 - DNA, 78 bp, Artificial
  Hairpin sequence PT_from_MM_234, chimp
gctgggcgtttggccgcctccgtcccggccttgtctggctcagcggggctggggccgggggcgggccctgtgtcgggc

SEQ ID NO: 8119 - DNA, 98 bp, Artificial
  Hairpin sequence PT_from_MM_236, chimp
ttacacctgaaacttctcacttgggggtacaattagcctctggtgcctttagaatgagttgctggtgactaattatgccctcaaggaggcatttgtaa

SEQ ID NO: 8120 - DNA, 108 bp, Artificial
  Hairpin sequence PT_from_MM_237, chimp
ttgtctgtcttattgtgtttggttgaggcctagtaattttcgataaagcccttaatccaagtacttgactgaaaattaccaggcttctctgtggaggataagggtcaa

SEQ ID NO: 8121 - DNA, 108 bp, Artificial
  Hairpin sequence PT_from_MM_238, chimp
tcctcgatgcttgattagtcagattgatggaggaggccatatgtggccatgtcaaaacttggctacaaggctctttccctctctgtgaaggacaggcaataaagagga

SEQ ID NO: 8122 - DNA, 119 bp, Artificial
  Hairpin sequence PT_from_MM_242, chimp
tgatggagatgcaggcatttcctgaggattaatgaccagctgggaggaaccagtggcccttggctctgcctcccagccagccattaattctaaggaaatgtcttttgctgaggtcgtta

SEQ ID NO: 8123 - DNA, 108 bp, Artificial
  Hairpin sequence PT_from_MM_26, chimp
ttgttatggagatgatcccttaccctacctgtctttctatcagtgtagctgaggctaattcagtgcattgatgtaagattattatggggttgagcacttatctgacaa

SEQ ID NO: 8124 - DNA, 97 bp, Artificial
  Hairpin sequence PT_from_MM_266, chimp
gatagctttctccaactgttacaatctccacttcactgtcagttgaggtaacattaatttcttcattggcagtaacctggggagtggaggaagcttc

SEQ ID NO: 8125 - DNA, 86 bp, Artificial
  Hairpin sequence PT_from_MM_269, chimp
tgctgatgttggtatggcagcctgaacacttccagttcccaggaatgggcttgggatcaaaggttgctatcactccaaagtcttca

SEQ ID NO: 8126 - DNA, 100 bp, Artificial
  Hairpin sequence PT_from_MM_276, chimp; PT_from_MM_39, chimp
attataactaaattaaatgcctaaactggcagagtgcaaacaattttgactcagatctaaatgtttgcactggctgtttaaacatttaatttgttagaat

SEQ ID NO: 8127 - DNA, 118 bp, Artificial
  Hairpin sequence PT_from_MM_28, chimp
tttcttgttctcctctatataccctcagagctgatctgagtgtggagattccattcacttcaaaggaagcttcacgcttggatcttctccacaggggtgcttagactaagacaagaaa

SEQ ID NO: 8128 - DNA, 112 bp, Artificial
  Hairpin sequence PT_from_MM_29, chimp
ggaagactgtcggctcagaagtccatggagctgtgggccaggtagtccttgcgaccgatgttgctgacctgcttggtctgcatagcctcgagtttggggcagtcagtgatcc

SEQ ID NO: 8129 - DNA, 108 bp, Artificial
  Hairpin sequence PT_from_MM_290, chimp
tttgtctctgctctgtggccatttcggtttttccagtccgatgcccctgagggggagggtcgggccccttggaaaatccgttttcatggcaacacggagcctctcaga

SEQ ID NO: 8130 - DNA, 112 bp, Artificial
  Hairpin sequence PT_from_MM_293, chimp
tggtgtgttctcggtagctatggaaatcccagggtttccctagcaacagttccagatgggtcttgttgctagggaacgctgggatttcccaggctgccagatgagcaagaca

SEQ ID NO: 8131 - DNA, 83 bp, Artificial
  Hairpin sequence PT_from_MM_299, chimp
gccttggcttcctgctcctcctcatactgttcccgcagcaggtcacagtcatggcgggaggactgcagggcatgtgccagggc

SEQ ID NO: 8132 - DNA, 119 bp, Artificial
  Hairpin sequence PT_from_MM_30, chimp
ttatttttctttctttcacaaagagcaaagggtttcagaatcaagtttgtcttcaagcagcagcaaacgcttgctgacaagatattttggaacaacttgctattaggaaggaagtatga

SEQ ID NO: 8133 - DNA, 105 bp, Artificial
  Hairpin sequence PT_from_MM_301, chimp
tcagatggttgggtgtggggatgggggcacttctgttcctgacaacctcattatgtggttatcaggagcagacactgcccaggttgtcacgacaaccagcaatga

SEQ ID NO: 8134 - DNA, 119 bp, Artificial
  Hairpin sequence PT_from_MM_303, chimp
ggtggcaaggggcacttcacctggcacactgggctggaagactttattcagatccaaggaggaggctctggaatgggttttctgtggccgaggtggcggggtgggagggtcctcgcccc

SEQ ID NO: 8135 - DNA, 71 bp, Artificial
  Hairpin sequence PT_from_MM_305, chimp
gggtaggagagatgctggaggtgggggtgctgtgttctagaccccccatattatcccagtgtcccctgccc

SEQ ID NO: 8136 - DNA, 104 bp, Artificial
  Hairpin sequence PT_from_MM_306, chimp
gctgtgaggtcagaatcctgtgcttacgacacctcggtctgttgccatggaaacaggggcggattaaggctggagcgcggagcgcagggatcaggcccctcggc

SEQ ID NO: 8137 - DNA, 98 bp, Artificial
  Hairpin sequence PT_from_MM_307, chimp
tgaattactcacctgaaaactgctgaggagcacaaatgtcatggggataaatcaagcccgtgagattggcatctctcagcagctaggtgactagctca

SEQ ID NO: 8138 - DNA, 79 bp, Artificial
  Hairpin sequence PT_from_MM_311, chimp
tacaggacgtctgtgcaatttgatggagctcatcactttttggtctatgagcaattaaattgcaccaggaagccctgta

SEQ ID NO: 8139 - DNA, 77 bp, Artificial
  Hairpin sequence PT_from_MM_313, chimp
gtctaaaggaagaagtttgttctactgtaaacagttatgagaactgtttgctttggatgggcttggtcctcattggc

SEQ ID NO: 8140 - DNA, 90 bp, Artificial
  Hairpin sequence PT_from_MM_315, chimp
ggcctcagtctgcgggccccgaggagggttgtgggcccttttttgtgaatgaagcgccacgcaacagccctcctggggtccccacgagcc

SEQ ID NO: 8141 - DNA, 76 bp, Artificial
  Hairpin sequence PT_from_MM_317, chimp
cacacatgtgatgaattgtgggtgcttgcctggcttcccaggcgagaaccgtaagcaattattaaatgccattgtg

SEQ ID NO: 8142 - DNA, 119 bp, Artificial
  Hairpin sequence PT_from_MM_318, chimp; PT_from_MM_340, chimp; PT_from_MM_346, chimp
tctggcttgctgttgtccttggagaagtctgggcctgggacagaggagggatgtaatctgaacactcctttgtcacaggtcaccagggtgtgcttgaggggacggtagacataaatgga

SEQ ID NO: 8143 - DNA, 105 bp, Artificial
  Hairpin sequence PT_from_MM_319, chimp
tggccccatgatgctggtgatgctggcggtgatcccgatggtgtgagctggaaatggggtgctacgtcatcgttgtcatcgtcatcatcatcatccgagcagcca

SEQ ID NO: 8144 - DNA, 118 bp, Artificial
  Hairpin sequence PT_from_MM_320, chimp
cggagaggggcacgaggcaggcacgcagagctctttaaatattgctaagcatttcctggatcagcatgatatttaaagatttttgttccacctgcctgcgaaatatagagtccagccg

SEQ ID NO: 8145 - DNA, 64 bp, Artificial
  Hairpin sequence PT_from_MM_321, chimp
tggcgttgatgtctgctttcatctccatggcaacatgacggggaaggacagacagcaggagccg

SEQ ID NO: 8146 - DNA, 113 bp, Artificial
  Hairpin sequence PT_from_MM_323, chimp
gtagatcaaacagcgagaggcactttgtacttctgccaggagaccatatgatatctctcagtgactctcctgcatgccaggaacacggacccatgcctcttagctgggtctgc

SEQ ID NO: 8147 - DNA, 119 bp, Artificial
  Hairpin sequence PT_from_MM_331, chimp
acgtgcctcatccagtttaggggtggacctgatgtccctgagtgtatgtggtgaacctgaatttaccttgggtttcctcatattcattcaggagtgtcagttgccccttcacgcgacgt

SEQ ID NO: 8148 - DNA, 120 bp, Artificial
  Hairpin sequence PT_from_MM_34, chimp
gctgtttattcctcatttgagtcataatcctccatttgtgacatcacaattagccacttgtggtgatgattataatgtcatgaacaaaggattatgactgggagttggaaacaaaacagc

SEQ ID NO: 8149 - DNA, 94 bp, Artificial
  Hairpin sequence PT_from_MM_354, chimp
gcagtgcctaaagaattaatgacccgctgaggttaatgagtccctactctgggccatcaactctcccagctggccattaatcccctagaaatgt

SEQ ID NO: 8150 - DNA, 105 bp, Artificial
  Hairpin sequence PT_from_MM_359, chimp
tcaatctgaaatctaggaggcaggtgctcacttgtcctcctccatgcttggaaaatacagggaggaggccatagtggcaactgttaccatgattaatttcgttgg

SEQ ID NO: 8151 - DNA, 118 bp, Artificial
  Hairpin sequence PT_from_MM_43, chimp
tgtgtaaaaggcagaaataatcatgtaatcatcttgtaattatatggtacttactatgcaattacatagtaaatacattgtaaattcaaaataattgcatggttatttgcattatgca

SEQ ID NO: 8152 - DNA, 104 bp, Artificial
  Hairpin sequence PT_from_MM_45, chimp
ggctcggcggtgggggaggcggtttgtgctggtgcctggtgtataatcgggttaatccagtagacaaagaataaaccaatagccctcccacctcacttcccgct

SEQ ID NO: 8153 - DNA, 110 bp, Artificial
  Hairpin sequence PT_from_MM_49, chimp
cccgcccctggcagcgggctctgcttcggaaactgttgactcagagggtggccgggcggccagcgtctgatgtcagcctggagctgggccagggagtgcagggcgtgcgg

SEQ ID NO: 8154 - DNA, 102 bp, Artificial
  Hairpin sequence PT_from_MM_58, chimp
gcaaagcagctggaaagggcttagccctttaatgccggcagctgtatcttcacagtgcggctgctctgctgaggggctggactctgtccagaagcaccaggc

SEQ ID NO: 8155 - DNA, 113 bp, Artificial
  Hairpin sequence PT_from_MM_6, chimp
tagacctgggcatttcctggggattaatgaatagctgggtggagttaattgcctaaagtatagtctcaggccattaacctcagttggtcactaatctctaggaatttcttcta

SEQ ID NO: 8156 - DNA, 105 bp, Artificial
  Hairpin sequence PT_from_MM_63, chimp
gccagtcacttaagctgagtgcattgtgatttccaataattgaggcagtggttctaaaagctgtctacattaatgaaaagagcaatgtggccagcttgactaagc

SEQ ID NO: 8157 - DNA, 91 bp, Artificial
  Hairpin sequence PT_from_MM_65, chimp
cagctagctccgttcgtgatccgggagcctggtgccagcgagacctggaatttccggtctggttggtcttgggccccgcggagccaggttg

SEQ ID NO: 8158 - DNA, 85 bp, Artificial
  Hairpin sequence PT_from_MM_66, chimp
cttcctgtataagcactgtgctaaaatcgcagaaactaggaccatatcttggtttttgtgataatgctagcagagtacacagaag

SEQ ID NO: 8159 - DNA, 82 bp, Artificial
  Hairpin sequence PT_from_MM_68, chimp
ggtccatctttgggccaagatatgtagtcaccaacagtgagttggcgactatattttttgagtcctggcgcaaagtaagatc

SEQ ID NO: 8160 - DNA, 110 bp, Artificial
  Hairpin sequence PT_from_MM_70, chimp
taattgggtcagagtgttttgttgtcaggattcttagttgcttgcattggcttatgaaaaggtcattatgagagaagggatctgaatagcaacgagattccagctggtta

SEQ ID NO: 8161 - DNA, 93 bp, Artificial
  Hairpin sequence PT_from_MM_71, chimp
tagccagtaggtactgatttatgaaaagctgtaaaagatcaggtggagcgctgtaggacatcgtttacagctgcatggattgaaacctatcta

SEQ ID NO: 8162 - DNA, 95 bp, Artificial
  Hairpin sequence PT_from_MM_72, chimp
ttgagctgtaattccattgagggtttctggtgactccagcttcgcacttgtggttatagtattcccagaacccctcaatggagtgatttcctgaa

SEQ ID NO: 8163 - DNA, 87 bp, Artificial
  Hairpin sequence PT_from_MM_73, chimp
taggcacgcagctttggagacgccaaggggaaaatggatttaattgattcgttacctctggtattgtaatgcctgctgcgatgttta

SEQ ID NO: 8164 - DNA, 95 bp, Artificial
  Hairpin sequence PT_from_MM_79, chimp
gtgccccgcggagtagctgtgatgagcgggatgcggaaggtgtccactgagccgatctgtctcccgctcacccacagcagttgctccatggtcac

SEQ ID NO: 8165 - DNA, 114 bp, Artificial
  Hairpin sequence PT_from_MM_85, chimp
gtaaaccaaaggtatcgaatttgtggcttttgctagctttgcagaaaagatttttaaaaaatacatttcttgatagtgcaaaactagcaaaagccacaaatggaatgggtttgc

SEQ ID NO: 8166 - DNA, 116 bp, Artificial
  Hairpin sequence PT_from_MM_89, chimp; PT_from_MM_90, chimp
ggaacaggcgcggcaccagctccgccagctccagccccaggtcctgcgcgatgcggcccacgaaggtgccgtgtttggcctcctcggggacggagtagcggagctggccgctcccc

SEQ ID NO: 8167 - DNA, 118 bp, Artificial
  Hairpin sequence PT_from_MM_9, chimp
tgagaaggtatattagcatgttaataggtctttgtgcccagaggctttggattataaattataaagactgcattagccagatgggcaggattaattagcatgctagtattacctggca

SEQ ID NO: 8168 - DNA, 109 bp, Artificial
  Hairpin sequence PT_from_MM_91, chimp
ttgccctgacctccacctccactgactccctcttttccttcttccctcagccaatgctgaggccttgaaggagatgctgggggacagtgaaggagaagggacagtgcag

SEQ ID NO: 8169 - DNA, 119 bp, Artificial
  Hairpin sequence PT_from_MM_96, chimp
cctttcctttcgtctggccgtgctggcggggctggctctgggcctcagacactctggaatcgccaaggtctgagctcagggcctggcccccttcccaggctaacagccgggaggagggg

SEQ ID NO: 8170 - DNA, 93 bp, Artificial
  Hairpin sequence PT_from_MQbrain_1, chimp
tttatacccgatgtcaagggagcagtactggtttgtgacatgtcctcaaacttcctgtccaagccagtggatgtttccaaggtggagtataaa

SEQ ID NO: 8171 - DNA, 63 bp, Artificial
  Hairpin sequence PT_from_MQbrain_100, chimp
ttggcctagagccaggagtttgggggcccaccttcctgggcttccaaggaactttaggaccag

SEQ ID NO: 8172 - DNA, 76 bp, Artificial
  Hairpin sequence PT_from_MQbrain_1003, chimp
agatgggcttgtcttcagctctgcaccacattcctgctggggccgggtggagagtggaggcctcgagcgtgcgttt

SEQ ID NO: 8173 - DNA, 105 bp, Artificial
  Hairpin sequence PT_from_MQbrain_1007, chimp; PT_from_MQbrain_1159, chimp
gtaagtgggcccacccggtgggacccccgtggggcagggagctgggcccgacatggctcaggcctctgcctttgcaccgcgggacatcacagggtgggcctcggc

SEQ ID NO: 8174 - DNA, 67 bp, Artificial
  Hairpin sequence PT_from_MQbrain_1016, chimp
tggaaccttggggttttgggggcctatggatgacaggattcaaggggcagcaggtctctgaggtccg

SEQ ID NO: 8175 - DNA, 89 bp, Artificial
  Hairpin sequence PT_from_MQbrain_1018, chimp
ggataagaaaaggtggggattaagacatttctggaggcttagggaccaaggatggtctcctttccccacttgatccctttctctgatct

SEQ ID NO: 8176 - DNA, 67 bp, Artificial
  Hairpin sequence PT_from_MQbrain_102, chimp
ggccctcctgtcctgcccacgccaaccagtggaatcaggctgtggggtgggcaggggactggggatc

SEQ ID NO: 8177 - DNA, 120 bp, Artificial
  Hairpin sequence PT_from_MQbrain_1020, chimp
gggtggcgccccaagctgtcctcctaggctcccctgggaaggcggggaccaaccacccgaaatcacgccccttcctcctcccttccctagggagcttgcgaaggcgtctgggtcgcaccc

SEQ ID NO: 8178 - DNA, 93 bp, Artificial
  Hairpin sequence PT_from_MQbrain_1022, chimp; PT_from_MQbrain_1136, chimp
tcttaacctggcccttcccctgtgactctccttggccccaggcaaagaaagcatcttgcctgaggtcacctgtcaggtagggacagagtgaga

SEQ ID NO: 8179 - DNA, 119 bp, Artificial
  Hairpin sequence PT_from_MQbrain_1024, chimp
tggttcctttttgcctcttttttctccaaaggccccttggcccctggctgaggtagtttatcacataataagccctacctgcagggtccagcagcctttgggattccagagcagagcca

SEQ ID NO: 8180 - DNA, 96 bp, Artificial
  Hairpin sequence PT_from_MQbrain_1027, chimp
cactcatttgacttcctaggcacccactatccactaaagtgcagccatcttgtatcccagtgactagaaaatgggtgctgatgggttaatatggtg

SEQ ID NO: 8181 - DNA, 74 bp, Artificial
  Hairpin sequence PT_from_MQbrain_1028, chimp
tcctggagaaggtgcgccataagcaggagagcatcatggatgcggggccggtcttggtgcactgcagtgctgga

SEQ ID NO: 8182 - DNA, 93 bp, Artificial
  Hairpin sequence PT_from_MQbrain_1030, chimp
ccgcggtggcttccgcggaggtttcggcagtggcatccggggccgaggtcgcggccgtggacggggccggggccgaggccgcggagctcgcgg

SEQ ID NO: 8183 - DNA, 107 bp, Artificial
  Hairpin sequence PT_from_MQbrain_1033, chimp
gtgtctcacttgctctcctacataaagacacatgattgcttttgagcttaactaaatttagtgtggtatctaagttgtctgtgtgttattctggtgagcaaaggcac

SEQ ID NO: 8184 - DNA, 107 bp, Artificial
  Hairpin sequence PT_from_MQbrain_104, chimp
gctctgtgctggaggcccaggctttggggggggacggcagaagatcatgctgtgtatgcatgaaccttgatggctagtccccattgcagctggatggccagcactgt

SEQ ID NO: 8185 - DNA, 108 bp, Artificial
  Hairpin sequence PT_from_MQbrain_1043, chimp
ctacgagacaggaagcacctcactgccctcagactatctccaaatcctggctgagggaaaccagacaagggaagagagagggtgggggcagagaaaggatcctggtgg

SEQ ID NO: 8186 - DNA, 96 bp, Artificial
  Hairpin sequence PT_from_MQbrain_1044, chimp
cgtcttgcctcagagccttcttagggcattgctatggacacaccaccagtagatactggcctctgttcttggttgccatgaggtagggagcagacg

SEQ ID NO: 8187 - DNA, 57 bp, Artificial
  Hairpin sequence PT_from_MQbrain_1049, chimp
cagtaaatgttccccttcccttgacgctatagcgtagatgggagggagccactgctg

SEQ ID NO: 8188 - DNA, 118 bp, Artificial
  Hairpin sequence PT_from_MQbrain_1051, chimp
ctccgtctgaaagccagcgtgtgtggggtcagggacagagccccaggccagagaactctctggagcgggaggagatgggtcccgtgccagcgcacacggatgccttccaggactgggg

SEQ ID NO: 8189 - DNA, 91 bp, Artificial
  Hairpin sequence PT_from_MQbrain_1052, chimp
cttgtcaccaaggctgccaggggtgagtgagcgcagctgggcgcatcagcccctcctgctcgcccaccccagcccagcctcccagcgcagg

SEQ ID NO: 8190 - DNA, 87 bp, Artificial
  Hairpin sequence PT_from_MQbrain_1055, chimp
gcctacctggagggcacgtgcgtggagtggctccgcagatacctggagaacgggaaggagacgctgcagcgcgcgggtaccaggggc

SEQ ID NO: 8191 - DNA, 97 bp, Artificial
  Hairpin sequence PT_from_MQbrain_1058, chimp
tttgtagaggagaggtttcaccagggggttcattggtatttaaagttaaaatagagaatgaaaagtgaaagcctttgtgttggagactcctttcaaa

SEQ ID NO: 8192 - DNA, 98 bp, Artificial
  Hairpin sequence PT_from_MQbrain_1059, chimp; PT_from_MQbrain_172, chimp
agtcagcctacatgctccagctcttgggcctcaacctcctcttcctgctgtcccaggattaggtggctgagttccacatggagttggagtggctgcct

SEQ ID NO: 8193 - DNA, 88 bp, Artificial
  Hairpin sequence PT_from_MQbrain_1064, chimp; PT_from_MQbrain_1143, chimp
ctgcccacaggctagtgctgcctctggcctggcacctcccctcccaacaggctggtgcccgcctcccagcccttcttggatggggcag

SEQ ID NO: 8194 - DNA, 84 bp, Artificial
  Hairpin sequence PT_from_MQbrain_1065, chimp
cctttcagtgactcctaaagggatagcctgatggcaagtagctgttctcattggcctggcttccctttgagactggagatgagg

SEQ ID NO: 8195 - DNA, 116 bp, Artificial
  Hairpin sequence PT_from_MQbrain_1070, chimp; PT_from_MQbrain_1566, chimp
tggacccagcacaaatggttcccagtttttcatctgcactgccaagagtgagtggttggatggcaagcatgtggtctttggcaagatgaaagaaggcatgaatattgtggaggcca

SEQ ID NO: 8196 - DNA, 74 bp, Artificial
  Hairpin sequence PT_from_MQbrain_1072, chimp
gcggggcatggggggcgccttcgtgctggtcctgtacgacgagctcaagaaggtgatctaagggccgtggccgc

SEQ ID NO: 8197 - DNA, 77 bp, Artificial
  Hairpin sequence PT_from_MQbrain_1075, chimp
tgggcagagggagagaggtggggtccgggcagagtttctccactgggacattaaagcccctcctgtctcctctccta

SEQ ID NO: 8198 - DNA, 117 bp, Artificial
  Hairpin sequence PT_from_MQbrain_108, chimp
gtcaggacacagagagagacttggtgtggggttgagggtgagggacaagtggaggacacccccaggtctatctgaccctcccctctctaaaccaggctccttctgtgtccacagggc

SEQ ID NO: 8199 - DNA, 113 bp, Artificial
  Hairpin sequence PT_from_MQbrain_1081, chimp
ctggcatcttgtccatggcaaatgctgtacccaacacaaacggttcccagtttttcatctgcactgccaagagtggttggatggcaagcatgtggtctttagcaaggtgaaag

SEQ ID NO: 8200 - DNA, 113 bp, Artificial
  Hairpin sequence PT_from_MQbrain_1082, chimp
gaggccctgggtctgtaggccccccagtttttccccctgccctgtctcctgatgtcatggctggcagcagggcactggggccaggcctggtggggcctttgggccgacccctc

SEQ ID NO: 8201 - DNA, 87 bp, Artificial
  Hairpin sequence PT_from_MQbrain_1083, chimp
catttctgggcagagggagagaggtggggtccgggcagagtttctccactgggacattaaagcccctcctgtctcctctcctagttg

SEQ ID NO: 8202 - DNA, 119 bp, Artificial
  Hairpin sequence PT_from_MQbrain_1085, chimp
ccccatcgtgggcatcattgctggcctggttctgtttgtagctgtgatcactggagctgtggtcgctgctgtgatgtggaggaggaagagctcaggtggggaaggggtgaagggtgggg

SEQ ID NO: 8203 - DNA, 107 bp, Artificial
  Hairpin sequence PT_from_MQbrain_1089, chimp; PT_from_MQbrain_907, chimp
caagaaaatcacagcctttgtacccaacgacggttgcttgaactttattgaggaaaatgatgaagttctggttgctggatttggtcgcaaaggtcatgctgttggtg

SEQ ID NO: 8204 - DNA, 64 bp, Artificial
  Hairpin sequence PT_from_MQbrain_1091, chimp; PT_from_MQbrain_1223, chimp; PT_from_MQbrain_1224, chimp
gcaagctgctggagggcgaggagtgcaggtaggtaactgacgcgacttcctccaacagctgagt

SEQ ID NO: 8205 - DNA, 106 bp, Artificial
  Hairpin sequence PT_from_MQbrain_1099, chimp
aggatagtgctggtcatgcccccgatgcagctatgctctgaatgatttcattcctgagagtgatagcattctggtcctggctgcagtggggtacaatttacatcct

SEQ ID NO: 8206 - DNA, 118 bp, Artificial
  Hairpin sequence PT_from_MQbrain_11, chimp
gggcagtcactctctcatctctccttatgtctgagattctggcccttcctatgctttggggaggtccattattttacactaaagggaggaagggtgatggagaattgttgacacgctt

SEQ ID NO: 8207 - DNA, 79 bp, Artificial
  Hairpin sequence PT_from_MQbrain_110, chimp
atctactcagcttcattgactcggcgtccagcaacatcaagctggcgctggacaagccgggcaagtcaaagcggaaggt

SEQ ID NO: 8208 - DNA, 74 bp, Artificial
  Hairpin sequence PT_from_MQbrain_1100, chimp; PT_from_MQbrain_1169, chimp
tcttggatcctgtggaggcctcctgggaacagtacttcttaaaggaagtatgtctggaaggctgtggtccaagg

SEQ ID NO: 8209 - DNA, 118 bp, Artificial
  Hairpin sequence PT_from_MQbrain_1102, chimp
gcaggggaaggggaggagcgggacgagggtgaagacaggcagaaagaaagggcaagagctgctcccagcgctgaatatggaaaaacccacatctgcactccaaggatccgtctcttgc

SEQ ID NO: 8210 - DNA, 98 bp, Artificial
  Hairpin sequence PT_from_MQbrain_1107, chimp; PT_from_MQbrain_1121, chimp; PT_from_MQbrain_1161, chimp
cctgggccgtcctctttaaggtggagagggctgtggggtcgctcgggagcgtccgcacaccctgggccgtcctctttaaggtggaaagggctgtcggg

SEQ ID NO: 8211 - DNA, 119 bp, Artificial
  Hairpin sequence PT_from_MQbrain_1108, chimp
tcgcccgcccgcccgccctcggtttcgatgcgcccggagtgatcctccttctctctcctcgggggagggtgggtcacttcgcggcgctcggggaacgccgaggaaaggggaagccgcga

SEQ ID NO: 8212 - DNA, 96 bp, Artificial
  Hairpin sequence PT_from_MQbrain_111, chimp
agataaaacttttattctcctattggagggtctaatttgtcccaaaataggggcaagtggggttgagggtgggatttgggtggggggaggagatct

SEQ ID NO: 8213 - DNA, 116 bp, Artificial
  Hairpin sequence PT_from_MQbrain_1110, chimp
ggtcttcatctttgcagtctcgggtgcccacctcagctgtgggcctggtgagagtgcctcagtcatcagtgtcctcaggtgacctgttgcccaaggctgcactgggaggagggact

SEQ ID NO: 8214 - DNA, 99 bp, Artificial
  Hairpin sequence PT_from_MQbrain_1114, chimp
ggcactgcctgcggaaggtaggattagatcattagctcagtgacctcctagggtttcgatgtgctatgttctcatcctacagttggtttggtaatgatc

SEQ ID NO: 8215 - DNA, 83 bp, Artificial
  Hairpin sequence PT_from_MQbrain_1115, chimp; PT_from_MQbrain_299, chimp
ttggtttccagtatgggaaaggaatgttgtgtatggtcccatcgggcacctgcaaccccatccctatgccatgctgtcttcaa

SEQ ID NO: 8216 - DNA, 70 bp, Artificial
  Hairpin sequence PT_from_MQbrain_1119, chimp
ggaactctcagtacccagccctgccctggctctggcatgtatgtgggagagagggacagggggagttgcc

SEQ ID NO: 8217 - DNA, 113 bp, Artificial
  Hairpin sequence PT_from_MQbrain_1126, chimp
ggtcaaaaagatagtgtctcttgtgagatcagcgtgcagcttccctggccttgaagcccaaggcacaggggtaatcacacctgaagctttaggtgcactcttttccttgtgcc

SEQ ID NO: 8218 - DNA, 114 bp, Artificial
  Hairpin sequence PT_from_MQbrain_1128, chimp; PT_from_MQbrain_1462, chimp
gtcactgtggagtggtatcactgtaggtggtgtcactgtagtgcaatgtcactgtggagcagcactgtcactgtagaggggtgtcactgtagggtggtgtcactacagagggat

SEQ ID NO: 8219 - DNA, 89 bp, Artificial
  Hairpin sequence PT_from_MQbrain_1131, chimp
gatggtcagggtttgactggagaggctgatttggaacatctggagcaggtctgacctctctagttggcctttattgaatttgtgacttc

SEQ ID NO: 8220 - DNA, 115 bp, Artificial
  Hairpin sequence PT_from_MQbrain_1134, chimp
agacggggtgagggctgggggcgctggagcgggaggggccaggcagggaggtgggaccatgggggccttgctgtgtgaccaccgttcctgcaggcccatcagcctcactgtggct

SEQ ID NO: 8221 - DNA, 74 bp, Artificial
  Hairpin sequence PT_from_MQbrain_1137, chimp
ctgggcgggggctcctggcttggtccccctgtggtaccccttttctgggtcccctccagcccagcctcccccag

SEQ ID NO: 8222 - DNA, 94 bp, Artificial
  Hairpin sequence PT_from_MQbrain_1144, chimp
gcactgtggccagggttcacattggtcacgtcatcatgtccatcggcaccaagctgcagaacaaggagcatgtgattgaggccctgcacagggc

SEQ ID NO: 8223 - DNA, 62 bp, Artificial
  Hairpin sequence PT_from_MQbrain_1146, chimp
ggaggccgctgctgtggctgcccactggctgtgcccaggccttgaagccgcagcgaacctct

SEQ ID NO: 8224 - DNA, 64 bp, Artificial
  Hairpin sequence PT_from_MQbrain_115, chimp
cctccttaaccaccagcatccctcctctccccaaggtgaagtggagggtgctgtggtgagctgg

SEQ ID NO: 8225 - DNA, 77 bp, Artificial
  Hairpin sequence PT_from_MQbrain_1150, chimp
ggaacttcccatcaatcagccaagaatgctctgccagtgggtgagagtctgtgaggcaggagagcttggggaattcc

SEQ ID NO: 8226 - DNA, 68 bp, Artificial
  Hairpin sequence PT_from_MQbrain_1152, chimp
caagtggaggtgactggcaatgaatacaatgtggaaagcattgatggtcagccaggtgcctttacctg

SEQ ID NO: 8227 - DNA, 97 bp, Artificial
  Hairpin sequence PT_from_MQbrain_1156, chimp; PT_from_MQbrain_1479, chimp
gattccttggtagaggaagttttagtgttggcttggcaaaagaaattgtttctttagccaaggatatatgatcctgaagagtctttggccttgagtt

SEQ ID NO: 8228 - DNA, 104 bp, Artificial
  Hairpin sequence PT_from_MQbrain_116, chimp
gcacattattctgatgaaaatccacaatgtctttgagcttctggttgtgtaatgctggggtttaaagtcaccatttgtgggtttggcatcaattaatatttagc

SEQ ID NO: 8229 - DNA, 111 bp, Artificial
  Hairpin sequence PT_from_MQbrain_1160, chimp
aattgggctgtaggtggagaggagttggaggtgagatatagggaggaacccagttgtaggtttcttagaaaatcaccatggccttctcagagaccctttattagctcattt

SEQ ID NO: 8230 - DNA, 116 bp, Artificial
  Hairpin sequence PT_from_MQbrain_1163, chimp
cctgcaggaattagtgctgagaagcaggagcttgggggtaggaggaggagatccagtcccagatacaggtgaagaaatcctttccctctcccaagcatggcagtcagcactgcagg

SEQ ID NO: 8231 - DNA, 87 bp, Artificial
  Hairpin sequence PT_from_MQbrain_1166, chimp
gggcagctccgcggcagcagcggcggcggcggtggctgcggctgtagagacggtcaccatctcccctccgctggccgtcagcccccc

SEQ ID NO: 8232 - DNA, 102 bp, Artificial
  Hairpin sequence PT_from_MQbrain_1167, chimp
ggggcatggggtgagcaggccctgtctccatggcagaggagggacctgggtgctgcctgtccccccttctcttggtggaccctggcctgcttccagagcttt

SEQ ID NO: 8233 - DNA, 88 bp, Artificial
  Hairpin sequence PT_from_MQbrain_1168, chimp; PT_from_MQbrain_1892, chimp; PT_from_MQbrain_800, chimp; PT_from_MQbrain_808, chimp; PT_from_MQbrain_809, chimp
cagtcatccacggtctctggcaggaaccaagctggagctcagaaagctttaaaatgggctccacgacttgtgggagtccctgggtttg

SEQ ID NO: 8234 - DNA, 88 bp, Artificial
  Hairpin sequence PT_from_MQbrain_1171, chimp
tcattgctggcctggttctccttggagctgtggtcactgctgtgatgtggaggaagaagagctcaggtggggaaggggtgaggagtgg

SEQ ID NO: 8235 - DNA, 85 bp, Artificial
  Hairpin sequence PT_from_MQbrain_1180, chimp
cacaaagtctggcagcacccccagcccagctgcacgataagataagacgtgcccaagggacctggggagagaagccagactggtg

SEQ ID NO: 8236 - DNA, 115 bp, Artificial
  Hairpin sequence PT_from_MQbrain_1181, chimp
ggcggggatgaacgggacctagaagaaaagtgcctacgacttccgtgatgccttgcggttgctgtagcctaatgcctcgtgggagttgtagttttctttggaaaccgtcccttct

SEQ ID NO: 8237 - DNA, 78 bp, Artificial
  Hairpin sequence PT_from_MQbrain_1182, chimp
gtgggacaggatcagtggaaacgctgcttgggtatttgaaattcaagcagtgagacctgagagactggagttcctcgc

SEQ ID NO: 8238 - DNA, 91 bp, Artificial
  Hairpin sequence PT_from_MQbrain_1184, chimp
ggttccagcacctctggctgcctgggcctccttcctctgaccgttggcaccagctgtcagcccctggaggaatgggcggcctgtcggcacc

SEQ ID NO: 8239 - DNA, 66 bp, Artificial
  Hairpin sequence PT_from_MQbrain_1185, chimp
cagtgtgtgattttgtatcacctgctgtgcctcagtagaggacagcgggatgtagtcagcatcttg

SEQ ID NO: 8240 - DNA, 119 bp, Artificial
  Hairpin sequence PT_from_MQbrain_1195, chimp
gtatgcctgcctggccttgtctcttggaagagcacgttaggccaggttcccatttccctctccccctgggcttgcctccctagtttgcttttcctaccgatgtgctggctaggatgtgc

SEQ ID NO: 8241 - DNA, 68 bp, Artificial
  Hairpin sequence PT_from_MQbrain_1196, chimp
cagggtagttcctactggcttggccgggggaggctgtcccttcatctgtccaggaggagctgctgttg

SEQ ID NO: 8242 - DNA, 70 bp, Artificial
  Hairpin sequence PT_from_MQbrain_1199, chimp
cactaggaagctgcagctggagcggcctgtgtcccctgagacccaggctgacctccagcggaatctggtg

SEQ ID NO: 8243 - DNA, 72 bp, Artificial
  Hairpin sequence PT_from_MQbrain_1200, chimp
ccagtgcaggatagcacccagatcacttgctctctgcaactatctgctgctccccattactgtcctgactgg

SEQ ID NO: 8244 - DNA, 94 bp, Artificial
  Hairpin sequence PT_from_MQbrain_1201, chimp; PT_from_MQbrain_1404, chimp
caagaaagccgaggctggggctgggtcagcaaccgaattccagatttagaggcggatttggtcgtggacgtggtcagccacctcagtaaaattg

SEQ ID NO: 8245 - DNA, 90 bp, Artificial
  Hairpin sequence PT_from_MQbrain_1205, chimp
gccagaagctgccactttgcctggcccccagggcccagcaggcaccctcagctgaggccccaggaggctgggcttggggagaactgaagc

SEQ ID NO: 8246 - DNA, 119 bp, Artificial
  Hairpin sequence PT_from_MQbrain_1206, chimp
ttcgggaacgagaaggacgactccgagctgcctacaacctggtgaagcgtgggatcaccaatctctgtgtcattgggggtgatggcagcctcactggggctgacaccttccgttctgag

SEQ ID NO: 8247 - DNA, 105 bp, Artificial
  Hairpin sequence PT_from_MQbrain_1207, chimp; PT_from_MQbrain_591, chimp
cagtcgtgtgagtgtgtggctgttatgtttgcctccattgccaacttctctgagttctatgtggagctagaggcaaacaatgagggtgtcgagtgcctgcggctg

SEQ ID NO: 8248 - DNA, 92 bp, Artificial
  Hairpin sequence PT_from_MQbrain_1212, chimp
cctgatgccagcaccaatcccaggctgctgcttctcccttcagggttccttgtgggccttgggacagagcaacttgggatggtgggggaagg

SEQ ID NO: 8249 - DNA, 82 bp, Artificial
  Hairpin sequence PT_from_MQbrain_1213, chimp
gggttctcctggggcctttgggtcacggagcctctgacagttagtctcttcctttcccctgcccctagctgctggaagacct

SEQ ID NO: 8250 - DNA, 65 bp, Artificial
  Hairpin sequence PT_from_MQbrain_1219, chimp
ggaagcgtaggaagggggtggggcgagggagccctgttcctctcctgaccccctgctgtgccccc

SEQ ID NO: 8251 - DNA, 59 bp, Artificial
  Hairpin sequence PT_from_MQbrain_122, chimp
ttcttgctgtcctctctataggcagaaaaccatcttttccgagagagagatggcaaggg

SEQ ID NO: 8252 - DNA, 74 bp, Artificial
  Hairpin sequence PT_from_MQbrain_1221, chimp
tcctgtgcaatcagatggtgtggtttctgccttggaaagagggctggaagaggaggcaagtctgaagtacaggg

SEQ ID NO: 8253 - DNA, 112 bp, Artificial
  Hairpin sequence PT_from_MQbrain_1222, chimp
gaaggtgatgaactccaagctgggcctggacattgagatcgccacctacaggcgcctgctggagggcgaggagcagaggtgaggaccacagctgtggggagggtgtcccctc

SEQ ID NO: 8254 - DNA, 96 bp, Artificial
  Hairpin sequence PT_from_MQbrain_1225, chimp
ccatcctctggggcttagggatgggaggccaggatgaagattaatccctaatccccaacactggccttgctgtccccagggcggaccaggcactgg

SEQ ID NO: 8255 - DNA, 77 bp, Artificial
  Hairpin sequence PT_from_MQbrain_1229, chimp
gcttatacctgagccacacatctccctgcccttctggcactgaagggccttggggtagtttgctcagtctttcaggt

SEQ ID NO: 8256 - DNA, 115 bp, Artificial
  Hairpin sequence PT_from_MQbrain_123, chimp
ggatgaaatgggcacctagtcagatcttctcagcttgttagccagaaatgactgtgattctgctgggggctgctgagaaggtaatgtaggttgaaaaggggctctaagtttattt

SEQ ID NO: 8257 - DNA, 78 bp, Artificial
  Hairpin sequence PT_from_MQbrain_1231, chimp
tagaacggcggtacctgcgggagcccctctggccaactcatgaggttgtgctggagaaggccctgcttagcacaccta

SEQ ID NO: 8258 - DNA, 93 bp, Artificial
  Hairpin sequence PT_from_MQbrain_1235, chimp; PT_from_MQbrain_1323, chimp
ggggggactgggtctgggatgggtacccttctcattagtaagatccaggaggagtatccagacaggatcataaacaaattcagcgtcctaccc

SEQ ID NO: 8259 - DNA, 114 bp, Artificial
  Hairpin sequence PT_from_MQbrain_1236, chimp
ggtgacaccaggagagagggacaggttctgttgggggtgacaagaggagacagggacaggttctgtcgggggtgacaccaggagagagggacaggttctgtcgggggtgacacc

SEQ ID NO: 8260 - DNA, 96 bp, Artificial
  Hairpin sequence PT_from_MQbrain_1237, chimp; PT_from_MQbrain_1813, chimp
ttctgttgggggtgacaagaggagacagggacaggttctgtcgggggtgacaccaggagagagggacaggttctgtcgggggtgacaccaggagag

SEQ ID NO: 8261 - DNA, 67 bp, Artificial
  Hairpin sequence PT_from_MQbrain_1245, chimp
gggagaccttgagcctgagttctgcctagaggtggatgggtgggaagggtacagggggtgggattcc

SEQ ID NO: 8262 - DNA, 64 bp, Artificial
  Hairpin sequence PT_from_MQbrain_1246, chimp
aaggagaagctgtgctatgtggccctggattttgagaatgagatggccacagcagcttcctctt

SEQ ID NO: 8263 - DNA, 100 bp, Artificial
  Hairpin sequence PT_from_MQbrain_1248, chimp; PT_from_MQbrain_1694, chimp
tccaaggtcatccatgacaactctggtattgtagaaggactcatgaccacagtccatgccatcactgccacccagaagactgtggatggaccctccagga

SEQ ID NO: 8264 - DNA, 118 bp, Artificial
  Hairpin sequence PT_from_MQbrain_1250, chimp
ttgcaatactctcgtttcagctgtgggattaattattgccattctcatcccagtggcagtggctgtcattgttggagtggtgacaagtatcctttgctatcggaaacgagaatggtaa

SEQ ID NO: 8265 - DNA, 94 bp, Artificial
  Hairpin sequence PT_from_MQbrain_1256, chimp
ggctatggctatggatttgggtcagatggatttggaagatacctcaattattgtttttcaggaatgtctgatcacaaatatggggatggtggct

SEQ ID NO: 8266 - DNA, 84 bp, Artificial
  Hairpin sequence PT_from_MQbrain_1257, chimp
gcaggactggagaaggtggtggttctagcttggtctctgttggccttgaagcaagcatcccccctgccctttttccttgactgt

SEQ ID NO: 8267 - DNA, 101 bp, Artificial
  Hairpin sequence PT_from_MQbrain_1259, chimp
ttgggatggtggtgctggtggagcaacagacggaagaaatttcttacattaagaaggcttccagtcttttttccagaggtagtgctacaaatacatgccag

SEQ ID NO: 8268 - DNA, 104 bp, Artificial
  Hairpin sequence PT_from_MQbrain_1261, chimp
tttatttctgttatagtatttccacttagtattatgatttatttctgtccctcatgaaagggacagaaagtagtcaggtggttatgagatgaaaagacagtaag

SEQ ID NO: 8269 - DNA, 100 bp, Artificial
  Hairpin sequence PT_from_MQbrain_1263, chimp
gctcccatctcggttatctggtggttgggctgagaggagaaaggtgctccccaagcttggcttctccagcttcaccgaagccagggaaccacaggagagc

SEQ ID NO: 8270 - DNA, 101 bp, Artificial
  Hairpin sequence PT_from_MQbrain_1264, chimp
tcacagcccgcctggactcctgagggcccctctcacagacagaccatctccctgtggtggtttgactgctcattttacctctggaatctgcctgggcttgg

SEQ ID NO: 8271 - DNA, 95 bp, Artificial
  Hairpin sequence PT_from_MQbrain_1267, chimp
agcatattttgagagtattcaacaccaacattgatgagtggtgtaaaataacctttgccatcactgccattaagggtgtgggtcaaatatatgct

SEQ ID NO: 8272 - DNA, 77 bp, Artificial
  Hairpin sequence PT_from_MQbrain_1268, chimp
acattttgttggtggctggctgtgtcttctaaaacagatcacactgttctggggcacagtgagtcattccacgttgt

SEQ ID NO: 8273 - DNA, 84 bp, Artificial
  Hairpin sequence PT_from_MQbrain_1271, chimp
agggggctgaaggatcttggctgaggtggggcagattaaaatggtcattaccttaaggcccctttccagctgcctcaggcctct

SEQ ID NO: 8274 - DNA, 79 bp, Artificial
  Hairpin sequence PT_from_MQbrain_1273, chimp
gtcctcactggatgccacaggggcaagagggtggttttcctgaagcagctggctagtggcttgttacttgtgactggac

SEQ ID NO: 8275 - DNA, 98 bp, Artificial
  Hairpin sequence PT_from_MQbrain_1279, chimp
ctttaagctcactgtgctttcataaagtagtacattaacaccagagcagtgtgtctctggggtttatgactggggtggtggcacactagggcataaag

SEQ ID NO: 8276 - DNA, 99 bp, Artificial
  Hairpin sequence PT_from_MQbrain_128, chimp
gctgtccgctcgggctctggaggcagccaacgccgccagtctgaggcaggtgcccgacatggcgagtgtagtgctgccgagcggatcccagtgtgcggc

SEQ ID NO: 8277 - DNA, 72 bp, Artificial
  Hairpin sequence PT_from_MQbrain_1280, chimp
ggccatgtggaggaggaggcctgtgagcactggctctctggacattgctcatctccctccttgacaagcgcc

SEQ ID NO: 8278 - DNA, 117 bp, Artificial
  Hairpin sequence PT_from_MQbrain_1286, chimp
gcttttaattctgtccgctggaagagaagcactgatgctgctgactggaccctgggcagcccaggcttcacccaagtgggcagtctcaggctttctcactctggaggagagagctgc

SEQ ID NO: 8279 - DNA, 83 bp, Artificial
  Hairpin sequence PT_from_MQbrain_1287, chimp
gctagaaatcaaggccatctggagtgttctgcatgggagagaattctattcagttcgctttagtggccctttttattctcagt

SEQ ID NO: 8280 - DNA, 100 bp, Artificial
  Hairpin sequence PT_from_MQbrain_1288, chimp
cttgtacccctgactttagatggagcctggggttctctgccatcgctgcctcttgagacagacctgtgacctcactctactgtaagtgcaggggtgcagg

SEQ ID NO: 8281 - DNA, 60 bp, Artificial
  Hairpin sequence PT_from_MQbrain_1295, chimp
gcacaaaagtggtgctgtggccagcctgctgagcaaggcagagcgggccacggagctggc

SEQ ID NO: 8282 - DNA, 86 bp, Artificial
  Hairpin sequence PT_from_MQbrain_1296, chimp
tccttgcctcacacaaccaagatgaagtccaggcttgcagagtcagaaaaaattctggtctacaggcctcttctctatagggagga

SEQ ID NO: 8283 - DNA, 72 bp, Artificial
  Hairpin sequence PT_from_MQbrain_1297, chimp
agaaaaggaaacctggcctgggcaaaggagtatgggcctatagggtcccctgctaggccaggaccctcttct

SEQ ID NO: 8284 - DNA, 98 bp, Artificial
  Hairpin sequence PT_from_MQbrain_1298, chimp
gcctgccacctctgcccaggacactcttccctcttggggtgtgtgatgaactcccaggagaggaaagatgggagccagggcaagataggaagctctgc

SEQ ID NO: 8285 - DNA, 73 bp, Artificial
  Hairpin sequence PT_from_MQbrain_1299, chimp
gggtggggcaactcaggctcagacctgccttgatctgaggcagggacagggctgggtgtgtctgtgtccgctc

SEQ ID NO: 8286 - DNA, 82 bp, Artificial
  Hairpin sequence PT_from_MQbrain_13, chimp
ggcagagccctcgagggaaaggtcctggctgagctgccttgcaaggccgcccacagccgggccagctcccttgtgccaggcc

SEQ ID NO: 8287 - DNA, 74 bp, Artificial
  Hairpin sequence PT_from_MQbrain_1301, chimp
ccagtccttgtaccgggcgcgcgtcctggaagatgcaccctccggcacgcgcgtggtacaagtccttgcaacgg

SEQ ID NO: 8288 - DNA, 79 bp, Artificial
  Hairpin sequence PT_from_MQbrain_1305, chimp
caggtcctcctgactcttacgaatccagttgagaacctcacccatgtgactctcttggagtgtgaggagggggaccctg

SEQ ID NO: 8289 - DNA, 64 bp, Artificial
  Hairpin sequence PT_from_MQbrain_1306, chimp; PT_from_MQbrain_1711, chimp
gctcttgggcgaggttcactggtccgcagggggagggccagggaagtcgtgctgtgccagaggt

SEQ ID NO: 8290 - DNA, 103 bp, Artificial
  Hairpin sequence PT_from_MQbrain_1308, chimp
ttaggaaagccctgtcaaagcaagagatggctagtgcttcatccagccaaagaggtcgaagaggttctggaaattttggtggtggttgtagaggtggttttgg

SEQ ID NO: 8291 - DNA, 115 bp, Artificial
  Hairpin sequence PT_from_MQbrain_1311, chimp
ggccttgcaaggctcttaaccgaaagggggaggaggaaggtcgccaacaaacggctgagctcacaatcctggccggggcgtccccctcccccatggagagagccagacccgagcc

SEQ ID NO: 8292 - DNA, 76 bp, Artificial
  Hairpin sequence PT_from_MQbrain_1315, chimp
cctggagcccgggcggtggtggatatggtggctggggaggttcccaaggccgagatcaccgcagagggctgaatgg

SEQ ID NO: 8293 - DNA, 84 bp, Artificial
  Hairpin sequence PT_from_MQbrain_1320, chimp
ggggtgcagcactgatggtgacttgtcttgcttggactaagccagcactagcaggacacgctaagccggtcactgcacaacccc

SEQ ID NO: 8294 - DNA, 75 bp, Artificial
  Hairpin sequence PT_from_MQbrain_1322, chimp
ccgggtgaggcaattctcttggaagcgaaggtgtcggctatgagccggagcctccttccttgaatttctccgtgg

SEQ ID NO: 8295 - DNA, 77 bp, Artificial
  Hairpin sequence PT_from_MQbrain_1328, chimp
atggtgagcctggaggaagactcgtgttgggcccacaggccccaggcaagtgtacgtcagccaggtgctcagcccat

SEQ ID NO: 8296 - DNA, 117 bp, Artificial
  Hairpin sequence PT_from_MQbrain_1330, chimp
atgtttatggtaattaatgacaggttttgcataattcctggaaccagagatcaaaattcttgctctgtttgattctggtgcaaggaattatgcaaaacctgtcatcattagatgcat

SEQ ID NO: 8297 - DNA, 99 bp, Artificial
  Hairpin sequence PT_from_MQbrain_1331, chimp
ggccgccccggctcggtccgcacccctctcctcggggcgcctgagcggcaggctgcgtggccggggaggagaggtgcagagcaggcggggcgcgcagcc

SEQ ID NO: 8298 - DNA, 110 bp, Artificial
  Hairpin sequence PT_from_MQbrain_1334, chimp
tgagacaggcccctgcagagggatgccttaaagctgtccctggctggaggagcactccaccttggggacagtggagggggccttcagccctctgcaccctgcctgcctca

SEQ ID NO: 8299 - DNA, 106 bp, Artificial
  Hairpin sequence PT_from_MQbrain_1339, chimp
tggggcagtaaatgaggttggcagagtggcagtgggggccctgcagagccagccttggagcctgctcattctgggcccttgctgccaaggagcccagcctcaccta

SEQ ID NO: 8300 - DNA, 117 bp, Artificial
  Hairpin sequence PT_from_MQbrain_1341, chimp
agtgaatctagcagccaatgggcattagtggtacagttctgcaggctacacaatatgaaactaagcatatcttaccttagagaatgtgccaaagcaaatgattggctgcagttcatt

SEQ ID NO: 8301 - DNA, 114 bp, Artificial
  Hairpin sequence PT_from_MQbrain_1343, chimp
caaatagacctgatgtgctagatactgctttgttacgacctggaagattagataagatcatctatatcccacctccagatcacaaggtagtcatttacacatttactctgtgtg

SEQ ID NO: 8302 - DNA, 110 bp, Artificial
  Hairpin sequence PT_from_MQbrain_1344, chimp
aggctgaaggggatgctaaaggagacaaacccaaggtgaaggatgaaccacagagaagatctgcgaggttgtctgctaaacctgctcctccaaagccagagcccaagcct

SEQ ID NO: 8303 - DNA, 85 bp, Artificial
  Hairpin sequence PT_from_MQbrain_1345, chimp
tggaaaggggaatttagaaggagaggttcagtgggctggagagttaccctagaccttggcacccttttgaagattcccaaccccg

SEQ ID NO: 8304 - DNA, 91 bp, Artificial
  Hairpin sequence PT_from_MQbrain_1346, chimp
gagttgggggtgggtgtggtggaggggaatgtgttgagttgtgccctaaagaatgggtaagatttagattttttggaactcattccaactt

SEQ ID NO: 8305 - DNA, 111 bp, Artificial
  Hairpin sequence PT_from_MQbrain_1348, chimp
tccatggagctcttcagcaatggagggaaatagggtttggggtcactttgttgtgtgtcttggggatgaggtggcttttcccagatggcccttgctggagagggactggga

SEQ ID NO: 8306 - DNA, 103 bp, Artificial
  Hairpin sequence PT_from_MQbrain_1349, chimp
gaggagtcaggtgaggagaagagagtttggtgtccaggggagatggacaaatctctttctttggatggaacctctctttcttcctcctctgttttggattgtc

SEQ ID NO: 8307 - DNA, 99 bp, Artificial
  Hairpin sequence PT_from_MQbrain_1350, chimp
ggactgttgattctcctccctgggatttggcagcctgtgcgttagctataccgccatgcttgttaaaatgaccacagggctggaaaattatctatgtct

SEQ ID NO: 8308 - DNA, 70 bp, Artificial
  Hairpin sequence PT_from_MQbrain_1355, chimp
ccacccgcttgccttggtgctcagccctcccattgggagcaggttggggcgagctggaggcccgggctgg

SEQ ID NO: 8309 - DNA, 119 bp, Artificial
  Hairpin sequence PT_from_MQbrain_1360, chimp
ttgctagtcgtgggtcccctgacttctcactgggtgggttgagttaaagaggtgggattaataactaatctaaatgccactttcttacttttccagaagaagaaaggggtcagaagcga

SEQ ID NO: 8310 - DNA, 95 bp, Artificial
  Hairpin sequence PT_from_MQbrain_1361, chimp
aggatgtttgagaaaggttgggggcacagagagcgaggagccttccccagaggagtcaggccttgttcctgtccccattcctcagagtttatcct

SEQ ID NO: 8311 - DNA, 93 bp, Artificial
  Hairpin sequence PT_from_MQbrain_1364, chimp
ctggaactgcactggggtaaggataggagggtcaggtctgcagccttgtatctgctgatcctctttcgtccatcccactccaggtcatttggg

SEQ ID NO: 8312 - DNA, 87 bp, Artificial
  Hairpin sequence PT_from_MQbrain_1365, chimp
cccagccccctggccccaaaccctgcagccccagctggaggatgaggagatgctgggcttgggtgggggaatcaggggtgtaaaggg

SEQ ID NO: 8313 - DNA, 90 bp, Artificial
  Hairpin sequence PT_from_MQbrain_1366, chimp
tgggccagatgggtccagatgcagggtgcaggtcaatgtggtatgcttttgcttgcatctgcagatcttctgggctggctggttgaacca

SEQ ID NO: 8314 - DNA, 99 bp, Artificial
  Hairpin sequence PT_from_MQbrain_1367, chimp; PT_from_MQbrain_1544, chimp
cgtccagtgcctatgtcgtgccgctgtcgccgccaccaccatgcccaagagaaaggctgaaggggatgctaaaggggataaagccaaaggggaaggatg

SEQ ID NO: 8315 - DNA, 76 bp, Artificial
  Hairpin sequence PT_from_MQbrain_1368, chimp
tcgtcctcttctgcctggtgctgctgtttctctggagccggggcaagggcaacacaaagcacaacattgagatcga

SEQ ID NO: 8316 - DNA, 77 bp, Artificial
  Hairpin sequence PT_from_MQbrain_137, chimp
agtggcggctgaagcgccgctggcggggctcactgtcgtggtgtgagtgggaggcggcggcgctggtggctgcagct

SEQ ID NO: 8317 - DNA, 117 bp, Artificial
  Hairpin sequence PT_from_MQbrain_1374, chimp
ggtgggaatagaaggggtgaggaagagctgctaagggtgactgtgtttggaaggggatcagcggctggggctcctccttcaaaccagggcccccatgctcatcatttcccctctact

SEQ ID NO: 8318 - DNA, 92 bp, Artificial
  Hairpin sequence PT_from_MQbrain_1377, chimp
ttccaggccaatgctgaagacacagctcagcttgggagcctgagaacccgggcttcccaggccacagtgtggcttcttaaatggcaaaggaa

SEQ ID NO: 8319 - DNA, 119 bp, Artificial
  Hairpin sequence PT_from_MQbrain_1378, chimp
tcctgttgtttgcctccaaggtgtccccacccagtgactctggccggcatgctggagatgggtgtctcctacctgcctgtcaaccagaactgggagcgttacctggcagaggcacaggg

SEQ ID NO: 8320 - DNA, 114 bp, Artificial
  Hairpin sequence PT_from_MQbrain_1379, chimp
ggcgctcctattccagatccgccgacagagggcgccgggggcccgagaggagcatgttcgggcgcctctcccgggtccctggcgccacgctgtggggcttggtggttcagagcc

SEQ ID NO: 8321 - DNA, 119 bp, Artificial
  Hairpin sequence PT_from_MQbrain_1380, chimp
gtccctcctcccactcccgcaatgctttttccatctagggcagatggtgtcccacagagggaaatccaggcaccagcaggacaggaaggggcgatgcagtggggtaagtggagtggggc

SEQ ID NO: 8322 - DNA, 103 bp, Artificial
  Hairpin sequence PT_from_MQbrain_1382, chimp
gggtgcctgggccccagggtgtggcaggagacccagtggatggggccagctggcctgccctgatcctctgcttcctcctcacaaccccaagagcccccaaccc

SEQ ID NO: 8323 - DNA, 75 bp, Artificial
  Hairpin sequence PT_from_MQbrain_1384, chimp
atttgctggaaaagtcctcctcagagctaggcatagctctgtctgatggaggcctgacttgcttctagaaagagt

SEQ ID NO: 8324 - DNA, 89 bp, Artificial
  Hairpin sequence PT_from_MQbrain_1390, chimp
acacaccaagctggtctcagtggtcacttttggggaggaggaaactgatactgaaggaagtggccaaggtgaatgctggctttatctgt

SEQ ID NO: 8325 - DNA, 79 bp, Artificial
  Hairpin sequence PT_from_MQbrain_1391, chimp
agtgactgttagtgtgtgccgctgccagcctgacggctctgtggcatcctgctggcctgaggctcacctctcagctgct

SEQ ID NO: 8326 - DNA, 112 bp, Artificial
  Hairpin sequence PT_from_MQbrain_1392, chimp
cctggctccatgaaggtcctttggcacagctctgctcctcccctgcctgccaaagcccccctttaggccttgggtggctggagggctttgttaagggactaggagaaatggg

SEQ ID NO: 8327 - DNA, 106 bp, Artificial
  Hairpin sequence PT_from_MQbrain_1394, chimp
ggggtggaagggatggggaggtcgggggagtcggagaaccaaaaggggagtgaaggaactggactgaggggagccgatttctcgataaccagaaagcagaagccct

SEQ ID NO: 8328 - DNA, 86 bp, Artificial
  Hairpin sequence PT_from_MQbrain_1396, chimp
ggatggaaaggatggtcccacggagaccctggaggagctggtcctgggactagccgctgaggtgtgtgatgattttcttgtctact

SEQ ID NO: 8329 - DNA, 79 bp, Artificial
  Hairpin sequence PT_from_MQbrain_1399, chimp
gcggggcgccggggaaggaggtgggggagtgccaggttaactaagtcccggcacaccctactgcaccttcctgttttgc

SEQ ID NO: 8330 - DNA, 118 bp, Artificial
  Hairpin sequence PT_from_MQbrain_14, chimp
gtggggcattcccctgcagcaaggggcggggccaccccaacgccgcttctgcggccaaagtaggttgggagtggaaggtggtggctgctgctccgcagtgtcgggaagatggcgccgc

SEQ ID NO: 8331 - DNA, 77 bp, Artificial
  Hairpin sequence PT_from_MQbrain_140, chimp
cctgagccagacccatgtgggccatagctggaagactgcccggaaccagactcaagatggccacggctagggctagg

SEQ ID NO: 8332 - DNA, 77 bp, Artificial
  Hairpin sequence PT_from_MQbrain_1400, chimp
ctgggagctgggctatcaggctctccattgcctttgccttcaaaggtggcatagaagagaatgaaccacagtcccag

SEQ ID NO: 8333 - DNA, 72 bp, Artificial
  Hairpin sequence PT_from_MQbrain_1402, chimp
accatgggctgagtgtgcatgtgcagggagtggggccctgtggcttcccctgtgcctccaggacaccaaggt

SEQ ID NO: 8334 - DNA, 103 bp, Artificial
  Hairpin sequence PT_from_MQbrain_141, chimp
gcttgggtactgcattgattaggagattatatggagctgcgggagctgccgcctgggggaagagaggtgcagcttctgctaggtttgtgctctcctcccaggc

SEQ ID NO: 8335 - DNA, 91 bp, Artificial
  Hairpin sequence PT_from_MQbrain_1412, chimp
ggtgaaatgtttgcttcaaggtccctagatatttaccctgtgggcctgctttgaggtttcagggtggactggtggtgggctctgcagtgcc

SEQ ID NO: 8336 - DNA, 110 bp, Artificial
  Hairpin sequence PT_from_MQbrain_1416, chimp; PT_from_MQbrain_341, chimp
aggctgaaggggatgctaaaggagataaagccaaggtgaaggacgaatcacacagaagatccatgaggttgtcagctaaacctgctcctccaaagccagaacccaagcct

SEQ ID NO: 8337 - DNA, 119 bp, Artificial
  Hairpin sequence PT_from_MQbrain_1420, chimp
ggtgagtcaaaggtcagctctccagacatgccattcccctggcaggcctgggctgaggtatgcacctgtcttcctggttgcttgggaatggcattgagaagtggcttccattggcaacc

SEQ ID NO: 8338 - DNA, 87 bp, Artificial
  Hairpin sequence PT_from_MQbrain_1421, chimp
gctgggtgggagtgctggtgggaagctccggaagggaggctgctcggggcctccctgtggctgtggctgcatgggcagccccgaagc

SEQ ID NO: 8339 - DNA, 88 bp, Artificial
  Hairpin sequence PT_from_MQbrain_1423, chimp
ctggcagggtggaggctgggctggggagttagctgcagtgtgcgtgaatggctctgtctccagcaagtctctctccatcaaaccccag

SEQ ID NO: 8340 - DNA, 113 bp, Artificial
  Hairpin sequence PT_from_MQbrain_1425, chimp
gtcagggtggcttttcccctgactgtgtccgatgccaaggagtcctggcctccgcagatgcttcattttgacccttggctgcagtggaagtcagcacagagcagttccctggc

SEQ ID NO: 8341 - DNA, 119 bp, Artificial
  Hairpin sequence PT_from_MQbrain_1427, chimp
tgggccctggtgtaggaaaggcctgaggtgggtctcatctgttaacattatttagagctctttgggttaacgggggcagacacccaattcactgttgtttacactcacaaggaagttta

SEQ ID NO: 8342 - DNA, 119 bp, Artificial
  Hairpin sequence PT_from_MQbrain_1429, chimp
tgtaatgctttgttctgtagcccccaggtttccctagatgacaaataaacattccttttcctgcgtgaagatcgtttgtggaaaccttggccatggcatcgatatcagagcctgttaca

SEQ ID NO: 8343 - DNA, 109 bp, Artificial
  Hairpin sequence PT_from_MQbrain_1430, chimp
ggctctgtggtatttgacatgcagatgggcccagaattcctgacttaaggctaaagatttatcttgagcttatgatgtgggcttatcatgattgttttgatcagcagct

SEQ ID NO: 8344 - DNA, 91 bp, Artificial
  Hairpin sequence PT_from_MQbrain_1433, chimp
tgttccaggtcccaggttcacccttttctgctactgggcagtccttctggaagccccggaggagtggctggtgcctagggcccagggggca

SEQ ID NO: 8345 - DNA, 77 bp, Artificial
  Hairpin sequence PT_from_MQbrain_1439, chimp
gctgccccggggcgccttcgccgtggcgcatgaggccaccacctgccacggcgagatctacgtgtccgggggctcgc

SEQ ID NO: 8346 - DNA, 90 bp, Artificial
  Hairpin sequence PT_from_MQbrain_1443, chimp
cctctgctccagttctcccgagagcctgtcagtttcagtccgctgcgggcaggcggagtggaaccgccaggcagagggggacggaagagg

SEQ ID NO: 8347 - DNA, 93 bp, Artificial
  Hairpin sequence PT_from_MQbrain_1444, chimp
gactcgggccccagcatcgtggtgtccttcctcattgctgccctggcttcagtgatggctggcctctgctatgccgaatttggggcccgtgtt

SEQ ID NO: 8348 - DNA, 83 bp, Artificial
  Hairpin sequence PT_from_MQbrain_1447, chimp
agattcttggctccagcctggctcccctccttggaaaggaagatggagagagggaaggggagtgggaaggggtgaagcactct

SEQ ID NO: 8349 - DNA, 70 bp, Artificial
  Hairpin sequence PT_from_MQbrain_145, chimp
gccttcttggcaggcgtgggaggaacaagcctgcgtggtgctgtccctccctccccaccaggagcagagc

SEQ ID NO: 8350 - DNA, 75 bp, Artificial
  Hairpin sequence PT_from_MQbrain_1450, chimp
cagccaggtaggaggcctgggcagggaagattccagtcatcctgcccagtaggaaggggctttctgccaagactg

SEQ ID NO: 8351 - DNA, 86 bp, Artificial
  Hairpin sequence PT_from_MQbrain_1458, chimp
gctacagtgagggtgacagggctgtcctcaggggcttcagtgagagcagcgaggaggaggaggagccggaaagccctcggtcaagc

SEQ ID NO: 8352 - DNA, 119 bp, Artificial
  Hairpin sequence PT_from_MQbrain_1459, chimp
ggagaagagtgatccagaccatggggaaggacctcactcccatcacgccgtccaggtaagcctgggctggtggacgagcagggcaggtcttgtcatccgaggcctgggtagagcttccc

SEQ ID NO: 8353 - DNA, 75 bp, Artificial
  Hairpin sequence PT_from_MQbrain_146, chimp
tcataacccagacttgacctgccagggcacactggagtgaagcggcgccctggtgggagggtgtgggggcagtgg

SEQ ID NO: 8354 - DNA, 64 bp, Artificial
  Hairpin sequence PT_from_MQbrain_1461, chimp
acttgcccacttctgggggcagagctgccacttccacgaggtgctcctgctcccaaggggcagt

SEQ ID NO: 8355 - DNA, 79 bp, Artificial
  Hairpin sequence PT_from_MQbrain_1463, chimp
gttgggccgacccactgagcgctggaaggacacctgggaccgggtgaaggctgcacagcgcctcgagggccggcccgac

SEQ ID NO: 8356 - DNA, 107 bp, Artificial
  Hairpin sequence PT_from_MQbrain_1466, chimp
ccaccatcttgaagcttttagaggcctgctgggaataggacttctaaaaggcaaatatgtctggaaggctgtggtccaaggccattttttgttggctataaatgggg

SEQ ID NO: 8357 - DNA, 118 bp, Artificial
  Hairpin sequence PT_from_MQbrain_147, chimp
ctggccctgccttgcctccccacccagtattgcccggcccctcagaagctagccatggtaaaaaggcttggctcaggaggggctggaaggactgagaaaggagaagggtcagagccag

SEQ ID NO: 8358 - DNA, 117 bp, Artificial
  Hairpin sequence PT_from_MQbrain_1470, chimp
gctcgctcccggctcgctcctcacctctccgccgcccgcccccttctccgcgcgggacgctgcccggagcgcggcggggcgggggtggaggacgagagagcggtcggtggcgtcggc

SEQ ID NO: 8359 - DNA, 78 bp, Artificial
  Hairpin sequence PT_from_MQbrain_1471, chimp
acaacattgctgctttgagagtgggaagggcactttgcactgcatgccattttctgttctttgagtggcacatactgt

SEQ ID NO: 8360 - DNA, 113 bp, Artificial
  Hairpin sequence PT_from_MQbrain_1475, chimp
ctgtgttagagggtggaacagatgtgtttggcactgcatgggatctggtgttcctcttctcctggattcacatccccacccaaggccctcttaagtgttctgccctagcctag

SEQ ID NO: 8361 - DNA, 64 bp, Artificial
  Hairpin sequence PT_from_MQbrain_1477, chimp
gctggccttgcctaggactgttgagcactgaaagtcatacatcagttctaggcaagccaaaagc

SEQ ID NO: 8362 - DNA, 113 bp, Artificial
  Hairpin sequence PT_from_MQbrain_1478, chimp
cttcaaagatagagcaaggcttggggaggcagtgcttcaggggaggaaacctacttgcgtctgttctccctgtgaagtaatggagctcacccccttttgttcttcctttggag

SEQ ID NO: 8363 - DNA, 91 bp, Artificial
  Hairpin sequence PT_from_MQbrain_1487, chimp; PT_from_MQbrain_1884, chimp
tcgccctggtatgatgcccgcaccccatatggggggccctcccatgatgccaatgatgggccctcctcctcctgggatgatgccagtggga

SEQ ID NO: 8364 - DNA, 73 bp, Artificial
  Hairpin sequence PT_from_MQbrain_1489, chimp
tgggactgtggccttccttggggacaggcagtgccttcatcatctgtttgttcccaagacagccatgtaatca

SEQ ID NO: 8365 - DNA, 109 bp, Artificial
  Hairpin sequence PT_from_MQbrain_1503, chimp
tcgctggcagacacactctgtggccaggtaggcccagacctgtctgagtatggactgacaccaagctcagagaggtctggacctggccacggagcacctcatgctagga

SEQ ID NO: 8366 - DNA, 73 bp, Artificial
  Hairpin sequence PT_from_MQbrain_1507, chimp
ctggagcccccagagaccagaggcggccggcggggggccggccctcgcccttggccatggggaagcgtctcag

SEQ ID NO: 8367 - DNA, 97 bp, Artificial
  Hairpin sequence PT_from_MQbrain_151, chimp
ggtcttggccggcaggctagctcctggggtacagatggcatcagatgttttgactatggactgtggctcagggcctggtcttccatcctatcaggcc

SEQ ID NO: 8368 - DNA, 72 bp, Artificial
  Hairpin sequence PT_from_MQbrain_1513, chimp
cccgtgatcaggactattctaatttctcttcatccatggaaaaagagtctgaggatggtccagtttcctggg

SEQ ID NO: 8369 - DNA, 110 bp, Artificial
  Hairpin sequence PT_from_MQbrain_1515, chimp
tacatactgagctcctaaagtttaaattcaggtactgagtgtacaatttcaccaacattctaacccatgaaacttttacactctgtaccaagaaactgttggcttttgta

SEQ ID NO: 8370 - DNA, 94 bp, Artificial
  Hairpin sequence PT_from_MQbrain_1518, chimp
gttcaccaccgggcagctgggccaggctttctggggaggtgagctccccctgttcaccaccgggcagctgggccaggttttctgggaggtgggc

SEQ ID NO: 8371 - DNA, 73 bp, Artificial
  Hairpin sequence PT_from_MQbrain_1520, chimp
gacctcatacctcccctccccaggggctggtacccacctcctagcccttcttggatggggcagggttaccgtc

SEQ ID NO: 8372 - DNA, 79 bp, Artificial
  Hairpin sequence PT_from_MQbrain_1525, chimp; PT_from_MQbrain_1592, chimp; PT_from_MQbrain_1700, chimp; PT_from_MQbrain_1724, chimp; PT_from_MQbrain_468, chimp; PT_from_MQbrain_664, chimp; PT_from_MQbrain_972, chimp
ggtggagaacaagaaagctcagctggtggtgattgcacacgatgtggattccatcgagctggttgtcttcttgcctgcc

SEQ ID NO: 8373 - DNA, 118 bp, Artificial
  Hairpin sequence PT_from_MQbrain_1527, chimp
cagtgcatcatcgaccagttcatcagcaccggccaggccaagtgggtgcggcataacggcattgtgctgctgctgccccatggcatggaaggcatggtgagggctgcggtggtggctg

SEQ ID NO: 8374 - DNA, 108 bp, Artificial
  Hairpin sequence PT_from_MQbrain_1531, chimp
tgcttccagggattcaataactgaccagaacacctgagcttccaatgtgcctgcctctaccctgcccagtgcttgcccaggtggaaagtcagtgccttcctggtttca

SEQ ID NO: 8375 - DNA, 76 bp, Artificial
  Hairpin sequence PT_from_MQbrain_1535, chimp
ctctgggctcagcacctgaggcgggtttcctgggtcccctctccagcaagcctccaccagcaagctcagcccagag

SEQ ID NO: 8376 - DNA, 55 bp, Artificial
  Hairpin sequence PT_from_MQbrain_1536, chimp
gcaggtgcgtgtggaggcaagctagtcctgagaccgccccacacgctgtgcctgt

SEQ ID NO: 8377 - DNA, 90 bp, Artificial
  Hairpin sequence PT_from_MQbrain_1537, chimp
ctcactggggacagggcggtggccaggcagatggctggagggaagcagagcctccttgccggctgcctgtgctgttctgggcccagagag

SEQ ID NO: 8378 - DNA, 116 bp, Artificial
  Hairpin sequence PT_from_MQbrain_1540, chimp
gagattgtattggattttactaaattgtgtcagtgagggagtaagttgaataagagacccgaccagggcatattcataactctgtctcctgacagtggttgattatatacgatttt

SEQ ID NO: 8379 - DNA, 91 bp, Artificial
  Hairpin sequence PT_from_MQbrain_1545, chimp
ttctatgggaaaggggggaattttactttctcgtcgctctgttctgagagtggatgattgaactgccactttctccctgactctcatggga

SEQ ID NO: 8380 - DNA, 73 bp, Artificial
  Hairpin sequence PT_from_MQbrain_1547, chimp
cctccagtagagggcgcactcttgcgagcggcttttgtagccagttgcttcctgggcgctttaccaccggtgg

SEQ ID NO: 8381 - DNA, 102 bp, Artificial
  Hairpin sequence PT_from_MQbrain_1549, chimp
ggaggagatgagtgtaccccaggactgtcacctccttccctccactgaaagcttttccgggggaggcagtgaagatgtcatttctaggcctcattctcctcc

SEQ ID NO: 8382 - DNA, 69 bp, Artificial
  Hairpin sequence PT_from_MQbrain_1550, chimp
gcttctctgtagttgggcagctgctcttggtctagtgaccaccagcctggacagctacggagaacccgc

SEQ ID NO: 8383 - DNA, 118 bp, Artificial
  Hairpin sequence PT_from_MQbrain_1551, chimp; PT_from_MQbrain_1552, chimp
ctgcgggggcatcgctggagccgccggcagctccggcacccggagaagacaaccccgccggggctgggggagcggcggtggccggggctgcaggaggggctcggcggttcctgtgcgg

SEQ ID NO: 8384 - DNA, 81 bp, Artificial
  Hairpin sequence PT_from_MQbrain_1561, chimp
ctaatgttaaaaaagtggtgggagctgatcacctatgctgccgtaaaatgaaacagctccccctcttatatttgaccagag

SEQ ID NO: 8385 - DNA, 92 bp, Artificial
  Hairpin sequence PT_from_MQbrain_1569, chimp
ctgtggacaggtccctggggtgtccagccagctactaggcctgaccaggaggcttgctggggcccatccctgggtcattgtacgagccagag

SEQ ID NO: 8386 - DNA, 69 bp, Artificial
  Hairpin sequence PT_from_MQbrain_1570, chimp
gtttctgactggtgtctagcagccctgccagagagagtggcagtgtgtctgcaggcgaccaggagaaat

SEQ ID NO: 8387 - DNA, 70 bp, Artificial
  Hairpin sequence PT_from_MQbrain_1571, chimp
gccggcacgagggtgttttcgacgttggttgtggggaaacagcaagcggcgtggacgaccgttgctgagc

SEQ ID NO: 8388 - DNA, 108 bp, Artificial
  Hairpin sequence PT_from_MQbrain_1572, chimp
agttgatgcatctgtggctgtcttttgtgagatccagaacacactaattaacacactgattagaaaacatggaacagaagaacaaaaggccacctatttgcctcagct

SEQ ID NO: 8389 - DNA, 113 bp, Artificial
  Hairpin sequence PT_from_MQbrain_1573, chimp
ctctgagccaggaagccttgttagaggaaggaactctggcattcagaggggtccccttgggggcacttgcttgggtcttggatcaaactctactggggcagcctggctgtggg

SEQ ID NO: 8390 - DNA, 83 bp, Artificial
  Hairpin sequence PT_from_MQbrain_1574, chimp
gaggggcaaggaggaaaagctgctgatcagttgtgtctctccctttaaataaagctgctccttgtggctcctcttagtccttc

SEQ ID NO: 8391 - DNA, 88 bp, Artificial
  Hairpin sequence PT_from_MQbrain_1575, chimp
tggccatgtcaaaacttggctacaaggctctttccctctctgtgaaggacaggcaataaagaggaggcctggggtggcggcgtgggca

SEQ ID NO: 8392 - DNA, 119 bp, Artificial
  Hairpin sequence PT_from_MQbrain_1579, chimp
tccagggcctgtggggcttgcgtggccgctgtggtctcagcaggcgtggggggcctggacgctgggtcctgtggggcttgtgtggccgctctggtctcggcaggcgtggggggcctgga

SEQ ID NO: 8393 - DNA, 113 bp, Artificial
  Hairpin sequence PT_from_MQbrain_158, chimp
ggcccgggccctgctactgccccagggtgcctgcactggccggacccccggacccccagccagcggtgcgggtggggcggccaatggcactggggcaggggcagtcatgggcc

SEQ ID NO: 8394 - DNA, 106 bp, Artificial
  Hairpin sequence PT_from_MQbrain_1584, chimp
tggccgcattcttagggaacgtcttcagtgtgcacactgcggtggtcccttagccacaagcttagggaatgtcttcagtgtgtacgtggtggcggtcccttggcta

SEQ ID NO: 8395 - DNA, 93 bp, Artificial
  Hairpin sequence PT_from_MQbrain_1585, chimp
cttagggaacgtcttcagtgtgcacactgcggtggtcccttagccacaagcttagggaatgtcttcagtgtgtacgtggtggcggtcccttgg

SEQ ID NO: 8396 - DNA, 98 bp, Artificial
  Hairpin sequence PT_from_MQbrain_1589, chimp
gttcatcaattttgtgaagaattgcttccgggtgactgactaggaggctattcgagatctctggcagtggaggaagcctctttaagaatagtttaaac

SEQ ID NO: 8397 - DNA, 89 bp, Artificial
  Hairpin sequence PT_from_MQbrain_1601, chimp; PT_from_MQbrain_386, chimp
gttccggcagtggcatctggggccggggtagcggccatggactgggccggggccgaagccgcggagctcgcggaggcaaggccgaggat

SEQ ID NO: 8398 - DNA, 116 bp, Artificial
  Hairpin sequence PT_from_MQbrain_1602, chimp
ggaacacctgagctctattcctgggctctgaaggtgctcacagtgagaagtgccctgcatacattgttggcctataccctgagacctgagaccccaggaggagttggggggatgcc

SEQ ID NO: 8399 - DNA, 105 bp, Artificial
  Hairpin sequence PT_from_MQbrain_1605, chimp
tggagataatcttgagacaaccttgcatttccagtttccctccttgggcagcctaactatgagggagggaaacatggcttgcaataaattagcattgtgtcttca

SEQ ID NO: 8400 - DNA, 114 bp, Artificial
  Hairpin sequence PT_from_MQbrain_1608, chimp; PT_from_MQbrain_18, chimp
tcatgtcataaaaatgacttcatagttattggggttagggaagtggagaagagataatctttttcattatgttttgactggatggctggttttgaggtttcaaacctgacttga

SEQ ID NO: 8401 - DNA, 99 bp, Artificial
  Hairpin sequence PT_from_MQbrain_1609, chimp
ttcctgaaaatttccaaggggcaccaagtggcagctggcttcctggggtgaagaggcaggcaccccagagtcctcaactgggcctaggggaagaaggag

SEQ ID NO: 8402 - DNA, 119 bp, Artificial
  Hairpin sequence PT_from_MQbrain_161, chimp
gcccagggccaggagatcctccttgatctgggtgcagccccttctgcctggagaaaagggtataccaggagctgcagtgcccagacagggaggaggctccagcctggctttctgagggc

SEQ ID NO: 8403 - DNA, 105 bp, Artificial
  Hairpin sequence PT_from_MQbrain_1616, chimp
ctggaggtgaaggctcaggggaaagggaggcagggaagggccatgatgagatgtctctgcctttcccagcgccatcctttacctaaatggggacttcgatggcgg

SEQ ID NO: 8404 - DNA, 78 bp, Artificial
  Hairpin sequence PT_from_MQbrain_1619, chimp
cagcaggctcctctgtttacccacctagttggccaagcagtgactgccacaggggagggaaaggggagggactgcatg

SEQ ID NO: 8405 - DNA, 84 bp, Artificial
  Hairpin sequence PT_from_MQbrain_162, chimp
gtgggctgcgtcctttggtcctgtccccgcagccctggcagggggcatgcggtcgggcaggggctggagggaggcgggggctgc

SEQ ID NO: 8406 - DNA, 63 bp, Artificial
  Hairpin sequence PT_from_MQbrain_1621, chimp
ggcaacctctctcttctcccctgtttcgtgaaggcaggggacacagatgggagagattgagcc

SEQ ID NO: 8407 - DNA, 69 bp, Artificial
  Hairpin sequence PT_from_MQbrain_1624, chimp
gtctcctgtagggaaggggctgggcttgtgtcctgctgtgtgcccaatctccttctcttcgctgaggac

SEQ ID NO: 8408 - DNA, 100 bp, Artificial
  Hairpin sequence PT_from_MQbrain_1625, chimp
gtcaaagcaagagatggctagtgcttcatccagccaaagaggtcgaagtggttctggaaactttggtggcggtcgtggaggtggtttcggtgggaatgac

SEQ ID NO: 8409 - DNA, 116 bp, Artificial
  Hairpin sequence PT_from_MQbrain_163, chimp
agaggccacctaagaagctgcacattgtccttctctgatgccttccctggatttgtgcagagactgggagggctttcagggaggatcagtgtcatcagagtcccgggctgaccttt

SEQ ID NO: 8410 - DNA, 118 bp, Artificial
  Hairpin sequence PT_from_MQbrain_1631, chimp
gccagtggccccactctgggctgccctgttcttcttcatgctgttgctgcttggtctcgacagccaggtttgcatggggctctgggacagggagccaggaggggggcggagtgagggc

SEQ ID NO: 8411 - DNA, 72 bp, Artificial
  Hairpin sequence PT_from_MQbrain_1635, chimp
gtggagaccttatagaagccaaacagctcctactgattccagggcagctgtggaggaggatgaggaggccac

SEQ ID NO: 8412 - DNA, 104 bp, Artificial
  Hairpin sequence PT_from_MQbrain_1638, chimp
gcttctagtgcgtcctgtaccttggcaggtttgtgggctgggtgggccttgaccccagagcccggtccacagggtctgtctgagctgtggggtgcgtgtgaggc

SEQ ID NO: 8413 - DNA, 68 bp, Artificial
  Hairpin sequence PT_from_MQbrain_1640, chimp
ccttaagggccacctccaccctggccaggcccccaaactggcacactggtctggatggaagcccctgg

SEQ ID NO: 8414 - DNA, 119 bp, Artificial
  Hairpin sequence PT_from_MQbrain_1642, chimp
tagcctcactgcacccctctctatcctcccaggctactccatgtttggggctggcctcaccgtaggcctgtctaacctcttctgtggagtctgcgtgggcatcgtgggcagtggggctg

SEQ ID NO: 8415 - DNA, 118 bp, Artificial
  Hairpin sequence PT_from_MQbrain_1644, chimp
tggaagatgctgaaactaagaatgctgccttggagagggtggaagaactggaagaaaacatttctcatgtaactatatctcagaaaaggaaaaattgcttacatttcagctggttgca

SEQ ID NO: 8416 - DNA, 59 bp, Artificial
  Hairpin sequence PT_from_MQbrain_1645, chimp
tcagccctctctgcctctgcagctgaccacaaggaagctggtggacagagagggactga

SEQ ID NO: 8417 - DNA, 117 bp, Artificial
  Hairpin sequence PT_from_MQbrain_1648, chimp
ctggcatcttgtccgtggcaaatgctggacccaacgcaaacagttcccagtttttcctctgcgctgccaagactgagtggttggatggcaagcatgtggtcttcggcaaggtgaaag

SEQ ID NO: 8418 - DNA, 98 bp, Artificial
  Hairpin sequence PT_from_MQbrain_1649, chimp
catgttttgtttgtttgttttgatgagagctgtggggagcatccttttgagagcagcaggaagcctcccccaaagtctcatatacagctaagggtatg

SEQ ID NO: 8419 - DNA, 104 bp, Artificial
  Hairpin sequence PT_from_MQbrain_165, chimp
cccattattgtgcagattcatcttgtcaggtgacctggggaagaggcccttgttggccttgtccccactcgtgggtcactggtctgtggacctgcactggaggg

SEQ ID NO: 8420 - DNA, 109 bp, Artificial
  Hairpin sequence PT_from_MQbrain_1650, chimp
aggtcagtgcctacaataagacagtgaccccttgtcagcaaattgtgactctgtgtaaaggggagatgaccttgacaggaggttactgttctcactaccagctgacact

SEQ ID NO: 8421 - DNA, 96 bp, Artificial
  Hairpin sequence PT_from_MQbrain_1651, chimp
gctgtgggccgcgctgcctggggcctccggggtcgctctggcctgctgcttcgtggcggcggccgtggccctgcgctggtccgggcgccggacggc

SEQ ID NO: 8422 - DNA, 102 bp, Artificial
  Hairpin sequence PT_from_MQbrain_1652, chimp
ctgccctccagagcctcataatcatctattattccaactactaagaacaggcagcaagagcctggctgcagtacgggacgggaaggagtggcctgggagcgg

SEQ ID NO: 8423 - DNA, 99 bp, Artificial
  Hairpin sequence PT_from_MQbrain_1658, chimp
ggaaatgctagtttgggaccttctgacctctttgccccacctgtgtcgaggtaagctcgacacaggtgggccaaagagctggggctcaagccagtcacc

SEQ ID NO: 8424 - DNA, 119 bp, Artificial
  Hairpin sequence PT_from_MQbrain_1660, chimp
gtgtagcaaagaggaaatactgtgccttgggattattttgtttatattcatgctacctttttggcatatatatttgagatacattttggggaggggtggtttgttctctttgaaatcac

SEQ ID NO: 8425 - DNA, 88 bp, Artificial
  Hairpin sequence PT_from_MQbrain_1661, chimp
gaaggggcatctcgagaggggctgcatggggatgccacgtggaaggtattctgtgcccagactcatgtggccatctcgagaggctgtc

SEQ ID NO: 8426 - DNA, 108 bp, Artificial
  Hairpin sequence PT_from_MQbrain_1664, chimp
caagttcatcaattatgtgaagaattgcttccggacaactgaccaggaggctattcaagatcctggcagtggaggaagtctctttaagaaaatagtttaaacaatttg

SEQ ID NO: 8427 - DNA, 82 bp, Artificial
  Hairpin sequence PT_from_MQbrain_1665, chimp
gagcagggtgtgaaacgtttgctgccagtgagggagaaaggtttgccttggctaggagtagcaggatttcaggctccacatc

SEQ ID NO: 8428 - DNA, 94 bp, Artificial
  Hairpin sequence PT_from_MQbrain_1667, chimp
aatatctccttaattaaggcagcagctctgctggggcctacattccaggattctcagcagagaaaacatgttttctttgtagaggagttttatt

SEQ ID NO: 8429 - DNA, 105 bp, Artificial
  Hairpin sequence PT_from_MQbrain_1671, chimp
cagtaggtgccccaggaattttggtgtctgctgctgccctggcctcagggaaggaagccgagggcccaggaagcagggctgccatttcccagggtcaagtgtctg

SEQ ID NO: 8430 - DNA, 66 bp, Artificial
  Hairpin sequence PT_from_MQbrain_1674, chimp
cccacaggtcctctttagccacagggaacctcctctggagctgaaagacacggacgccgccgtggg

SEQ ID NO: 8431 - DNA, 96 bp, Artificial
  Hairpin sequence PT_from_MQbrain_1676, chimp
tgaaagtgctccaagccagaaatccttgattatttacagtgcataagagttcttatatgctgtgggtaaaagagtgcagggcatggaacgtgttta

SEQ ID NO: 8432 - DNA, 94 bp, Artificial
  Hairpin sequence PT_from_MQbrain_1678, chimp
tcgagatcgccacctacaggaagctgctggaagatggagaacatgagtatccatacgaagaccaccagcggctatgcaggtgatgtgagcttgg

SEQ ID NO: 8433 - DNA, 69 bp, Artificial
  Hairpin sequence PT_from_MQbrain_1681, chimp
ctgccagtgatggacacgggtggagaggccagcagagatagtggccgccagctgggacaatggtggtag

SEQ ID NO: 8434 - DNA, 119 bp, Artificial
  Hairpin sequence PT_from_MQbrain_1685, chimp
catggttggggaccatattccccatggtgtctagggggactccagcacggtcagggaccctattccccacagtgtctagggggactccagcatggtcggggaccatattccccacagtg

SEQ ID NO: 8435 - DNA, 118 bp, Artificial
  Hairpin sequence PT_from_MQbrain_1687, chimp
gactccactctggccaagatgagctctcagattgcacttcagaatcggtgatgcgcgctcattcccctgcacccacccttttttctgtggtcagcatgtgtttcccagactgggcgtc

SEQ ID NO: 8436 - DNA, 82 bp, Artificial
  Hairpin sequence PT_from_MQbrain_1689, chimp
tggagggtgctgtgtgcagtcaggggtctcccaccaggtccctaaggttggaggtgaggctggaggctgccacagttctcca

SEQ ID NO: 8437 - DNA, 83 bp, Artificial
  Hairpin sequence PT_from_MQbrain_1690, chimp
ggccctgctgttctccagacactgatgagggtggactctccatgagccccgcctctcaccaggctgtcctggagtggctcgcc

SEQ ID NO: 8438 - DNA, 78 bp, Artificial
  Hairpin sequence PT_from_MQbrain_1692, chimp
gtataccaggatgtggtagctactgcagtgcaataaccccagaattgcagtagctactaacctgttttcctcttgtac

SEQ ID NO: 8439 - DNA, 95 bp, Artificial
  Hairpin sequence PT_from_MQbrain_1696, chimp
tttgatctgcagaacctgctctacctgaagaccagcaaccgtttgaaagcaggggccagtgggtgttgagctaaggatggagttgcagcatgaga

SEQ ID NO: 8440 - DNA, 116 bp, Artificial
  Hairpin sequence PT_from_MQbrain_1698, chimp
cctttatctttacctttaaaaaactttgtctgtttaaatcaggagctgcaggcagaaattcttatctggaagttcttctgaagttggcagacaaatacaaaaagaaaatgtggggg

SEQ ID NO: 8441 - DNA, 72 bp, Artificial
  Hairpin sequence PT_from_MQbrain_1699, chimp
atcctaggcttagagggcagaggttcagggtgcccaaggagcctgacgcaactgccctgagaaccctggggt

SEQ ID NO: 8442 - DNA, 110 bp, Artificial
  Hairpin sequence PT_from_MQbrain_1701, chimp
cgctggtacggggctgtgtatgcgcctctgtctggagggggctgtctgttggttaaagggtgtcttttccaggccctggagattgcaggcactaacagtccactcaggtg

SEQ ID NO: 8443 - DNA, 84 bp, Artificial
  Hairpin sequence PT_from_MQbrain_1712, chimp
gacccggaggccctggtggccctgggatggggaaccgcggtggcttccgcggaggtttcggcagtggcatccggggccggggtc

SEQ ID NO: 8444 - DNA, 116 bp, Artificial
  Hairpin sequence PT_from_MQbrain_1715, chimp
ctaaaggaggagcccgaggagctggcccagctggctcccaccccaggagacgccatcatctctctggatttcggtgggtgcttcttagctaagccaggcccctggaaccctgttgg

SEQ ID NO: 8445 - DNA, 86 bp, Artificial
  Hairpin sequence PT_from_MQbrain_1717, chimp
gggtatctaaatcattaagaatgttgggaggaaggaggccaatggtaaagaagctcctccttctaacaaacatgaatcctttacct

SEQ ID NO: 8446 - DNA, 97 bp, Artificial
  Hairpin sequence PT_from_MQbrain_1719, chimp
tccgcggaggtttcggcagtggcatccggggccggggtcgcggccgtggacggggccggggccgaggctgcggagctcgcggaggcaaggccgagga

SEQ ID NO: 8447 - DNA, 69 bp, Artificial
  Hairpin sequence PT_from_MQbrain_1720, chimp
gagggctggtggggtggaggtggggggtgagtgggaagaagccactccatcagctttgtcttggccttt

SEQ ID NO: 8448 - DNA, 99 bp, Artificial
  Hairpin sequence PT_from_MQbrain_1723, chimp
tgagggcatcagggtggtgcctctgattctggaatggcctctttcccctcctattcagccaaattccatgaccacaggcctctcctgctcctgccttta

SEQ ID NO: 8449 - DNA, 110 bp, Artificial
  Hairpin sequence PT_from_MQbrain_1726, chimp
cacgctctgcttggttgggcgtggcctcctgtgagagggggccctaggatgacgcgatatgctggattcctgggcttccttaacatgagccctcccctgctgtagacgtg

SEQ ID NO: 8450 - DNA, 115 bp, Artificial
  Hairpin sequence PT_from_MQbrain_1727, chimp
gagagctggaggggtcctaacaaatgaccagttaagttggcctgggatagagtgagaggctatgaaccaggatcagcatgaggtgggggtcggacaatgtggaccccaggcagtc

SEQ ID NO: 8451 - DNA, 103 bp, Artificial
  Hairpin sequence PT_from_MQbrain_173, chimp
gtatagattctccagaatcttccactcttcctcctcttatcggttttcctgatttcaggtggctgagcagtagggaggagaggcctctgtgggaacgctgtgc

SEQ ID NO: 8452 - DNA, 101 bp, Artificial
  Hairpin sequence PT_from_MQbrain_1747, chimp
gtgtcagtggtggacctgacctgccgtctggaaaaacctgccaattatgatgacatcaagaaggtggtgaaacaggcatcggagggccccctcaaggacat

SEQ ID NO: 8453 - DNA, 116 bp, Artificial
  Hairpin sequence PT_from_MQbrain_1750, chimp
agctgatagcctgttaataagcactggtctaacacagccaaccctcctccacagcgccatgttaatggaggagggaaggaaggtgaaatctactgcatgggattcaggaaacagtt

SEQ ID NO: 8454 - DNA, 116 bp, Artificial
  Hairpin sequence PT_from_MQbrain_1752, chimp
tgtgcagggtatgtccttgaacttggaacctgacaatgttggtgttgttgtgtttggaaatgataaactaattaaggaaggagatatagtgaagaggacaggagccattgtggacg

SEQ ID NO: 8455 - DNA, 99 bp, Artificial
  Hairpin sequence PT_from_MQbrain_1753, chimp; PT_from_MQbrain_1882, chimp; PT_from_MQbrain_1893, chimp
ggttgtagacagagattctctggtcatcgagcatatccaggtgaacaaagcactcaggatgcgccgctggacttacagagctcatggtctgattaaatc

SEQ ID NO: 8456 - DNA, 75 bp, Artificial
  Hairpin sequence PT_from_MQbrain_1754, chimp
gggtcccgtggctggggggcacggccgtgtggctcggaggctgcatgaccaacgtgcccgcagcctgccacatcc

SEQ ID NO: 8457 - DNA, 79 bp, Artificial
  Hairpin sequence PT_from_MQbrain_1755, chimp
cggctctggcagggactggtggggacgcggggagcggcccaggcccctgccccgccgggctcagcctcccatgcgctcg

SEQ ID NO: 8458 - DNA, 98 bp, Artificial
  Hairpin sequence PT_from_MQbrain_1758, chimp
acaaatggttcccagtttttcatctgcacagccaagactgagtggttggatggcaagcatgtggtctttggcaaagtgaaagaaggcatgaatattgt

SEQ ID NO: 8459 - DNA, 109 bp, Artificial
  Hairpin sequence PT_from_MQbrain_176, chimp
ccttccgtagttctcatgcagcggaggggttcgacttgtaaccggcccgaaaccaagcgtggcgcaagatttgctcaagcccctcctcttggccaaactttccggaggg

SEQ ID NO: 8460 - DNA, 92 bp, Artificial
  Hairpin sequence PT_from_MQbrain_1760, chimp
ctccacaatgctcccaacacctgtgacccctaggaagacagggagcaaggtagatctggccaggagtcacaggatatacacccattctggag

SEQ ID NO: 8461 - DNA, 111 bp, Artificial
  Hairpin sequence PT_from_MQbrain_1764, chimp
cctgtggctgtgtggtttggggccacggagcggaggcttcaacatggacagttcaagtataccttggaccccaacatcacctctgctggccccaccaagagcttcctcagg

SEQ ID NO: 8462 - DNA, 68 bp, Artificial
  Hairpin sequence PT_from_MQbrain_1767, chimp
ggaatataagctggtggtggtgggcgccggcggtgtgggcaagagtgcgctgaccatccagctgatcc

SEQ ID NO: 8463 - DNA, 105 bp, Artificial
  Hairpin sequence PT_from_MQbrain_1768, chimp
agtggggtgactccgggctgctctggtgggagccatgagggtctgtgctgtctctgagcaccgtctcttctgttccccaggatcctgcaggcccaggtgcctcct

SEQ ID NO: 8464 - DNA, 92 bp, Artificial
  Hairpin sequence PT_from_MQbrain_177, chimp
ttctggctgcctcaacggctgctcaaggtcaaggaacaaacagataaaccctttctctggagccagcacggagaggacgcctccagctagaa

SEQ ID NO: 8465 - DNA, 119 bp, Artificial
  Hairpin sequence PT_from_MQbrain_1771, chimp
ctgccacaagctactgctccaaggcctggccacatgcagacaggaggaagctgagctcgacattaggcctcaaggctgccatctgtcttgtagggcctggccttgtgggcagggggcag

SEQ ID NO: 8466 - DNA, 66 bp, Artificial
  Hairpin sequence PT_from_MQbrain_1772, chimp
gggtgggctccatgacgctggctgtgcccgagctcctgctgtggcagctggcacaggagcctgccc

SEQ ID NO: 8467 - DNA, 93 bp, Artificial
  Hairpin sequence PT_from_MQbrain_1773, chimp
cagccaggcttgctattggggcagggaggtgcctggtgaagtctactgccacctctcactctccccttcttccccaggctgctgcttctgctg

SEQ ID NO: 8468 - DNA, 101 bp, Artificial
  Hairpin sequence PT_from_MQbrain_1776, chimp
tgagaatgggttggtagtggctggtgtggctgtgtgccgagggtccgtggtccctgcgactctcaggacaccgctgcacgtgacagctctcgcccccggca

SEQ ID NO: 8469 - DNA, 74 bp, Artificial
  Hairpin sequence PT_from_MQbrain_1777, chimp
gtcctggggagattggaggggacggcagcgttctgcatgatggaggcactgctgggccccgggtctgtgggggc

SEQ ID NO: 8470 - DNA, 115 bp, Artificial
  Hairpin sequence PT_from_MQbrain_1778, chimp
tgccgcctccgcccctccgcagagcacaagtgcaatgcctcgtcacagttcctgtgcagcagtgggcgctgtgtggctgaggcactgctctgcaacggccaggatgactgtggcg

SEQ ID NO: 8471 - DNA, 94 bp, Artificial
  Hairpin sequence PT_from_MQbrain_1779, chimp
gtgtcaagaggaaagagccttagacctgggcgggccttcaggggcatctagacccctgcacagcccaggcctggtgtctgcatttccatagcac

SEQ ID NO: 8472 - DNA, 113 bp, Artificial
  Hairpin sequence PT_from_MQbrain_178, chimp
tcaggccttacttgtagggggctggtccctcttctgatgcctgtgccctgtcctcctgattgtgttctctgtcttgccaggtgatctctctggccacctccttgcctacctga

SEQ ID NO: 8473 - DNA, 116 bp, Artificial
  Hairpin sequence PT_from_MQbrain_1780, chimp
tcacccactctgcactggggcgtttcctactgtgcctcgtgctggcggacgcagctgggtggagaagctgtggggtcggagaggcgtttggagaaggtctgtggtgcagtgtgtga

SEQ ID NO: 8474 - DNA, 86 bp, Artificial
  Hairpin sequence PT_from_MQbrain_1781, chimp
cttgctgatctcagcgcttggccaagtacaaccagctcctcagaattgaagaggagctgggcagcaaggctaagtttgccggcagg

SEQ ID NO: 8475 - DNA, 101 bp, Artificial
  Hairpin sequence PT_from_MQbrain_1784, chimp
agaaatatacctgcatgttagtctaacgttctgatagaaatgacatgcatttatgctgccatttgttactatcaggactcgactcgtgtgcggacatttct

SEQ ID NO: 8476 - DNA, 116 bp, Artificial
  Hairpin sequence PT_from_MQbrain_1785, chimp
tggacccaacacaaatggttcccagtttttcatctgcactgccaagtctgagtggttggatagcaagcatgtggtctttggcaaggtgaaagaaggcatgaatattgtggaggcca

SEQ ID NO: 8477 - DNA, 81 bp, Artificial
  Hairpin sequence PT_from_MQbrain_1791, chimp
ccttcatcggcaacagcacggccatccaggagctgttcaagcgcatctccgagcagttcacggccatgttccggcgcaagg

SEQ ID NO: 8478 - DNA, 85 bp, Artificial
  Hairpin sequence PT_from_MQbrain_1792, chimp
ccaggggcactgcctggaagattcaggagcctgggcggccttcgcttactctcacctgcttctgagttgcccaggaggccactgg

SEQ ID NO: 8479 - DNA, 115 bp, Artificial
  Hairpin sequence PT_from_MQbrain_1793, chimp
gcagaggtgagccagcggttcgaacagctctgtctacagcagcaagaaaaggagagctccctaaagaagcttctgccccaggcagagatgtttgaacacctctctggtaagctgc

SEQ ID NO: 8480 - DNA, 98 bp, Artificial
  Hairpin sequence PT_from_MQbrain_1795, chimp
tgtacgagcagctgtctgggaagtagggggttagcttgggtacctgaactgtcctggaggccccaagccatgttccccagttcagtgttgcatgtata

SEQ ID NO: 8481 - DNA, 102 bp, Artificial
  Hairpin sequence PT_from_MQbrain_1798, chimp; PT_from_MQbrain_1802, chimp
tgtcaaagcaagagatggctagtgcttcatccagccaaagaggtcgaagtggttctggaaactttggtggcggtcgtggaggtggtttcggtgggaatgaca

SEQ ID NO: 8482 - DNA, 117 bp, Artificial
  Hairpin sequence PT_from_MQbrain_1801, chimp
gagtcagaaagcaagaccaggaagcaaatagcagctcaggaaatcccacggttgacttgccttgctggcaagcttggtggagagggctgaagctgttgctgggggccgattctgatc

SEQ ID NO: 8483 - DNA, 66 bp, Artificial
  Hairpin sequence PT_from_MQbrain_1806, chimp
ctgcagaacaaggagcatgtgattgaggccctatgcagggccaagttcaagttccctggctgccag

SEQ ID NO: 8484 - DNA, 114 bp, Artificial
  Hairpin sequence PT_from_MQbrain_1808, chimp
cggggggttctccatcctgctgtggattggggctatcctctgcttcctggcctacggcatccaggctgccatggaggatgaaccatccaacgacaatgtgagcccacacgcctg

SEQ ID NO: 8485 - DNA, 85 bp, Artificial
  Hairpin sequence PT_from_MQbrain_1811, chimp
ctgtgccactgggaattgcaacccatgagttcagaaggcacactctgccatgctgagctccaagggtgctaccaggggaagatgg

SEQ ID NO: 8486 - DNA, 117 bp, Artificial
  Hairpin sequence PT_from_MQbrain_1812, chimp
ggaacaggttctgtcaggggtgacaccaggacacagggacaggttctgtcaggggtgacaccaggacacagggacaggttctgtcatgggtgacacgaggacacagggacaggttct

SEQ ID NO: 8487 - DNA, 66 bp, Artificial
  Hairpin sequence PT_from_MQbrain_1817, chimp; PT_from_MQbrain_1840, chimp
ctgcagaacaaggagcatgtgattgaggccctgcccagggccaagttcaagttccccggctgccag

SEQ ID NO: 8488 - DNA, 75 bp, Artificial
  Hairpin sequence PT_from_MQbrain_182, chimp
gtgaatgacgtctgcaccaatggacaagacctcattaagaaggtgagtccagcccattggtaagacctccatcgc

SEQ ID NO: 8489 - DNA, 75 bp, Artificial
  Hairpin sequence PT_from_MQbrain_1820, chimp
gcctgggcccacagctgcactggcagcccaaggggaaggaccggttgggggagccgggcatgtgaggccctgggc

SEQ ID NO: 8490 - DNA, 66 bp, Artificial
  Hairpin sequence PT_from_MQbrain_1824, chimp
ctgtggcagtgggctggatagggctcctggggttggaggggcctttgacagtctttctctgcctag

SEQ ID NO: 8491 - DNA, 76 bp, Artificial
  Hairpin sequence PT_from_MQbrain_1825, chimp
atgcagaggaggcccgccttcttcatgtcaaggagaccatgcagattgatgagaggaagcggccttacaatagcat

SEQ ID NO: 8492 - DNA, 117 bp, Artificial
  Hairpin sequence PT_from_MQbrain_1827, chimp
gctgcggcgggaggtggaggagctgagaagcagcctgcgagggcttgcgggggagattgttggggaggtccggtgagtaacgcagcttcttctcctgctttatccctcccctgcagc

SEQ ID NO: 8493 - DNA, 92 bp, Artificial
  Hairpin sequence PT_from_MQbrain_1828, chimp
aggcatatttccaagcgtaggtgtccctggcttttgtggccaaagctagtgttatggtcaacaacgggccagggtctgcggggcactgacct

SEQ ID NO: 8494 - DNA, 99 bp, Artificial
  Hairpin sequence PT_from_MQbrain_1831, chimp
gttcatcaattatgtgaggagtgcttccggatgactgaccaggaggttattcgaaatctctggcagtggaggaagtctctttaggaaaatagtttaaac

SEQ ID NO: 8495 - DNA, 92 bp, Artificial
  Hairpin sequence PT_from_MQbrain_184, chimp
tcccggagcccccagcagggccctccgaggtggagcagcagctacaagcagaggctgaacacctgcggaaggagctggagaatctgacagga

SEQ ID NO: 8496 - DNA, 96 bp, Artificial
  Hairpin sequence PT_from_MQbrain_1841, chimp
gctatagaggagtttcccgaggtggctttagaggcaactctggaggagactacagagggcctagtggaggctacagaggatctgggggattccagc

SEQ ID NO: 8497 - DNA, 118 bp, Artificial
  Hairpin sequence PT_from_MQbrain_1856, chimp
ccactatcagtcgtgctgtgggcagtgccctattcagaaaggtgccagtcacttagattacatgtcactgtttcctttctgagtggagtaaggcttaccaagtacaagtgtgtggtgg

SEQ ID NO: 8498 - DNA, 116 bp, Artificial
  Hairpin sequence PT_from_MQbrain_1862, chimp
gctgcatctagagatgacacattagctgttctctcttcttcttttctaacagcagtattgagcccaggcttctgtgggagagagtggagaagctggtgcccagacctggcagtggc

SEQ ID NO: 8499 - DNA, 118 bp, Artificial
  Hairpin sequence PT_from_MQbrain_1863, chimp; PT_from_MQbrain_40, chimp
gggaagacgttgggtggcgttccctgcagagagtaggagggttttgggggaagacgttgggtggcgttccctggagagagtaggatggttttgggggaagacgttgggtggcgttccc

SEQ ID NO: 8500 - DNA, 120 bp, Artificial
  Hairpin sequence PT_from_MQbrain_1864, chimp; PT_from_MQbrain_39, chimp
ggggaagacgttgggtggcgttccctgcagagagtaggagggttttgggggaagacgttgggtggcgttccctggagagagtaggatggttttgggggaagacgttgggtggcgttccct

SEQ ID NO: 8501 - DNA, 75 bp, Artificial
  Hairpin sequence PT_from_MQbrain_1867, chimp
gctgcctcaaggacgtgagtagggctagggaggggctgcaggctgttcaggagccctttgtctcctgtcttcagc

SEQ ID NO: 8502 - DNA, 106 bp, Artificial
  Hairpin sequence PT_from_MQbrain_1868, chimp
gacctgtgcttgcccggggagagtcagggctctcctgtcagctgggtcccctcccggccccgggaggccgccactggagccctgcctcttcctggcagggagcatc

SEQ ID NO: 8503 - DNA, 87 bp, Artificial
  Hairpin sequence PT_from_MQbrain_1869, chimp
ggcttcaaaggagagggcccagaagtggatgtgaacctgcccaaggctgacattgatgtctcaggacccaaggtggatgttgaagtc

SEQ ID NO: 8504 - DNA, 84 bp, Artificial
  Hairpin sequence PT_from_MQbrain_187, chimp
agagcttcttaagggggactacaactcccaaggtacatacaaagcaattgtggtgcacactgggagttgtagtccttgagctct

SEQ ID NO: 8505 - DNA, 117 bp, Artificial
  Hairpin sequence PT_from_MQbrain_1872, chimp; PT_from_MQbrain_227, chimp; PT_from_MQbrain_895, chimp
ggctgcaaggtcgtggcgtctgggaaactccgaggacagagggctaaatccatgaagtttgtggatggcctgatgatccacagtggagaccctattaactactacgttggcactgct

SEQ ID NO: 8506 - DNA, 95 bp, Artificial
  Hairpin sequence PT_from_MQbrain_1873, chimp
gcccctctcccgtctccccctcgcgcttctctctcgcagtctcctcctcccaaaccgcgagcgaaaagggcgagggggagaggagcctcggcggc

SEQ ID NO: 8507 - DNA, 87 bp, Artificial
  Hairpin sequence PT_from_MQbrain_1876, chimp
gggcctttgtcgcgtccccttgcccccaggcgactgggcccgaggaacccgcgtggggccagcgtgggggagtaaggggcgaggccc

SEQ ID NO: 8508 - DNA, 85 bp, Artificial
  Hairpin sequence PT_from_MQbrain_1877, chimp
tccttagaagctcttggccctgaggactttgcctggggcattggccctgccatggcgttccggagggctgagggcacgtctatga

SEQ ID NO: 8509 - DNA, 99 bp, Artificial
  Hairpin sequence PT_from_MQbrain_1879, chimp
tgttgttttgagattcgctcgggcctagctgtcatcgcagcccgacattcgggctgggcggtcccgcggcctgggcgtaggggcgtaacagtagcaaca

SEQ ID NO: 8510 - DNA, 78 bp, Artificial
  Hairpin sequence PT_from_MQbrain_188, chimp
gagcttctggtctgcagccctctggtagaacctttggttttgccttgggcctcctgtttctgtgcggccctcttgctt

SEQ ID NO: 8511 - DNA, 94 bp, Artificial
  Hairpin sequence PT_from_MQbrain_1889, chimp
attgcagagtcaggggtagagcggcaagtacttttgggagaccagatacccaaattcgccattgccactttaccacccgcctgaatcctgggat

SEQ ID NO: 8512 - DNA, 71 bp, Artificial
  Hairpin sequence PT_from_MQbrain_1890, chimp
ccagttacagatccagccacaggagccgtgaaggagaagatcacagcttttgtggtggagaggggcttcgg

SEQ ID NO: 8513 - DNA, 68 bp, Artificial
  Hairpin sequence PT_from_MQbrain_1894, chimp
cacagcccttggcccagccatctgcacccacttttgcttgtagttatggccagggccaaatagctatg

SEQ ID NO: 8514 - DNA, 73 bp, Artificial
  Hairpin sequence PT_from_MQbrain_1896, chimp
cacacatcaccatgagctacccaggggtgaggatggcattcccacccctgggtagctgttccggggttgtctg

SEQ ID NO: 8515 - DNA, 118 bp, Artificial
  Hairpin sequence PT_from_MQbrain_1897, chimp
gttgaccggcaggccccatctgtgctcacagctcctccccttgtttggccaccctttcctcagggcatctgcagcaagtgggggggcacagcacgggaaacggggccaaggccacagc

SEQ ID NO: 8516 - DNA, 100 bp, Artificial
  Hairpin sequence PT_from_MQbrain_192, chimp
ggtaagtgtgttagtggtgggagagtgatggagacctgggatgggccccacgtctgcccatccttcagctctaattctcccaccctccccatttttttcc

SEQ ID NO: 8517 - DNA, 114 bp, Artificial
  Hairpin sequence PT_from_MQbrain_194, chimp
ttttagcatccttgagtcccagggcctgaagggttcttggacatgggccgattttcttgtcacctgtgtcccctcaacctcatcaccactgggcagctcattatctctctggaa

SEQ ID NO: 8518 - DNA, 116 bp, Artificial
  Hairpin sequence PT_from_MQbrain_1946, chimp
ggggagctgcttgcctccctccgtttttggcaatggtagaactcacactggtgaggtaacaggatccggtggttctagacttgccaactatggggcgaggactcagccggcaccct

SEQ ID NO: 8519 - DNA, 79 bp, Artificial
  Hairpin sequence PT_from_MQbrain_1958, chimp; PT_from_MQbrain_1985, chimp; PT_from_MQbrain_579, chimp
ggggactgcgtctgggatgggtacccttctcattagtaagatccgggaggagtacccagacaggatcataagcacattc

SEQ ID NO: 8520 - DNA, 64 bp, Artificial
  Hairpin sequence PT_from_MQbrain_198, chimp; PT_from_MQbrain_799, chimp; PT_from_MQbrain_832, chimp; PT_from_MQbrain_952, chimp
ttgagctctcgggcgaggttcactggtccgcagggggagggccagggaagtcgcgctgtgccaa

SEQ ID NO: 8521 - DNA, 114 bp, Artificial
  Hairpin sequence PT_from_MQbrain_20, chimp
caataccaggttttcttctctgtgcaaatggccattacaattcctataatatttacactgatgatataaagctgcgaaggccaaatgctgggaaaggtgaaaacatgtttattg

SEQ ID NO: 8522 - DNA, 109 bp, Artificial
  Hairpin sequence PT_from_MQbrain_203, chimp
cctcctagaagaaccttcttagacaatggggggaggatgggactttgttttttccaagaataaacttcaactcctgtcatgtgtcttggctactttcttggatgggagg

SEQ ID NO: 8523 - DNA, 117 bp, Artificial
  Hairpin sequence PT_from_MQbrain_2050, chimp
agaagtcctgtagccagtcagaaatgagcttattcataaaagtgcagtatggtgaagtcaatctgtaattttatgtataagctagtctctgattgaaacatgcagcagctgtcttct

SEQ ID NO: 8524 - DNA, 110 bp, Artificial
  Hairpin sequence PT_from_MQbrain_2087, chimp
caacggcgctgacgtgcggtacttaatgagaagttgcccgtgtttttttcgctttatttgtgacgaaacattcgcggtgcacttcttcttcagtatcctattctgccttg

SEQ ID NO: 8525 - DNA, 64 bp, Artificial
  Hairpin sequence PT_from_MQbrain_209, chimp
ctgctgcttgtgctggccgcggtggtggcctggtgctactacagcgtctccctacgcaaggcgg

SEQ ID NO: 8526 - DNA, 71 bp, Artificial
  Hairpin sequence PT_from_MQbrain_21, chimp
actgctctcctctctgcaccccaagtaacagagtctgactttgttgcttggggtgcacagtggaaagcagt

SEQ ID NO: 8527 - DNA, 98 bp, Artificial
  Hairpin sequence PT_from_MQbrain_22, chimp
gtcaaatcctcggatgggcttgtaaaccagctcctggcctagcctcatcagatgtgaggatgaggaagagagagcctggtgggccctggggaggggac

SEQ ID NO: 8528 - DNA, 106 bp, Artificial
  Hairpin sequence PT_from_MQbrain_222, chimp
tttgactttatacccgatgtcaagggagcagtactggtttgtgacatgtcctcaaacttcctgtccaagccagtggatgtttccaaggtggagtataaaaggcagg

SEQ ID NO: 8529 - DNA, 71 bp, Artificial
  Hairpin sequence PT_from_MQbrain_224, chimp
gcatgccaacgggaggctgtgcccagaccaagcaccggaagtgtgcttctaggcatagtcattggttttgc

SEQ ID NO: 8530 - DNA, 78 bp, Artificial
  Hairpin sequence PT_from_MQbrain_226, chimp
aaggcagtgtagagctttatgctgaaaaggtggccactaggggtctgtgtgccattgctcaggcagagtctctgcctt

SEQ ID NO: 8531 - DNA, 82 bp, Artificial
  Hairpin sequence PT_from_MQbrain_228, chimp
gcccctttcctgatgcgccgtctcttcgccgccctccgtgggggcgcggcgaacgggttgcgtgctctggagagagacaggc

SEQ ID NO: 8532 - DNA, 117 bp, Artificial
  Hairpin sequence PT_from_MQbrain_231, chimp
agggtgccccctgactcactgagggacaccccacttatgccctggtgggagcagggctccttcctgacttctttgggtgcttgaaccgggttcttcgtggacacaggtgggcatcct

SEQ ID NO: 8533 - DNA, 75 bp, Artificial
  Hairpin sequence PT_from_MQbrain_234, chimp
gaggcaaatggaggcgcctggtgccccgcccaggaccctgacgtgggaagccatggagcagatccggtaagactc

SEQ ID NO: 8534 - DNA, 86 bp, Artificial
  Hairpin sequence PT_from_MQbrain_238, chimp
cggcggcggtggcggctgggatcgcctgggagtgagcgagcccctctccgagttcgctggcgcccgccctcacctccacctcgccg

SEQ ID NO: 8535 - DNA, 120 bp, Artificial
  Hairpin sequence PT_from_MQbrain_2380, chimp
caggtctcagctccaccccactgtgtcttggtcagcctcagtgatggcctgaccccagctgtgaggccttgtgagctaaggctgaagagaccttgcctgtgggagctggggtggtacctg

SEQ ID NO: 8536 - DNA, 88 bp, Artificial
  Hairpin sequence PT_from_MQbrain_239, chimp
ggtgtgagctgcagattcgtggcctgtctgtggcagatgccggggagtactcgtgcatgtgtgggcaggagaggacctcagccacact

SEQ ID NO: 8537 - DNA, 97 bp, Artificial
  Hairpin sequence PT_from_MQbrain_24, chimp; PT_from_MQbrain_25, chimp
tttgtcggatcttcagtggaacctttgtgaagctcaacaagccttcagttaacatactgaggcttgtacagccacatattgcatgagggtacccaaa

SEQ ID NO: 8538 - DNA, 97 bp, Artificial
  Hairpin sequence PT_from_MQbrain_240, chimp
ggggccgtgatggagcagggcacgtcttcgtcaatgacaggtaacagcttcctgctgaaccctgcgttcacgaggtgctgcctggcttccttgcccc

SEQ ID NO: 8539 - DNA, 114 bp, Artificial
  Hairpin sequence PT_from_MQbrain_244, chimp
tggcaaccccggggcaggctgggagctggtgctgcacccatctcctgcatgcacccttgggggatggcacactgcagcattgcctccttctgttcccaggactcagtgttgcca

SEQ ID NO: 8540 - DNA, 105 bp, Artificial
  Hairpin sequence PT_from_MQbrain_251, chimp
ggatggcatccagaggccgccgctgcatttcccgcagggaggacacctgctgtcctttctgtcctgtctggagaatgggctgctgcctcggggacagctagagcc

SEQ ID NO: 8541 - DNA, 116 bp, Artificial
  Hairpin sequence PT_from_MQbrain_258, chimp
cagcaagagcctggtcaaggagaggtggctggtggagttggttttgggtggtggagtcacagaggctcgtcctaggtctaacatgatgccagcacctttgggtggggcttgggttg

SEQ ID NO: 8542 - DNA, 103 bp, Artificial
  Hairpin sequence PT_from_MQbrain_26, chimp
gtatctgttatatgtggttgagttagggttggccagcccaccctcaggggtggtgagaaaagcatggctgatgacaggctcagaagcatgacatagtgggggc

SEQ ID NO: 8543 - DNA, 67 bp, Artificial
  Hairpin sequence PT_from_MQbrain_260, chimp
gttttgccttgcctggcccaagccacagtgagggagtgaaagagctgtgggcggtaggcgaggctgc

SEQ ID NO: 8544 - DNA, 72 bp, Artificial
  Hairpin sequence PT_from_MQbrain_261, chimp
tccgagtccccgaaggtcccaccatccccgcaggaactccctggatggagggggccgatcccggggagcggg

SEQ ID NO: 8545 - DNA, 55 bp, Artificial
  Hairpin sequence PT_from_MQbrain_262, chimp
gcctccggaggccctggcctccctcccacctgggcgctaggagccatcccggggc

SEQ ID NO: 8546 - DNA, 89 bp, Artificial
  Hairpin sequence PT_from_MQbrain_264, chimp
ccttccattctccagtccactttccatcttcccctccctccatctcctcttctggggacacaggatggggaggactggagagcaccagg

SEQ ID NO: 8547 - DNA, 79 bp, Artificial
  Hairpin sequence PT_from_MQbrain_266, chimp
ctcctctcttggggggctggttagattggagggtgtgggatctaaacagcaccagctgtccccaagaaaacttaagggg

SEQ ID NO: 8548 - DNA, 119 bp, Artificial
  Hairpin sequence PT_from_MQbrain_2663, chimp; PT_from_MQbrain_2664, chimp
cccgacggctacctccagatcggtgggtagggtttgggggagagcgtgggctggggttcggggacaccctctcagcgctgccctcccccaggctccttctacaagggagtggcagaggg

SEQ ID NO: 8549 - DNA, 103 bp, Artificial
  Hairpin sequence PT_from_MQbrain_2670, chimp
agtcaccgttagaactgaagtaaagtctgtcgaaatgcaccatgaagctttgagtgaagtttttcctggggacagtgtgggcttcagtgtcaagaatgtgtct

SEQ ID NO: 8550 - DNA, 93 bp, Artificial
  Hairpin sequence PT_from_MQbrain_268, chimp
ccttggagttgggtagtatggtgaatggggtttcataaaacctccaacctgcacccctcccttctccatctcgcttgctgcccaacaccatgg

SEQ ID NO: 8551 - DNA, 117 bp, Artificial
  Hairpin sequence PT_from_MQbrain_2699, chimp
agagtctacaaatgttgtctccttaatccttgcaacgaacctgagccattgattcagtaaaatactcagtggcacatgtttgttgtgggggtcaaaagagataatctctacaggcct

SEQ ID NO: 8552 - DNA, 117 bp, Artificial
  Hairpin sequence PT_from_MQbrain_271, chimp
aggcacgtttcccgggaagatctgaactggctgcatctccctttcctctgtcctccatccttctcccaggatggtgaagggggacctggtacccagtgatccccaccccgggatcct

SEQ ID NO: 8553 - DNA, 85 bp, Artificial
  Hairpin sequence PT_from_MQbrain_272, chimp
ggtgactcagggtgagggctctgggcttgggggatgggagctaggtccatccctcggcagccaggaggccccgggctcaggtgct

SEQ ID NO: 8554 - DNA, 68 bp, Artificial
  Hairpin sequence PT_from_MQbrain_278, chimp
gccagggcagtggggggcactcagccagggcttgtggactggtctgactggcactcttctgccctggt

SEQ ID NO: 8555 - DNA, 107 bp, Artificial
  Hairpin sequence PT_from_MQbrain_279, chimp
ggccaccacagggctggagagtcaccggtcgggcggcacccggcctgggacgcgtagaggcgcacgtgtcccggcccgaacgccgccaagggacccccggcccggcc

SEQ ID NO: 8556 - DNA, 91 bp, Artificial
  Hairpin sequence PT_from_MQbrain_28, chimp
ggcctgcgtgccctgaccctccccacagcccctctgagaggctaggtctgagcctcaggagggtgtgggattggagctgggccgctgggct

SEQ ID NO: 8557 - DNA, 77 bp, Artificial
  Hairpin sequence PT_from_MQbrain_280, chimp
gtcctccacccacgcccactagcctgccatgtccacagttccttgggctgctgaggggctagtgcagtggtcctgac

SEQ ID NO: 8558 - DNA, 113 bp, Artificial
  Hairpin sequence PT_from_MQbrain_283, chimp
attctttgctgtgagctggaaagtgtgcagttggtcgtctttcttctcctttctttaggatagtaagagactcactcactgcacttctgctcagttggcttctgcatcgggat

SEQ ID NO: 8559 - DNA, 77 bp, Artificial
  Hairpin sequence PT_from_MQbrain_288, chimp
tgggtctaggggtgggaactgggcactgcagtcagctctgaccctggccagttcccccatccccacccccagatcta

SEQ ID NO: 8560 - DNA, 78 bp, Artificial
  Hairpin sequence PT_from_MQbrain_291, chimp
ctccaccctgggcggaaatggccttggcatggggaccaagtgccgtgctgatgcctcatttgtacccctaggacagag

SEQ ID NO: 8561 - DNA, 70 bp, Artificial
  Hairpin sequence PT_from_MQbrain_293, chimp
gagccctggagctgtgtcccaggatgatgtctgcattgtctggggtgagtcactggctttttcaggcctc

SEQ ID NO: 8562 - DNA, 108 bp, Artificial
  Hairpin sequence PT_from_MQbrain_296, chimp
ttacttttctcttcccacaggccaatggccatgtgtctcaggatcaagaggaacccatctacctggagagcgtggccagagtacctgctgaggatgagacccaggtgg

SEQ ID NO: 8563 - DNA, 113 bp, Artificial
  Hairpin sequence PT_from_MQbrain_297, chimp
ctggccgagcggagggcggggccgtactgtggggctggggcggggagcgggcgggaaatggaactgtgacggtcccggcctgaggcccctgcagccacgcatctcccggtgag

SEQ ID NO: 8564 - DNA, 65 bp, Artificial
  Hairpin sequence PT_from_MQbrain_300, chimp
ggctgaggctgcgtcaacaaccaaattccagtaagaggcagatttggtcgtggatgtggtcagcc

SEQ ID NO: 8565 - DNA, 88 bp, Artificial
  Hairpin sequence PT_from_MQbrain_309, chimp
tcttgagttataacctccacagccccaccctgctgctgaaggcctttgccttttgcctgctgtagctgtggttgtgcctaaccccaga

SEQ ID NO: 8566 - DNA, 75 bp, Artificial
  Hairpin sequence PT_from_MQbrain_312, chimp
aggaccctccagcaccttgctcccaggtaccctgtccggggagaggggagcaggtgcaggctggcagagggacct

SEQ ID NO: 8567 - DNA, 94 bp, Artificial
  Hairpin sequence PT_from_MQbrain_313, chimp
tgtgtctgtctgtgtctcttcttccatgagtctgtctgtccttaggggctgggggatacagggggagtgtggaggtgcacagagaatcagtgca

SEQ ID NO: 8568 - DNA, 110 bp, Artificial
  Hairpin sequence PT_from_MQbrain_317, chimp; PT_from_MQbrain_527, chimp; PT_from_MQbrain_962, chimp
aggctgaaggagatgctaaaggagataaagccaaggtgaaggacgaaccgcagagaagatccgctaggttgtctgctaaacctgctcctccaaagccagagcccaagcct

SEQ ID NO: 8569 - DNA, 76 bp, Artificial
  Hairpin sequence PT_from_MQbrain_319, chimp
cttaggtttcctccagctttcttgctgtcttgccattgctgggcccagagaggaggggagatgtttggaacttgag

SEQ ID NO: 8570 - DNA, 109 bp, Artificial
  Hairpin sequence PT_from_MQbrain_324, chimp
catttttttcatgatggagtagatttcaatcctgatttattgaacagccagagccaaagtggttttggagaagaatattttgatgaaagcagccaaagtggggataatg

SEQ ID NO: 8571 - DNA, 96 bp, Artificial
  Hairpin sequence PT_from_MQbrain_329, chimp
gagacttcttgctccccttcctggaagaggtgagtgagtcaggccaacttaaagggtgcaggcctggcctcagatctccaggaacagcattgtttt

SEQ ID NO: 8572 - DNA, 118 bp, Artificial
  Hairpin sequence PT_from_MQbrain_33, chimp
agctggtggaggaggcgatcacctatggccggaagctgggcgggtgagtgcctggactcgggagggtcccagctaggccctcgtgctagtctagttggccttgcttccctccctaact

SEQ ID NO: 8573 - DNA, 112 bp, Artificial
  Hairpin sequence PT_from_MQbrain_330, chimp
gcccctcccaccgcccgccccccttggggtgcagggcatggtgtgaaaggccaagtgctgaggcgggtatcatgggtgctgtgccctagggcctgggtggcagggggtgggt

SEQ ID NO: 8574 - DNA, 110 bp, Artificial
  Hairpin sequence PT_from_MQbrain_333, chimp
tctttgacctttgccacttacctctccttattgatcctcatacctaagcctctctgacttagagtaaagtggacttttgagtgggggtgagtttgacaaattgttggaga

SEQ ID NO: 8575 - DNA, 93 bp, Artificial
  Hairpin sequence PT_from_MQbrain_334, chimp
tggaaagttgctagcagaagcagtacctaagctcagaaaggtctaagatcctgtgttttctgagcttagctactgtatctagagtttgttcta

SEQ ID NO: 8576 - DNA, 117 bp, Artificial
  Hairpin sequence PT_from_MQbrain_336, chimp
ggagtggtcttgggtttgggcggtggggcagaccttgggaaggggcttaggaagggagaggcagctcttccttcagctggctctcatcaggctgcagccccctccccgcccccacct

SEQ ID NO: 8577 - DNA, 103 bp, Artificial
  Hairpin sequence PT_from_MQbrain_337, chimp
agagcagctgcctgagagaggaccattgtcatccccagccgctgagtgcagaactcactccggcctcgtggcagggatgtccacctctttctacggaaggcct

SEQ ID NO: 8578 - DNA, 112 bp, Artificial
  Hairpin sequence PT_from_MQbrain_342, chimp
cccctggcttgcctgccccaggctgctgcctgtgcccccgacctccctgccttctcccacgggggcttctctcacaactaggcggtcctgggatggggcatgtggccaaggg

SEQ ID NO: 8579 - DNA, 110 bp, Artificial
  Hairpin sequence PT_from_MQbrain_343, chimp; PT_from_MQbrain_349, chimp; PT_from_MQbrain_350, chimp
agactgcaccaatgaatcctgagcaggttctagttcagtaggtggacctgtgacttcagtcaggcttcgatgcagagtctgaacctggtctggacgagaagctgtagtct

SEQ ID NO: 8580 - DNA, 80 bp, Artificial
  Hairpin sequence PT_from_MQbrain_345, chimp
ctagccagggcacctagctgaggagtgtgagtggcagaagccactggtgtctgagcagggtgagggcccgatggggctgg

SEQ ID NO: 8581 - DNA, 87 bp, Artificial
  Hairpin sequence PT_from_MQbrain_347, chimp
ggggagaggctggtgaaacggcttccctctgccgtccttccacaggggcgcggatcctgaggccgagctctgccagcttccctcccc

SEQ ID NO: 8582 - DNA, 94 bp, Artificial
  Hairpin sequence PT_from_MQbrain_348, chimp
cccaagctctgtgccttctctggcctctattactgtgacatctgccaccaagatgatgcctcagtgattctggccaggatcatccacagctggg

SEQ ID NO: 8583 - DNA, 72 bp, Artificial
  Hairpin sequence PT_from_MQbrain_353, chimp
ggggtggccccggccctcgtggcctgaggtgattgtccctgtggctctgagagcagctggggccgggtcccc

SEQ ID NO: 8584 - DNA, 74 bp, Artificial
  Hairpin sequence PT_from_MQbrain_354, chimp
cctgggcactccagtgacgccggagctgcctgggccagatcccacgcccagcctcactggctcctgtccccagg

SEQ ID NO: 8585 - DNA, 65 bp, Artificial
  Hairpin sequence PT_from_MQbrain_357, chimp; PT_from_MQbrain_667, chimp
cgtgtcctggtcactggtctttataattgttgtgcaataactaaaggctaaggactagatgcacg

SEQ ID NO: 8586 - DNA, 111 bp, Artificial
  Hairpin sequence PT_from_MQbrain_358, chimp
gagatttatactcgtgctcttggctatactgtgaattactgaaatgttgaacaaacctgtgaaagacatacattagccctttaagatggccaggagctaagcttgagtctc

SEQ ID NO: 8587 - DNA, 118 bp, Artificial
  Hairpin sequence PT_from_MQbrain_36, chimp
ctcggtgacatcttgccctcaccgcagcaccctgccttgtctccaggaggtccgaagctctgtgggacctcctgggggcaaggtggggtgaggtcggggagtagggaggtcaggcggg

SEQ ID NO: 8588 - DNA, 114 bp, Artificial
  Hairpin sequence PT_from_MQbrain_370, chimp
atggcagcaaagagtcagtctctttcatttgtccagatcaatgcccacatgcccaatttaggtcaaggcatcaggcagaggaaaggactggagactgacattgagatgctctat

SEQ ID NO: 8589 - DNA, 65 bp, Artificial
  Hairpin sequence PT_from_MQbrain_371, chimp
gcagggcaggggtgggagtgaggagtaagggcctgcccctcttcccccaaccccttcccccgtgc

SEQ ID NO: 8590 - DNA, 76 bp, Artificial
  Hairpin sequence PT_from_MQbrain_372, chimp
ccttggggctcactgtggaggagctgacggcctgggcccttggccagtcctggctcttccctgggcctcaccaggg

SEQ ID NO: 8591 - DNA, 118 bp, Artificial
  Hairpin sequence PT_from_MQbrain_378, chimp
tgggagtgcctcctgatggggcacctgggagtagggatgctccaggcgttcgtgccttctgagaacgcctctcctgggggcatcttccgagtccagtgccccagtctgagaaggccca

SEQ ID NO: 8592 - DNA, 117 bp, Artificial
  Hairpin sequence PT_from_MQbrain_38, chimp
gaggccggaacctgagggactgcctgtgttgtgggtgtctgtggtcagcattgctggtgttggcggtgaccactgagcttgtgagcacgtgaggaggcagtgtgggggtgtggcctt

SEQ ID NO: 8593 - DNA, 83 bp, Artificial
  Hairpin sequence PT_from_MQbrain_381, chimp
tttggctagggtggggggggggtggccgacgctccccatggggtccctcctcggtctccctcccctgagagctctgtgccaag

SEQ ID NO: 8594 - DNA, 73 bp, Artificial
  Hairpin sequence PT_from_MQbrain_383, chimp
tcgggcttgtgccgatgggtggtgtgatgcctggggctgtccctgctgcagcagcccaggaggtgagtcctga

SEQ ID NO: 8595 - DNA, 63 bp, Artificial
  Hairpin sequence PT_from_MQbrain_387, chimp
gctctcgggcgaggttcactggtcctaacaaggagggccagggaagtcgcacccgactggggc

SEQ ID NO: 8596 - DNA, 101 bp, Artificial
  Hairpin sequence PT_from_MQbrain_388, chimp
aggtacctgggttcaactaaagcgtcagcctgctccacccagagaagcacactttgtgagaaccaatgggaaggagcctgagctgctggaacctattccct

SEQ ID NO: 8597 - DNA, 117 bp, Artificial
  Hairpin sequence PT_from_MQbrain_391, chimp
agatagtaattgtttgtttctcctgactcctccggttgttcttctcacacaggcactgctgggagacagtggcagccagaactggagcactggaacaacagataaatatgggcgtct

SEQ ID NO: 8598 - DNA, 59 bp, Artificial
  Hairpin sequence PT_from_MQbrain_397, chimp
cccctggggcgggtgtgaggttcaagcgtactcagaccccagccacctgcggcaggcgg

SEQ ID NO: 8599 - DNA, 104 bp, Artificial
  Hairpin sequence PT_from_MQbrain_398, chimp
tcttccaccttcaatgctggggctgtcattgccctcaacaaccactttttcaagctcatttcctggtatgacaatgaatttggctacagcaacagggtggtgga

SEQ ID NO: 8600 - DNA, 109 bp, Artificial
  Hairpin sequence PT_from_MQbrain_401, chimp
gcctcccaagcctctgcccagggctctgtccccaactccgaggactgggacagggtgaactatgccgaggagggaggggacggagcctgaggctggcccaggctgaggc

SEQ ID NO: 8601 - DNA, 78 bp, Artificial
  Hairpin sequence PT_from_MQbrain_406, chimp
tcccctgctcctccccattggggaaagcatctctggagggctgttgactggagaaagggggaaggaggagctggggga

SEQ ID NO: 8602 - DNA, 113 bp, Artificial
  Hairpin sequence PT_from_MQbrain_409, chimp
tcctccaatgattccaggactgtggagagcatcctggtgtgacaatgttgtcaagcagacattcctcattttcctcattccaggtcccacagagtaagagtcacttggtagga

SEQ ID NO: 8603 - DNA, 110 bp, Artificial
  Hairpin sequence PT_from_MQbrain_41, chimp
gaagtggggttgggcagggactgaggagcagtgtggcagcaccccaagtgcaaaggccctgtggtgggaagctgccaagctgtttccctttcctttgtgtaagtatcttt

SEQ ID NO: 8604 - DNA, 120 bp, Artificial
  Hairpin sequence PT_from_MQbrain_412, chimp
aatgtggcactggtaaatctacctggttctggcatgcttcactttgatttcctgctatcctctactgcttgcctctaaatcaaggtaaagagcagagcaggtatgtattaatgtcacatt

SEQ ID NO: 8605 - DNA, 97 bp, Artificial
  Hairpin sequence PT_from_MQbrain_414, chimp
tccgcggaggtttcggcagtggcatccggggccgaggtcgcggccgtggacggggccggggccgaggccgcggagctcgcggaggcaaggccgagga

SEQ ID NO: 8606 - DNA, 79 bp, Artificial
  Hairpin sequence PT_from_MQbrain_42, chimp
ccctgctgcccttctacgaccccgacaccagtgtggtctacgtctgcggcaaggtggggctgggcagggctggggaggg

SEQ ID NO: 8607 - DNA, 93 bp, Artificial
  Hairpin sequence PT_from_MQbrain_420, chimp
ctgcagagtgacccccactcagcctcctggacagccaggttcagtttcatatggtggctatcctccaggctggtgtgggtagcctctttctag

SEQ ID NO: 8608 - DNA, 69 bp, Artificial
  Hairpin sequence PT_from_MQbrain_421, chimp
ggaggtctttctccccttcctgcctccccctactagtcactgggagagagaaggggacagaagctcacc

SEQ ID NO: 8609 - DNA, 117 bp, Artificial
  Hairpin sequence PT_from_MQbrain_422, chimp
ctggtgtgtgctgagggtggccacaggggtctgcagggtgatcccaccaggctctccagcatgcactgagctccctgggggctcaccctaccctgatggccagcctcaagtagccag

SEQ ID NO: 8610 - DNA, 95 bp, Artificial
  Hairpin sequence PT_from_MQbrain_427, chimp
tgcgtggttggatggcatgcatgtggtccttggcaaagtgaaagaaggcatgaatattgcggaggccatggagcgctttgggtccaggaatggca

SEQ ID NO: 8611 - DNA, 95 bp, Artificial
  Hairpin sequence PT_from_MQbrain_43, chimp
gtcctccaggggacaggctcggccaccttgagcaagttgtgaggtctctttggaccttgttgcctggtgcctgccctctcccatcccctgggggc

SEQ ID NO: 8612 - DNA, 118 bp, Artificial
  Hairpin sequence PT_from_MQbrain_432, chimp
aagtgagcacattcagtaatatctagaagtgtcctagcttactaataatttgatttatggaaaaatggttgaaattaataggtaaacacttttagttttctattacatgtgtttattt

SEQ ID NO: 8613 - DNA, 104 bp, Artificial
  Hairpin sequence PT_from_MQbrain_437, chimp
gcccacagggaggaggcccccagtgagcctcctgccccacaggctcttgcaacctacctgcagcgggcccgtggcacaggcttcctgccgccatcctgtgtggt

SEQ ID NO: 8614 - DNA, 103 bp, Artificial
  Hairpin sequence PT_from_MQbrain_444, chimp
gggaaatggctggatggccacactctctcaggctacaacatccagaaagagtccaccctaaacctggtgctgcgcctgcgaggtggcattactgagccttccc

SEQ ID NO: 8615 - DNA, 91 bp, Artificial
  Hairpin sequence PT_from_MQbrain_446, chimp
ggtgtggggcccttctgagtagggccggccacatgcccctgagccagctctggggagggtgtgggggcccttctgagagggggcccgggct

SEQ ID NO: 8616 - DNA, 75 bp, Artificial
  Hairpin sequence PT_from_MQbrain_45, chimp
gcgggagccaccttcccagggtcctcttcggggagaaaagagcttctgagggacttctggggatgggagcggagt

SEQ ID NO: 8617 - DNA, 89 bp, Artificial
  Hairpin sequence PT_from_MQbrain_450, chimp
ggcgctgggacgggggaaagatgcgagcgctgcaggtaatggctgtggctttgctgcgctcgcctcttccccgcgctgccgtcagcgcc

SEQ ID NO: 8618 - DNA, 85 bp, Artificial
  Hairpin sequence PT_from_MQbrain_451, chimp
ctgtgggcccctgagcagaaggctctatggaaaacggcttttccttaaggtctttttgatggctttctgttacatgggcctatag

SEQ ID NO: 8619 - DNA, 89 bp, Artificial
  Hairpin sequence PT_from_MQbrain_452, chimp
gtgcaggctgaaattgagagcccaggcactggagaagaacccaagacacaagcttggggtgtgtctggggatgacaagacaggctggat

SEQ ID NO: 8620 - DNA, 119 bp, Artificial
  Hairpin sequence PT_from_MQbrain_461, chimp
gcccaggagcggagggagccttcctcagggctctggcagcctctcctcacaagacgtgaccttgctttgggtgagggtctgcctagagccttggatgaaggtctcccatctggccgagc

SEQ ID NO: 8621 - DNA, 114 bp, Artificial
  Hairpin sequence PT_from_MQbrain_462, chimp
ggactgcagagaaccttctggctgtgcagctgagaactgagtcaatgcaagagctcctggctcctgcttgacctcgagcagctgaggttagcagatgggcaaagcctgcagttc

SEQ ID NO: 8622 - DNA, 97 bp, Artificial
  Hairpin sequence PT_from_MQbrain_465, chimp
tttggtgatggagatgtcaagcaggtggcctctggacgtcaccgttgccctgcatggtggccccagagcagcctctatgaacaacctcgtttccaaa

SEQ ID NO: 8623 - DNA, 112 bp, Artificial
  Hairpin sequence PT_from_MQbrain_466, chimp
cttctgtttcacgaagcttgctctgctctgggtgctgaatgctgggaaggtggacaggaagcctcaccacgttagggcccaggggacaaagagctttggcttcaccctgaag

SEQ ID NO: 8624 - DNA, 106 bp, Artificial
  Hairpin sequence PT_from_MQbrain_47, chimp
gcattttgcaaggaaaagccacttggggaaagatggaaaaggacaaaaaaattaataaatttccattggccctcgggtgagctgagggtttttgcaaggaagttgt

SEQ ID NO: 8625 - DNA, 110 bp, Artificial
  Hairpin sequence PT_from_MQbrain_470, chimp
cctgtgaccactaccctggagttggaatggccatgggcatggggctggaccctagacttaaccccaggccacatgtcattctggctttggtgggtggaggggcacatcgg

SEQ ID NO: 8626 - DNA, 120 bp, Artificial
  Hairpin sequence PT_from_MQbrain_471, chimp
ggtgtccatgggctctggagaccatcagttcaacctcgcagagatcctgtcacagaactacagtgttcggggggagtgcgaggaggcctcgaggtgcccagacaagcccaaggaggagct

SEQ ID NO: 8627 - DNA, 115 bp, Artificial
  Hairpin sequence PT_from_MQbrain_477, chimp
ccctggtgaaggccctggagtaggcggtgcgtacccggtgtcccgaggcccggctaggggctgggcagggatgccaggtgggcccagccagctcctggggtcccggccacctggg

SEQ ID NO: 8628 - DNA, 66 bp, Artificial
  Hairpin sequence PT_from_MQbrain_478, chimp
cctggggttcgaggtgcccagcgccgccgcctcttaacttgggggtgacgctgcccgtttcccagg

SEQ ID NO: 8629 - DNA, 73 bp, Artificial
  Hairpin sequence PT_from_MQbrain_479, chimp
ccctacgagcagctggtgcggcaggtggaggccttgaaggctgagaacagccacctgaggcaggagctaaggg

SEQ ID NO: 8630 - DNA, 107 bp, Artificial
  Hairpin sequence PT_from_MQbrain_483, chimp
agcagtgacccctgtgtcccccgcaggcgtcctgcatcctgcagctggtcaagcacatccagaagcttcaggccaaggacgtgcctgtggcagaggaggtcagcgct

SEQ ID NO: 8631 - DNA, 86 bp, Artificial
  Hairpin sequence PT_from_MQbrain_484, chimp
cagagctgggaaattccgcagcagggcagatgagggatcgatctgagtcccatgatcctcggccctgctgaggtcctaggaggctg

SEQ ID NO: 8632 - DNA, 94 bp, Artificial
  Hairpin sequence PT_from_MQbrain_485, chimp
agggcctggcgggcggcaccttcctcttcatcaccttcctggagatcctggccaaggagctggaggagaagagtgaccgtctgctcaaggtcct

SEQ ID NO: 8633 - DNA, 111 bp, Artificial
  Hairpin sequence PT_from_MQbrain_487, chimp
ccccaggctattgtcatccccaggtcttagggctgagtctcccagggctgaggttggtggaattggccgggcaggactgaggaatttggcactgggggtggaaggctgggg

SEQ ID NO: 8634 - DNA, 68 bp, Artificial
  Hairpin sequence PT_from_MQbrain_488, chimp
ggatctcttttcagcctgagcttctcttttagcctgagctgaaagagatcatcttgggaaggagctcc

SEQ ID NO: 8635 - DNA, 99 bp, Artificial
  Hairpin sequence PT_from_MQbrain_490, chimp
ggcagtctgtctcatctaccctgggtggcatcccctgcagaaagatgatttgatgagacagcaagagggcatggctacctgggaaagatgaatagggcc

SEQ ID NO: 8636 - DNA, 93 bp, Artificial
  Hairpin sequence PT_from_MQbrain_491, chimp
gaggaaaagatcgaggtgggttggggcgggctctggggatttggtctcacagcccggatcccagcccacttaccttggctactctccttcctt

SEQ ID NO: 8637 - DNA, 96 bp, Artificial
  Hairpin sequence PT_from_MQbrain_492, chimp
tcagaaccatggacagtggaacgcatgccaggggagagctgattggctggattagttaccatccaaactggagtgatcctattggacaatctttga

SEQ ID NO: 8638 - DNA, 85 bp, Artificial
  Hairpin sequence PT_from_MQbrain_493, chimp
tgtacttttaggcactgcccttgcagactcacctttctccacctgccctggagaaaggtagggtgtgctgggcctgccccttgca

SEQ ID NO: 8639 - DNA, 53 bp, Artificial
  Hairpin sequence PT_from_MQbrain_494, chimp
tctgacccaaaggctgggcacgacgctggtcccgaccttgtgcccagcccaga

SEQ ID NO: 8640 - DNA, 65 bp, Artificial
  Hairpin sequence PT_from_MQbrain_497, chimp
tgtcactggtgggtgaggctctgtggtcagcaggtgcccggcccaaggtctcgcccctcgtggca

SEQ ID NO: 8641 - DNA, 102 bp, Artificial
  Hairpin sequence PT_from_MQbrain_498, chimp
tgtctttcatcgagacctcagccttggattccactaacgtagaggaagcattcaagaacatcctcacaggtggccggggaccagatgggtgtgggtagggca

SEQ ID NO: 8642 - DNA, 101 bp, Artificial
  Hairpin sequence PT_from_MQbrain_499, chimp
caacagcctcgagcgcatgggccccgccatgggcccggccctgggcgctggcattgagcgcatgggcctggccatgggtggcggtggcggtgccagctttg

SEQ ID NO: 8643 - DNA, 90 bp, Artificial
  Hairpin sequence PT_from_MQbrain_5, chimp
tcctggagggctgaggtgggtgtgttggagccagcagtttctgggagaagggataaggctcaccttccacaccctcctggctcctgagga

SEQ ID NO: 8644 - DNA, 119 bp, Artificial
  Hairpin sequence PT_from_MQbrain_500, chimp
ggccgtcacggtggaatgtgagtaggggcaccgcggagttaggcaggatctgtgggacaaccccggctggacttcctggcccccgtgtgagcccttgcaatcctgtttcccagatggcc

SEQ ID NO: 8645 - DNA, 59 bp, Artificial
  Hairpin sequence PT_from_MQbrain_502, chimp
ggccttcgtcctggccgtcactggcaacctgacgctggtgctggcccagaggagggacc

SEQ ID NO: 8646 - DNA, 105 bp, Artificial
  Hairpin sequence PT_from_MQbrain_506, chimp
gagacatggcagctgtaggcatcttgggccagccccaggtagtcctgaaacccaggatcaggaaaaggtagagggtgggctgaggtcgcatcactgtaaagtttc

SEQ ID NO: 8647 - DNA, 95 bp, Artificial
  Hairpin sequence PT_from_MQbrain_508, chimp
ccggctggtgggcgcagggggactgggggtgagcaggcccagaacccagctcgtgctcactctcagtccctccctagacgtggtgcacctggagg

SEQ ID NO: 8648 - DNA, 93 bp, Artificial
  Hairpin sequence PT_from_MQbrain_514, chimp
ctccttaaggaagagccggggccccgctgtcgctgatgaatgggaaatttccatttgcacatacgcatgggatcctggccgccctcctaggag

SEQ ID NO: 8649 - DNA, 93 bp, Artificial
  Hairpin sequence PT_from_MQbrain_519, chimp
gcgcgtgcgcgtgttgtgcacacgcgtgtgcgcgcctgcctgtgtcagcgggtctgtgtgcacccttgcttgtgtacctggatatgctcgtgt

SEQ ID NO: 8650 - DNA, 60 bp, Artificial
  Hairpin sequence PT_from_MQbrain_52, chimp
ggttccgggattcccatccgtcctggcgctcctgccagcagtgggtgggcagcctgagct

SEQ ID NO: 8651 - DNA, 74 bp, Artificial
  Hairpin sequence PT_from_MQbrain_522, chimp
caagaagaagcagtggtgcgccaactgcaagaaggaggccatcttttactgctgttggaacaccagctactgtg

SEQ ID NO: 8652 - DNA, 109 bp, Artificial
  Hairpin sequence PT_from_MQbrain_523, chimp
gggacagcatcgtggccgagctggaccgagagatgagcaggagcgtggacgtgaccaacaccaccttcctgctcatggctgcctccatctatctccacgaccagaaccc

SEQ ID NO: 8653 - DNA, 66 bp, Artificial
  Hairpin sequence PT_from_MQbrain_528, chimp
cagcgggcgcaggtggaaagtgaaggctcagagcattgctctgagacttgtcctgggaggctcctg

SEQ ID NO: 8654 - DNA, 72 bp, Artificial
  Hairpin sequence PT_from_MQbrain_529, chimp
gcacccccatccccgccctcctcgtctgtgtaagttggggtacctgggccaggcagggcgtggaggcagggc

SEQ ID NO: 8655 - DNA, 87 bp, Artificial
  Hairpin sequence PT_from_MQbrain_531, chimp
gggaggctcttcctttttgccctctacatgagctgagcaccctgggtgtttcacaggggctggctgtgggcaatggactctcctcct

SEQ ID NO: 8656 - DNA, 98 bp, Artificial
  Hairpin sequence PT_from_MQbrain_532, chimp
gatgggtaaagcaatactgccgctgcccccaccctgcttctgctgcctgtttggggaggggggcggtgaggtgggggcagcggccccccgctcccctc

SEQ ID NO: 8657 - DNA, 117 bp, Artificial
  Hairpin sequence PT_from_MQbrain_533, chimp
ccgtggctgtgactctgttttccgcagtggagcggaggcggagggacaagatcaacaactggatcgtccagctttcgaaaatcattccagactgtaatgcagacaacagcaagacgg

SEQ ID NO: 8658 - DNA, 109 bp, Artificial
  Hairpin sequence PT_from_MQbrain_539, chimp
ccatctgggggccctgggctcccatcctcatctctctccttgactggaattgctgctacccagctggggtgggtgaggcctgcactgattggggcctggggcagggggg

SEQ ID NO: 8659 - DNA, 79 bp, Artificial
  Hairpin sequence PT_from_MQbrain_540, chimp
gcagacgacctgaaggctgtgggcgggaagcccgccggatggcaggtgggcggcgcccagggctgcggggaatgtgtgt

SEQ ID NO: 8660 - DNA, 80 bp, Artificial
  Hairpin sequence PT_from_MQbrain_543, chimp
gggcattaccttgtggggttggagagctggctggcccagcccctcagaagctctcccctccccgcagggtgaggaggtcc

SEQ ID NO: 8661 - DNA, 105 bp, Artificial
  Hairpin sequence PT_from_MQbrain_550, chimp
actttgatgggggcagtgagggagacagcccaaacccttttctccaatcccccttccccaggttcctgggctccccttctctctaccttctcccccaacgtctgt

SEQ ID NO: 8662 - DNA, 75 bp, Artificial
  Hairpin sequence PT_from_MQbrain_555, chimp; PT_from_MQbrain_910, chimp
ggtgaagaacaagaaagctcagctggtggtgattgcacatgatgtagatcccatcaagctggttgtcttcttgcc

SEQ ID NO: 8663 - DNA, 87 bp, Artificial
  Hairpin sequence PT_from_MQbrain_556, chimp
gccaggccgcagagcggaaggaggcggtgacgtcactgcgggagcaagtgcagcggccacatcctcctcctagtccggccacggggc

SEQ ID NO: 8664 - DNA, 93 bp, Artificial
  Hairpin sequence PT_from_MQbrain_559, chimp
gcagtttggttctgctgggggttggggcaggatgaagaggaaggggctgccttcccaactcagccgcctcctcactccacaggagcctgcagc

SEQ ID NO: 8665 - DNA, 77 bp, Artificial
  Hairpin sequence PT_from_MQbrain_56, chimp
ccagataaaaagagctggtgaggctacttccattggttcttaatgaattccaggtctcggttcctcatcagccctgg

SEQ ID NO: 8666 - DNA, 79 bp, Artificial
  Hairpin sequence PT_from_MQbrain_561, chimp
ggatggggggggctcggcaactcctgggggcctggcgaggaggcgggcttcccgggggggggacacgggaccgcttacc

SEQ ID NO: 8667 - DNA, 73 bp, Artificial
  Hairpin sequence PT_from_MQbrain_564, chimp
ggtgcagagcccagctgcccccagggctcctgggccttctcagtgagtctgggggagctgaagtccatccgcc

SEQ ID NO: 8668 - DNA, 92 bp, Artificial
  Hairpin sequence PT_from_MQbrain_566, chimp
ccatgggccccccactccttgacagatgagtggttttgatccagccagaaatgctggatttacaatggcagagaagtggcggggttgggtgg

SEQ ID NO: 8669 - DNA, 83 bp, Artificial
  Hairpin sequence PT_from_MQbrain_571, chimp
gcgtaagcctggcgcgcgcgcgcgccattgtgtggctggactcggccgcccctgtggtgtgaggcgcgtgttcgggctcttgc

SEQ ID NO: 8670 - DNA, 108 bp, Artificial
  Hairpin sequence PT_from_MQbrain_574, chimp
tccggaaagtccagagactttcagatttcagccctggcactgtctcccattctcagaggagacaggggagagccagaggctgatcaggctgtgggtggacttggggga

SEQ ID NO: 8671 - DNA, 78 bp, Artificial
  Hairpin sequence PT_from_MQbrain_575, chimp
ggctccatgggcctggaggcagccacggccgtggtgagtgccagggccgggccattgggctctgggactcagggggcc

SEQ ID NO: 8672 - DNA, 118 bp, Artificial
  Hairpin sequence PT_from_MQbrain_576, chimp
gaagccctggggcgtttgacatgagtggggtcaggggatctctggctgaggctgtgggcagccccccacctgcagccacaccaactcccacgccccccacccggaagacgccggagtc

SEQ ID NO: 8673 - DNA, 116 bp, Artificial
  Hairpin sequence PT_from_MQbrain_582, chimp
gatttctgttttccctccatcctcttctaatctttctcctttttatcctggcactctcatcagccccccagaagaggatttgaataggaagactttgggattgggagccagaggtt

SEQ ID NO: 8674 - DNA, 92 bp, Artificial
  Hairpin sequence PT_from_MQbrain_585, chimp
agcacaagggatcttgcccacctcctctttgactctgtggattatccatccatctgctcactgtgaagatggagaggcagtgccctaaggct

SEQ ID NO: 8675 - DNA, 85 bp, Artificial
  Hairpin sequence PT_from_MQbrain_587, chimp
gtgaactgagttgtgtgccgcttgtgtgtaatttggtacaggtacccctgtccttcacagataggtgacacacgtcctaattcat

SEQ ID NO: 8676 - DNA, 69 bp, Artificial
  Hairpin sequence PT_from_MQbrain_59, chimp
tctcaggaggaggctgccctgaggggctggggaggggggtacctcatgaggaccagggtggagctgaga

SEQ ID NO: 8677 - DNA, 79 bp, Artificial
  Hairpin sequence PT_from_MQbrain_590, chimp
ggtcttacccattgagcctgcagccctcctgggagggctcaggagagccagtgggggctgctggccctgggatggtacc

SEQ ID NO: 8678 - DNA, 68 bp, Artificial
  Hairpin sequence PT_from_MQbrain_592, chimp
agtgtcgtccgtgagtgcttggctggtggtcaagtgcatcttccagcctgagaccgcgtggactcgct

SEQ ID NO: 8679 - DNA, 72 bp, Artificial
  Hairpin sequence PT_from_MQbrain_594, chimp
cctttttcccttcactggttgcagggggagggagcctgccagctgcgaggacctctgtggtggaggagttgg

SEQ ID NO: 8680 - DNA, 95 bp, Artificial
  Hairpin sequence PT_from_MQbrain_596, chimp
acttggatgcctgcagccagctctcagctgggccacacaggagccacctccatcctgggtccagcgggagagagcgctgttcccctccaccaggt

SEQ ID NO: 8681 - DNA, 95 bp, Artificial
  Hairpin sequence PT_from_MQbrain_597, chimp
gctgcagtgtcccacctaaaaacaggcacattgggttagttccatcagacccactgatggaactgtgcctgtacagccccaggactctgcgaggc

SEQ ID NO: 8682 - DNA, 74 bp, Artificial
  Hairpin sequence PT_from_MQbrain_599, chimp
gccgcccgggctctcgacgcgccgacggccgggcggacggacggacggacgcgccgagcgcagtgccccgcggt

SEQ ID NO: 8683 - DNA, 119 bp, Artificial
  Hairpin sequence PT_from_MQbrain_600, chimp
caggatgctctctcctgagcctgtgatctgcctgtggcttgctgcagagtacggctgctctcactgctgcacaggccacggccggagcaatgcactggacaggggagggttgcatcctg

SEQ ID NO: 8684 - DNA, 68 bp, Artificial
  Hairpin sequence PT_from_MQbrain_605, chimp
gggagcacctgctctgttctagcctggcatcagatgtaggggtggcaagacgaaggtgccaaggtccc

SEQ ID NO: 8685 - DNA, 79 bp, Artificial
  Hairpin sequence PT_from_MQbrain_607, chimp
ggatcagggaaagcccaggaggggctggcctggcttccggccgcacattggcagaaaagctcctcgagggctctgagct

SEQ ID NO: 8686 - DNA, 115 bp, Artificial
  Hairpin sequence PT_from_MQbrain_608, chimp
ttttgatatataagccagtttaatgttttctatacagaccctggcttttcttaaattttatatattggaaagcccatgtttgtattggaaactgctggtttctttcatattgaaa

SEQ ID NO: 8687 - DNA, 108 bp, Artificial
  Hairpin sequence PT_from_MQbrain_610, chimp
tcaggccttgttttaactctcttgttgtcactgctgtaggtcagaggcctggcttcaagtactggtatgacaaggagtggctgagcaggggacatatgcatggcctgg

SEQ ID NO: 8688 - DNA, 98 bp, Artificial
  Hairpin sequence PT_from_MQbrain_612, chimp
ccagaagcatctgggaaggcagcccacccctcctttctgcagtcattgattaaggcagaagctgaacagtgagcagtcatcccagatgctcaccatgg

SEQ ID NO: 8689 - DNA, 93 bp, Artificial
  Hairpin sequence PT_from_MQbrain_62, chimp
tcatagagcacagcctctcacctctcacgcactcataagcctgtcaacccagggcttaatgagtgtgccagtagtattggttagtttctaggg

SEQ ID NO: 8690 - DNA, 67 bp, Artificial
  Hairpin sequence PT_from_MQbrain_620, chimp
gagcagtgaggatgacgtctacctgcacacagtcattccggccgtggtggtcgcagccatcctgctc

SEQ ID NO: 8691 - DNA, 92 bp, Artificial
  Hairpin sequence PT_from_MQbrain_621, chimp
gggcccgagaccgttcacctccccttatccctgttcccctcttcaggatggagctgacctcaagggaaagagggaggggacagcctctgccc

SEQ ID NO: 8692 - DNA, 114 bp, Artificial
  Hairpin sequence PT_from_MQbrain_626, chimp
tttgtgctcaaactggactccgagaaacacaagcttttttagaccaccacaataagagctgtggggggatgggagatggggaagaaaagaaagggccaggaagaaagacacaaa

SEQ ID NO: 8693 - DNA, 119 bp, Artificial
  Hairpin sequence PT_from_MQbrain_63, chimp
ggtgtacccggctgtgggccagcgtgtgagctcggggaaggaggggtggccccaggaggtccagccctgccatgcctcctgccctcagctccaggagctgcaccgagctgggggcgacc

SEQ ID NO: 8694 - DNA, 100 bp, Artificial
  Hairpin sequence PT_from_MQbrain_632, chimp
agactgaatttgtatttgtggaaagcggcttggcttggaagattccattgtgcagaactggagtctttactgacccgctttccacatcagcccaaggtct

SEQ ID NO: 8695 - DNA, 96 bp, Artificial
  Hairpin sequence PT_from_MQbrain_640, chimp
ccgcggtggcttccgcggaggtttcggcagtggcatccggggccggggtcgcggccgttggacggggccgggggccgaggccgcgggagctcgcgg

SEQ ID NO: 8696 - DNA, 110 bp, Artificial
  Hairpin sequence PT_from_MQbrain_641, chimp
cttctccctgccgtcatgtttaagtcagagtctcctaaagagcccaaacagctgaggaagctcttcattggagggctgagctttgaaacaaccaatgagagtctgaggag

SEQ ID NO: 8697 - DNA, 105 bp, Artificial
  Hairpin sequence PT_from_MQbrain_642, chimp
tctcctcctcttcctcctccccagggtggagtccatgtccctggctgacagagggaaccctggaaatattacttcgcgcttgatggagaaggagaaggccagaga

SEQ ID NO: 8698 - DNA, 117 bp, Artificial
  Hairpin sequence PT_from_MQbrain_644, chimp
gttctcacaggtactgagctgtcaaaagtgcatgaaggcctcactgtactctagtcctgacttggggtgcagagggctgcttgcaatcctgtttgtaaggctgtgcctgctcagagc

SEQ ID NO: 8699 - DNA, 76 bp, Artificial
  Hairpin sequence PT_from_MQbrain_645, chimp
ggcgaaggcggcagcggcggcgacagctctgggggttgcgtctcggggtgtgtcggccgccgctgctgcttgggcc

SEQ ID NO: 8700 - DNA, 102 bp, Artificial
  Hairpin sequence PT_from_MQbrain_648, chimp
gaggaggagtggtggaaggcactggagtcaggaatctctgaatggcaagagtgatcagagaggtctgaaggataggaggatgctgggccgtggctggtcctt

SEQ ID NO: 8701 - DNA, 118 bp, Artificial
  Hairpin sequence PT_from_MQbrain_650, chimp
tctggcatcttgtccatggcaaatgctggacccaacacaagcagttcccagtctttcatctgcactgcaagattgactggttggatggcaagcatgtggtctttggcaaggtgaaaga

SEQ ID NO: 8702 - DNA, 115 bp, Artificial
  Hairpin sequence PT_from_MQbrain_653, chimp
gttctggagagtctaggtttgcaggaatccagccaaggacaagactttgcattttttaaaaagtctaatatttgctttggtgtttcattgcagagaccctagatttaatttgaat

SEQ ID NO: 8703 - DNA, 80 bp, Artificial
  Hairpin sequence PT_from_MQbrain_66, chimp
gagacgatggtgtggatggcatgggactcaggagcgaggcacggtcactgttcccaatcccggattctgaccggctgctc

SEQ ID NO: 8704 - DNA, 77 bp, Artificial
  Hairpin sequence PT_from_MQbrain_661, chimp
ggagacggtgagtagtggcgcgcggcggctcggagtacctctgccgccgcgcgcatcggctcagcatgcccgtctct

SEQ ID NO: 8705 - DNA, 80 bp, Artificial
  Hairpin sequence PT_from_MQbrain_666, chimp
agagggctgcagcccgggcggacgcgcggagccgagcggggcacggcggcggcagcgacagcggccgggatgagtcaact

SEQ ID NO: 8706 - DNA, 77 bp, Artificial
  Hairpin sequence PT_from_MQbrain_669, chimp
ctgtgctgcggaggggagtacagtaattttcagacagagctgaaatgtttgtggctgtgtctcccagaccatgccag

SEQ ID NO: 8707 - DNA, 94 bp, Artificial
  Hairpin sequence PT_from_MQbrain_67, chimp
agtgcctgatgccgcggcctgtgattgggagttgctggagtcggtgcttcactcttaaggttccgaccacagactgcggagtgggtccggggct

SEQ ID NO: 8708 - DNA, 77 bp, Artificial
  Hairpin sequence PT_from_MQbrain_677, chimp
gcggcgctctcaaagccaagccgcacgtgaagcggcccatgaacgcattcatggtgtgggcgcaggcggcgcgccgc

SEQ ID NO: 8709 - DNA, 98 bp, Artificial
  Hairpin sequence PT_from_MQbrain_68, chimp
gtttaggggtggacctgatgtccctgagtgtatgtggtgaacctgaatttaccttgggtttcctcatattcattcaggagtgtcagttgccccttcac

SEQ ID NO: 8710 - DNA, 91 bp, Artificial
  Hairpin sequence PT_from_MQbrain_681, chimp
caatcgccgcggccctgaggaccccgttctgcccacgcgactgcaaaggcggccccgttgggctgagcgccgagtgcttgggaggcgaatg

SEQ ID NO: 8711 - DNA, 79 bp, Artificial
  Hairpin sequence PT_from_MQbrain_686, chimp
cagcgccttcttcctggtcaatgactggctttcggtggagacggaggccaacgggggcctggtggagaaggaggtgctg

SEQ ID NO: 8712 - DNA, 120 bp, Artificial
  Hairpin sequence PT_from_MQbrain_688, chimp
ctccctgatgtgctgtgggaggggctgttgcgaggtctggatgggcaagctctcactggggacagatgcttgtgcaggggggcattcagaggcagccagggcctgggcaggttgagggag

SEQ ID NO: 8713 - DNA, 116 bp, Artificial
  Hairpin sequence PT_from_MQbrain_689, chimp
gggctgtccccacgctggccttcgcctccctgaagtggctttctgcagtgactttgtccattgatctgtttactgccttccctgaggccacaagggagcctgccagggtggggccc

SEQ ID NO: 8714 - DNA, 88 bp, Artificial
  Hairpin sequence PT_from_MQbrain_691, chimp
gagttgcttttgccctctttggagccagggtgaattgagggtgatgggcctagtctggcttgtccaaggagacaggacttaagtactt

SEQ ID NO: 8715 - DNA, 78 bp, Artificial
  Hairpin sequence PT_from_MQbrain_697, chimp
gggcttgaggctgagtgccctgtcttgcatgctggagacagacagaggagcagagggaccgggccatgtgcctggctc

SEQ ID NO: 8716 - DNA, 80 bp, Artificial
  Hairpin sequence PT_from_MQbrain_699, chimp
agacctcttcgtgggtagatgccacctcagggctacagctatatggtgggtggtgtggatgcctgggaagccaagtgttt

SEQ ID NO: 8717 - DNA, 101 bp, Artificial
  Hairpin sequence PT_from_MQbrain_70, chimp
aggcaggatggtggggacggcagggggctactgccatcccgaagttacagttggattgggaagaagcagccagatcccccgctgttctcactcatcttctt

SEQ ID NO: 8718 - DNA, 77 bp, Artificial
  Hairpin sequence PT_from_MQbrain_708, chimp
ccccggcctcggcgccctgggcagagccatcacagctgtttccagggtggtggttggggcctaggcctgggcctggg

SEQ ID NO: 8719 - DNA, 118 bp, Artificial
  Hairpin sequence PT_from_MQbrain_710, chimp
gacagggtggggatggccatgtgtgcagcctgctgtgggcaggagggaaactaagggggtccttgacttgctcccctcccttagctggcagctcaagtggtcttggtcacttcttgtc

SEQ ID NO: 8720 - DNA, 52 bp, Artificial
  Hairpin sequence PT_from_MQbrain_712, chimp
gggagaggggagcaggtgacagctcagctgcagatacgtgctcctgtctccc

SEQ ID NO: 8721 - DNA, 92 bp, Artificial
  Hairpin sequence PT_from_MQbrain_713, chimp
ccctcggtgggagctgggtgctgctggctcttggtgtccatgaggccatcttgttggagcctgacagtacctgggacttccttccccatggg

SEQ ID NO: 8722 - DNA, 114 bp, Artificial
  Hairpin sequence PT_from_MQbrain_715, chimp
gtgttgaagtcccctggacagtgggcaggggtggcagaggacacgagcagccactgcccgtaccccctctcctctctgtaagcccatgccctgtcttcccagggatttgtgagc

SEQ ID NO: 8723 - DNA, 77 bp, Artificial
  Hairpin sequence PT_from_MQbrain_716, chimp
gttctgctgcgcctgtcacccatggccttccgggccctgcagggctgtggggctgtgggggaccggggtctgtttgc

SEQ ID NO: 8724 - DNA, 95 bp, Artificial
  Hairpin sequence PT_from_MQbrain_717, chimp
tgctgggcctgccccagggcctgtggtcactgctgagggactgcatccatcccttccctcacccactggcaatagcacccccttgggttccagca

SEQ ID NO: 8725 - DNA, 83 bp, Artificial
  Hairpin sequence PT_from_MQbrain_721, chimp
ccctcctgtgagagtctgaaggacactattgccaaggctctgcccttttggaatgaaaaaatagttccccagatcaaggaggg

SEQ ID NO: 8726 - DNA, 86 bp, Artificial
  Hairpin sequence PT_from_MQbrain_722, chimp
caggaattcagcttcctctcaaaagccatggttgcgaggtcgcgtgtttaacctcgcactggctgctgagggaattaacaggcctg

SEQ ID NO: 8727 - DNA, 59 bp, Artificial
  Hairpin sequence PT_from_MQbrain_723, chimp
ctggatgaccagtgcttcgtccacccctgcactggtgtgggcgagtgtcggtcttccag

SEQ ID NO: 8728 - DNA, 70 bp, Artificial
  Hairpin sequence PT_from_MQbrain_724, chimp
gcctgggggtggtgagtggggtgtggggtgtgcttgtgcatgtagatcacactgatattggccatcaggc

SEQ ID NO: 8729 - DNA, 82 bp, Artificial
  Hairpin sequence PT_from_MQbrain_731, chimp
tcccatcctgggtggggttctcctagtggcctgagtgtgccaccaggtctgcagggaggaggaatccatgcaggaggttgga

SEQ ID NO: 8730 - DNA, 116 bp, Artificial
  Hairpin sequence PT_from_MQbrain_737, chimp
cggcgggcacactgggccaggaagtgggtgaggcgggcacgcagggctggggccagctcatgcttggccaagctccgcaggctctcctcggctgcccggctccggcgctccagctg

SEQ ID NO: 8731 - DNA, 110 bp, Artificial
  Hairpin sequence PT_from_MQbrain_74, chimp
tcatcttctgtcttctgcatttcagacctatgagcagaggaaaattgtggagttcacctgccacacagccttcttcgtcagtatcgtggtggtgcagtgggccgacttgg

SEQ ID NO: 8732 - DNA, 112 bp, Artificial
  Hairpin sequence PT_from_MQbrain_740, chimp
gagcagtcttttcattagagcacacttggtttaaatgagtttggagtggttgtaatagccattcctgcactgttatttataaaggtgaaatctgatgtgagtatttttgttc

SEQ ID NO: 8733 - DNA, 99 bp, Artificial
  Hairpin sequence PT_from_MQbrain_750, chimp
ggctgctggccgggagaccagccagagcacgaggggggtcagggctgtgtgggttttggcctgattctgcatttggttgttcctgggggccatgtagcc

SEQ ID NO: 8734 - DNA, 116 bp, Artificial
  Hairpin sequence PT_from_MQbrain_751, chimp
gaaccgtgggtaccgatggatgtggccgagagccctgaacaggatcctcactctccagaggatgaagagcagccacaggggctctcggacgatgacattctgagggacagcgggtc

SEQ ID NO: 8735 - DNA, 63 bp, Artificial
  Hairpin sequence PT_from_MQbrain_756, chimp
cctccccctggcagcctgctgggtgccctcctcgcgtccccagccaggttgcagtgggtgggg

SEQ ID NO: 8736 - DNA, 70 bp, Artificial
  Hairpin sequence PT_from_MQbrain_759, chimp
ggcccgtccacaggcccggctctgggccgcgtgccccggaagcaggtgtgtccagagccagctgagggct

SEQ ID NO: 8737 - DNA, 98 bp, Artificial
  Hairpin sequence PT_from_MQbrain_760, chimp
ggtgctgcccttgacctgccccgtccctactgctgcaggcctatgaaggggtgctgcagctggtggaggctcgcgggcgctacgaggagctctgcatc

SEQ ID NO: 8738 - DNA, 78 bp, Artificial
  Hairpin sequence PT_from_MQbrain_765, chimp
ggagacagacagagaaggcagcaggcggcctttgttgctcagcaaggggctctgccctccctccttccttcttgcttc

SEQ ID NO: 8739 - DNA, 101 bp, Artificial
  Hairpin sequence PT_from_MQbrain_77, chimp
agctccagttgcagctggaacaactgaccatcctgggggctgtgttgctggtcaccttcagcatggcagtgccaggaatttccagccaggccgactttgct

SEQ ID NO: 8740 - DNA, 65 bp, Artificial
  Hairpin sequence PT_from_MQbrain_770, chimp
acgtctctgggctgggggtccacagggcactgatgtgtcctgggatttgaaagccccatctatgt

SEQ ID NO: 8741 - DNA, 114 bp, Artificial
  Hairpin sequence PT_from_MQbrain_771, chimp
gttggcatgtgctgcagggggcttgtccttttaactctcccacaggatggatgtaggcagtgtcacattcattatgctgagagtgaaggttcatcactcctgtatcatggtagc

SEQ ID NO: 8742 - DNA, 100 bp, Artificial
  Hairpin sequence PT_from_MQbrain_775, chimp
gccagcaggggggcctgggtttccttgtttggaggtgcaggatatttgttctatcctgtttacagccaatggggggccctttttcttccctacagtgagc

SEQ ID NO: 8743 - DNA, 99 bp, Artificial
  Hairpin sequence PT_from_MQbrain_776, chimp
cccgggccgtcccccgggcccccagctctgtccagccgcccgcgaccgctgcaggcgcctggacagctcctcctggggacccgggaaagcgctcttggg

SEQ ID NO: 8744 - DNA, 95 bp, Artificial
  Hairpin sequence PT_from_MQbrain_777, chimp
gttgtgttaagacagttttcagtgtaccgtaaatgttgtgttttcagaaaaagacaaaacgatggtgctgactggttttctgtatattgcacaac

SEQ ID NO: 8745 - DNA, 117 bp, Artificial
  Hairpin sequence PT_from_MQbrain_78, chimp
gtcaggttcttgttttacagatgcgtacactgagaaccagatctttgatttgatttgcttgggtcctaaaatctggttctcagtgtctacatacgtaaaacaacatggtactgtgac

SEQ ID NO: 8746 - DNA, 92 bp, Artificial
  Hairpin sequence PT_from_MQbrain_780, chimp
gcatctatgggattcagaaagagccagtgacaattccagcacccacttccaatgagcatgctgatgtcacaggcgtgatattcagcaggtgt

SEQ ID NO: 8747 - DNA, 93 bp, Artificial
  Hairpin sequence PT_from_MQbrain_782, chimp
cttcagccctttccttcctctccccgccctgcctctgtcccgcaggcgagcgaggacaaagtgaggcagctggtgaaggagatcggccgggag

SEQ ID NO: 8748 - DNA, 109 bp, Artificial
  Hairpin sequence PT_from_MQbrain_783, chimp
tcaaatgggagccctccagacataaggaggccagaggctgcaaggagcggggccgtgaccgcttacaccccttctccacagcccggcccgacctggagggcccccgggg

SEQ ID NO: 8749 - DNA, 79 bp, Artificial
  Hairpin sequence PT_from_MQbrain_784, chimp
ccatgctgggggcatttaccatgctgggggcatttcccactctgggggcactccacgctgggggcatttcccatgctgg

SEQ ID NO: 8750 - DNA, 79 bp, Artificial
  Hairpin sequence PT_from_MQbrain_788, chimp
ggtatgcacgcatgtgcatgcgtgcgtgttcctgtgcacgttgtgggagtgtgcatgtgcgtgtgtctgcatgtgttcc

SEQ ID NO: 8751 - DNA, 80 bp, Artificial
  Hairpin sequence PT_from_MQbrain_789, chimp
gctcttacggatattgggagtggtgggcctggcctcgaggggttttccaggggccctgcccccactcccccttctcgagc

SEQ ID NO: 8752 - DNA, 120 bp, Artificial
  Hairpin sequence PT_from_MQbrain_790, chimp
aggaccccgggaggctctcagccaactccgggtgctctgctgtgagtggctgaggcccgagctgcacacgaaggagcagatcctggagctgctggtgctggagcagttcctgaccatcct

SEQ ID NO: 8753 - DNA, 116 bp, Artificial
  Hairpin sequence PT_from_MQbrain_792, chimp
aggtgggctggtggagtggggtctggcaagccctcagcctagcccatcagtctctctcttcccccttaccagctgctccgagggccgagggcccacaactccatttgtctccacct

SEQ ID NO: 8754 - DNA, 118 bp, Artificial
  Hairpin sequence PT_from_MQbrain_796, chimp
ccttccaggccccatgccagcttggctcctccctggaccccaggatcttcatctattagtgaagtctcctgggctgtggggaggggcccgcagttgccggggcactgagattcttggg

SEQ ID NO: 8755 - DNA, 66 bp, Artificial
  Hairpin sequence PT_from_MQbrain_802, chimp
aggggcctggagctgcaggatcccaggggaggggtttctctctgcatcccaagccatccagccctt

SEQ ID NO: 8756 - DNA, 97 bp, Artificial
  Hairpin sequence PT_from_MQbrain_804, chimp
cggtggcctttgcagtgggtcagctttgggctgctgagatgggcggcgtgaaggccggcttccagagccctggctggcctttgtagtggatgagacg

SEQ ID NO: 8757 - DNA, 88 bp, Artificial
  Hairpin sequence PT_from_MQbrain_806, chimp
ggattttactttacaccccagaggtcatgctgggtgggtaccacttggcgtatggttcctctggtggtggggattgggggctgagtcc

SEQ ID NO: 8758 - DNA, 76 bp, Artificial
  Hairpin sequence PT_from_MQbrain_807, chimp
agtgtgaaggacatccaggcgcacctggctcagggccatgtggccatcgtgctggtgaactcaggggtgctgcact

SEQ ID NO: 8759 - DNA, 78 bp, Artificial
  Hairpin sequence PT_from_MQbrain_810, chimp
gctggcttctctctggggatggaaggaggctgggggagcgtcttcacagctccatcctctcctgtgcatgggcgtggc

SEQ ID NO: 8760 - DNA, 113 bp, Artificial
  Hairpin sequence PT_from_MQbrain_812, chimp
gcgattgaagctgtgggaagactaatagttgataatgctagcgtggctcctctgattaaatgtattagtaggtgtctggctgtaattttggctgttaattgcacagctaatgc

SEQ ID NO: 8761 - DNA, 76 bp, Artificial
  Hairpin sequence PT_from_MQbrain_82, chimp
gaatacctccaggtgctcacctggtgttggcctcagcattggggcagttagcactgaggtggcttctgtttgattc

SEQ ID NO: 8762 - DNA, 97 bp, Artificial
  Hairpin sequence PT_from_MQbrain_822, chimp; PT_from_MQbrain_823, chimp
ggagctgggtcaatttcaggcacagcccatccgagtcaggcgaggtccagaaaggcctgactcgcccggcagcctcaacggacttgtccccgcagcc

SEQ ID NO: 8763 - DNA, 111 bp, Artificial
  Hairpin sequence PT_from_MQbrain_827, chimp
cggcagtgtcagctggcagcagcagctggctgtgcctgagcctaatgttctccattaagggaacatctgttggctggggcatgggccagacgcagccacgctccacggccg

SEQ ID NO: 8764 - DNA, 95 bp, Artificial
  Hairpin sequence PT_from_MQbrain_828, chimp
tgccttcattcaggcgggtagctgcactgggcatggggtggtggtgggagcttaccgccacctattcaaactctcagccactcctgaaatgggca

SEQ ID NO: 8765 - DNA, 70 bp, Artificial
  Hairpin sequence PT_from_MQbrain_83, chimp
tccagccgcaggctctgggatggtcttggagagtcggaacctcgcccccggcctccatgcactgcgcggg

SEQ ID NO: 8766 - DNA, 117 bp, Artificial
  Hairpin sequence PT_from_MQbrain_830, chimp
ctttgagcaagcccttagcgtctctggggcccttctggagagagaaggctacacttttcagcaaaatgccctctctcagcagcaggctcccaatggacacaatggcgactcccaaag

SEQ ID NO: 8767 - DNA, 93 bp, Artificial
  Hairpin sequence PT_from_MQbrain_833, chimp
ttagcggccatcgggcggttggtcttcattctaccagactttgctgtcggaagagagaaatggtagaatgacaggccacgtttggcccgttgg

SEQ ID NO: 8768 - DNA, 92 bp, Artificial
  Hairpin sequence PT_from_MQbrain_835, chimp
gacccctcatgctctctgactgggccggtgggcagccctggcctctcttggatggagctgccctgccggtgcctaggcaaagaagaggcctc

SEQ ID NO: 8769 - DNA, 91 bp, Artificial
  Hairpin sequence PT_from_MQbrain_836, chimp
tcttggttcatgtccggacagtccccaggggagttctgggttcaaccagccagagctcttcctcctggctgatctggtcctcagccttgga

SEQ ID NO: 8770 - DNA, 86 bp, Artificial
  Hairpin sequence PT_from_MQbrain_837, chimp
acacctgaacacagtggcaccagcagcccaaggcttccatgtggttccagagccttgggctggtgtgagctactgtacttctctgt

SEQ ID NO: 8771 - DNA, 70 bp, Artificial
  Hairpin sequence PT_from_MQbrain_838, chimp
attgtagagctttatgctgaaaaggtggccccagaggtctgtgtgccattgcccaggcagagtctgcagt

SEQ ID NO: 8772 - DNA, 112 bp, Artificial
  Hairpin sequence PT_from_MQbrain_84, chimp
gcaaggcatttcctgggctgggtgggttttctcctgccctggtgtgagcttccttagggaggatccagagcaaggcttagagctcacagcaggctagaaaaggcctccatgc

SEQ ID NO: 8773 - DNA, 96 bp, Artificial
  Hairpin sequence PT_from_MQbrain_840, chimp
ggtctggcgtgcaaaggagggtggttctttggctaatggtggacctgctcctaggcctatcccagagtccctcagctctcctagcaaacaaaatcc

SEQ ID NO: 8774 - DNA, 116 bp, Artificial
  Hairpin sequence PT_from_MQbrain_842, chimp
ggcttccacggaggttttggcagtggcatccagagccggggtcgcggccatggacggggccggggccgaggccccggagatcgcggaggcaaggccaaggataaggagtggatgcc

SEQ ID NO: 8775 - DNA, 58 bp, Artificial
  Hairpin sequence PT_from_MQbrain_843, chimp
ggggaatgcgaggctgcttcccttctgcgcaatcagggtacgcagcctccagttctct

SEQ ID NO: 8776 - DNA, 116 bp, Artificial
  Hairpin sequence PT_from_MQbrain_844, chimp
cttagatgactggagggataaagaaagagagaggggggctgcagaggggagagagggaagaataaggccctttctccacttaagtagctcaagccttcagcctagtatgcaatgag

SEQ ID NO: 8777 - DNA, 106 bp, Artificial
  Hairpin sequence PT_from_MQbrain_847, chimp
cttttttttatatagtttaatcttaaaaccaatacgatattgtcaaacaatacaatgtgtgacaatgttgtatcgtttttactgaatacttgatacttggagaaag

SEQ ID NO: 8778 - DNA, 114 bp, Artificial
  Hairpin sequence PT_from_MQbrain_848, chimp
cttatactcttcccaccaaagcttccacccttcagtctaggtagatcattgttctgtatccccttgatctatatccttggttgaggaatggaagttctgtggccagcagatagg

SEQ ID NO: 8779 - DNA, 113 bp, Artificial
  Hairpin sequence PT_from_MQbrain_849, chimp
catgggtggcccgccgttacctgtgcccattgtccttgcaggtgcctgtgaagcatgtataccgtgtgctgcagtgccaggaggaggagctcacgcagatggtgtccaccatg

SEQ ID NO: 8780 - DNA, 81 bp, Artificial
  Hairpin sequence PT_from_MQbrain_852, chimp
gtcacgtggccactgcccccacccccgccacagtttgttgctagaaggaagatggcgggtctggaggaggagctgtctgat

SEQ ID NO: 8781 - DNA, 107 bp, Artificial
  Hairpin sequence PT_from_MQbrain_859, chimp
ggaaccatttccctgagatcaggcctggctccttccatggcctgagctccctcaagaagctctgggtcatgaactcacaggtcagcctgattgagcggaatgctttt

SEQ ID NO: 8782 - DNA, 90 bp, Artificial
  Hairpin sequence PT_from_MQbrain_86, chimp
gaagtcacggcagggtcacagtgggcagggaggggtgcaggggtgtttggagagcatctctcccttccacttgtgggtggctgaggtgtc

SEQ ID NO: 8783 - DNA, 74 bp, Artificial
  Hairpin sequence PT_from_MQbrain_870, chimp
ctcaaagggtgaaatgagctggatggctacggtcggaggtgctctgtggctgcacggctcattcataaaacgag

SEQ ID NO: 8784 - DNA, 118 bp, Artificial
  Hairpin sequence PT_from_MQbrain_873, chimp
cgccccgccacgcgtgcgcctaggcgccgctgagcgctgactgggtgcgagtggggaagctgctaacccgacccggattggcgctgaggtggcccgtggggcaggtgagtgcggggcg

SEQ ID NO: 8785 - DNA, 98 bp, Artificial
  Hairpin sequence PT_from_MQbrain_874, chimp
tccttggttttgtataagcattaaatctcagcagaggtggatatttaaggtggtgagtagtagcagctctgcaggggaagagaaaggcaagatgggga

SEQ ID NO: 8786 - DNA, 91 bp, Artificial
  Hairpin sequence PT_from_MQbrain_876, chimp
agaggagaaaggtattatcagtccacgaaactgctttgtgagtctgacctagcaaagtaatttcctgggaatgtgccttactttttccttt

SEQ ID NO: 8787 - DNA, 119 bp, Artificial
  Hairpin sequence PT_from_MQbrain_878, chimp
gcagctgggtgggaggcagggccatgctgagaaggaagtcctgggtggaaggaggctctgatttaccctcttctatttcagtacactctcctgccctgccctgccctgccctgctccgc

SEQ ID NO: 8788 - DNA, 86 bp, Artificial
  Hairpin sequence PT_from_MQbrain_879, chimp
ctcaagatgatgtcagaggcaaagagaggccaacccactctaatcccacagcgggtctcctctctaatacctcaactcataaaggg

SEQ ID NO: 8789 - DNA, 112 bp, Artificial
  Hairpin sequence PT_from_MQbrain_88, chimp
ggtcaaaaagatagtgtctcttgtgagatcagcgtgcagcttccctggccttgaagcccaaggcacaggggtaatcacacctgaagctttaggtgcactctttccttgtgcc

SEQ ID NO: 8790 - DNA, 119 bp, Artificial
  Hairpin sequence PT_from_MQbrain_882, chimp
tcatcgacatggtggccgccatccccttcgacctgctcatcttcggctctggctctgaggaggtggggtcagcaaggaggcaggtggtgtagggagaggagaggccaggaatgtggtgg

SEQ ID NO: 8791 - DNA, 103 bp, Artificial
  Hairpin sequence PT_from_MQbrain_884, chimp
ttaataagaatggatatcggttcctctagctatgtatttcatgtcttctcttatcaggggatggcatgtattatcaggaggagcagtggtctgtgtctgttaa

SEQ ID NO: 8792 - DNA, 77 bp, Artificial
  Hairpin sequence PT_from_MQbrain_889, chimp
gttggaatggtgacaccatgctggagccaagtgctaacatgccttggttcaagggatggaaagtcactcgtaaagat

SEQ ID NO: 8793 - DNA, 69 bp, Artificial
  Hairpin sequence PT_from_MQbrain_89, chimp
tgcagtgcaagtcccgcagtctgacaccatcttggcaattcaggctgatgggacagtggcaggtctgca

SEQ ID NO: 8794 - DNA, 57 bp, Artificial
  Hairpin sequence PT_from_MQbrain_894, chimp
ggggtgagggggaggaacaggaagacttcagttccagttcctctgacgcatcacccc

SEQ ID NO: 8795 - DNA, 79 bp, Artificial
  Hairpin sequence PT_from_MQbrain_899, chimp
cctgtggaggcctgctgggaacaggacttctaaaaggaaatatgtctggaaggctgtggtccaaggccatttttgctgg

SEQ ID NO: 8796 - DNA, 94 bp, Artificial
  Hairpin sequence PT_from_MQbrain_9, chimp
gcaggagagcctgtgtttccagagtcagtgcccttgttagcctgcatgtgcaggctggctgatgtgtgaggcatttgtgttctccactggatgc

SEQ ID NO: 8797 - DNA, 75 bp, Artificial
  Hairpin sequence PT_from_MQbrain_90, chimp
caggtgagacttgccccagcagtctcactcctctttcaggggagtggtggattgggatgaggaggttctaatctg

SEQ ID NO: 8798 - DNA, 89 bp, Artificial
  Hairpin sequence PT_from_MQbrain_901, chimp
gccttcctgagcatgtaacggtgcaggtggtggtcgtgcgggtgagtataaccgagtggtcggcctgcccgtaactccgccagagaggc

SEQ ID NO: 8799 - DNA, 117 bp, Artificial
  Hairpin sequence PT_from_MQbrain_902, chimp
gatgaagagagaggtacacacctactaatccccagttctcctctcccaccctggctgcctaaggtaggagagaagaactgggaatcagtaggtgtgtacccagactccgagcccatc

SEQ ID NO: 8800 - DNA, 89 bp, Artificial
  Hairpin sequence PT_from_MQbrain_903, chimp
cagcccacccccacctttccgtataacgggcttgtttctcagagctgagagtggctgggttgtgctaggaggagtggggtggaaggctg

SEQ ID NO: 8801 - DNA, 112 bp, Artificial
  Hairpin sequence PT_from_MQbrain_904, chimp
ttgatgatgctgggaaaagtgactgcgattctgaagaaccgctgccttgcaaggtcaaggacattcagtggttgctggggtccgcagactactgccacccactcaccatcaa

SEQ ID NO: 8802 - DNA, 75 bp, Artificial
  Hairpin sequence PT_from_MQbrain_909, chimp
tttctgtcctgtttgccacttcatttcgtttccttgaggaaatgagctgaagtgtaaagcaaagaatagcagaag

SEQ ID NO: 8803 - DNA, 72 bp, Artificial
  Hairpin sequence PT_from_MQbrain_912, chimp
gaggtggcagagctgagggcagacccagtttgggagattccgaaacctgactgtctctgcaatgccatcctt

SEQ ID NO: 8804 - DNA, 114 bp, Artificial
  Hairpin sequence PT_from_MQbrain_913, chimp
gtctttgaaaaggccagcttctcacagatctaagggatgcaatttgctggcaaatctttagttgtccagtcttgactacatctgatcaaagttgggaagtgagctgttggagat

SEQ ID NO: 8805 - DNA, 100 bp, Artificial
  Hairpin sequence PT_from_MQbrain_919, chimp
gtcagggcctacctgagggcaagtgcatggagttgctccgcagacacctggagaacgggaaggagacgctgcagcgcgcgggtaccaggggccacggggc

SEQ ID NO: 8806 - DNA, 97 bp, Artificial
  Hairpin sequence PT_from_MQbrain_92, chimp
cgggaccgccagagcccccggactcctttggatgggcctggtactggcgctggcgctggcgctggctctgtctgactctcgggttctctgggctccg

SEQ ID NO: 8807 - DNA, 111 bp, Artificial
  Hairpin sequence PT_from_MQbrain_922, chimp
gcacctcgccgggcagctgccaagtctcctgatctgtcaaaccagaactcggaccaagccaatgaggaatgggagactgcatcagagagcagtgacttcgccagtgagcgc

SEQ ID NO: 8808 - DNA, 71 bp, Artificial
  Hairpin sequence PT_from_MQbrain_925, chimp
tctgggcaggggcttattgtaggagtctctgaagagagctgtggactgacctgctttaccccttccccagg

SEQ ID NO: 8809 - DNA, 97 bp, Artificial
  Hairpin sequence PT_from_MQbrain_927, chimp
tcaggctaaggggtcaggccagatggggcaggaaggctccgcaggaccggacccctagaccaccctgccccacctgccccttccctctttgctgtga

SEQ ID NO: 8810 - DNA, 79 bp, Artificial
  Hairpin sequence PT_from_MQbrain_928, chimp
aggaagatttttgcagcactctctggagctgaggggagtgaaatttggtccagagagggcggaaggaaatagttttcct

SEQ ID NO: 8811 - DNA, 72 bp, Artificial
  Hairpin sequence PT_from_MQbrain_93, chimp
gggtagaaccttttgggactggcctttgaagctctggccagggatggggtgggggccaaaaggacagagcct

SEQ ID NO: 8812 - DNA, 98 bp, Artificial
  Hairpin sequence PT_from_MQbrain_930, chimp
cctcgccctggtatgatgcccgcaccccatatggggggccctcccatgatgccaatgatgggccctcctcctcctgggatgatgccagtgggacctgg

SEQ ID NO: 8813 - DNA, 72 bp, Artificial
  Hairpin sequence PT_from_MQbrain_941, chimp
gttggggaagatgggaggttgtgggtgaggcctctaaaggtcctctcccaaactgaccaggctgatgtcaac

SEQ ID NO: 8814 - DNA, 110 bp, Artificial
  Hairpin sequence PT_from_MQbrain_943, chimp
gatgggctctggtgcttttctgtgggggtgtgggggaagaggagagagaacagaagttcctggatccttgtttctccctcccaggcttccacaaagtcatggagggcatc

SEQ ID NO: 8815 - DNA, 106 bp, Artificial
  Hairpin sequence PT_from_MQbrain_947, chimp
cctgcctgcctagaaccgcccctcctgtgccccctggccttggaaggggtatgaaatttccgtcccctttcctccttggggcccaggaggagtggagggtcccggg

SEQ ID NO: 8816 - DNA, 112 bp, Artificial
  Hairpin sequence PT_from_MQbrain_948, chimp
taggatttgaattcccagcctggccaacccttgcagccatgtcttggcctcaagtggaacaagggctccttgaggccagcagggttgggggagttggggtggggtgggcctg

SEQ ID NO: 8817 - DNA, 98 bp, Artificial
  Hairpin sequence PT_from_MQbrain_949, chimp
gccagcagggttgggggagttggggtggggtgggcctgagcctctttcctgctagagctcttggtcctccctgcctccaccacccatccctgctctgc

SEQ ID NO: 8818 - DNA, 90 bp, Artificial
  Hairpin sequence PT_from_MQbrain_950, chimp
cccctttcagtaagtcttgctgcagtccattgctggatgattttagggaccttgaatctcgggggattggagtgagaatgacatcagtgg

SEQ ID NO: 8819 - DNA, 82 bp, Artificial
  Hairpin sequence PT_from_MQbrain_954, chimp
gtgcttgggtgctgctatggcaagggaaacctgccctggggaagggttggtttctcttggctgtgtctcagttgcttggtat

SEQ ID NO: 8820 - DNA, 100 bp, Artificial
  Hairpin sequence PT_from_MQbrain_961, chimp
ggggcaacatttatcggtgctgagatgcaggtctccctgtagataacctaagtggtttctgtgacctagttccctctctaccatgtaaatctggccatcc

SEQ ID NO: 8821 - DNA, 114 bp, Artificial
  Hairpin sequence PT_from_MQbrain_965, chimp
gaggagatgggtgtatccaggaggccaatggaggaaggagaggaaggttttctgggaagccagctgacatgtcatgctttgtcagtggggcctctgcatggattccctccactc

SEQ ID NO: 8822 - DNA, 84 bp, Artificial
  Hairpin sequence PT_from_MQbrain_967, chimp
tttgtcttgatcctcactgagaagtcaccagggcagcggtcttctccatctctgctgttttggggtcttagggtacagcccaag

SEQ ID NO: 8823 - DNA, 85 bp, Artificial
  Hairpin sequence PT_from_MQbrain_968, chimp
ccattctctggtctctgcctttctcagatgcaaggcttaagaaagccttacaagtccggctgtaacagggccagggagcacgtgg

SEQ ID NO: 8824 - DNA, 97 bp, Artificial
  Hairpin sequence PT_from_MQbrain_97, chimp
tggctgccagaaccgagtccttgtcctgagccctgacacgctgcagctggaggtagcagggggtgggggaatggaattggtgccatgggatgagcta

SEQ ID NO: 8825 - DNA, 90 bp, Artificial
  Hairpin sequence PT_from_MQbrain_970, chimp
gtggtgtctgggaaactctgaggacagagagctaaatccatgaagtttgtggatggcctgatgatccacagcagagaccctgttaactac

SEQ ID NO: 8826 - DNA, 92 bp, Artificial
  Hairpin sequence PT_from_MQbrain_973, chimp
ggagacagagttgggccgacccactgagcgctggaaggacacctgggaccgggtgaaggctgcacagcgcctcgagggccggcccgacggcc

SEQ ID NO: 8827 - DNA, 98 bp, Artificial
  Hairpin sequence PT_from_MQbrain_974, chimp
cccaaactgggcatgctggcggggaaggggaaggcagggtggcccagggtcagcaggcccaccacacaggcctctccatcccctcggcgcctgctggg

SEQ ID NO: 8828 - DNA, 114 bp, Artificial
  Hairpin sequence PT_from_MQbrain_981, chimp
ctgagaatttggaattggaatggggtgtgcacggtgtgtgtcggaagggctggaagcgagtttgattttgacacgcggcctgtcaccgcctcagaacgagatcgatgagctgag

SEQ ID NO: 8829 - DNA, 72 bp, Artificial
  Hairpin sequence PT_from_MQbrain_991, chimp
tgggcacctgggctccttcttctgtttcagggctccaaggtcctggccaagaaagagctggcctatgtcccg

SEQ ID NO: 8830 - DNA, 116 bp, Artificial
  Hairpin sequence PT_from_MQbrain_992, chimp
ttctacagtgtgaccctgtgaactaggcttttctacagtgtgactcctgtgaacttaggcttttctacagtgtgacttctgtgaatctaggcttttctacagtgtgaccctgtgaa

SEQ ID NO: 8831 - DNA, 85 bp, Artificial
  Hairpin sequence PT_from_MQbrain_995, chimp
gttcctggaggagtgaagaccatcgaagccaatgggaagatggtgatccctggaggcatcgatgtccatactcacttccagatgc

SEQ ID NO: 8832 - DNA, 111 bp, Artificial
  Hairpin sequence PT_from_MQbrain_997, chimp
cttctgccaaattcaagcatctggatggctgggtttaacttgcatctctgtgtccttcagaacatatgccatagtgccttgtgcctcacggtgacttgtattttgcagaag

SEQ ID NO: 8833 - DNA, 20 bp, Artificial
  HS_10, HSbrain_1174; human brain 186351, human brain D4G3YLC02JBYXC sequence
ctggagatatggaagagctg

SEQ ID NO: 8834 - DNA, 18 bp, Artificial
  HS_100; human brain 88844 sequence
atcccaccgctgccaaaa

SEQ ID NO: 8835 - DNA, 19 bp, Artificial
  HS_101, HS_102; human brain 31268 sequence
atcctgtctgttctcccca

SEQ ID NO: 8836 - DNA, 23 bp, Artificial
  HS_103, HS_87; human brain 80314 sequence
aggtctgatggcccagatggcaa

SEQ ID NO: 8837 - DNA, 18 bp, Artificial
  HS_104; human brain 110 sequence
accccttcggctgctggg

SEQ ID NO: 8838 - DNA, 19 bp, Artificial
  HS_105; human brain 1294 sequence
ctgggcgggtggtaggtga

SEQ ID NO: 8839 - DNA, 18 bp, Artificial
  HS_106; human brain 60370 sequence
agctggtgtttgtgaatc

SEQ ID NO: 8840 - DNA, 18 bp, Artificial
  HS_107; human brain 168176 sequence
gccactgatctcggtcga

SEQ ID NO: 8841 - DNA, 19 bp, Artificial
  HS_108; human brain 11556 sequence
tgaggtagtaggtggtgtg

SEQ ID NO: 8842 - DNA, 20 bp, Artificial
  HS_109; human brain 152287 sequence
tctccagctgggaccctgca

SEQ ID NO: 8843 - DNA, 18 bp, Artificial
  HS_10; human brain 168655 sequence
ctggagatatggaagagc

SEQ ID NO: 8844 - DNA, 18 bp, Artificial
  HS_10; human brain 52768 sequence
actggagatatggaagag

SEQ ID NO: 8845 - DNA, 23 bp, Artificial
  HS_110; human brain 181244 sequence
ctctgtgctgtgcgtagtgccta

SEQ ID NO: 8846 - DNA, 18 bp, Artificial
  HS_111; human brain 163920 sequence
agggtggaggttggcggg

SEQ ID NO: 8847 - DNA, 21 bp, Artificial
  HS_112; human brain 102665 sequence
agtcctccggcccttcctccc

SEQ ID NO: 8848 - DNA, 21 bp, Artificial
  HS_113, PT_226; chimp brain 128379, human brain 163180 sequence
tagcccccaggcttcacttgg

SEQ ID NO: 8849 - DNA, 19 bp, Artificial
  HS_114, HS_118; human brain 119551 sequence
gtggcgaggaggcccttta

SEQ ID NO: 8850 - DNA, 18 bp, Artificial
  HS_115; human brain 189331 sequence
aatgtggaagtggtctga

SEQ ID NO: 8851 - DNA, 21 bp, Artificial
  HS_116; human brain 147974 sequence
tctgggctgcgggcctgggaa

SEQ ID NO: 8852 - DNA, 18 bp, Artificial
  HS_117; human brain 51579 sequence
ccgcaccaagaggccgcc

SEQ ID NO: 8853 - DNA, 19 bp, Artificial
  HS_119; human brain 76711 sequence
gggaggacaaaggactggc

SEQ ID NO: 8854 - DNA, 19 bp, Artificial
  HS_120; human brain 112628 sequence
aggctcccgcccgccctga

SEQ ID NO: 8855 - DNA, 18 bp, Artificial
  HS_121; human brain 22478 sequence
aaagggtgtcagaaaacg

SEQ ID NO: 8856 - DNA, 22 bp, Artificial
  HS_122, HSbrain_1262; human brain 3935, human brain D4G3XZT01BOQ3O sequence
tttccactgccactacctaatt

SEQ ID NO: 8857 - DNA, 19 bp, Artificial
  HS_123; human brain 70875 sequence
atgctgcgggaaggggctg

SEQ ID NO: 8858 - DNA, 18 bp, Artificial
  HS_124; human brain 61022 sequence
aaaagaacatgggttgag

SEQ ID NO: 8859 - DNA, 19 bp, Artificial
  HS_125; human brain 189170 sequence
tctgacctctgaccctcta

SEQ ID NO: 8860 - DNA, 19 bp, Artificial
  HS_126; human brain 101782 sequence
agccgggcggaggtgactg

SEQ ID NO: 8861 - DNA, 22 bp, Artificial
  HS_127; human brain 3336 sequence
ctgccatgtctaagaagaaaac

SEQ ID NO: 8862 - DNA, 23 bp, Artificial
  HS_128; human brain 22362 sequence
tcggaagaggagcggaaaggaaa

SEQ ID NO: 8863 - DNA, 20 bp, Artificial
  HS_129; human brain 164087 sequence
aggagtgtttgcggggaggg

SEQ ID NO: 8864 - DNA, 20 bp, Artificial
  HS_12; human brain 47693 sequence
tggccggggagggacgctgc

SEQ ID NO: 8865 - DNA, 18 bp, Artificial
  HS_130; human brain 123219 sequence
gttcttggaccaggacgc

SEQ ID NO: 8866 - DNA, 19 bp, Artificial
  HS_131; human brain 55217 sequence
tggcaaacgtggaagccga

SEQ ID NO: 8867 - DNA, 23 bp, Artificial
  HS_132; human brain 1964 sequence
ctgtgtggagccttccctctgtg

SEQ ID NO: 8868 - DNA, 19 bp, Artificial
  HS_133; human brain 5202 sequence
cttgtgttctttcgctcgg

SEQ ID NO: 8869 - DNA, 22 bp, Artificial
  HS_134, HSbrain_1269; human brain 182088, human brain D703HKJ01EDYVB sequence
catctgggccttgccatctctc

SEQ ID NO: 8870 - DNA, 18 bp, Artificial
  HS_135; human brain 116536 sequence
tgggtgggtggtgggctg

SEQ ID NO: 8871 - DNA, 18 bp, Artificial
  HS_136; human brain 177595 sequence
ctgggcctctgctcccca

SEQ ID NO: 8872 - DNA, 19 bp, Artificial
  HS_137; human brain 26313 sequence
actgaggacttcaggaatg

SEQ ID NO: 8873 - DNA, 20 bp, Artificial
  HS_138; human brain 153035 sequence
cccggaaagggacgaagagg

SEQ ID NO: 8874 - DNA, 18 bp, Artificial
  HS_139; human brain 5618 sequence
cggtgagaggcggaggag

SEQ ID NO: 8875 - DNA, 19 bp, Artificial
  HS_13; human brain 167012 sequence
agatgacctggtcaccgtg

SEQ ID NO: 8876 - DNA, 18 bp, Artificial
  HS_140; human brain 7417 sequence
cctgcctgtacatgtgaa

SEQ ID NO: 8877 - DNA, 19 bp, Artificial
  HS_141, MQbrain_2646, PT_264; chimp brain 154411, human brain 172698, macaque brain D708I2V01C6384 sequence
tctggctgctatggccccc

SEQ ID NO: 8878 - DNA, 20 bp, Artificial
  HS_142, HSbrain_1426; human brain 40, human brain D71F8O202G5DWX sequence
tctcccttcctgccctggct

SEQ ID NO: 8879 - DNA, 19 bp, Artificial
  HS_143; human brain 97723 sequence
tccgagggggagccattgc

SEQ ID NO: 8880 - DNA, 18 bp, Artificial
  HS_144; human brain 146485 sequence
atgagaccttctgggatt

SEQ ID NO: 8881 - DNA, 22 bp, Artificial
  HS_145; human brain 8135 sequence
ccaggtgtcttccattctgtcc

SEQ ID NO: 8882 - DNA, 19 bp, Artificial
  HS_146; human brain 14315 sequence
acttgagggtcgggggttc

SEQ ID NO: 8883 - DNA, 18 bp, Artificial
  HS_147; human brain 165305 sequence
cggtgctgggcggccggt

SEQ ID NO: 8884 - DNA, 19 bp, Artificial
  HS_148, HSbrain_1210, HSbrain_1247, MQbrain_2550, PT_231; chimp brain 92910, human brain 186331, human brain D4G3XZT01CY4FP, human brain D4G3XZT02F764P, human brain D4HE26K01A6ZQ9, human brain D703HKJ01E6SA1, human brain D703HKJ02GPCG3, macaque brain D4HK4YF01BYIP0
ttagggccctggctccatc

SEQ ID NO: 8885 - DNA, 19 bp, Artificial
  HS_149; human brain 79103 sequence
aggcccgcggtgtggagcg

SEQ ID NO: 8886 - DNA, 22 bp, Artificial
  HS_14; human brain 9288 sequence
ggccgaatctcccgcctccagg

SEQ ID NO: 8887 - DNA, 21 bp, Artificial
  HS_150; human brain 106139 sequence
tgacccacccctctccaccag

SEQ ID NO: 8888 - DNA, 18 bp, Artificial
  HS_151; human brain 11176 sequence
gtagtagcccgtaggggc

SEQ ID NO: 8889 - DNA, 19 bp, Artificial
  HS_151; human brain 4059 sequence
gtagtagcccgtaggggcc

SEQ ID NO: 8890 - DNA, 18 bp, Artificial
  HS_152; human brain 192084 sequence
aggccaagtgcgctgtgc

SEQ ID NO: 8891 - DNA, 19 bp, Artificial
  HS_153; human brain 161915 sequence
tggctgccttgtgttgatc

SEQ ID NO: 8892 - DNA, 20 bp, Artificial
  HS_154; human brain 122671 sequence
gggaaaaggaagggggagga

SEQ ID NO: 8893 - DNA, 22 bp, Artificial
  HS_155; human brain 154192 sequence
aggggtggccgggctcgggaac

SEQ ID NO: 8894 - DNA, 19 bp, Artificial
  HS_156; human brain 143131 sequence
tgcagctgccatgggaaga

SEQ ID NO: 8895 - DNA, 20 bp, Artificial
  HS_157; human brain 89929 sequence
tgcctgccctcttcctccag

SEQ ID NO: 8896 - DNA, 19 bp, Artificial
  HS_158, HSbrain_1434; human brain 151128, human brain D4G3XZT02HKQKS, human brain D4G3YLC01DPL37, human brain D4G3YLC02JG0YH sequence
ctccgtttgcctgtttcgc

SEQ ID NO: 8897 - DNA, 18 bp, Artificial
  HS_158; human brain 42163 sequence
ctccgtttgcctgtttcg

SEQ ID NO: 8898 - DNA, 20 bp, Artificial
  HS_159; human brain 83261 sequence
ggctgggagggagaagaaat

SEQ ID NO: 8899 - DNA, 18 bp, Artificial
  HS_15; human brain 8818 sequence
cgggaagcggatcgcgtg

SEQ ID NO: 8900 - DNA, 18 bp, Artificial
  HS_160; human brain 79430 sequence
ctgtcctaaggttgttga

SEQ ID NO: 8901 - DNA, 19 bp, Artificial
  HS_161; human brain 103231 sequence
tgaaggtagtaggattgta

SEQ ID NO: 8902 - DNA, 18 bp, Artificial
  HS_161; human brain 168174 sequence
tgaaggtagtaggattgt

SEQ ID NO: 8903 - DNA, 18 bp, Artificial
  HS_161; human brain 3537 sequence
atgaaggtagtaggattg

SEQ ID NO: 8904 - DNA, 19 bp, Artificial
  HS_161; human brain 47383 sequence
atgaaggtagtaggattgt

SEQ ID NO: 8905 - DNA, 18 bp, Artificial
  HS_162; human brain 186722 sequence
acaagtcaggcatcaaat

SEQ ID NO: 8906 - DNA, 21 bp, Artificial
  HS_163; human brain 166572 sequence
tccagccgccgcctgtctcca

SEQ ID NO: 8907 - DNA, 19 bp, Artificial
  HS_163; human brain 177927 sequence
cagccgccgcctgtctcca

SEQ ID NO: 8908 - DNA, 18 bp, Artificial
  HS_164; human brain 107198 sequence
ttcccagggactgtcgga

SEQ ID NO: 8909 - DNA, 20 bp, Artificial
  HS_165; human brain 119955 sequence
caccgccgccacccccagga

SEQ ID NO: 8910 - DNA, 23 bp, Artificial
  HS_166; human brain 6924 sequence
ccagatccccgcgcggccccaga

SEQ ID NO: 8911 - DNA, 18 bp, Artificial
  HS_167; human brain 2184 sequence
ggaagctgggctgagagg

SEQ ID NO: 8912 - DNA, 19 bp, Artificial
  HS_168; human brain 22899 sequence
gagaaggtggatgggggaa

SEQ ID NO: 8913 - DNA, 18 bp, Artificial
  HS_168; human brain 61459 sequence
agaaggtggatgggggaa

SEQ ID NO: 8914 - DNA, 18 bp, Artificial
  HS_169; human brain 171169 sequence
ctggccctctctcctcca

SEQ ID NO: 8915 - DNA, 19 bp, Artificial
  HS_16; human brain 109674 sequence
gaaatcgcttccctttgga

SEQ ID NO: 8916 - DNA, 18 bp, Artificial
  HS_170; human brain 130739 sequence
tgggggaggaggaaggac

SEQ ID NO: 8917 - DNA, 20 bp, Artificial
  HS_171; human brain 52114 sequence
tcaggcccctgtctgcccca

SEQ ID NO: 8918 - DNA, 20 bp, Artificial
  HS_172, HSbrain_1417, MQbrain_2650, PT_281; chimp brain 45987, human brain 44221, human brain D4G3XZT01ET300, human brain D4G3XZT02I058G, human brain D4HE26K02GZT8B, human brain D703HKJ02F9XPC, human brain D71F8O202JMUIK, macaque brain D4HK8WR01CEH7U
ttcattcggctgtccagatg

SEQ ID NO: 8919 - DNA, 20 bp, Artificial
  HS_173; human brain 175564 sequence
gagggttgggtggaggcaaa

SEQ ID NO: 8920 - DNA, 18 bp, Artificial
  HS_173; human brain 69074 sequence
agggttgggtggaggcaa

SEQ ID NO: 8921 - DNA, 18 bp, Artificial
  HS_173; human brain 90508 sequence
gagggttgggtggaggca

SEQ ID NO: 8922 - DNA, 21 bp, Artificial
  HS_174; human brain 8560 sequence
gggcagggcagcttcacctgg

SEQ ID NO: 8923 - DNA, 20 bp, Artificial
  HS_175; human brain 123550 sequence
cttctctggcctgtctcctg

SEQ ID NO: 8924 - DNA, 24 bp, Artificial
  HS_176; human brain 136685 sequence
ccgtggggagggatggcgggagga

SEQ ID NO: 8925 - DNA, 23 bp, Artificial
  HS_177; human brain 151160 sequence
ggcttagccaaagtacaggtgta

SEQ ID NO: 8926 - DNA, 18 bp, Artificial
  HS_178; human brain 30106 sequence
tgtctactactggagaca

SEQ ID NO: 8927 - DNA, 19 bp, Artificial
  HS_179; human brain 14689 sequence
tgaggtagtagtttgaatg

SEQ ID NO: 8928 - DNA, 18 bp, Artificial
  HS_179; human brain 34037 sequence
tgaggtagtagtttgaat

SEQ ID NO: 8929 - DNA, 18 bp, Artificial
  HS_17; human brain 92590 sequence
ctcgggcggcgggaggag

SEQ ID NO: 8930 - DNA, 19 bp, Artificial
  HS_180; human brain 140208 sequence
tgcaacgaacctgagccac

SEQ ID NO: 8931 - DNA, 21 bp, Artificial
  HS_181; human brain 8247 sequence
cctgtctgctgctgagtgatt

SEQ ID NO: 8932 - DNA, 20 bp, Artificial
  HS_182; human brain 1527 sequence
tccccttcctccctgcccag

SEQ ID NO: 8933 - DNA, 21 bp, Artificial
  HS_183; human brain 9030 sequence
cccggaggaaccgccaacagc

SEQ ID NO: 8934 - DNA, 19 bp, Artificial
  HS_184; human brain 18792 sequence
tgtcagtgactcctgcccc

SEQ ID NO: 8935 - DNA, 21 bp, Artificial
  HS_185; human brain 4143 sequence
tctgctcgcccaccacccaat

SEQ ID NO: 8936 - DNA, 19 bp, Artificial
  HS_186; human brain 144006 sequence
gagaagctggcgttcggag

SEQ ID NO: 8937 - DNA, 19 bp, Artificial
  HS_187; human brain 148553 sequence
tgggcaacagtctggggcc

SEQ ID NO: 8938 - DNA, 20 bp, Artificial
  HS_188; human brain 72268 sequence
gcggaaggcggagcggcgga

SEQ ID NO: 8939 - DNA, 22 bp, Artificial
  HS_189; human brain 9813 sequence
aatgttgggtgaacggctgttt

SEQ ID NO: 8940 - DNA, 18 bp, Artificial
  HS_18; human brain 162488 sequence
ccctgactcctggggcgc

SEQ ID NO: 8941 - DNA, 18 bp, Artificial
  HS_190; human brain 42262 sequence
ggtgacgggtggccgtgc

SEQ ID NO: 8942 - DNA, 19 bp, Artificial
  HS_191, HSbrain_1422, MQbrain_2671, PT_6; chimp brain 116120, human brain 52392, human brain D4G3XZT01C92V2, human brain D4G3XZT01CVLN0, human brain D4G3XZT02FTS85, human brain D4G3XZT02J40M9, macaque brain D4G3X1F02JMJHM sequence
actctagctgccaaaggcg

SEQ ID NO: 8943 - DNA, 25 bp, Artificial
  HS_192, PT_7; chimp brain 57945, human brain 6151 sequence
ggactcgactcgtgtgcggacattt

SEQ ID NO: 8944 - DNA, 20 bp, Artificial
  HS_193; human brain 24617 sequence
cggccgtggcggcctgagcg

SEQ ID NO: 8945 - DNA, 19 bp, Artificial
  HS_194; human brain 104757 sequence
ctcgccctgtctcccgcta

SEQ ID NO: 8946 - DNA, 20 bp, Artificial
  HS_194; human brain 167267 sequence
ctcgccctgtctcccgctag

SEQ ID NO: 8947 - DNA, 18 bp, Artificial
  HS_194; human brain 27894 sequence
gctcgccctgtctcccgc

SEQ ID NO: 8948 - DNA, 21 bp, Artificial
  HS_194; human brain 46836 sequence
tgctcgccctgtctcccgcta

SEQ ID NO: 8949 - DNA, 20 bp, Artificial
  HS_194; human brain 83681 sequence
gctcgccctgtctcccgcta

SEQ ID NO: 8950 - DNA, 20 bp, Artificial
  HS_195; human brain 120611 sequence
gggaagagagagaatggaac

SEQ ID NO: 8951 - DNA, 20 bp, Artificial
  HS_196; human brain 11766 sequence
aagaggaggaggaggaggat

SEQ ID NO: 8952 - DNA, 22 bp, Artificial
  HS_197; human brain 152127 sequence
cccgctctcccgaagctgttcg

SEQ ID NO: 8953 - DNA, 21 bp, Artificial
  HS_198; human brain 91351 sequence
acactgtccccttctccccag

SEQ ID NO: 8954 - DNA, 18 bp, Artificial
  HS_199; human brain 190662 sequence
gtgggtgggtgcggtggg

SEQ ID NO: 8955 - DNA, 21 bp, Artificial
  HS_19; human brain 128562 sequence
gggcgcggcccagccaggaga

SEQ ID NO: 8956 - DNA, 20 bp, Artificial
  HS_1; human brain 114411 sequence
gggatgctggggagccatgg

SEQ ID NO: 8957 - DNA, 19 bp, Artificial
  HS_200; human brain 94074 sequence
cctggggagtggctgggga

SEQ ID NO: 8958 - DNA, 21 bp, Artificial
  HS_201; human brain 185470 sequence
tttccctttccatcctggcag

SEQ ID NO: 8959 - DNA, 18 bp, Artificial
  HS_202; human brain 376 sequence
gctacatctgtctgctga

SEQ ID NO: 8960 - DNA, 18 bp, Artificial
  HS_203; human brain 80357 sequence
gctgggggtgaaagttca

SEQ ID NO: 8961 - DNA, 19 bp, Artificial
  HS_204; human brain 10527 sequence
gacttgctgccttgccact

SEQ ID NO: 8962 - DNA, 21 bp, Artificial
  HS_205; human brain 1867 sequence
ggccaccctggcagctgggcc

SEQ ID NO: 8963 - DNA, 18 bp, Artificial
  HS_206; human brain 70994 sequence
gaagctggcggagcagga

SEQ ID NO: 8964 - DNA, 18 bp, Artificial
  HS_208; human brain 139244 sequence
acctgctgagctcctggg

SEQ ID NO: 8965 - DNA, 20 bp, Artificial
  HS_20; human brain 171291 sequence
tgaggccgagaaggcaaccg

SEQ ID NO: 8966 - DNA, 22 bp, Artificial
  HS_210, PT_30; chimp brain 40182, human brain 179033 sequence
accaggaggctgaggcccctca

SEQ ID NO: 8967 - DNA, 19 bp, Artificial
  HS_210; human brain 137170 sequence
accaggaggctgaggcccc

SEQ ID NO: 8968 - DNA, 23 bp, Artificial
  HS_211; human brain 160383 sequence
attggaatccccgctagagcgtg

SEQ ID NO: 8969 - DNA, 19 bp, Artificial
  HS_212, HS_213, HSbrain_1336, HSbrain_1337, PT_329, PT_330; chimp brain 99561, human brain 51842, human brain D4G3XZT01CP4D2, human brain D4G3XZT02I3WAX sequence
agaggataccctttgtatg

SEQ ID NO: 8970 - DNA, 22 bp, Artificial
  HS_214, HSbrain_1338, MQbrain_2642, PT_32; chimp brain 158418, human brain 8282, human brain D4G3XZT01BTB7B, human brain D4G3XZT02GRJJL, human brain D4G3YLC01BXZ9N, human brain D703HKJ01D39OV, human brain D71F8O202GSL9B, human brain D71F8O202I2EA7
ttaatatcggacaaccattgtt

SEQ ID NO: 8971 - DNA, 21 bp, Artificial
  HS_214, HSbrain_1338, MQbrain_2642, PT_32; chimp brain 82601, human brain 5608, human brain D4G3XZT01DFH1J, human brain D4G3XZT02JADQD, human brain D4G3YLC01EYH9T, human brain D703HKJ01CRU44, human brain D703HKJ01DBMYQ, human brain D703HKJ01EAVHW, human brain D703HKJ02FVXG4
ttaatatcggacaaccattgt

SEQ ID NO: 8972 - DNA, 20 bp, Artificial
  HS_215; human brain 130337 sequence
tgtcactcggctcggcccac

SEQ ID NO: 8973 - DNA, 20 bp, Artificial
  HS_215; human brain 14086 sequence
atgtcactcggctcggccca

SEQ ID NO: 8974 - DNA, 19 bp, Artificial
  HS_215; human brain 28039 sequence
tgtcactcggctcggccca

SEQ ID NO: 8975 - DNA, 21 bp, Artificial
  HS_216; human brain 117626 sequence
gtggtgggcacagaatctgga

SEQ ID NO: 8976 - DNA, 19 bp, Artificial
  HS_217; human brain 104050 sequence
gctaccatcagggaagaga

SEQ ID NO: 8977 - DNA, 20 bp, Artificial
  HS_218; human brain 141024 sequence
gactcgccctatgggtggga

SEQ ID NO: 8978 - DNA, 24 bp, Artificial
  HS_219; human brain 111125 sequence
ccgatgcgggccacaggcctcccc

SEQ ID NO: 8979 - DNA, 18 bp, Artificial
  HS_21; human brain 36915 sequence
ctggccggagcccttggg

SEQ ID NO: 8980 - DNA, 20 bp, Artificial
  HS_220, HS_223, HS_225, HS_229, HS_235, HS_237; human brain 146387 sequence
ccatggtccaggacctggtg

SEQ ID NO: 8981 - DNA, 19 bp, Artificial
  HS_221, HS_222, HS_224, HS_226, HS_227, HS_230, HS_233, HS_234, HS_236, HS_238; human brain 61396 sequence
cgcggggtggctggggcta

SEQ ID NO: 8982 - DNA, 18 bp, Artificial
  HS_228; human brain 6672 sequence
tctctgtgatcctagctt

SEQ ID NO: 8983 - DNA, 18 bp, Artificial
  HS_22; human brain 885 sequence
ccaaggaaggcagcaggc

SEQ ID NO: 8984 - DNA, 18 bp, Artificial
  HS_231; human brain 9137 sequence
gcggctgtgccttagaga

SEQ ID NO: 8985 - DNA, 18 bp, Artificial
  HS_232; human brain 29903 sequence
actggagccaggctgaag

SEQ ID NO: 8986 - DNA, 18 bp, Artificial
  HS_239; human brain 181208 sequence
cgggcagggctcctgtca

SEQ ID NO: 8987 - DNA, 19 bp, Artificial
  HS_23; human brain 139028 sequence
gtgcaggcatgcagtttaa

SEQ ID NO: 8988 - DNA, 22 bp, Artificial
  HS_240; human brain 88604 sequence
actggcctgggactaccggggg

SEQ ID NO: 8989 - DNA, 19 bp, Artificial
  HS_242, HS_245; human brain 72491 sequence
tgagaaggcacagcttgca

SEQ ID NO: 8990 - DNA, 22 bp, Artificial
  HS_244, HS_246, HS_247, HS_248, HS_249, HS_277; human brain 30927 sequence
tgtgcatttctctcccttctaa

SEQ ID NO: 8991 - DNA, 21 bp, Artificial
  HS_24; human brain 115941 sequence
ctgtccccatgtcatgaagga

SEQ ID NO: 8992 - DNA, 20 bp, Artificial
  HS_250; human brain 173623 sequence
ccaggtccctggagccgccg

SEQ ID NO: 8993 - DNA, 21 bp, Artificial
  HS_251; human brain 70 sequence
ctgtgatgttttgccaggaaa

SEQ ID NO: 8994 - DNA, 23 bp, Artificial
  HS_252; human brain 2561 sequence
ttctgggagtcactgaagccttt

SEQ ID NO: 8995 - DNA, 20 bp, Artificial
  HS_253; human brain 97638 sequence
agcggtccgggtcgaaccag

SEQ ID NO: 8996 - DNA, 19 bp, Artificial
  HS_254; human brain 28972 sequence
agagccgcgagagccgccg

SEQ ID NO: 8997 - DNA, 18 bp, Artificial
  HS_255; human brain 180908 sequence
ctgagctcgcggccagcg

SEQ ID NO: 8998 - DNA, 21 bp, Artificial
  HS_256; human brain 29314 sequence
tgaggtgaccgcagatgggaa

SEQ ID NO: 8999 - DNA, 18 bp, Artificial
  HS_257; human brain 25638 sequence
cggggcgagacgccggag

SEQ ID NO: 9000 - DNA, 20 bp, Artificial
  HS_258; human brain 121748 sequence
gggatggctccagtggagga

SEQ ID NO: 9001 - DNA, 20 bp, Artificial
  HS_259, MQbrain_2602, PT_311; chimp brain 1990, human brain 130593, macaque brain D4HK8WR02FPLHV sequence
cggctctgggtctgtgggga

SEQ ID NO: 9002 - DNA, 22 bp, Artificial
  HS_259; human brain 44615 sequence
tcggctctgggtctgtggggag

SEQ ID NO: 9003 - DNA, 19 bp, Artificial
  HS_25; human brain 120063 sequence
agtggaggaggaggcgcgg

SEQ ID NO: 9004 - DNA, 20 bp, Artificial
  HS_260; human brain 153521 sequence
aggttcccgagccaacgcca

SEQ ID NO: 9005 - DNA, 23 bp, Artificial
  HS_262, HSbrain_1406; human brain 2974, human brain D4G3XZT01D5ZGO, human brain D4G3XZT01DNZXQ sequence
caggcagtgactgttcagacgtc

SEQ ID NO: 9006 - DNA, 18 bp, Artificial
  HS_263; human brain 4428 sequence
tcctcctcctcccccgtc

SEQ ID NO: 9007 - DNA, 20 bp, Artificial
  HS_264; human brain 438 sequence
tgagccagtgtccaggttct

SEQ ID NO: 9008 - DNA, 23 bp, Artificial
  HS_265; human brain 9733 sequence
gcgactgcctccctgctgtgagc

SEQ ID NO: 9009 - DNA, 21 bp, Artificial
  HS_266; human brain 1735 sequence
ccacttggatctgaaggctgc

SEQ ID NO: 9010 - DNA, 18 bp, Artificial
  HS_267; human brain 135965 sequence
gcggctgaaggcgatccg

SEQ ID NO: 9011 - DNA, 20 bp, Artificial
  HS_268; human brain 129731 sequence
gactaaactgtaggctcttc

SEQ ID NO: 9012 - DNA, 22 bp, Artificial
  HS_269, HS_270, HS_271, HS_272, HS_293, HS_294, HS_295, HS_296, HS_297; human brain 126613 sequence
tggccatggggctgtacccgat

SEQ ID NO: 9013 - DNA, 20 bp, Artificial
  HS_273; human brain 120090 sequence
tgacgccccttctgattctg

SEQ ID NO: 9014 - DNA, 20 bp, Artificial
  HS_274; human brain 50636 sequence
cctcctccccgcgcccccga

SEQ ID NO: 9015 - DNA, 18 bp, Artificial
  HS_275; human brain 115004 sequence
ttgatgagccttggggat

SEQ ID NO: 9016 - DNA, 18 bp, Artificial
  HS_276; human brain 8327 sequence
gcccctgctgcctccttg

SEQ ID NO: 9017 - DNA, 20 bp, Artificial
  HS_278; human brain 113266 sequence
tgcgcgtcccagatgcccaa

SEQ ID NO: 9018 - DNA, 21 bp, Artificial
  HS_279, HSbrain_1066; human brain 13728, human brain 3623, human brain D703HKJ01CLWIH, human brain D71F8O201AM7S9 sequence
ctccagccccacagcctcagc

SEQ ID NO: 9019 - DNA, 20 bp, Artificial
  HS_279, PT_322; chimp brain 46550, human brain 45797 sequence
actccagccccacagcctca

SEQ ID NO: 9020 - DNA, 18 bp, Artificial
  HS_279; human brain 162101 sequence
aggaggaattggtgctgg

SEQ ID NO: 9021 - DNA, 20 bp, Artificial
  HS_279; human brain 915 sequence
ctccagccccacagcctcag

SEQ ID NO: 9022 - DNA, 19 bp, Artificial
  HS_27; human brain 163360 sequence
atcctgaggatcccatttg

SEQ ID NO: 9023 - DNA, 18 bp, Artificial
  HS_280; human brain 107085 sequence
ttcagccaggctagtgca

SEQ ID NO: 9024 - DNA, 20 bp, Artificial
  HS_280; human brain 16530 sequence
actgccctagtctagctgaa

SEQ ID NO: 9025 - DNA, 23 bp, Artificial
  HS_281, HSbrain_1076, MQbrain_2651; human brain 12343, human brain D71F8O201A9G90, macaque brain D708I2V02FHTY4, macaque brain D708YRU02I62NY, macaque brain D708ZXV01DP7B6 sequence
tgcaccatggttgtctgagcatg

SEQ ID NO: 9026 - DNA, 21 bp, Artificial
  HS_281; human brain 160200 sequence
tgcaccatggttgtctgagca

SEQ ID NO: 9027 - DNA, 19 bp, Artificial
  HS_281; human brain 43233 sequence
tgcaccatggttgtctgag

SEQ ID NO: 9028 - DNA, 22 bp, Artificial
  HS_281; human brain 6209 sequence
tgcaccatggttgtctgagcat

SEQ ID NO: 9029 - DNA, 18 bp, Artificial
  HS_281; human brain 84000 sequence
tgcaccatggttgtctga

SEQ ID NO: 9030 - DNA, 23 bp, Artificial
  HS_281; human brain 84254 sequence
tgctcataccccatggtttctga

SEQ ID NO: 9031 - DNA, 19 bp, Artificial
  HS_282; human brain 182898 sequence
tgcaggtgccccggagtag

SEQ ID NO: 9032 - DNA, 22 bp, Artificial
  HS_283, HSbrain_1421; human brain 163510, human brain D703HKJ01CN3QF sequence
cctctagggaagagaaggttgg

SEQ ID NO: 9033 - DNA, 21 bp, Artificial
  HS_283; human brain 18433 sequence
ctctagggaagagaaggttgg

SEQ ID NO: 9034 - DNA, 18 bp, Artificial
  HS_284; human brain 134147 sequence
gagttggaggccggaggg

SEQ ID NO: 9035 - DNA, 20 bp, Artificial
  HS_284; human brain 9264 sequence
ctcggggcggcggctggagg

SEQ ID NO: 9036 - DNA, 22 bp, Artificial
  HS_285, HSbrain_932, MQbrain_2075; human brain 122357, human brain D4G3XZT01AQBPD, human brain D4HE26K01EN601, human brain D4HE26K02IC1SY, macaque brain D4HK8WR01DV948, macaque brain D708I2V01BS7MB, macaque brain D708YRU02I6LWP sequence
tgggcctgatgtggtgctgggg

SEQ ID NO: 9037 - DNA, 23 bp, Artificial
  HS_285, PT_326; chimp brain 201364, human brain 1658 sequence
tccagtaccacgtgtcagggcca

SEQ ID NO: 9038 - DNA, 22 bp, Artificial
  HS_286, HSbrain_941, PT_327; chimp brain 110028, human brain 15950, human brain D4G3XZT01A1M22, human brain D4G3XZT02F722P, human brain D4G3XZT02IP10O, human brain D4G3XZT02IWI6C, human brain D4G3YLC02H0BQ3, human brain D4HE26K01A52LJ, human brain D703HKJ01BE3CK
tttgtgacctggtccactaacc

SEQ ID NO: 9039 - DNA, 20 bp, Artificial
  HS_286, PT_327; chimp brain 56269, human brain 160057 sequence
tttgtgacctggtccactaa

SEQ ID NO: 9040 - DNA, 18 bp, Artificial
  HS_286; human brain 33463 sequence
atggttgaccagagagca

SEQ ID NO: 9041 - DNA, 22 bp, Artificial
  HS_287, HS_288, HS_289, HS_290, HSbrain_1360, HSbrain_1362, HSbrain_1363, HSbrain_1364; human brain 142637, human brain D703HKJ01B50EJ sequence
tggggcggagcttccggaggcc

SEQ ID NO: 9042 - DNA, 20 bp, Artificial
  HS_287, HS_288, HS_289, HS_290, HSbrain_1360, HSbrain_1362, HSbrain_1363, HSbrain_1364; human brain 2414, human brain D4G3XZT02GWZWY sequence
tggggcggagcttccggagg

SEQ ID NO: 9043 - DNA, 18 bp, Artificial
  HS_287, HS_288, HS_289, HS_290; human brain 180248 sequence
tggggcggagcttccgga

SEQ ID NO: 9044 - DNA, 18 bp, Artificial
  HS_28; human brain 161116 sequence
agcggcggcggcggaagg

SEQ ID NO: 9045 - DNA, 18 bp, Artificial
  HS_29, PT_144; chimp brain 37558, human brain 26565 sequence
gtgcttggctgaggagaa

SEQ ID NO: 9046 - DNA, 18 bp, Artificial
  HS_29, PT_144; chimp brain 60379, human brain 141196 sequence
tgtgcttggctgaggaga

SEQ ID NO: 9047 - DNA, 26 bp, Artificial
  HS_291, HSbrain_1437, MQbrain_2700; human brain 3968, human brain D4G3YLC01AZI75, human brain D4HE26K01CYAKM, macaque brain D708I2V01C8J4T, macaque brain D708ZXV02H0STZ sequence
tcacaatgctgacactcaaactgctg

SEQ ID NO: 9048 - DNA, 20 bp, Artificial
  HS_291, HSbrain_1437, MQbrain_2700; human brain 4846, human brain D4G3YLC02H9Q45, human brain D703HKJ01CGKQN, human brain D71F8O201DFNWE, human brain D71F8O201DFQS0, human brain D71F8O202FWN9P, macaque brain D4G3X1F01BXVTY, macaque brain D4HK8WR01EMXGL
gttggaggatgaaagtacgg

SEQ ID NO: 9049 - DNA, 26 bp, Artificial
  HS_291; human brain 1311 sequence
gttggaggatgaaagtacggagtgat

SEQ ID NO: 9050 - DNA, 22 bp, Artificial
  HS_291; human brain 14020 sequence
gttggaggatgaaagtacggag

SEQ ID NO: 9051 - DNA, 28 bp, Artificial
  HS_291; human brain 3418 sequence
tcacaatgctgacactcaaactgctgac

SEQ ID NO: 9052 - DNA, 18 bp, Artificial
  HS_291; human brain 3470 sequence
gttggaggatgaaagtac

SEQ ID NO: 9053 - DNA, 24 bp, Artificial
  HS_292, HSbrain_970, MQbrain_2154; human brain 14523, human brain 9447, human brain D4G3XZT02F7A3E, human brain D4G3YLC02JQNCP, human brain D703HKJ01B439D, human brain D71F8O202GSOD6, human brain D71F8O202JB6RV, macaque brain D4G3X1F01E3QJM, macaque brain D4G3X1F02JXG0P
tagtgcaatattgcttatagggtt

SEQ ID NO: 9054 - DNA, 20 bp, Artificial
  HS_292; human brain 5201 sequence
gtgcaatattgcttataggg

SEQ ID NO: 9055 - DNA, 18 bp, Artificial
  HS_298, HSbrain_1423, MQbrain_2614; human brain 10673, human brain 161524, human brain 2760, human brain D4G3XZT01CSTC4, human brain D4G3XZT01DQKMX, human brain D4G3XZT01E11MX, human brain D4G3XZT02F0KIB, human brain D4G3XZT02F0VPS, human brain D4G3YLC01BG5OK
tgagacctctgggttctg

SEQ ID NO: 9056 - DNA, 20 bp, Artificial
  HS_298, HSbrain_1423, MQbrain_2614; human brain 172896, human brain D4G3XZT01BQ6D0, human brain D4G3XZT02HWNLY, human brain D4HE26K02GNB5V, human brain D703HKJ02FVZ38, human brain D703HKJ02GT3EP, human brain D71F8O201E3NOK, human brain D71F8O201ENYXX
tgggatctccggggtcttgg

SEQ ID NO: 9057 - DNA, 21 bp, Artificial
  HS_298, HSbrain_1423, MQbrain_2614; human brain 30638, human brain D4G3XZT01DUAKD, human brain D4G3XZT02FRW5D, human brain D4G3XZT02FSS4T, human brain D4G3YLC02I22RM, human brain D703HKJ02HVWAJ, human brain D703HKJ02IP0XH, human brain D71F8O202GG8L0
ctgggatctccggggtcttgg

SEQ ID NO: 9058 - DNA, 20 bp, Artificial
  HS_298; human brain 1612, human brain 61107 sequence
tgagacctctgggttctgag

SEQ ID NO: 9059 - DNA, 19 bp, Artificial
  HS_298; human brain 24871 sequence
tgagacctctgggttctga

SEQ ID NO: 9060 - DNA, 20 bp, Artificial
  HS_298; human brain 29836 sequence
ctgagacctctgggttctga

SEQ ID NO: 9061 - DNA, 18 bp, Artificial
  HS_299, HS_300, HS_46; human brain 29457 sequence
tgctggcttgcaccgtga

SEQ ID NO: 9062 - DNA, 18 bp, Artificial
  HS_2; human brain 141678 sequence
ctgggaggcggtcggttc

SEQ ID NO: 9063 - DNA, 20 bp, Artificial
  HS_301, HS_302, HSbrain_1404, HSbrain_1405; human brain 128414, human brain D703HKJ02GB0NJ sequence
cacccggctgtgtgcacatg

SEQ ID NO: 9064 - DNA, 22 bp, Artificial
  HS_301, HS_302, HSbrain_1404, HSbrain_1405; human brain 24234, human brain D4G3XZT02GTVKO, human brain D4G3YLC02G13QO sequence
cacccggctgtgtgcacatgtg

SEQ ID NO: 9065 - DNA, 23 bp, Artificial
  HS_301, HS_302, HSbrain_1404, HSbrain_1405; human brain 3785, human brain D4G3XZT01DME7F, human brain D71F8O202I5K9E sequence
cacccggctgtgtgcacatgtgc

SEQ ID NO: 9066 - DNA, 21 bp, Artificial
  HS_303, HSbrain_1408, MQbrain_2657, PT_124; chimp brain 184743, human brain 3549, human brain D4G3XZT01BNTYX, human brain D4G3XZT02GH2YX, human brain D4G3XZT02JCECM, human brain D703HKJ01D6FDP, human brain D703HKJ01EOXTY, human brain D703HKJ02IS7SI, human brain D71F8O201BHHEB
ccacctcccctgcaaacgtcc

SEQ ID NO: 9067 - DNA, 21 bp, Artificial
  HS_303, HSbrain_1408, MQbrain_2657; human brain 13976, human brain D4G3XZT01BV4ZZ, human brain D4G3XZT01DXCB6, human brain D4G3XZT02J6G2H, human brain D71F8O202JWSZ6, macaque brain D4HK8WR01CRGXJ, macaque brain D708YRU02HF7WD sequence
acgttggctctggtggtgatg

SEQ ID NO: 9068 - DNA, 22 bp, Artificial
  HS_303, PT_124; chimp brain 94778, human brain 71330 sequence
ccacctcccctgcaaacgtcca

SEQ ID NO: 9069 - DNA, 19 bp, Artificial
  HS_303; human brain 137187 sequence
acgttggctctggtggtga

SEQ ID NO: 9070 - DNA, 18 bp, Artificial
  HS_303; human brain 85826 sequence
ccacctcccctgcaaacg

SEQ ID NO: 9071 - DNA, 21 bp, Artificial
  HS_304; human brain 108910 sequence
ggaggaaccttggagcttcgg

SEQ ID NO: 9072 - DNA, 19 bp, Artificial
  HS_304; human brain 117764 sequence
gaagctctaaggttccgcc

SEQ ID NO: 9073 - DNA, 19 bp, Artificial
  HS_304; human brain 30636 sequence
aggaaccttggagcttcgg

SEQ ID NO: 9074 - DNA, 21 bp, Artificial
  HS_305, HSbrain_1425; human brain 62489, human brain D71F8O202GAD7Y sequence
cctctcctaacctcgctctcg

SEQ ID NO: 9075 - DNA, 19 bp, Artificial
  HS_305; human brain 25827 sequence
agagtcgagagtgggagaa

SEQ ID NO: 9076 - DNA, 20 bp, Artificial
  HS_306, HSbrain_1424, PT_313; chimp brain 38025, human brain 3192, human brain D4G3XZT01C808T sequence
ggaagccctggaggggctgg

SEQ ID NO: 9077 - DNA, 19 bp, Artificial
  HS_306, PT_313; chimp brain 149747, human brain 23192 sequence
tccggttctcagggctcca

SEQ ID NO: 9078 - DNA, 22 bp, Artificial
  HS_306; human brain 14893, human brain 9235 sequence
ggaagccctggaggggctggag

SEQ ID NO: 9079 - DNA, 24 bp, Artificial
  HS_306; human brain 3538 sequence
ggaagccctggaggggctggaggt

SEQ ID NO: 9080 - DNA, 23 bp, Artificial
  HS_306; human brain 39, human brain 7805 sequence
ggaagccctggaggggctggagg

SEQ ID NO: 9081 - DNA, 18 bp, Artificial
  HS_306; human brain 62539 sequence
aggaagccctggaggggc

SEQ ID NO: 9082 - DNA, 21 bp, Artificial
  HS_307, HSbrain_1415, PT_316; chimp brain 96508, human brain 119972, human brain D4G3YLC01CHPL9, human brain D71F8O201C71S7 sequence
tggtggtttacaaagtaattc

SEQ ID NO: 9083 - DNA, 22 bp, Artificial
  HS_307; human brain 139437 sequence
tggtggtttacaaagtaattca

SEQ ID NO: 9084 - DNA, 18 bp, Artificial
  HS_307; human brain 48543 sequence
tggtggtttacaaagtaa

SEQ ID NO: 9085 - DNA, 19 bp, Artificial
  HS_307; human brain 83435 sequence
tggatttctttgtgaatca

SEQ ID NO: 9086 - DNA, 20 bp, Artificial
  HS_30; human brain 56337 sequence
tgaaatgcaaatccatgcaa

SEQ ID NO: 9087 - DNA, 18 bp, Artificial
  HS_31; human brain 5307 sequence
gagcaggtgagatggaat

SEQ ID NO: 9088 - DNA, 19 bp, Artificial
  HS_32; human brain 148388 sequence
ctctccgccacctccaccg

SEQ ID NO: 9089 - DNA, 18 bp, Artificial
  HS_33, HS_34; human brain 74193 sequence
tgggaggtctgggcacac

SEQ ID NO: 9090 - DNA, 18 bp, Artificial
  HS_35; human brain 53930 sequence
ctgggtgagagcgggagg

SEQ ID NO: 9091 - DNA, 18 bp, Artificial
  HS_36; human brain 7403 sequence
gcaccttgccggggattt

SEQ ID NO: 9092 - DNA, 18 bp, Artificial
  HS_37; human brain 194458 sequence
ccctccctgaactgcagc

SEQ ID NO: 9093 - DNA, 18 bp, Artificial
  HS_38; human brain 18115 sequence
tcgcggaggggaggagac

SEQ ID NO: 9094 - DNA, 21 bp, Artificial
  HS_39; human brain 2307, human brain 4982 sequence
tggaggagaaggaaggtgatg

SEQ ID NO: 9095 - DNA, 21 bp, Artificial
  HS_3; human brain 38262 sequence
ctcctcctgcctgacccccca

SEQ ID NO: 9096 - DNA, 18 bp, Artificial
  HS_40; human brain 162451 sequence
gaagccatgaggtgagaa

SEQ ID NO: 9097 - DNA, 18 bp, Artificial
  HS_41; human brain 64397 sequence
tcaaaggaactcagtccc

SEQ ID NO: 9098 - DNA, 18 bp, Artificial
  HS_42; human brain 155943 sequence
ttgtccttgctgtttgga

SEQ ID NO: 9099 - DNA, 21 bp, Artificial
  HS_42; human brain 185142 sequence
attgtccttgctgtttggaga

SEQ ID NO: 9100 - DNA, 19 bp, Artificial
  HS_42; human brain 75694 sequence
attgtccttgctgtttgga

SEQ ID NO: 9101 - DNA, 18 bp, Artificial
  HS_43; human brain 3883 sequence
tcagcattattgttctcc

SEQ ID NO: 9102 - DNA, 19 bp, Artificial
  HS_44; human brain 11456 sequence
gggaaaagagctaggaaag

SEQ ID NO: 9103 - DNA, 19 bp, Artificial
  HS_45; human brain 3229 sequence
ggtgcagtgcctgcatctc

SEQ ID NO: 9104 - DNA, 18 bp, Artificial
  HS_47, PT_109; chimp brain 159670, human brain 86014 sequence
gtacagtactgaatgaat

SEQ ID NO: 9105 - DNA, 20 bp, Artificial
  HS_48; human brain 3532 sequence
ggtcgggggccaggggacag

SEQ ID NO: 9106 - DNA, 21 bp, Artificial
  HS_49; human brain 27210 sequence
tctctctggtgactggacctg

SEQ ID NO: 9107 - DNA, 21 bp, Artificial
  HS_50; human brain 79528 sequence
cagatggagggtggcaatgtg

SEQ ID NO: 9108 - DNA, 21 bp, Artificial
  HS_51; human brain 138868 sequence
tgtgggagagggtatcaggga

SEQ ID NO: 9109 - DNA, 18 bp, Artificial
  HS_52, PT_127; chimp brain 19986, human brain 127523 sequence
gtcacctggcaggtgacc

SEQ ID NO: 9110 - DNA, 21 bp, Artificial
  HS_53; human brain 105289 sequence
cagcccggagcccggacccca

SEQ ID NO: 9111 - DNA, 18 bp, Artificial
  HS_54; human brain 164802 sequence
gtcgctgggaaggaagga

SEQ ID NO: 9112 - DNA, 21 bp, Artificial
  HS_55; human brain 110979 sequence
cctcggcccctccctaccctg

SEQ ID NO: 9113 - DNA, 19 bp, Artificial
  HS_55; human brain 387 sequence
ggcccctccctaccctgcc

SEQ ID NO: 9114 - DNA, 21 bp, Artificial
  HS_56; human brain 120672 sequence
ttggcgccggcaatggcagga

SEQ ID NO: 9115 - DNA, 18 bp, Artificial
  HS_58; human brain 85146 sequence
gggaccctggtttgagga

SEQ ID NO: 9116 - DNA, 19 bp, Artificial
  HS_59; human brain 157453 sequence
ccttctcgagccttgagtg

SEQ ID NO: 9117 - DNA, 21 bp, Artificial
  HS_5; human brain 10307 sequence
cagcccggatcccagcccact

SEQ ID NO: 9118 - DNA, 23 bp, Artificial
  HS_60; human brain 161662 sequence
cgagggaaaattctggaatgtga

SEQ ID NO: 9119 - DNA, 20 bp, Artificial
  HS_61; human brain 136699 sequence
taacaaacacctgtaaaaca

SEQ ID NO: 9120 - DNA, 23 bp, Artificial
  HS_62; human brain 111265 sequence
ttctgcttcctgttggtcctcca

SEQ ID NO: 9121 - DNA, 18 bp, Artificial
  HS_63; human brain 150018 sequence
cagattcccagagtggga

SEQ ID NO: 9122 - DNA, 20 bp, Artificial
  HS_64; human brain 150644 sequence
tccctctccctccttgctcc

SEQ ID NO: 9123 - DNA, 18 bp, Artificial
  HS_65; human brain 189956 sequence
ggagagggaaaagaaaag

SEQ ID NO: 9124 - DNA, 18 bp, Artificial
  HS_66; human brain 93451 sequence
tcacagtgaacctgtcat

SEQ ID NO: 9125 - DNA, 18 bp, Artificial
  HS_67; human brain 87897 sequence
tgtgttgatgtgaatgga

SEQ ID NO: 9126 - DNA, 18 bp, Artificial
  HS_68; human brain 145262 sequence
tgcagctgcctgggaaga

SEQ ID NO: 9127 - DNA, 19 bp, Artificial
  HS_69; human brain 73003 sequence
aggctgccattgatcaaac

SEQ ID NO: 9128 - DNA, 21 bp, Artificial
  HS_6; human brain 147593 sequence
tccccaacccctgcccgcaga

SEQ ID NO: 9129 - DNA, 18 bp, Artificial
  HS_70; human brain 77024 sequence
ctggagtttggggagcca

SEQ ID NO: 9130 - DNA, 18 bp, Artificial
  HS_71; human brain 8452 sequence
ccactgctcctggtgctg

SEQ ID NO: 9131 - DNA, 18 bp, Artificial
  HS_72; human brain 64494 sequence
gggcctgggcggagggac

SEQ ID NO: 9132 - DNA, 19 bp, Artificial
  HS_73; human brain 323 sequence
tgtgcacatccctgctaca

SEQ ID NO: 9133 - DNA, 19 bp, Artificial
  HS_74; human brain 137043 sequence
ttccggtcgcctcggccca

SEQ ID NO: 9134 - DNA, 18 bp, Artificial
  HS_75; human brain 3914 sequence
tgaggtaaggaggctgta

SEQ ID NO: 9135 - DNA, 18 bp, Artificial
  HS_76; human brain 4981 sequence
agggggaaaggaggagga

SEQ ID NO: 9136 - DNA, 18 bp, Artificial
  HS_77; human brain 31804 sequence
cgcagggcgaaaggaggc

SEQ ID NO: 9137 - DNA, 18 bp, Artificial
  HS_78; human brain 32528 sequence
gcggaggagcggatggca

SEQ ID NO: 9138 - DNA, 22 bp, Artificial
  HS_79; human brain 10547 sequence
tgtgcagtactcaccccctccg

SEQ ID NO: 9139 - DNA, 18 bp, Artificial
  HS_7; human brain 150448 sequence
cccctgcccagacttgaa

SEQ ID NO: 9140 - DNA, 18 bp, Artificial
  HS_80; human brain 119371 sequence
cctctggggatccgcgcg

SEQ ID NO: 9141 - DNA, 20 bp, Artificial
  HS_81; human brain 118869 sequence
ctggagacagcgctgaacga

SEQ ID NO: 9142 - DNA, 21 bp, Artificial
  HS_82; human brain 7479 sequence
gcccaggctgggaccactctg

SEQ ID NO: 9143 - DNA, 18 bp, Artificial
  HS_84; human brain 166205 sequence
tgatgacactggcaattg

SEQ ID NO: 9144 - DNA, 18 bp, Artificial
  HS_86; human brain 121476 sequence
gtgtgtgagtgtgcaaga

SEQ ID NO: 9145 - DNA, 19 bp, Artificial
  HS_88; human brain 124843 sequence
ctcctccagcggatcccgc

SEQ ID NO: 9146 - DNA, 18 bp, Artificial
  HS_89; human brain 138847 sequence
gcctgggtctcagccccg

SEQ ID NO: 9147 - DNA, 20 bp, Artificial
  HS_8; human brain 186490 sequence
actgcccgccttgcccacag

SEQ ID NO: 9148 - DNA, 24 bp, Artificial
  HS_8; human brain 57247 sequence
tgctgactgcccgccttgcccaca

SEQ ID NO: 9149 - DNA, 20 bp, Artificial
  HS_90; human brain 172535 sequence
aacatctgcagcaaggtcaa

SEQ ID NO: 9150 - DNA, 19 bp, Artificial
  HS_91; human brain 323 sequence
tccgtcgcagcagtcgctg

SEQ ID NO: 9151 - DNA, 21 bp, Artificial
  HS_92; human brain 138864 sequence
aaaaccgtctagttacagttg

SEQ ID NO: 9152 - DNA, 18 bp, Artificial
  HS_92; human brain 180757 sequence
aaaaccgtctagttacag

SEQ ID NO: 9153 - DNA, 18 bp, Artificial
  HS_92; human brain 182954 sequence
gaaaaccgtctagttaca

SEQ ID NO: 9154 - DNA, 21 bp, Artificial
  HS_92; human brain 5719 sequence
aaaccgtctagttacagttgt

SEQ ID NO: 9155 - DNA, 19 bp, Artificial
  HS_93; human brain 181900 sequence
tggactggactacaatgac

SEQ ID NO: 9156 - DNA, 19 bp, Artificial
  HS_94; human brain 136585 sequence
tggggagcgggaatggata

SEQ ID NO: 9157 - DNA, 21 bp, Artificial
  HS_95; human brain 174992 sequence
ctgtgctacagtgttctggtg

SEQ ID NO: 9158 - DNA, 20 bp, Artificial
  HS_96; human brain 125399 sequence
acaacagtgccaacctcaca

SEQ ID NO: 9159 - DNA, 18 bp, Artificial
  HS_97; human brain 176221 sequence
tcagcagagtccaggcct

SEQ ID NO: 9160 - DNA, 20 bp, Artificial
  HS_98; human brain 147308 sequence
ctctcaccactgccctccca

SEQ ID NO: 9161 - DNA, 22 bp, Artificial
  HS_98; human brain 3499 sequence
cctctcaccactgccctcccac

SEQ ID NO: 9162 - DNA, 21 bp, Artificial
  HS_99; human brain 4559 sequence
tctgtgagaccaaagaactac

SEQ ID NO: 9163 - DNA, 22 bp, Artificial
  HS_9; human brain 125120 sequence
cctgacctcactcccgccccta

SEQ ID NO: 9164 - DNA, 23 bp, Artificial
  HSbrain_100, HSbrain_99; human brain D703HKJ02IB394 sequence
cctgtgacctgcatgtactgggg

SEQ ID NO: 9165 - DNA, 18 bp, Artificial
  HSbrain_101, HSbrain_424; human brain D71F8O202JHXVF sequence
ttgtttttggggtttggc

SEQ ID NO: 9166 - DNA, 18 bp, Artificial
  HSbrain_102; human brain D703HKJ01CNIZZ sequence
aggtgctggctggccagg

SEQ ID NO: 9167 - DNA, 19 bp, Artificial
  HSbrain_103, HSbrain_104, HSbrain_105, HSbrain_107, HSbrain_108, HSbrain_153, HSbrain_252, HSbrain_293, HSbrain_311, HSbrain_490, HSbrain_631; human brain D4G3YLC01ETVLQ sequence
atgtggatcagcaagcagg

SEQ ID NO: 9168 - DNA, 23 bp, Artificial
  HSbrain_103, HSbrain_104, HSbrain_105, HSbrain_107, HSbrain_108, HSbrain_153, HSbrain_252, HSbrain_293, HSbrain_311; human brain D71F8O201B0TPN sequence
gatgtggatcagcaagcaggagt

SEQ ID NO: 9169 - DNA, 22 bp, Artificial
  HSbrain_1066, PT_322; chimp brain 165651, human brain D71F8O201CCSG6, human brain D71F8O202HGQKN, human brain D71F8O202HKSND, human brain D71F8O202INU78 sequence
actccagccccacagcctcagc

SEQ ID NO: 9170 - DNA, 19 bp, Artificial
  HSbrain_1066, PT_322; chimp brain 202163, human brain D4G3XZT01B1EUP, human brain D4G3XZT01BLVMK, human brain D4G3XZT01CGCYW, human brain D4G3XZT01D1QEL, human brain D4G3XZT02FO8UI, human brain D4G3YLC01C85RG, human brain D4G3YLC01E5SK0, human brain D4G3YLC01EDXE2
actccagccccacagcctc

SEQ ID NO: 9171 - DNA, 18 bp, Artificial
  HSbrain_1066; human brain D4G3XZT01BUB7F, human brain D71F8O202HLFVU sequence
ctccagccccacagcctc

SEQ ID NO: 9172 - DNA, 23 bp, Artificial
  HSbrain_1066; human brain D4G3XZT01DUJCI, human brain D71F8O202FNQP6 sequence
aggaggaattggtgctggtcttt

SEQ ID NO: 9173 - DNA, 19 bp, Artificial
  HSbrain_1066; human brain D4HE26K02GIT5M, human brain D703HKJ02H4BF2 sequence
ctccagccccacagcctca

SEQ ID NO: 9174 - DNA, 23 bp, Artificial
  HSbrain_1066; human brain D71F8O202IFC4K sequence
actccagccccacagcctcagcc

SEQ ID NO: 9175 - DNA, 27 bp, Artificial
  HSbrain_106; human brain D4HE26K02GOFY6 sequence
tctgtgtggccttggagggatcatgtc

SEQ ID NO: 9176 - DNA, 20 bp, Artificial
  HSbrain_1076, MQbrain_2651; human brain D703HKJ02ISTNM, human brain D71F8O201BC5JF, human brain D71F8O201DXMZB, macaque brain D4G3X1F02F7H4A, macaque brain D4HK8WR02FICXP, macaque brain D708I2V01EIP8Z, macaque brain D708YRU02H5LXZ
tgcaccatggttgtctgagc

SEQ ID NO: 9177 - DNA, 21 bp, Artificial
  HSbrain_1076, MQbrain_2651; human brain D71F8O201DAZCS, human brain D71F8O202GR1YO, human brain D71F8O202JVS4F, macaque brain D708ZXV02F5303, macaque brain D708ZXV02GBVP3, macaque brain D708ZXV02IPIVB sequence
ctgctcataccccatggtttc

SEQ ID NO: 9178 - DNA, 24 bp, Artificial
  HSbrain_1076; human brain D4G3YLC01C51GF sequence
atgcaccatggttgtctgagcatg

SEQ ID NO: 9179 - DNA, 22 bp, Artificial
  HSbrain_1076; human brain D4HE26K01CTV6R sequence
tctgctcataccccatggtttc

SEQ ID NO: 9180 - DNA, 24 bp, Artificial
  HSbrain_1076; human brain D703HKJ02GVMJW sequence
tgcaccatggttgtctgagcatgc

SEQ ID NO: 9181 - DNA, 22 bp, Artificial
  HSbrain_1076; human brain D71F8O201BY3XU sequence
tgctcataccccatggtttctg

SEQ ID NO: 9182 - DNA, 22 bp, Artificial
  HSbrain_109; human brain D71F8O202IIVC8 sequence
tgaggatatggcagggaagggg

SEQ ID NO: 9183 - DNA, 19 bp, Artificial
  HSbrain_10; human brain D4HE26K02HS1FR sequence
ttggaggggtgggggtggg

SEQ ID NO: 9184 - DNA, 20 bp, Artificial
  HSbrain_11, HSbrain_406; human brain D71F8O201BHAQF sequence
cctctgagaagctaacagtc

SEQ ID NO: 9185 - DNA, 24 bp, Artificial
  HSbrain_110; human brain D71F8O202JVL2S sequence
atgaaagtttggcttcctggtttg

SEQ ID NO: 9186 - DNA, 19 bp, Artificial
  HSbrain_111, HSbrain_16, HSbrain_214, HSbrain_238, HSbrain_394, HSbrain_533, HSbrain_706; human brain D71F8O202IRQVM sequence
accagccggggcagccagc

SEQ ID NO: 9187 - DNA, 29 bp, Artificial
  HSbrain_112; human brain D703HKJ02J3A0U sequence
aagttaatgtcagagaaagaagctcggtc

SEQ ID NO: 9188 - DNA, 20 bp, Artificial
  HSbrain_113; human brain D703HKJ02GPG79 sequence
atttttgcaggcggtagttg

SEQ ID NO: 9189 - DNA, 21 bp, Artificial
  HSbrain_114; human brain D4G3XZT02GELIG sequence
aacactcttcggtacctttcc

SEQ ID NO: 9190 - DNA, 20 bp, Artificial
  HSbrain_115; human brain D4G3XZT02JSCRT sequence
gggtgttgggaaggcctgcg

SEQ ID NO: 9191 - DNA, 20 bp, Artificial
  HSbrain_1168; human brain D4G3YLC02FHZUR sequence
ctgggaggcggtcggttctg

SEQ ID NO: 9192 - DNA, 23 bp, Artificial
  HSbrain_116; human brain D71F8O201BC4WZ sequence
cccacgccagccaggaagaaagt

SEQ ID NO: 9193 - DNA, 22 bp, Artificial
  HSbrain_1174; human brain D4G3YLC01DHS7U, human brain D71F8O201BJB4G sequence
ctggagatatggaagagctgtg

SEQ ID NO: 9194 - DNA, 23 bp, Artificial
  HSbrain_1174; human brain D703HKJ02JC0DY, human brain D71F8O201AYGNK, human brain D71F8O202JA2A0 sequence
ctggagatatggaagagctgtgt

SEQ ID NO: 9195 - DNA, 22 bp, Artificial
  HSbrain_1178; human brain D703HKJ02FKHRU sequence
tctgtgagaccaaagaactact

SEQ ID NO: 9196 - DNA, 19 bp, Artificial
  HSbrain_1178; human brain D71F8O201DAEJL sequence
tctgtgagaccaaagaact

SEQ ID NO: 9197 - DNA, 22 bp, Artificial
  HSbrain_117; human brain D4HE26K01CUVNU sequence
tgtggatccgggtgcagcagtt

SEQ ID NO: 9198 - DNA, 21 bp, Artificial
  HSbrain_118; human brain D703HKJ01DVKKF sequence
cgctgtgctggcgggctatgg

SEQ ID NO: 9199 - DNA, 20 bp, Artificial
  HSbrain_119; human brain D71F8O201EPXKW sequence
tggtgtggcagcaagtgacc

SEQ ID NO: 9200 - DNA, 21 bp, Artificial
  HSbrain_120; human brain D4HE26K01CMRIM sequence
gatagcccagcagccagtgcc

SEQ ID NO: 9201 - DNA, 23 bp, Artificial
  HSbrain_1210, MQbrain_2550, PT_231; chimp brain 130384, human brain D71F8O202I8H4U, macaque brain D708I2V02HCOD2, macaque brain D708YRU01AVPSG sequence
ttagggccctggctccatctcct

SEQ ID NO: 9202 - DNA, 20 bp, Artificial
  HSbrain_1210, MQbrain_2550, PT_231; chimp brain 91523, human brain D4G3YLC02H44OV, human brain D703HKJ01CLZ5C, human brain D703HKJ02I4GBO, human brain D703HKJ02JF4Z1, human brain D71F8O201AEZ1H, human brain D71F8O201BDO1G, macaque brain D708I2V01CLJJN
ttagggccctggctccatct

SEQ ID NO: 9203 - DNA, 21 bp, Artificial
  HSbrain_1210, MQbrain_2550; human brain D703HKJ01COWZY, human brain D71F8O202JZVXI, macaque brain D4HK4YF01CODPS sequence
tagggccctggctccatctcc

SEQ ID NO: 9204 - DNA, 24 bp, Artificial
  HSbrain_1210, PT_231; chimp brain 159065, human brain D703HKJ01BDJBY, human brain D703HKJ02HILV9, human brain D71F8O201AG2FI sequence
ttagggccctggctccatctcctt

SEQ ID NO: 9205 - DNA, 20 bp, Artificial
  HSbrain_1210; human brain D71F8O202IHG7M sequence
tagggccctggctccatctc

SEQ ID NO: 9206 - DNA, 22 bp, Artificial
  HSbrain_121; human brain D703HKJ02F4WLZ sequence
cttcctctcggagaggcagcgg

SEQ ID NO: 9207 - DNA, 23 bp, Artificial
  HSbrain_122; human brain D71F8O201E03MS sequence
ctgtgtcctctcagccaggtgcc

SEQ ID NO: 9208 - DNA, 22 bp, Artificial
  HSbrain_123; human brain D4HE26K01EC9H1 sequence
agggcctgggaaatgctggggg

SEQ ID NO: 9209 - DNA, 24 bp, Artificial
  HSbrain_124; human brain D703HKJ01CE4L7 sequence
tgctgttcagtgacaaactggccc

SEQ ID NO: 9210 - DNA, 20 bp, Artificial
  HSbrain_125; human brain D703HKJ01A6DKR sequence
acccctcactgtacctgccc

SEQ ID NO: 9211 - DNA, 23 bp, Artificial
  HSbrain_1263; human brain D71F8O201AY17B sequence
agccgggcggaggtgactgccgc

SEQ ID NO: 9212 - DNA, 25 bp, Artificial
  HSbrain_126; human brain D71F8O201EP88O sequence
gatctgcggggaggaggccctcgtc

SEQ ID NO: 9213 - DNA, 20 bp, Artificial
  HSbrain_127; human brain D71F8O202ILM1Q sequence
tttatgttgcttctgatgtc

SEQ ID NO: 9214 - DNA, 21 bp, Artificial
  HSbrain_1286; human brain D703HKJ01BT4PS, human brain D71F8O201AOVWS, human brain D71F8O202GW0GM sequence
ctgtcctaaggttgttgagtt

SEQ ID NO: 9215 - DNA, 22 bp, Artificial
  HSbrain_1286; human brain D71F8O201CQVX2 sequence
ctgtcctaaggttgttgagttg

SEQ ID NO: 9216 - DNA, 23 bp, Artificial
  HSbrain_1286; human brain D71F8O201DCSCV sequence
ctgtcctaaggttgttgagttgt

SEQ ID NO: 9217 - DNA, 19 bp, Artificial
  HSbrain_128; human brain D4G3XZT01AMS88 sequence
tttgctgaaggtctgtacc

SEQ ID NO: 9218 - DNA, 23 bp, Artificial
  HSbrain_129, HSbrain_297, HSbrain_340, HSbrain_589, HSbrain_88; human brain D4G3XZT02JWRZH sequence
cttcatcttgtgttgagacttcg

SEQ ID NO: 9219 - DNA, 19 bp, Artificial
  HSbrain_1298; human brain D4G3XZT02GYJX5 sequence
tcaggcccctgtctgcccc

SEQ ID NO: 9220 - DNA, 22 bp, Artificial
  HSbrain_12; human brain D4G3XZT01BF7UR, human brain D71F8O201C8CJ3 sequence
acggtgctggatgtggcctttt

SEQ ID NO: 9221 - DNA, 21 bp, Artificial
  HSbrain_12; human brain D4G3XZT01DE1KS, human brain D703HKJ02I9QQ3, human brain D71F8O201BO6U1 sequence
acggtgctggatgtggccttt

SEQ ID NO: 9222 - DNA, 21 bp, Artificial
  HSbrain_13, HSbrain_422, HSbrain_789; human brain D4HE26K01DL55O sequence
gaagtgtgacgtggacatccg

SEQ ID NO: 9223 - DNA, 19 bp, Artificial
  HSbrain_1305; human brain D71F8O202JP44V sequence
cttcccggctgagctcgcg

SEQ ID NO: 9224 - DNA, 21 bp, Artificial
  HSbrain_130; human brain D4G3YLC01EKCY2 sequence
tctgggaggttgtagcagtgg

SEQ ID NO: 9225 - DNA, 22 bp, Artificial
  HSbrain_131; human brain D71F8O202HWGUA sequence
tttgattggccagtggacagcg

SEQ ID NO: 9226 - DNA, 19 bp, Artificial
  HSbrain_1325; human brain D4HE26K02IPG9T sequence
tcctggggagtggctgggg

SEQ ID NO: 9227 - DNA, 23 bp, Artificial
  HSbrain_132; human brain D4G3YLC01A5XEV sequence
ctgggcggcgtggaggggcagcc

SEQ ID NO: 9228 - DNA, 24 bp, Artificial
  HSbrain_132; human brain D4G3YLC02G4B6Q sequence
ctgggcggcgtggaggggcagcct

SEQ ID NO: 9229 - DNA, 20 bp, Artificial
  HSbrain_1338, MQbrain_2642, PT_32; chimp brain 172883, human brain D4G3XZT01CPJ4U, human brain D4G3XZT01CUKUA, human brain D4G3XZT01CZRZF, human brain D4G3XZT02FQ5BM, human brain D4G3XZT02JLLZZ, human brain D4G3YLC02F9SAX, human brain D4G3YLC02I6J8V, human brain D4HE26K01A3GIG
ttaatatcggacaaccattg

SEQ ID NO: 9230 - DNA, 19 bp, Artificial
  HSbrain_1338, MQbrain_2642; human brain D4G3YLC02F5I86, human brain D703HKJ02J3MTM, macaque brain D708I2V01DTOQY sequence
taatatcggacaaccattg

SEQ ID NO: 9231 - DNA, 26 bp, Artificial
  HSbrain_133; human brain D4G3XZT02JWTK5 sequence
cctgacagcatcttccccaggcagcg

SEQ ID NO: 9232 - DNA, 19 bp, Artificial
  HSbrain_134; human brain D4G3XZT01A9M94, human brain D703HKJ01E1VMB, human brain D71F8O202I4VY0 sequence
agcgagggttccgccggcc

SEQ ID NO: 9233 - DNA, 25 bp, Artificial
  HSbrain_134; human brain D71F8O201CRZTS sequence
ggggagagcgagggttccgccggcc

SEQ ID NO: 9234 - DNA, 21 bp, Artificial
  HSbrain_134; human brain D71F8O201DMRGL sequence
ggagagcgagggttccgccgg

SEQ ID NO: 9235 - DNA, 21 bp, Artificial
  HSbrain_135; human brain D703HKJ01EKWOZ sequence
atctttgccttgggctgctcc

SEQ ID NO: 9236 - DNA, 19 bp, Artificial
  HSbrain_136; human brain D4G3XZT02IBLX7 sequence
gaggacctggcagctctgg

SEQ ID NO: 9237 - DNA, 20 bp, Artificial
  HSbrain_1377; human brain D71F8O201DKBHW sequence
tctgtgcagtactcaccccc

SEQ ID NO: 9238 - DNA, 20 bp, Artificial
  HSbrain_137; human brain D703HKJ01EUSEQ sequence
cccagcagctgaagaaatgg

SEQ ID NO: 9239 - DNA, 22 bp, Artificial
  HSbrain_1386, HSbrain_1387, HSbrain_1388, HSbrain_1389, HSbrain_1390, HSbrain_1391, HSbrain_1392, HSbrain_1398, HSbrain_666, HSbrain_667, HSbrain_670, HSbrain_672, HSbrain_674, HSbrain_678, HSbrain_681, HSbrain_683, HSbrain_686; human brain D4G3XZT02H2RKP sequence
ccagaagggcagagggaatccc

SEQ ID NO: 9240 - DNA, 20 bp, Artificial
  HSbrain_1386, HSbrain_1387, HSbrain_1388, HSbrain_1389, HSbrain_1390, HSbrain_1391, HSbrain_1392, HSbrain_1398, HSbrain_666, HSbrain_667, HSbrain_670, HSbrain_672, HSbrain_674, HSbrain_678, HSbrain_681, HSbrain_683, HSbrain_686; human brain D703HKJ02IRAAO sequence
ccagaagggcagagggaatc

SEQ ID NO: 9241 - DNA, 20 bp, Artificial
  HSbrain_138; human brain D4G3YLC01DHXXF sequence
tgagccagtgtgtcatgtcc

SEQ ID NO: 9242 - DNA, 23 bp, Artificial
  HSbrain_1399; human brain D4G3XZT02IASGS sequence
actgtgggttctgggttggggtg

SEQ ID NO: 9243 - DNA, 19 bp, Artificial
  HSbrain_139; human brain D4G3YLC01BRC7S sequence
ccgctcttcccctgacccc

SEQ ID NO: 9244 - DNA, 20 bp, Artificial
  HSbrain_14, HSbrain_15, HSbrain_764, HSbrain_765; human brain D4G3YLC02I8UNH sequence
agctcactggcttctcgagg

SEQ ID NO: 9245 - DNA, 24 bp, Artificial
  HSbrain_1400; human brain D703HKJ02HA5WM sequence
gcgtggtggctcgaggccatggcc

SEQ ID NO: 9246 - DNA, 22 bp, Artificial
  HSbrain_1401; human brain D71F8O202ICXTQ sequence
ctacaaaggaaagcgctttctg

SEQ ID NO: 9247 - DNA, 21 bp, Artificial
  HSbrain_1404, HSbrain_1405; human brain D71F8O201ECEM6 sequence
cacccggctgtgtgcacatgt

SEQ ID NO: 9248 - DNA, 19 bp, Artificial
  HSbrain_1406; human brain D4G3XZT01C5CTF sequence
acgcctcttcagcgctgtc

SEQ ID NO: 9249 - DNA, 21 bp, Artificial
  HSbrain_1406; human brain D4G3XZT02H7881, human brain D4G3XZT02IQKWV sequence
caggcagtgactgttcagacg

SEQ ID NO: 9250 - DNA, 18 bp, Artificial
  HSbrain_1407; human brain D703HKJ01B9URW sequence
cagccgccgcctgtctcc

SEQ ID NO: 9251 - DNA, 22 bp, Artificial
  HSbrain_1407; human brain D71F8O201D3243 sequence
ccgggagaaggaggtggcctgg

SEQ ID NO: 9252 - DNA, 18 bp, Artificial
  HSbrain_1408; human brain D4G3XZT01BTE41, human brain D4G3XZT02HTIRY, human brain D4HE26K02FZQLF sequence
acgttggctctggtggtg

SEQ ID NO: 9253 - DNA, 22 bp, Artificial
  HSbrain_1408; human brain D4G3XZT01CU3AW sequence
gacgttggctctggtggtgatg

SEQ ID NO: 9254 - DNA, 22 bp, Artificial
  HSbrain_1408; human brain D4HE26K01A9NJH sequence
accacctcccctgcaaacgtcc

SEQ ID NO: 9255 - DNA, 20 bp, Artificial
  HSbrain_1408; human brain D71F8O201AFIKH sequence
ccacctcccctgcaaacgtc

SEQ ID NO: 9256 - DNA, 20 bp, Artificial
  HSbrain_1408; human brain D71F8O202J5RKX sequence
cacctcccctgcaaacgtcc

SEQ ID NO: 9257 - DNA, 22 bp, Artificial
  HSbrain_1409; human brain D71F8O201BPH7B sequence
gaagctctaaggttccgcctgc

SEQ ID NO: 9258 - DNA, 20 bp, Artificial
  HSbrain_140; human brain D4HE26K01EACJD sequence
cctggacatgctgctgaggg

SEQ ID NO: 9259 - DNA, 21 bp, Artificial
  HSbrain_1410; human brain D4G3YLC02HA067, human brain D4HE26K02HHTK4 sequence
ccttctcgagccttgagtgtg

SEQ ID NO: 9260 - DNA, 22 bp, Artificial
  HSbrain_1410; human brain D71F8O201BYSX1, human brain D71F8O201EJ0B7 sequence
ccttctcgagccttgagtgtgc

SEQ ID NO: 9261 - DNA, 20 bp, Artificial
  HSbrain_1410; human brain D71F8O202IPDM3 sequence
ggctcaaggttcaagaaggc

SEQ ID NO: 9262 - DNA, 20 bp, Artificial
  HSbrain_1411; human brain D4G3XZT01BAAYV sequence
accctttgagaaacactttg

SEQ ID NO: 9263 - DNA, 21 bp, Artificial
  HSbrain_1412; human brain D71F8O202JDD5X sequence
gtgaggttggcattgttgtct

SEQ ID NO: 9264 - DNA, 20 bp, Artificial
  HSbrain_1413; human brain D703HKJ02GJB9X, human brain D703HKJ02ILLIT sequence
taagtaaagtggggggtggg

SEQ ID NO: 9265 - DNA, 21 bp, Artificial
  HSbrain_1414; human brain D703HKJ02I6FI7 sequence
ctggggagctgaggctctggg

SEQ ID NO: 9266 - DNA, 19 bp, Artificial
  HSbrain_1415, MQbrain_2656; human brain D703HKJ01AIBMW, macaque brain D4HK8WR02F1TK4 sequence
gatttctttgtgaatcacc

SEQ ID NO: 9267 - DNA, 19 bp, Artificial
  HSbrain_1416; human brain D4G3XZT02IL0P7, human brain D71F8O202IX4H0 sequence
ttgcctgccctcttcctcc

SEQ ID NO: 9268 - DNA, 22 bp, Artificial
  HSbrain_1416; human brain D4G3XZT02ILWAN, human brain D71F8O202GVH0K sequence
aaggaggatggagagctgggcc

SEQ ID NO: 9269 - DNA, 18 bp, Artificial
  HSbrain_1417, MQbrain_2650; human brain D4G3XZT01DOQLL, human brain D4G3YLC02FY51P, human brain D703HKJ02HPZIC, macaque brain D4HK8WR02GR8L4, macaque brain D4HK8WR02JK1J6, macaque brain D708ZXV01D5VSL sequence
catctgggcaactgactg

SEQ ID NO: 9270 - DNA, 20 bp, Artificial
  HSbrain_1417; human brain D703HKJ02I845O sequence
tacatctgggcaactgactg

SEQ ID NO: 9271 - DNA, 21 bp, Artificial
  HSbrain_1418; human brain D4G3XZT01CQHXJ, human brain D4G3XZT01DHA38, human brain D4G3XZT02GEEJ6, human brain D703HKJ01EN9BY, human brain D703HKJ02HF7XO, human brain D71F8O201DCAWW sequence
ttcagccaggctagtgcagtc

SEQ ID NO: 9272 - DNA, 21 bp, Artificial
  HSbrain_1418; human brain D703HKJ01BVDSI, human brain D71F8O202FQQNP sequence
ctgccctagtctagctgaagc

SEQ ID NO: 9273 - DNA, 22 bp, Artificial
  HSbrain_1418; human brain D703HKJ01EMXSE sequence
ctgccctagtctagctgaagct

SEQ ID NO: 9274 - DNA, 22 bp, Artificial
  HSbrain_1418; human brain D71F8O202G9NHZ sequence
ttcagccaggctagtgcagtct

SEQ ID NO: 9275 - DNA, 21 bp, Artificial
  HSbrain_1419, MQbrain_2646, PT_264; chimp brain 148875, human brain D4G3XZT01DO1TM, macaque brain D4HK8WR01C9RPE, macaque brain D4HK8WR02IXTGG, macaque brain D708ZXV02IQJKJ sequence
tctggctgctatggccccctc

SEQ ID NO: 9276 - DNA, 22 bp, Artificial
  HSbrain_1419; human brain D71F8O202H7JJY sequence
tctggctgctatggccccctcc

SEQ ID NO: 9277 - DNA, 26 bp, Artificial
  HSbrain_1419; human brain D71F8O202I18H0 sequence
aaggtgccattctgagggccaggagt

SEQ ID NO: 9278 - DNA, 23 bp, Artificial
  HSbrain_141; human brain D703HKJ01DA0DK sequence
ttttactctgttgtctcagccgc

SEQ ID NO: 9279 - DNA, 25 bp, Artificial
  HSbrain_1420; human brain D71F8O202I55Q6 sequence
aggaccggtgcgagtgaggcagccc

SEQ ID NO: 9280 - DNA, 22 bp, Artificial
  HSbrain_1422, MQbrain_2671; human brain D4G3XZT02G93P7, human brain D4G3XZT02HDJEG, human brain D703HKJ01DNPU3, human brain D703HKJ01ESPD6, human brain D703HKJ01EV87H, human brain D703HKJ02JTRNS, human brain D71F8O201AF4ZQ, human brain D71F8O201D8ZQX, human brain D71F8O202F3YU9
actctagctgccaaaggcgctt

SEQ ID NO: 9281 - DNA, 21 bp, Artificial
  HSbrain_1422, MQbrain_2671; human brain D703HKJ01CKUM0, human brain D703HKJ02IN6IW, human brain D71F8O202F7Y6H, human brain D71F8O202I7DFF, macaque brain D708I2V02JWHZ4 sequence
actctagctgccaaaggcgct

SEQ ID NO: 9282 - DNA, 23 bp, Artificial
  HSbrain_1422, MQbrain_2671; human brain D703HKJ02FZ6SV, human brain D71F8O202JJT9W, macaque brain D4HK4YF01C627O, macaque brain D4HK4YF01DULO6, macaque brain D4HK8WR01AROP8, macaque brain D708I2V02IP51Z, macaque brain D708ZXV02F18ZF sequence
actctagctgccaaaggcgcttc

SEQ ID NO: 9283 - DNA, 20 bp, Artificial
  HSbrain_1422; human brain D4G3XZT02GRKY2, human brain D703HKJ02G1DAI, human brain D703HKJ02HOTDY, human brain D71F8O201AXX62 sequence
actctagctgccaaaggcgc

SEQ ID NO: 9284 - DNA, 19 bp, Artificial
  HSbrain_1422; human brain D4G3YLC02ITQ0Y sequence
cgctttgctcagccagtgt

SEQ ID NO: 9285 - DNA, 21 bp, Artificial
  HSbrain_1422; human brain D703HKJ02F3JO7 sequence
agcgctttgctcagccagtgt

SEQ ID NO: 9286 - DNA, 22 bp, Artificial
  HSbrain_1423, MQbrain_2614; human brain D4G3XZT01DQ3HS, macaque brain D708YRU02I45PR, macaque brain D708ZXV01CUU8B sequence
ctgagacctctgggttctgagc

SEQ ID NO: 9287 - DNA, 19 bp, Artificial
  HSbrain_1423, MQbrain_2614; human brain D4G3XZT01ERTZZ, human brain D4G3YLC02JOI5R, macaque brain D4G3X1F01ECCA7, macaque brain D4HK4YF02JJVJ5 sequence
tgggatctccggggtcttg

SEQ ID NO: 9288 - DNA, 20 bp, Artificial
  HSbrain_1423, MQbrain_2614; human brain D4G3YLC01EG6R8, human brain D71F8O201CQJD4, human brain D71F8O202I5Y0W, macaque brain D4G3X1F01D3GI4, macaque brain D4G3X1F02G9EEG, macaque brain D4HK4YF02FQMY6, macaque brain D4HK8WR01CKBJL
ctgggatctccggggtcttg

SEQ ID NO: 9289 - DNA, 22 bp, Artificial
  HSbrain_1423, MQbrain_2614; human brain D703HKJ01AN369, human brain D71F8O202GLC0Z, macaque brain D708I2V02FUKCQ, macaque brain D708I2V02GIP3O, macaque brain D708I2V02I5BEG, macaque brain D708I2V02JNV2F, macaque brain D708YRU01BOI3L
ctgggatctccggggtcttggt

SEQ ID NO: 9290 - DNA, 21 bp, Artificial
  HSbrain_1423, MQbrain_2614; human brain D71F8O202JPKTI, macaque brain D708I2V02FXYSU, macaque brain D708I2V02HGJPX, macaque brain D708YRU01BNRS4, macaque brain D708YRU01EAYKH, macaque brain D708YRU02GY48D, macaque brain D708ZXV02HFK5Z sequence
tgggatctccggggtcttggt

SEQ ID NO: 9291 - DNA, 20 bp, Artificial
  HSbrain_1423; human brain D71F8O202H970A sequence
gagacctctgggttctgagc

SEQ ID NO: 9292 - DNA, 21 bp, Artificial
  HSbrain_1423; human brain D71F8O202JMQJV sequence
gctgattcctgggctctgacc

SEQ ID NO: 9293 - DNA, 25 bp, Artificial
  HSbrain_1424, MQbrain_2672, PT_313; chimp brain 165414, human brain D703HKJ01BBI96, human brain D71F8O202GKSYF, macaque brain D708I2V01BHSZ7, macaque brain D708I2V02H1NZB, macaque brain D708YRU01A15DA, macaque brain D708YRU01B48SE
aggaagccctggaggggctggaggt

SEQ ID NO: 9294 - DNA, 21 bp, Artificial
  HSbrain_1424, MQbrain_2672, PT_313; chimp brain 51293, human brain D4G3XZT01CGAIW, human brain D703HKJ01CC77P, human brain D71F8O201APFI5, macaque brain D4HK8WR01AHV8M, macaque brain D4HK8WR01ECF06, macaque brain D708I2V01CUHNO, macaque brain D708YRU01DE83G sequence
aggaagccctggaggggctgg

SEQ ID NO: 9295 - DNA, 18 bp, Artificial
  HSbrain_1424, MQbrain_2672; human brain D4G3XZT01EC64V, human brain D703HKJ02G27GC, human brain D71F8O201A5HN6, macaque brain D4HK4YF01CQ8MR sequence
tccggttctcagggctcc

SEQ ID NO: 9296 - DNA, 19 bp, Artificial
  HSbrain_1424; human brain D4G3YLC02IY3VP sequence
ctggcaggccaggaagagg

SEQ ID NO: 9297 - DNA, 21 bp, Artificial
  HSbrain_1424; human brain D71F8O201CXOJ3 sequence
ggaagccctggaggggctgga

SEQ ID NO: 9298 - DNA, 20 bp, Artificial
  HSbrain_1425; human brain D4G3XZT02JJ8YX sequence
ctctcctaacctcgctctcg

SEQ ID NO: 9299 - DNA, 22 bp, Artificial
  HSbrain_1425; human brain D71F8O201A88R9 sequence
cctctcctaacctcgctctcgc

SEQ ID NO: 9300 - DNA, 19 bp, Artificial
  HSbrain_1425; human brain D71F8O201BHGZD sequence
cgagagtgggagaagagcg

SEQ ID NO: 9301 - DNA, 21 bp, Artificial
  HSbrain_1425; human brain D71F8O201DITCR sequence
tcgagagtgggagaagagcgg

SEQ ID NO: 9302 - DNA, 21 bp, Artificial
  HSbrain_1425; human brain D71F8O202H9DP4 sequence
cggagcgtgtgagcagtactg

SEQ ID NO: 9303 - DNA, 19 bp, Artificial
  HSbrain_1426, HSbrain_151; human brain D4HE26K02ITA0M, human brain D703HKJ02HOIVF, human brain D71F8O201DZQM7 sequence
tctcccttcctgccctggc

SEQ ID NO: 9304 - DNA, 19 bp, Artificial
  HSbrain_142; human brain D71F8O201EAWE9 sequence
cgccgcgcggtgactcccc

SEQ ID NO: 9305 - DNA, 18 bp, Artificial
  HSbrain_1431; human brain D71F8O202G9YZ2 sequence
tctgacctctgaccctct

SEQ ID NO: 9306 - DNA, 20 bp, Artificial
  HSbrain_1434; human brain D703HKJ02J16P2 sequence
ctccgtttgcctgtttcgct

SEQ ID NO: 9307 - DNA, 20 bp, Artificial
  HSbrain_1436, MQbrain_2602, PT_311; chimp brain 147112, human brain D4G3XZT02ITUPL, human brain D4G3XZT02JE2PW, human brain D4G3YLC01CZ73O, human brain D4G3YLC02HNZKQ, human brain D4HE26K01EFMQW, human brain D703HKJ01A7627, human brain D703HKJ02J47Q1, human brain D71F8O201BFS7Q
tcggctctgggtctgtgggg

SEQ ID NO: 9308 - DNA, 19 bp, Artificial
  HSbrain_1436, MQbrain_2602, PT_311; chimp brain 82944, human brain D4G3XZT01DSUWP, human brain D4G3XZT01EBJ16, human brain D4G3XZT02I5X5S, human brain D4G3YLC01D70T3, human brain D4G3YLC01EV3ZJ, human brain D4HE26K01ARV05, human brain D4HE26K01ESGLK, human brain D703HKJ01A78NH
cggctctgggtctgtgggg

SEQ ID NO: 9309 - DNA, 19 bp, Artificial
  HSbrain_1436; human brain D4G3XZT01BJ1KL, human brain D71F8O201ADQG0 sequence
tcggctctgggtctgtggg

SEQ ID NO: 9310 - DNA, 19 bp, Artificial
  HSbrain_1437, MQbrain_2700; human brain D4G3XZT01BIAH0, macaque brain D708I2V02I8CB5 sequence
ttggaggatgaaagtacgg

SEQ ID NO: 9311 - DNA, 25 bp, Artificial
  HSbrain_1437, MQbrain_2700; human brain D4G3XZT01BIJ53, macaque brain D708YRU02INRL4, macaque brain D708ZXV02G6POH, macaque brain D708ZXV02IG1OK sequence
cacaatgctgacactcaaactgctg

SEQ ID NO: 9312 - DNA, 26 bp, Artificial
  HSbrain_1437, MQbrain_2700; human brain D4HE26K02GYONS, human brain D71F8O202HBW8G, macaque brain D4G3X1F01C5NCQ sequence
ttggaggatgaaagtacggagtgatc

SEQ ID NO: 9313 - DNA, 19 bp, Artificial
  HSbrain_1437, MQbrain_2700; human brain D71F8O201BJRXG, macaque brain D4HK4YF02JLVRM sequence
gttggaggatgaaagtacg

SEQ ID NO: 9314 - DNA, 27 bp, Artificial
  HSbrain_1437; human brain D4G3XZT01DJXZW, human brain D4HE26K01ATHYU sequence
gttggaggatgaaagtacggagtgatc

SEQ ID NO: 9315 - DNA, 21 bp, Artificial
  HSbrain_1437; human brain D4HE26K01C1KAG sequence
gaggatgaaagtacggagtga

SEQ ID NO: 9316 - DNA, 24 bp, Artificial
  HSbrain_1437; human brain D703HKJ01AMSWD sequence
gttggaggatgaaagtacggagtg

SEQ ID NO: 9317 - DNA, 22 bp, Artificial
  HSbrain_1437; human brain D71F8O201ARRNE sequence
ttggaggatgaaagtacggagt

SEQ ID NO: 9318 - DNA, 23 bp, Artificial
  HSbrain_1437; human brain D71F8O201CHC87 sequence
gttggaggatgaaagtacggagt

SEQ ID NO: 9319 - DNA, 19 bp, Artificial
  HSbrain_143; human brain D703HKJ02IE0J7 sequence
tccccagcccttggctctg

SEQ ID NO: 9320 - DNA, 21 bp, Artificial
  HSbrain_144; human brain D4G3XZT01DDIF8 sequence
ggcctgcagccagggagagcc

SEQ ID NO: 9321 - DNA, 22 bp, Artificial
  HSbrain_145; human brain D4G3XZT02GZ92P sequence
acgtctgtggcaggagtccctg

SEQ ID NO: 9322 - DNA, 21 bp, Artificial
  HSbrain_146; human brain D71F8O202JVXGE sequence
aatgcagatcttggtggagcg

SEQ ID NO: 9323 - DNA, 22 bp, Artificial
  HSbrain_147; human brain D71F8O201DW2XM sequence
aaggcttctgaggatcccgccc

SEQ ID NO: 9324 - DNA, 29 bp, Artificial
  HSbrain_148; human brain D71F8O202HCC6O sequence
ctttggagctgatggctggagaactgatg

SEQ ID NO: 9325 - DNA, 27 bp, Artificial
  HSbrain_149; human brain D4G3XZT01BZJL6 sequence
ctgggcagccttttgggctgagttttc

SEQ ID NO: 9326 - DNA, 24 bp, Artificial
  HSbrain_150; human brain D703HKJ01B4SXA sequence
agtgggttggaagacagggtgacc

SEQ ID NO: 9327 - DNA, 18 bp, Artificial
  HSbrain_152; human brain D4G3XZT01CSDNC sequence
tgcccgcttgctgtgccc

SEQ ID NO: 9328 - DNA, 25 bp, Artificial
  HSbrain_154; human brain D71F8O201AQHFN sequence
tgggttccagaaaaggcagaggttc

SEQ ID NO: 9329 - DNA, 18 bp, Artificial
  HSbrain_155; human brain D71F8O201DRS5R sequence
gtgtgggctgcaggaggc

SEQ ID NO: 9330 - DNA, 19 bp, Artificial
  HSbrain_156; human brain D71F8O201EHQQN sequence
gtcctgggaccctgtgggt

SEQ ID NO: 9331 - DNA, 20 bp, Artificial
  HSbrain_157; human brain D71F8O201BQC12 sequence
ggagcagtggctgccctgcg

SEQ ID NO: 9332 - DNA, 20 bp, Artificial
  HSbrain_158; human brain D4G3YLC01B3VRF sequence
actgtggcagtttccagggg

SEQ ID NO: 9333 - DNA, 26 bp, Artificial
  HSbrain_159; human brain D71F8O201CGFHU sequence
atccttttgggcagcctgaagactgg

SEQ ID NO: 9334 - DNA, 22 bp, Artificial
  HSbrain_160; human brain D4G3XZT02GEPYB sequence
tggccccaggttcccagtcctt

SEQ ID NO: 9335 - DNA, 23 bp, Artificial
  HSbrain_161; human brain D703HKJ02HRIOG sequence
cgaagagactggagacaatgtgg

SEQ ID NO: 9336 - DNA, 21 bp, Artificial
  HSbrain_162; human brain D703HKJ02JBBGH sequence
cttaggggatagagtgcaagg

SEQ ID NO: 9337 - DNA, 20 bp, Artificial
  HSbrain_163; human brain D4G3XZT01DDBC2, human brain D4G3XZT01DLRB7, human brain D71F8O202FWE6G sequence
ctgcccaggcccgagggccg

SEQ ID NO: 9338 - DNA, 23 bp, Artificial
  HSbrain_164; human brain D71F8O202IY3KU sequence
ctggccagggtgggaggcagctg

SEQ ID NO: 9339 - DNA, 22 bp, Artificial
  HSbrain_165; human brain D703HKJ02J19WS sequence
tgggacacagaccccctgacgg

SEQ ID NO: 9340 - DNA, 21 bp, Artificial
  HSbrain_166; human brain D71F8O202JBR8T sequence
cctggttgaggagggaggggc

SEQ ID NO: 9341 - DNA, 22 bp, Artificial
  HSbrain_167; human brain D71F8O202HW1ZL sequence
aagatttgcttgaggctagccc

SEQ ID NO: 9342 - DNA, 22 bp, Artificial
  HSbrain_168; human brain D703HKJ01CCFBD sequence
ctgggtgagaagatgacagagg

SEQ ID NO: 9343 - DNA, 20 bp, Artificial
  HSbrain_169; human brain D71F8O202F12O4 sequence
tttgaggctggcggggtctg

SEQ ID NO: 9344 - DNA, 19 bp, Artificial
  HSbrain_170; human brain D703HKJ01E0GH2 sequence
agagaagagtgtttgtgtc

SEQ ID NO: 9345 - DNA, 19 bp, Artificial
  HSbrain_171; human brain D4G3YLC02HTLWU sequence
agtggagcctggcttaggg

SEQ ID NO: 9346 - DNA, 20 bp, Artificial
  HSbrain_172; human brain D4G3YLC02GECL5 sequence
agaccctgacacctctcatt

SEQ ID NO: 9347 - DNA, 22 bp, Artificial
  HSbrain_173; human brain D71F8O201BDDK4 sequence
tgatgagaagtgggtctccagg

SEQ ID NO: 9348 - DNA, 24 bp, Artificial
  HSbrain_174; human brain D703HKJ02GF2VW sequence
tctttgaagttgctgggataaatt

SEQ ID NO: 9349 - DNA, 23 bp, Artificial
  HSbrain_175; human brain D703HKJ01ETN4X sequence
aggtatgggaggacatggctatg

SEQ ID NO: 9350 - DNA, 19 bp, Artificial
  HSbrain_176; human brain D71F8O202GEEPF sequence
aggggaaatgaaatgggtg

SEQ ID NO: 9351 - DNA, 24 bp, Artificial
  HSbrain_177; human brain D4G3XZT01DDMF3 sequence
ctggatgagatgaggctcaggagc

SEQ ID NO: 9352 - DNA, 18 bp, Artificial
  HSbrain_178; human brain D4G3YLC02FLHQ5 sequence
tcgcgcagcaagcggtgc

SEQ ID NO: 9353 - DNA, 19 bp, Artificial
  HSbrain_179; human brain D71F8O202ISPHT sequence
atgtgaatgctgctgcagg

SEQ ID NO: 9354 - DNA, 19 bp, Artificial
  HSbrain_17; human brain D4HE26K02G77IV sequence
gtcgccttggatgctctgc

SEQ ID NO: 9355 - DNA, 21 bp, Artificial
  HSbrain_180; human brain D703HKJ01D027X sequence
tttcattttaaaggtgggttt

SEQ ID NO: 9356 - DNA, 28 bp, Artificial
  HSbrain_181; human brain D4HE26K01ET5KN sequence
ccagccaaagaggtcgaagtggttctgg

SEQ ID NO: 9357 - DNA, 22 bp, Artificial
  HSbrain_182; human brain D4HE26K02GX36J sequence
gagaaggtgaaggagcagctgg

SEQ ID NO: 9358 - DNA, 18 bp, Artificial
  HSbrain_183; human brain D4HE26K01CVWVE sequence
agcggatggtggaaaggt

SEQ ID NO: 9359 - DNA, 25 bp, Artificial
  HSbrain_184; human brain D71F8O201C0YZU sequence
ttttgagcttggccccagccttggg

SEQ ID NO: 9360 - DNA, 19 bp, Artificial
  HSbrain_185; human brain D4HE26K01D4N4I sequence
aaaagctgggttgagggga

SEQ ID NO: 9361 - DNA, 20 bp, Artificial
  HSbrain_185; human brain D71F8O202HJU9H sequence
aaaagctgggttgaggggac

SEQ ID NO: 9362 - DNA, 21 bp, Artificial
  HSbrain_186; human brain D703HKJ01DXMSE sequence
gctgagacagccagggccacc

SEQ ID NO: 9363 - DNA, 21 bp, Artificial
  HSbrain_187; human brain D703HKJ01D3QFD sequence
tgagggtgatgctgctcgtgc

SEQ ID NO: 9364 - DNA, 19 bp, Artificial
  HSbrain_188; human brain D4HE26K01E32HY sequence
agctgaggacgaggagatg

SEQ ID NO: 9365 - DNA, 22 bp, Artificial
  HSbrain_189; human brain D703HKJ02IQ1EK sequence
ctggaccagcccaagcttgacg

SEQ ID NO: 9366 - DNA, 22 bp, Artificial
  HSbrain_18; human brain D703HKJ01ANBSH sequence
ccagcgggtggcccaccgaacc

SEQ ID NO: 9367 - DNA, 20 bp, Artificial
  HSbrain_190; human brain D71F8O202F1S08 sequence
ttgctgtctgcaagggagcc

SEQ ID NO: 9368 - DNA, 30 bp, Artificial
  HSbrain_191; human brain D703HKJ01EAQTO sequence
tccagaagctcctggctgccttccctggcg

SEQ ID NO: 9369 - DNA, 20 bp, Artificial
  HSbrain_192; human brain D71F8O202JUEQF sequence
cagcctggactccagtttcc

SEQ ID NO: 9370 - DNA, 21 bp, Artificial
  HSbrain_193; human brain D4HE26K02I4SSJ sequence
cgggccatgtgcatcagtcgc

SEQ ID NO: 9371 - DNA, 27 bp, Artificial
  HSbrain_194; human brain D4HE26K02HJ1FJ sequence
ggtgacaaggttggaaaagcttccctg

SEQ ID NO: 9372 - DNA, 18 bp, Artificial
  HSbrain_195; human brain D4G3YLC02GO6OQ sequence
tgtggggtgctagaggcc

SEQ ID NO: 9373 - DNA, 23 bp, Artificial
  HSbrain_196, HSbrain_228, HSbrain_462; human brain D4G3XZT01DQ9UV sequence
gctctgagaagcacagctacctg

SEQ ID NO: 9374 - DNA, 20 bp, Artificial
  HSbrain_197; human brain D4G3XZT01COD38 sequence
aggctgctgagtgtgcaggg

SEQ ID NO: 9375 - DNA, 21 bp, Artificial
  HSbrain_198; human brain D4G3YLC01ETOTE sequence
ccagggctggcagtgacatgg

SEQ ID NO: 9376 - DNA, 19 bp, Artificial
  HSbrain_199; human brain D71F8O201CG69U sequence
ggtctccaagtgtcaactc

SEQ ID NO: 9377 - DNA, 21 bp, Artificial
  HSbrain_19; human brain D4HE26K02I7TGF sequence
gtgtgagtcccacatcctggg

SEQ ID NO: 9378 - DNA, 18 bp, Artificial
  HSbrain_1; human brain D71F8O202JSD44 sequence
cctttttaaccgcgagcg

SEQ ID NO: 9379 - DNA, 19 bp, Artificial
  HSbrain_2, MQbrain_2270; human brain D71F8O201DLG3L, macaque brain D708YRU02GBX5K, macaque brain D708YRU02IN7NW, macaque brain D708ZXV02GMA11 sequence
tctggctgttgtggtgtgc

SEQ ID NO: 9380 - DNA, 18 bp, Artificial
  HSbrain_200, HSbrain_89; human brain D4G3YLC01E072K sequence
caggactgcagcattggt

SEQ ID NO: 9381 - DNA, 20 bp, Artificial
  HSbrain_201; human brain D703HKJ01CMHS0 sequence
ttgcttctcaggttagaatg

SEQ ID NO: 9382 - DNA, 22 bp, Artificial
  HSbrain_202; human brain D4G3YLC01BEV1I sequence
cagggactggcagagcaagagg

SEQ ID NO: 9383 - DNA, 18 bp, Artificial
  HSbrain_203; human brain D703HKJ01DCSZM sequence
aggaggcatgccaggagg

SEQ ID NO: 9384 - DNA, 24 bp, Artificial
  HSbrain_204; human brain D703HKJ01DGV68 sequence
aagggaagggcagctcctggaatg

SEQ ID NO: 9385 - DNA, 26 bp, Artificial
  HSbrain_205; human brain D71F8O202GR1UR sequence
ctttcctgtcccaaatcagccagtgt

SEQ ID NO: 9386 - DNA, 20 bp, Artificial
  HSbrain_206; human brain D71F8O202GLAC0 sequence
accacgaggaccggcagatg

SEQ ID NO: 9387 - DNA, 20 bp, Artificial
  HSbrain_207; human brain D703HKJ01A2UKK sequence
gaacttggggatggagtagg

SEQ ID NO: 9388 - DNA, 19 bp, Artificial
  HSbrain_208; human brain D71F8O201DW02M sequence
ttaagctctgcccccgtgg

SEQ ID NO: 9389 - DNA, 19 bp, Artificial
  HSbrain_209; human brain D703HKJ01EPFM2 sequence
agctggccgaggctcaggg

SEQ ID NO: 9390 - DNA, 22 bp, Artificial
  HSbrain_20; human brain D71F8O202J2S53 sequence
gctgacagcagggctggccgct

SEQ ID NO: 9391 - DNA, 20 bp, Artificial
  HSbrain_21, HSbrain_576, HSbrain_623; human brain D4G3XZT01B3XTV sequence
gcttgtccctcagccgggtg

SEQ ID NO: 9392 - DNA, 23 bp, Artificial
  HSbrain_210; human brain D71F8O202I3FPR sequence
ctcctgagtccttccacctgttc

SEQ ID NO: 9393 - DNA, 18 bp, Artificial
  HSbrain_211; human brain D71F8O201E2JUP sequence
aagactggggtggacctc

SEQ ID NO: 9394 - DNA, 23 bp, Artificial
  HSbrain_212; human brain D4HE26K02IST1U sequence
caaccagggtgtggatgggactg

SEQ ID NO: 9395 - DNA, 21 bp, Artificial
  HSbrain_213; human brain D703HKJ02FUNWZ sequence
ctcagtaagtggcactctgtc

SEQ ID NO: 9396 - DNA, 20 bp, Artificial
  HSbrain_215; human brain D703HKJ01B86KE sequence
acctgggctccaaggttctc

SEQ ID NO: 9397 - DNA, 19 bp, Artificial
  HSbrain_216, HSbrain_299; human brain D4G3XZT01B1GHY sequence
agcagggaggacgtggtgg

SEQ ID NO: 9398 - DNA, 22 bp, Artificial
  HSbrain_217; human brain D71F8O201AM9WF sequence
actccctgccaggcctcctgct

SEQ ID NO: 9399 - DNA, 23 bp, Artificial
  HSbrain_218; human brain D71F8O201B5ELN sequence
ccctgccctgttcctccaccttg

SEQ ID NO: 9400 - DNA, 18 bp, Artificial
  HSbrain_219; human brain D4G3XZT02I45L9 sequence
ctggccctggagatgagg

SEQ ID NO: 9401 - DNA, 23 bp, Artificial
  HSbrain_220; human brain D4G3XZT01AXW7H sequence
gcttggtggcttcaggagtgtgg

SEQ ID NO: 9402 - DNA, 18 bp, Artificial
  HSbrain_221; human brain D71F8O201B0Q7T sequence
cgctgaccaggatcgatg

SEQ ID NO: 9403 - DNA, 20 bp, Artificial
  HSbrain_222; human brain D703HKJ01D575E sequence
tgagctagggatatctcctg

SEQ ID NO: 9404 - DNA, 23 bp, Artificial
  HSbrain_223, PT_176; chimp brain 8041, human brain D71F8O202G0TZB sequence
ccggggctgcgcgaggcacaggc

SEQ ID NO: 9405 - DNA, 18 bp, Artificial
  HSbrain_224; human brain D4G3XZT02FM0YR sequence
cttttggttatctagctg

SEQ ID NO: 9406 - DNA, 21 bp, Artificial
  HSbrain_225; human brain D71F8O202IF5K6 sequence
gcccaggatttagccaagtgg

SEQ ID NO: 9407 - DNA, 18 bp, Artificial
  HSbrain_226; human brain D4HE26K01BO7WE sequence
cgccggaccaagtggagg

SEQ ID NO: 9408 - DNA, 18 bp, Artificial
  HSbrain_227; human brain D71F8O202F3Z5J sequence
atgatggtggggaacagc

SEQ ID NO: 9409 - DNA, 21 bp, Artificial
  HSbrain_229; human brain D703HKJ01DO82Y sequence
ttcctgtaactgggccagttt

SEQ ID NO: 9410 - DNA, 27 bp, Artificial
  HSbrain_22; human brain D71F8O201B0THG sequence
ctgctgcggaagctgtgttcgccaatg

SEQ ID NO: 9411 - DNA, 23 bp, Artificial
  HSbrain_230, HSbrain_447, HSbrain_598, HSbrain_782, HSbrain_787, HSbrain_790; human brain D71F8O202GCGWK sequence
ctttgagtgaagctcttcctggg

SEQ ID NO: 9412 - DNA, 22 bp, Artificial
  HSbrain_231; human brain D703HKJ01BBIDU sequence
cccgctggggccaggaggagcc

SEQ ID NO: 9413 - DNA, 21 bp, Artificial
  HSbrain_232; human brain D71F8O201CLJQ4 sequence
gaccgagtactgcccccagtg

SEQ ID NO: 9414 - DNA, 21 bp, Artificial
  HSbrain_233, HSbrain_234, HSbrain_235, HSbrain_236, HSbrain_779, HSbrain_780; human brain D4G3XZT02FRWP5 sequence
cctgtctgtgtgaccgtcatg

SEQ ID NO: 9415 - DNA, 21 bp, Artificial
  HSbrain_237; human brain D703HKJ01BQU7L sequence
tgataggatggctgaaccacg

SEQ ID NO: 9416 - DNA, 25 bp, Artificial
  HSbrain_239; human brain D71F8O201AN2YW sequence
ctctgagccaaagcaggccaggctg

SEQ ID NO: 9417 - DNA, 26 bp, Artificial
  HSbrain_239; human brain D71F8O202I35HV sequence
ctctgagccaaagcaggccaggctgt

SEQ ID NO: 9418 - DNA, 24 bp, Artificial
  HSbrain_23; human brain D4G3XZT02J5JXP sequence
tttgctttgctgacctctcaggcc

SEQ ID NO: 9419 - DNA, 19 bp, Artificial
  HSbrain_240; human brain D4G3XZT02GIUVU sequence
gtgaggacaggagggtggg

SEQ ID NO: 9420 - DNA, 21 bp, Artificial
  HSbrain_241; human brain D4G3XZT01EEME5 sequence
tttctaccacagctctttgtt

SEQ ID NO: 9421 - DNA, 22 bp, Artificial
  HSbrain_241; human brain D4HE26K02HK85F sequence
tttctaccacagctctttgttt

SEQ ID NO: 9422 - DNA, 21 bp, Artificial
  HSbrain_242; human brain D703HKJ01DI6W8 sequence
agaagaattggcctactcagg

SEQ ID NO: 9423 - DNA, 26 bp, Artificial
  HSbrain_243; human brain D71F8O201AO7TI sequence
tggccagattcttgccggggagcttg

SEQ ID NO: 9424 - DNA, 24 bp, Artificial
  HSbrain_244; human brain D4G3XZT01APTFO sequence
ggggcagggcagggctggggcctg

SEQ ID NO: 9425 - DNA, 22 bp, Artificial
  HSbrain_245; human brain D703HKJ02FMRH9 sequence
ctcctatgtgcttggggtcctg

SEQ ID NO: 9426 - DNA, 21 bp, Artificial
  HSbrain_246; human brain D703HKJ01DGD8V, human brain D71F8O201CZF33 sequence
tctgccattgacccattattg

SEQ ID NO: 9427 - DNA, 26 bp, Artificial
  HSbrain_247; human brain D4G3YLC01BKF8K sequence
ctcttctgggagtgctgttctgcttt

SEQ ID NO: 9428 - DNA, 24 bp, Artificial
  HSbrain_248; human brain D703HKJ01BPKPC sequence
caccacaccaaccaagcaactagg

SEQ ID NO: 9429 - DNA, 21 bp, Artificial
  HSbrain_248; human brain D703HKJ01ERE5L sequence
cacaccaaccaagcaactagg

SEQ ID NO: 9430 - DNA, 25 bp, Artificial
  HSbrain_249; human brain D703HKJ02IOVP0 sequence
tactagaagctgatctgattggtcc

SEQ ID NO: 9431 - DNA, 20 bp, Artificial
  HSbrain_24; human brain D4G3XZT02H005Q sequence
cttttgagtcgtggcgtgcg

SEQ ID NO: 9432 - DNA, 22 bp, Artificial
  HSbrain_250; human brain D4HE26K02G16XY sequence
gtggaggactgagaaggtgagg

SEQ ID NO: 9433 - DNA, 21 bp, Artificial
  HSbrain_251; human brain D4G3XZT02G7QKN sequence
ggcatgggtcagaaggattcc

SEQ ID NO: 9434 - DNA, 29 bp, Artificial
  HSbrain_253; human brain D4G3XZT02F7HC2 sequence
cactggagtgaaagatgttttgttcattt

SEQ ID NO: 9435 - DNA, 21 bp, Artificial
  HSbrain_254; human brain D703HKJ01DD8KK sequence
tatacatgtgctccagtcccc

SEQ ID NO: 9436 - DNA, 22 bp, Artificial
  HSbrain_255; human brain D71F8O202F2UTI sequence
aagtgccaggatagctgcgtgg

SEQ ID NO: 9437 - DNA, 19 bp, Artificial
  HSbrain_256; human brain D4G3YLC02GWIGA sequence
gactggagccaaccaagtg

SEQ ID NO: 9438 - DNA, 21 bp, Artificial
  HSbrain_257; human brain D4G3YLC02G4P9N sequence
ctgggccaggacaccccgtcc

SEQ ID NO: 9439 - DNA, 20 bp, Artificial
  HSbrain_258; human brain D71F8O202HYK6M sequence
agatggaacgtggatcagct

SEQ ID NO: 9440 - DNA, 27 bp, Artificial
  HSbrain_259; human brain D4G3YLC01CBCMJ sequence
caggccgaggccgacttgctcaccgtc

SEQ ID NO: 9441 - DNA, 22 bp, Artificial
  HSbrain_25; human brain D703HKJ01C6ZUD sequence
gccccagtgtggtcaagcagcc

SEQ ID NO: 9442 - DNA, 22 bp, Artificial
  HSbrain_260; human brain D71F8O202GR0JB sequence
ctcagggggtggctgggtgctg

SEQ ID NO: 9443 - DNA, 21 bp, Artificial
  HSbrain_261; human brain D703HKJ01B20TG sequence
tgctgaccagctgaggatagg

SEQ ID NO: 9444 - DNA, 21 bp, Artificial
  HSbrain_262; human brain D4G3XZT01C2CC4 sequence
ttggatgatatctgtaggagg

SEQ ID NO: 9445 - DNA, 19 bp, Artificial
  HSbrain_263; human brain D71F8O202HR3LP sequence
aaagcagccaggaatatgt

SEQ ID NO: 9446 - DNA, 18 bp, Artificial
  HSbrain_264; human brain D71F8O202HVL2A sequence
tggctcaattcagcaagg

SEQ ID NO: 9447 - DNA, 21 bp, Artificial
  HSbrain_265; human brain D4G3XZT02HEJMH sequence
cttgctgcccaggcccagggg

SEQ ID NO: 9448 - DNA, 21 bp, Artificial
  HSbrain_266; human brain D4G3YLC01A3WIX sequence
ttccacctgccagggctgccc

SEQ ID NO: 9449 - DNA, 18 bp, Artificial
  HSbrain_267; human brain D703HKJ02ISNN2 sequence
tcctgtccaggtggaagt

SEQ ID NO: 9450 - DNA, 21 bp, Artificial
  HSbrain_268; human brain D4G3XZT01DP1RW sequence
tctgaagtggagtgaagcctc

SEQ ID NO: 9451 - DNA, 22 bp, Artificial
  HSbrain_269; human brain D703HKJ02J28KA sequence
ttgcaccagttgcctgcaggtt

SEQ ID NO: 9452 - DNA, 20 bp, Artificial
  HSbrain_26; human brain D703HKJ01CG1KU sequence
accccatgggaactctactg

SEQ ID NO: 9453 - DNA, 18 bp, Artificial
  HSbrain_270; human brain D71F8O201CZAKL sequence
ttttggctgagcctgccc

SEQ ID NO: 9454 - DNA, 19 bp, Artificial
  HSbrain_271; human brain D4G3YLC01BJEX8 sequence
ccatgtgcgtggtggtccg

SEQ ID NO: 9455 - DNA, 22 bp, Artificial
  HSbrain_272; human brain D71F8O201BN1AP sequence
ttggcacagtgagctgagaatg

SEQ ID NO: 9456 - DNA, 19 bp, Artificial
  HSbrain_273; human brain D703HKJ01ERGHD sequence
ggcctggtggcaggaaggg

SEQ ID NO: 9457 - DNA, 19 bp, Artificial
  HSbrain_274; human brain D703HKJ01AY0MX sequence
tattgaaaggctcctgggg

SEQ ID NO: 9458 - DNA, 22 bp, Artificial
  HSbrain_275; human brain D703HKJ02J1QRQ sequence
ggcccgggaaggcggcctaggg

SEQ ID NO: 9459 - DNA, 21 bp, Artificial
  HSbrain_276; human brain D71F8O202IHJDI sequence
ttgggtgacatttgcagatgt

SEQ ID NO: 9460 - DNA, 18 bp, Artificial
  HSbrain_277; human brain D71F8O201DKTOX sequence
ctcccgctgaagtgctga

SEQ ID NO: 9461 - DNA, 19 bp, Artificial
  HSbrain_278; human brain D4G3XZT02JUVN2 sequence
agtggggctccgctgatgc

SEQ ID NO: 9462 - DNA, 20 bp, Artificial
  HSbrain_279; human brain D4G3XZT02HVINQ sequence
ggcggcaggggtggctccgg

SEQ ID NO: 9463 - DNA, 21 bp, Artificial
  HSbrain_27; human brain D4G3XZT02FTRIB sequence
ggcagagcagtccagaacacg

SEQ ID NO: 9464 - DNA, 21 bp, Artificial
  HSbrain_280; human brain D71F8O202GV7R8 sequence
tgggccagggagcagctggtg

SEQ ID NO: 9465 - DNA, 24 bp, Artificial
  HSbrain_280; human brain D71F8O202JVYYL sequence
ctgggccagggagcagctggtggg

SEQ ID NO: 9466 - DNA, 21 bp, Artificial
  HSbrain_281; human brain D4G3YLC02F4GJ2 sequence
ctcaagtgggaccagcctatc

SEQ ID NO: 9467 - DNA, 23 bp, Artificial
  HSbrain_282; human brain D71F8O202IDL82 sequence
agaacgagctggaggattctgcc

SEQ ID NO: 9468 - DNA, 23 bp, Artificial
  HSbrain_283; human brain D4G3XZT02IPUW9 sequence
atgggagagagaagggctggttc

SEQ ID NO: 9469 - DNA, 21 bp, Artificial
  HSbrain_283; human brain D71F8O202GNSWK sequence
tgggagagagaagggctggtt

SEQ ID NO: 9470 - DNA, 22 bp, Artificial
  HSbrain_283; human brain D71F8O202JVII5 sequence
tgggagagagaagggctggttc

SEQ ID NO: 9471 - DNA, 22 bp, Artificial
  HSbrain_284; human brain D4G3XZT02HKSG7 sequence
ttccctgagatctctgtctttg

SEQ ID NO: 9472 - DNA, 20 bp, Artificial
  HSbrain_285; human brain D703HKJ01CCHF8 sequence
gctggtggtgggcccggctg

SEQ ID NO: 9473 - DNA, 21 bp, Artificial
  HSbrain_286; human brain D703HKJ01B0UDY sequence
gtcctggacagatgttacctt

SEQ ID NO: 9474 - DNA, 21 bp, Artificial
  HSbrain_287; human brain D4HE26K01EX6N1 sequence
atggagggagcccctgagagg

SEQ ID NO: 9475 - DNA, 19 bp, Artificial
  HSbrain_288; human brain D4HE26K01AI848 sequence
ccgctggtggtggctctcg

SEQ ID NO: 9476 - DNA, 20 bp, Artificial
  HSbrain_289; human brain D4G3XZT01DEEAV sequence
tgcagatgcccagacctcgg

SEQ ID NO: 9477 - DNA, 19 bp, Artificial
  HSbrain_28; human brain D4G3XZT02G9TMW sequence
gtgatgggcccgggcctgg

SEQ ID NO: 9478 - DNA, 20 bp, Artificial
  HSbrain_290; human brain D71F8O202HWJQR sequence
ctgcccagcaccaccacctc

SEQ ID NO: 9479 - DNA, 22 bp, Artificial
  HSbrain_291; human brain D4G3XZT01DN688 sequence
tttgaaggagaagagagcaagg

SEQ ID NO: 9480 - DNA, 22 bp, Artificial
  HSbrain_292; human brain D71F8O202JJPKP sequence
tgggggagggacagcgctgacc

SEQ ID NO: 9481 - DNA, 19 bp, Artificial
  HSbrain_294, MQbrain_2410; human brain D4G3YLC02FTQFJ, human brain D71F8O201CISK3, human brain D71F8O202HMQGN, macaque brain D708YRU01DWFOE, macaque brain D708ZXV02G5KCG sequence
atttgtgcttggctctgtc

SEQ ID NO: 9482 - DNA, 22 bp, Artificial
  HSbrain_295; human brain D703HKJ01CMRX0 sequence
ttcagtaagtggagatgtaact

SEQ ID NO: 9483 - DNA, 22 bp, Artificial
  HSbrain_296; human brain D703HKJ01E6FJ8 sequence
gcagtgactgtttggcagcttc

SEQ ID NO: 9484 - DNA, 21 bp, Artificial
  HSbrain_298, HSbrain_416, HSbrain_577, HSbrain_579; human brain D703HKJ01EYM8B sequence
tatgcagcctgtgaacagcgt

SEQ ID NO: 9485 - DNA, 23 bp, Artificial
  HSbrain_3, HSbrain_324, HSbrain_405; human brain D703HKJ01ASH2I sequence
tctgttggcatctccccatgctc

SEQ ID NO: 9486 - DNA, 20 bp, Artificial
  HSbrain_300, HSbrain_301, HSbrain_403, HSbrain_788; human brain D71F8O201BDOQP sequence
tgggacactatgatgaggct

SEQ ID NO: 9487 - DNA, 28 bp, Artificial
  HSbrain_302; human brain D4G3YLC01BK6F8 sequence
acacacctgtgtaggaggccaagacttg

SEQ ID NO: 9488 - DNA, 25 bp, Artificial
  HSbrain_303; human brain D71F8O202JFZXK sequence
aaggctgtgggcaaggtcatccctg

SEQ ID NO: 9489 - DNA, 21 bp, Artificial
  HSbrain_304; human brain D71F8O202I8FGC sequence
tctgccccctccgctgctgcc

SEQ ID NO: 9490 - DNA, 19 bp, Artificial
  HSbrain_305, HSbrain_306, HSbrain_307; human brain D71F8O202GX5QA sequence
aggctgctgacggaggagg

SEQ ID NO: 9491 - DNA, 27 bp, Artificial
  HSbrain_308; human brain D4G3XZT01EPBHF sequence
gtcaggcccaggtgccctcgttccgtc

SEQ ID NO: 9492 - DNA, 22 bp, Artificial
  HSbrain_309; human brain D703HKJ02IINFE sequence
tgggcctcaccggagctttgcc

SEQ ID NO: 9493 - DNA, 23 bp, Artificial
  HSbrain_30; human brain D71F8O201AL71D sequence
ctcctctctctcaccctcctgtc

SEQ ID NO: 9494 - DNA, 20 bp, Artificial
  HSbrain_310; human brain D71F8O202HF7VR sequence
ctctcgtgccagcttctgcc

SEQ ID NO: 9495 - DNA, 23 bp, Artificial
  HSbrain_312; human brain D71F8O202G6ZVF sequence
ttgaagagtacagtgctgacgtg

SEQ ID NO: 9496 - DNA, 21 bp, Artificial
  HSbrain_313; human brain D71F8O202JM8BZ sequence
agttgtgatggaggggagagg

SEQ ID NO: 9497 - DNA, 19 bp, Artificial
  HSbrain_314; human brain D71F8O201EMS60 sequence
gctgaagagaccttgcctg

SEQ ID NO: 9498 - DNA, 19 bp, Artificial
  HSbrain_315; human brain D4G3XZT01EQ25C sequence
gtgggtgaggggctgcgtg

SEQ ID NO: 9499 - DNA, 18 bp, Artificial
  HSbrain_316; human brain D4HE26K01EDLWO sequence
tggaggtgtcctgtgtgc

SEQ ID NO: 9500 - DNA, 23 bp, Artificial
  HSbrain_317; human brain D4G3XZT02HCBGK sequence
ctgagaaggacagccagcacttc

SEQ ID NO: 9501 - DNA, 21 bp, Artificial
  HSbrain_318; human brain D71F8O201D2AG4 sequence
agggcctgggaggatgtgggc

SEQ ID NO: 9502 - DNA, 21 bp, Artificial
  HSbrain_319; human brain D4G3XZT01CX6QR sequence
tcccagcagaggcttcaggtg

SEQ ID NO: 9503 - DNA, 18 bp, Artificial
  HSbrain_31; human brain D71F8O201CI90H sequence
tgggcaggggtgacttgg

SEQ ID NO: 9504 - DNA, 19 bp, Artificial
  HSbrain_320; human brain D703HKJ01C6K6T, human brain D703HKJ01EQ1RA sequence
actgcagtgaaggcctttg

SEQ ID NO: 9505 - DNA, 18 bp, Artificial
  HSbrain_321; human brain D71F8O202F7ROH sequence
gaggccctgggaggtgtc

SEQ ID NO: 9506 - DNA, 19 bp, Artificial
  HSbrain_322; human brain D71F8O201D52OW sequence
tgtgtgatcctgggcatcg

SEQ ID NO: 9507 - DNA, 23 bp, Artificial
  HSbrain_323; human brain D703HKJ02GWOFB sequence
ctgctcctctgtcctccgcccgg

SEQ ID NO: 9508 - DNA, 23 bp, Artificial
  HSbrain_325; human brain D71F8O202HR2YT sequence
agacgtttgaggattccaatctg

SEQ ID NO: 9509 - DNA, 21 bp, Artificial
  HSbrain_326; human brain D4G3XZT01BOAJP sequence
ccctccgtgctgcgtccctcg

SEQ ID NO: 9510 - DNA, 21 bp, Artificial
  HSbrain_327; human brain D4HE26K02FS9J5 sequence
cggccagcctggtggccaagg

SEQ ID NO: 9511 - DNA, 19 bp, Artificial
  HSbrain_328, HSbrain_558, HSbrain_591, HSbrain_783, HSbrain_802, HSbrain_810; human brain D703HKJ02GZG3T sequence
gcctggcggccatcgtggc

SEQ ID NO: 9512 - DNA, 20 bp, Artificial
  HSbrain_328, HSbrain_558, HSbrain_591; human brain D703HKJ01EG5O5 sequence
gcctggcggccatcgtggct

SEQ ID NO: 9513 - DNA, 22 bp, Artificial
  HSbrain_329; human brain D703HKJ02G2G5C sequence
ttgctaatgagtggtggtcctg

SEQ ID NO: 9514 - DNA, 21 bp, Artificial
  HSbrain_32; human brain D71F8O202I0CZN sequence
ccagccctgcctcccccctgc

SEQ ID NO: 9515 - DNA, 20 bp, Artificial
  HSbrain_330; human brain D71F8O201CLWUZ sequence
gcctgggtcttggggactgg

SEQ ID NO: 9516 - DNA, 23 bp, Artificial
  HSbrain_332, HSbrain_758; human brain D703HKJ02IGVZ3 sequence
cccaggtcgcaggctcctcaggc

SEQ ID NO: 9517 - DNA, 20 bp, Artificial
  HSbrain_333; human brain D703HKJ01D73ZP sequence
ctgccagccactcttgaggt

SEQ ID NO: 9518 - DNA, 21 bp, Artificial
  HSbrain_334; human brain D71F8O202IE3X3 sequence
ggcggtggtggtggtggatgg

SEQ ID NO: 9519 - DNA, 19 bp, Artificial
  HSbrain_335; human brain D703HKJ02G7397 sequence
ccgctctcagctcagtcct

SEQ ID NO: 9520 - DNA, 22 bp, Artificial
  HSbrain_336, HSbrain_339; human brain D703HKJ02G2HSP sequence
agatgtgatgagcaagccttgg

SEQ ID NO: 9521 - DNA, 20 bp, Artificial
  HSbrain_337; human brain D703HKJ01D3CCC, human brain D703HKJ02JNYK2 sequence
atatgggtttactagttggt

SEQ ID NO: 9522 - DNA, 20 bp, Artificial
  HSbrain_338; human brain D4G3XZT01CAGBS sequence
atgagctgaaggtgacagtc

SEQ ID NO: 9523 - DNA, 20 bp, Artificial
  HSbrain_33; human brain D71F8O202F8XNA sequence
gaacgtggaggatgaggccg

SEQ ID NO: 9524 - DNA, 20 bp, Artificial
  HSbrain_341, HSbrain_793; human brain D703HKJ01D10AE, human brain D703HKJ02I70DT sequence
catctgcattgctctcatgg

SEQ ID NO: 9525 - DNA, 21 bp, Artificial
  HSbrain_342; human brain D703HKJ02G0HTY sequence
aagacagagaaagagtgagtg

SEQ ID NO: 9526 - DNA, 20 bp, Artificial
  HSbrain_343, HSbrain_344, HSbrain_530; human brain D71F8O202J0EM1 sequence
gttgcctgtgctagttcatg

SEQ ID NO: 9527 - DNA, 21 bp, Artificial
  HSbrain_345; human brain D71F8O202GPPQ2 sequence
tctggttctgtagctgagagc

SEQ ID NO: 9528 - DNA, 20 bp, Artificial
  HSbrain_346; human brain D4G3YLC02FXIN3 sequence
gggacaggtggacaacggtc

SEQ ID NO: 9529 - DNA, 25 bp, Artificial
  HSbrain_347; human brain D4G3XZT02GYBIU sequence
agcggaaggtggaggtgggtagccc

SEQ ID NO: 9530 - DNA, 20 bp, Artificial
  HSbrain_348; human brain D4HE26K02JO9TD sequence
ctggctggagggagagcacc

SEQ ID NO: 9531 - DNA, 22 bp, Artificial
  HSbrain_349; human brain D4G3XZT01CY4K0 sequence
ttctaaggttagaagctcatcc

SEQ ID NO: 9532 - DNA, 25 bp, Artificial
  HSbrain_34; human brain D703HKJ01DI3OJ sequence
acctccagcctggtgcccagtgctc

SEQ ID NO: 9533 - DNA, 18 bp, Artificial
  HSbrain_350; human brain D4G3YLC01ASW2P sequence
agtggagggaatgggccg

SEQ ID NO: 9534 - DNA, 21 bp, Artificial
  HSbrain_351; human brain D4G3YLC02JPYAD sequence
acctgacctcccatgcctgtg

SEQ ID NO: 9535 - DNA, 20 bp, Artificial
  HSbrain_352; human brain D71F8O201A5WL7 sequence
gctgacgagagaacacctgg

SEQ ID NO: 9536 - DNA, 25 bp, Artificial
  HSbrain_353; human brain D703HKJ02JUDYV sequence
gtggctggggtccctgcaggtcatg

SEQ ID NO: 9537 - DNA, 22 bp, Artificial
  HSbrain_354; human brain D71F8O201D3KZM sequence
aaatgcaagtaaaacaggtttg

SEQ ID NO: 9538 - DNA, 20 bp, Artificial
  HSbrain_355; human brain D703HKJ01AV373 sequence
gaggagagtaaagtcgaagt

SEQ ID NO: 9539 - DNA, 18 bp, Artificial
  HSbrain_356, HSbrain_357; human brain D4G3YLC02HPJJP sequence
atggtttgtggaatggct

SEQ ID NO: 9540 - DNA, 20 bp, Artificial
  HSbrain_358; human brain D4G3XZT01DSP8I sequence
gaagcctcatggaggacatg

SEQ ID NO: 9541 - DNA, 22 bp, Artificial
  HSbrain_359; human brain D4G3XZT01CNJSG sequence
tggggagatcctcgaggttggc

SEQ ID NO: 9542 - DNA, 26 bp, Artificial
  HSbrain_35; human brain D4G3XZT02H78L4 sequence
agctggtgagggccatgtttgtgttg

SEQ ID NO: 9543 - DNA, 21 bp, Artificial
  HSbrain_360; human brain D71F8O201ERNSA sequence
aaaggttagtgtgacggtagc

SEQ ID NO: 9544 - DNA, 20 bp, Artificial
  HSbrain_361; human brain D4G3XZT02IAD51 sequence
ggtggggcaatgggatcagg

SEQ ID NO: 9545 - DNA, 21 bp, Artificial
  HSbrain_361; human brain D71F8O201B8DTS sequence
gtggggcaatgggatcaggtg

SEQ ID NO: 9546 - DNA, 22 bp, Artificial
  HSbrain_361; human brain D71F8O201DVYZW sequence
ggtggggcaatgggatcaggtg

SEQ ID NO: 9547 - DNA, 18 bp, Artificial
  HSbrain_362; human brain D703HKJ01BBL0P sequence
tacaaggagaagaacgcc

SEQ ID NO: 9548 - DNA, 21 bp, Artificial
  HSbrain_363; human brain D71F8O201DFKRZ sequence
agacctagctgggtgtctccc

SEQ ID NO: 9549 - DNA, 23 bp, Artificial
  HSbrain_364; human brain D71F8O201EANR9 sequence
gaggaggtgcatagtcatcatgc

SEQ ID NO: 9550 - DNA, 21 bp, Artificial
  HSbrain_365, HSbrain_391; human brain D71F8O201AEUH7 sequence
gggtgtgggtgctgggctggg

SEQ ID NO: 9551 - DNA, 20 bp, Artificial
  HSbrain_366; human brain D71F8O201BSUZV sequence
gactgtggatgaggctgtgc

SEQ ID NO: 9552 - DNA, 20 bp, Artificial
  HSbrain_367, HSbrain_404; human brain D71F8O202G8RVR sequence
tgcaggcctagggcggcggg

SEQ ID NO: 9553 - DNA, 19 bp, Artificial
  HSbrain_369; human brain D703HKJ02JCVY5 sequence
cagttgagacacttcaggg

SEQ ID NO: 9554 - DNA, 20 bp, Artificial
  HSbrain_36; human brain D71F8O201EAS0L sequence
tctggggacagcagctcctg

SEQ ID NO: 9555 - DNA, 18 bp, Artificial
  HSbrain_370; human brain D4G3XZT01CEJ1N sequence
ttgtggctggtcatgagg

SEQ ID NO: 9556 - DNA, 20 bp, Artificial
  HSbrain_370; human brain D703HKJ01CFKX1 sequence
ttgtggctggtcatgaggct

SEQ ID NO: 9557 - DNA, 19 bp, Artificial
  HSbrain_371; human brain D703HKJ02I6BF5 sequence
tggccctttgtacccctcc

SEQ ID NO: 9558 - DNA, 25 bp, Artificial
  HSbrain_372; human brain D4G3YLC01AGANE sequence
tggagtggggagcaggagccccagg

SEQ ID NO: 9559 - DNA, 21 bp, Artificial
  HSbrain_373; human brain D71F8O201E0K8N sequence
cagccatgtcctactgccagc

SEQ ID NO: 9560 - DNA, 18 bp, Artificial
  HSbrain_374, HSbrain_393; human brain D4G3XZT02H1M50 sequence
tctcatactcccaccccc

SEQ ID NO: 9561 - DNA, 21 bp, Artificial
  HSbrain_375; human brain D71F8O202HO1OI sequence
cgctcagtccccggcggtagc

SEQ ID NO: 9562 - DNA, 19 bp, Artificial
  HSbrain_376; human brain D4G3YLC02GAG8I sequence
tgttgtcagggctggaatg

SEQ ID NO: 9563 - DNA, 22 bp, Artificial
  HSbrain_377; human brain D703HKJ02GFC3F sequence
atagcccggtcgctggtacatg

SEQ ID NO: 9564 - DNA, 24 bp, Artificial
  HSbrain_378; human brain D4G3YLC01ENQM8 sequence
ggcagtgtggactcaggccctggg

SEQ ID NO: 9565 - DNA, 20 bp, Artificial
  HSbrain_379; human brain D4G3XZT02H4GO5 sequence
tcggggcactcgggtctttg

SEQ ID NO: 9566 - DNA, 23 bp, Artificial
  HSbrain_37; human brain D703HKJ01C56C6 sequence
ttttcagttatttccaagccagg

SEQ ID NO: 9567 - DNA, 19 bp, Artificial
  HSbrain_380; human brain D703HKJ01DZI4Z sequence
attggcgagtgtgtgcgtg

SEQ ID NO: 9568 - DNA, 20 bp, Artificial
  HSbrain_380; human brain D703HKJ02HBLAG sequence
attggcgagtgtgtgcgtgc

SEQ ID NO: 9569 - DNA, 25 bp, Artificial
  HSbrain_381; human brain D71F8O202GL1XP sequence
agtctgatgttgagaggttcttcca

SEQ ID NO: 9570 - DNA, 21 bp, Artificial
  HSbrain_382; human brain D71F8O202FD8KB sequence
ctgtgtgcagggccctgtggg

SEQ ID NO: 9571 - DNA, 19 bp, Artificial
  HSbrain_383; human brain D71F8O202JHQSW sequence
cttgaaggtcaggggcttt

SEQ ID NO: 9572 - DNA, 20 bp, Artificial
  HSbrain_384; human brain D71F8O201DZWVG sequence
cctctttgggcgactgctgg

SEQ ID NO: 9573 - DNA, 24 bp, Artificial
  HSbrain_385; human brain D703HKJ01ERFF0 sequence
ctgcctgcagccagggctggggtt

SEQ ID NO: 9574 - DNA, 20 bp, Artificial
  HSbrain_386; human brain D703HKJ01DWEOD sequence
cctgtcgttttcagcctgtc

SEQ ID NO: 9575 - DNA, 25 bp, Artificial
  HSbrain_387; human brain D703HKJ01C24IH sequence
gtgcctcaaggggaggctggacccc

SEQ ID NO: 9576 - DNA, 21 bp, Artificial
  HSbrain_388; human brain D71F8O202J1SFD sequence
ttgtgctgactgctgagaatc

SEQ ID NO: 9577 - DNA, 24 bp, Artificial
  HSbrain_389; human brain D71F8O202JH5GH sequence
ctgcccctgcctgagaacgccatc

SEQ ID NO: 9578 - DNA, 18 bp, Artificial
  HSbrain_38; human brain D71F8O202HDXH6 sequence
ttgtggaggcgccgtcgc

SEQ ID NO: 9579 - DNA, 22 bp, Artificial
  HSbrain_390; human brain D703HKJ02JN064 sequence
cggccctgctcctgcctctttg

SEQ ID NO: 9580 - DNA, 26 bp, Artificial
  HSbrain_392; human brain D4G3YLC01D9UMX sequence
ccaggccctgggaccccttgccaggg

SEQ ID NO: 9581 - DNA, 21 bp, Artificial
  HSbrain_393; human brain D4HE26K01BN5VC sequence
ccatctcatactcccaccccc

SEQ ID NO: 9582 - DNA, 19 bp, Artificial
  HSbrain_393; human brain D71F8O202JC3PW sequence
ccatctcatactcccaccc

SEQ ID NO: 9583 - DNA, 20 bp, Artificial
  HSbrain_395; human brain D703HKJ02HIOSU sequence
tgttcaggggccgcatgtcc

SEQ ID NO: 9584 - DNA, 27 bp, Artificial
  HSbrain_396; human brain D4G3XZT02I6U6H sequence
ggccggtcccaggagcggaggcagccc

SEQ ID NO: 9585 - DNA, 23 bp, Artificial
  HSbrain_397; human brain D4G3YLC01ASKLX sequence
tttctaaacccacacagcctagc

SEQ ID NO: 9586 - DNA, 21 bp, Artificial
  HSbrain_398, HSbrain_500; human brain D4G3YLC01CSGC5 sequence
attatcgaggcgattctgatc

SEQ ID NO: 9587 - DNA, 21 bp, Artificial
  HSbrain_398, HSbrain_500; human brain D71F8O202FPK5Q sequence
atcgaggcgattctgatctgg

SEQ ID NO: 9588 - DNA, 18 bp, Artificial
  HSbrain_399, HSbrain_507; human brain D71F8O201E0KS4 sequence
tttggagaaaagtctggc

SEQ ID NO: 9589 - DNA, 21 bp, Artificial
  HSbrain_39; human brain D4G3XZT02JEKZI sequence
gctgcggcctccaggatcctg

SEQ ID NO: 9590 - DNA, 18 bp, Artificial
  HSbrain_4, PT_73; chimp brain 208715, human brain D4HE26K02I0338 sequence
tgagacaggcttatgctg

SEQ ID NO: 9591 - DNA, 23 bp, Artificial
  HSbrain_400, HSbrain_508, HSbrain_511; human brain D4G3XZT01CL6BL sequence
gatccctctgtcctcactctctg

SEQ ID NO: 9592 - DNA, 18 bp, Artificial
  HSbrain_401; human brain D71F8O202H3079 sequence
cgtcctgtggtctgcctc

SEQ ID NO: 9593 - DNA, 19 bp, Artificial
  HSbrain_402, HSbrain_588, HSbrain_783, HSbrain_802, HSbrain_810; human brain D4G3XZT02FYDEH sequence
gccgaagatggcggaggtg

SEQ ID NO: 9594 - DNA, 18 bp, Artificial
  HSbrain_407; human brain D71F8O201DF8T8 sequence
ctggcactggctgatggg

SEQ ID NO: 9595 - DNA, 19 bp, Artificial
  HSbrain_407; human brain D71F8O201DL5OA sequence
ctggcactggctgatgggc

SEQ ID NO: 9596 - DNA, 20 bp, Artificial
  HSbrain_408; human brain D703HKJ02F357E sequence
tcttctgctgatctgtgagt

SEQ ID NO: 9597 - DNA, 23 bp, Artificial
  HSbrain_409; human brain D4HE26K02H4Y82 sequence
tctctgccaaccaagccatgacc

SEQ ID NO: 9598 - DNA, 22 bp, Artificial
  HSbrain_40; human brain D4G3YLC01D5Y1C sequence
ggaaggttgcatggctggtccc

SEQ ID NO: 9599 - DNA, 26 bp, Artificial
  HSbrain_410; human brain D4G3XZT02F2CZX sequence
tgaacagtctttgtctcctccccacc

SEQ ID NO: 9600 - DNA, 21 bp, Artificial
  HSbrain_411; human brain D4G3XZT01C1MF7 sequence
atcacattgccagtgattacc

SEQ ID NO: 9601 - DNA, 24 bp, Artificial
  HSbrain_413; human brain D71F8O202GZTMW sequence
atgttcagtgcccagatatcatgg

SEQ ID NO: 9602 - DNA, 23 bp, Artificial
  HSbrain_414; human brain D4G3XZT01C4WCK sequence
ttctggatgagctgttctgtctg

SEQ ID NO: 9603 - DNA, 24 bp, Artificial
  HSbrain_415; human brain D4G3XZT01BAQQ0 sequence
gggagagctcaagctggctgactt

SEQ ID NO: 9604 - DNA, 19 bp, Artificial
  HSbrain_417; human brain D71F8O201EKPD3 sequence
tgagtttagagctgtctgc

SEQ ID NO: 9605 - DNA, 19 bp, Artificial
  HSbrain_418; human brain D4HE26K02IYSM4 sequence
ccccccggagcggccctga

SEQ ID NO: 9606 - DNA, 26 bp, Artificial
  HSbrain_419; human brain D4HE26K02IOIJH sequence
tctccttcttcttggtcctggctccc

SEQ ID NO: 9607 - DNA, 21 bp, Artificial
  HSbrain_41; human brain D71F8O202GZRV2 sequence
gatgggatgaacctggagctt

SEQ ID NO: 9608 - DNA, 18 bp, Artificial
  HSbrain_420; human brain D703HKJ02JATXU sequence
ggtcagttccgggtggtc

SEQ ID NO: 9609 - DNA, 23 bp, Artificial
  HSbrain_423; human brain D71F8O201AZE3V sequence
attcctgagcctttggtacagtt

SEQ ID NO: 9610 - DNA, 20 bp, Artificial
  HSbrain_425, HSbrain_744; human brain D703HKJ02I9ROP sequence
gttgtcagtggaggggaagg

SEQ ID NO: 9611 - DNA, 19 bp, Artificial
  HSbrain_426; human brain D4G3XZT01B96NE sequence
actttctggctgaggatgg

SEQ ID NO: 9612 - DNA, 23 bp, Artificial
  HSbrain_427; human brain D71F8O201B5EEZ sequence
gaagatggctctgtgatcgaacg

SEQ ID NO: 9613 - DNA, 18 bp, Artificial
  HSbrain_428; human brain D703HKJ01CMOD4 sequence
agcctgggactgaggagg

SEQ ID NO: 9614 - DNA, 23 bp, Artificial
  HSbrain_429, HSbrain_610; human brain D703HKJ02HU1O1 sequence
ctgggaatgagtccaccagctcc

SEQ ID NO: 9615 - DNA, 22 bp, Artificial
  HSbrain_42; human brain D4HE26K02I4JNN sequence
ctactcctggggcggcttctcc

SEQ ID NO: 9616 - DNA, 21 bp, Artificial
  HSbrain_430; human brain D71F8O202IJCBO sequence
gagggctggacggcggaaagg

SEQ ID NO: 9617 - DNA, 20 bp, Artificial
  HSbrain_431; human brain D71F8O202F8JG4 sequence
ctcttactctcctgagctcc

SEQ ID NO: 9618 - DNA, 21 bp, Artificial
  HSbrain_432, MQbrain_2574, PT_282; chimp brain 11891, human brain D4HE26K02I8U27, macaque brain D4G3X1F01ENRKZ sequence
tgagtaccgccatgtctgttg

SEQ ID NO: 9619 - DNA, 23 bp, Artificial
  HSbrain_432, PT_282; chimp brain 60050, human brain D4G3XZT02G58PM sequence
tgagtaccgccatgtctgttggg

SEQ ID NO: 9620 - DNA, 24 bp, Artificial
  HSbrain_433; human brain D4G3YLC02GACX9 sequence
aggacttctactgcgtgacttgcc

SEQ ID NO: 9621 - DNA, 20 bp, Artificial
  HSbrain_434; human brain D703HKJ01DQRIG sequence
ttctcaagagggaggcaatc

SEQ ID NO: 9622 - DNA, 22 bp, Artificial
  HSbrain_435; human brain D703HKJ02ITDB2 sequence
tagtcccttccttgaagcggtc

SEQ ID NO: 9623 - DNA, 25 bp, Artificial
  HSbrain_436; human brain D71F8O201AWO4C sequence
ggtgctgagtgtcccagcgggtacc

SEQ ID NO: 9624 - DNA, 22 bp, Artificial
  HSbrain_437, HSbrain_438; human brain D71F8O202IPMHM sequence
ccgagggactcctggccagtgt

SEQ ID NO: 9625 - DNA, 24 bp, Artificial
  HSbrain_439; human brain D4G3XZT02H0S3X sequence
tgtctttgtgttctgtggtacttg

SEQ ID NO: 9626 - DNA, 22 bp, Artificial
  HSbrain_43; human brain D71F8O202I5UUD sequence
tgcctggtcccctgcttactgc

SEQ ID NO: 9627 - DNA, 20 bp, Artificial
  HSbrain_440; human brain D4HE26K01EJ0SM sequence
gtgagggtggaggagagccc

SEQ ID NO: 9628 - DNA, 20 bp, Artificial
  HSbrain_441; human brain D4G3YLC02IMK0Q sequence
cagccacctccagctcttcc

SEQ ID NO: 9629 - DNA, 20 bp, Artificial
  HSbrain_442; human brain D71F8O202HSYWC sequence
gctgtggtggccagagctgc

SEQ ID NO: 9630 - DNA, 26 bp, Artificial
  HSbrain_443; human brain D71F8O201CK97K sequence
actttgtcagaggcacaaaagggttt

SEQ ID NO: 9631 - DNA, 22 bp, Artificial
  HSbrain_444; human brain D4G3XZT02IN62X sequence
aagtgtgatatgtgtgtatatg

SEQ ID NO: 9632 - DNA, 19 bp, Artificial
  HSbrain_444; human brain D703HKJ02FX3HF sequence
tgtgatatgtgtgtatatg

SEQ ID NO: 9633 - DNA, 23 bp, Artificial
  HSbrain_446; human brain D4G3XZT01D38PI sequence
accatgagctgaacctaaactcc

SEQ ID NO: 9634 - DNA, 21 bp, Artificial
  HSbrain_448; human brain D71F8O202JJ9IM sequence
tgtagaattgtgggctgtagc

SEQ ID NO: 9635 - DNA, 24 bp, Artificial
  HSbrain_449; human brain D4G3YLC01C1V4U sequence
cttctgtccctgtaactgctttcc

SEQ ID NO: 9636 - DNA, 26 bp, Artificial
  HSbrain_449; human brain D4G3YLC01DW21Q sequence
cttctgtccctgtaactgctttcctt

SEQ ID NO: 9637 - DNA, 21 bp, Artificial
  HSbrain_44; human brain D4G3XZT02I14AN sequence
caggagccagggggtgactgg

SEQ ID NO: 9638 - DNA, 20 bp, Artificial
  HSbrain_450; human brain D4HE26K01EHOEU sequence
tcgcctccctcgctcgtctc

SEQ ID NO: 9639 - DNA, 26 bp, Artificial
  HSbrain_451; human brain D4HE26K01D4FTI sequence
tgctctggccaagcgcgtgcgacttc

SEQ ID NO: 9640 - DNA, 19 bp, Artificial
  HSbrain_452; human brain D703HKJ02HXK79 sequence
actcccagtccagggctca

SEQ ID NO: 9641 - DNA, 18 bp, Artificial
  HSbrain_453; human brain D703HKJ02FMKTZ sequence
ctctgtctcctcccctcc

SEQ ID NO: 9642 - DNA, 25 bp, Artificial
  HSbrain_454; human brain D4G3YLC02IQ6KI sequence
tttttgtgggaatgggccctgcttt

SEQ ID NO: 9643 - DNA, 21 bp, Artificial
  HSbrain_455; human brain D71F8O201D255V sequence
tagggttgggccgaggccggg

SEQ ID NO: 9644 - DNA, 19 bp, Artificial
  HSbrain_456; human brain D4G3XZT01EJ4L5, human brain D4G3XZT01ENKF0 sequence
tcctgccttcctctgcacc

SEQ ID NO: 9645 - DNA, 20 bp, Artificial
  HSbrain_457; human brain D4G3XZT01CW628 sequence
tgtgtgggtgggaaggactg

SEQ ID NO: 9646 - DNA, 19 bp, Artificial
  HSbrain_458; human brain D703HKJ02H7E00 sequence
ttccatgcctcctagaagt

SEQ ID NO: 9647 - DNA, 25 bp, Artificial
  HSbrain_459; human brain D71F8O202JGLUP sequence
ttgaacctcagtgcgcacagaaccc

SEQ ID NO: 9648 - DNA, 18 bp, Artificial
  HSbrain_45; human brain D71F8O202HUU4X sequence
ggaggaggttgagggctg

SEQ ID NO: 9649 - DNA, 19 bp, Artificial
  HSbrain_460; human brain D4G3YLC01B3PV6 sequence
tttctctcgcctctgctgc

SEQ ID NO: 9650 - DNA, 18 bp, Artificial
  HSbrain_461; human brain D71F8O202ISG9Z sequence
tggagctcaggattctgg

SEQ ID NO: 9651 - DNA, 21 bp, Artificial
  HSbrain_463; human brain D71F8O202JY6P4 sequence
ttgggattggtggggtgggtt

SEQ ID NO: 9652 - DNA, 21 bp, Artificial
  HSbrain_464; human brain D4G3XZT01CV0IW sequence
gcagcccagctgaggcctctg

SEQ ID NO: 9653 - DNA, 20 bp, Artificial
  HSbrain_465; human brain D71F8O201AKY24 sequence
ccactctctgcttccaggcc

SEQ ID NO: 9654 - DNA, 24 bp, Artificial
  HSbrain_466, HSbrain_58; human brain D4G3YLC02HIESS sequence
ctacgaggaggtcaaggaccgctg

SEQ ID NO: 9655 - DNA, 22 bp, Artificial
  HSbrain_467; human brain D4G3XZT02GJCRG sequence
tggccaggtcaggcctgccctg

SEQ ID NO: 9656 - DNA, 23 bp, Artificial
  HSbrain_468; human brain D71F8O201D14S6 sequence
tccaggacaaaggccccatcgtg

SEQ ID NO: 9657 - DNA, 24 bp, Artificial
  HSbrain_469; human brain D71F8O202J3COI sequence
gaagaggcacacaagaaggagagg

SEQ ID NO: 9658 - DNA, 19 bp, Artificial
  HSbrain_470, HSbrain_560; human brain D71F8O201EF20V sequence
tgaggggagaatgaggtgg

SEQ ID NO: 9659 - DNA, 20 bp, Artificial
  HSbrain_470; human brain D4HE26K01B66J3, human brain D703HKJ02F4KHB sequence
ttgaggggagaatgaggtgg

SEQ ID NO: 9660 - DNA, 20 bp, Artificial
  HSbrain_470; human brain D4HE26K01EZMA4 sequence
cttgaggggagaatgaggtg

SEQ ID NO: 9661 - DNA, 25 bp, Artificial
  HSbrain_471; human brain D703HKJ01ENBMK sequence
caggattccctgactgtgccagccc

SEQ ID NO: 9662 - DNA, 19 bp, Artificial
  HSbrain_472; human brain D71F8O201D7KAG sequence
tgggcagagtgtggaggtg

SEQ ID NO: 9663 - DNA, 23 bp, Artificial
  HSbrain_473; human brain D4G3XZT01DMBYF sequence
gaaatgagttttgttgagaatgc

SEQ ID NO: 9664 - DNA, 21 bp, Artificial
  HSbrain_474; human brain D4HE26K01ESOF0 sequence
ctccttggggtaactccagcc

SEQ ID NO: 9665 - DNA, 18 bp, Artificial
  HSbrain_475; human brain D71F8O201DL8NB sequence
gatggaggacagattgtg

SEQ ID NO: 9666 - DNA, 25 bp, Artificial
  HSbrain_476; human brain D71F8O202IOGQE sequence
tgtggcatctcggcacctgtgcgtg

SEQ ID NO: 9667 - DNA, 19 bp, Artificial
  HSbrain_477; human brain D703HKJ01BQIFO sequence
gtcccgtgggctgaccgct

SEQ ID NO: 9668 - DNA, 23 bp, Artificial
  HSbrain_478; human brain D703HKJ01BGLJN sequence
tttggcatataaagataaacatg

SEQ ID NO: 9669 - DNA, 24 bp, Artificial
  HSbrain_479; human brain D703HKJ01DS6ET sequence
cattgggagccatgaagttgtctt

SEQ ID NO: 9670 - DNA, 18 bp, Artificial
  HSbrain_47; human brain D4G3XZT01BJ8YU sequence
tgggtaggggtgggttgg

SEQ ID NO: 9671 - DNA, 22 bp, Artificial
  HSbrain_480; human brain D4G3YLC01CO420 sequence
cataagtgctgcacgacccttt

SEQ ID NO: 9672 - DNA, 19 bp, Artificial
  HSbrain_481, HSbrain_540, HSbrain_543, HSbrain_546; human brain D4G3XZT02F1E46 sequence
aaatgtgaccctcgccatg

SEQ ID NO: 9673 - DNA, 24 bp, Artificial
  HSbrain_482; human brain D4G3XZT01DWL1U sequence
ggactggcgagcgcggcgcagcgg

SEQ ID NO: 9674 - DNA, 23 bp, Artificial
  HSbrain_483; human brain D71F8O202JSRLE sequence
ctccgaggtgccctgagctgtgc

SEQ ID NO: 9675 - DNA, 20 bp, Artificial
  HSbrain_484; human brain D4G3YLC01BR4HE sequence
actgtgtccatgattgaagg

SEQ ID NO: 9676 - DNA, 19 bp, Artificial
  HSbrain_485; human brain D4G3XZT01CXMEN, human brain D71F8O202F915W sequence
gctggggaggcaaagggcg

SEQ ID NO: 9677 - DNA, 18 bp, Artificial
  HSbrain_486; human brain D4G3XZT01A2NJS sequence
agtcccatcagccacccc

SEQ ID NO: 9678 - DNA, 26 bp, Artificial
  HSbrain_487; human brain D4G3XZT01AR1O8 sequence
aaatgaagcagcagccctgaacttgg

SEQ ID NO: 9679 - DNA, 21 bp, Artificial
  HSbrain_488; human brain D4HE26K01EFUVC sequence
cagggtggctgaggtcctgga

SEQ ID NO: 9680 - DNA, 17 bp, Artificial
  HSbrain_489; human brain D703HKJ02JPMF1 sequence
agcagcacatctggttt

SEQ ID NO: 9681 - DNA, 19 bp, Artificial
  HSbrain_48; human brain D4G3XZT02HXLAB sequence
ttgtggtgggctgggcagg

SEQ ID NO: 9682 - DNA, 20 bp, Artificial
  HSbrain_491; human brain D4G3XZT01DMJA3 sequence
gttgcctttttgttcccatg

SEQ ID NO: 9683 - DNA, 21 bp, Artificial
  HSbrain_491; human brain D703HKJ02IJXRR sequence
gttgcctttttgttcccatgc

SEQ ID NO: 9684 - DNA, 22 bp, Artificial
  HSbrain_492; human brain D4HE26K01C268B sequence
ctctggccatgtctcaactttg

SEQ ID NO: 9685 - DNA, 21 bp, Artificial
  HSbrain_492; human brain D4HE26K02I1L9G sequence
tctggccatgtctcaactttg

SEQ ID NO: 9686 - DNA, 23 bp, Artificial
  HSbrain_492; human brain D71F8O201DTUUR, human brain D71F8O202GBH56 sequence
tctggccatgtctcaactttgtg

SEQ ID NO: 9687 - DNA, 24 bp, Artificial
  HSbrain_492; human brain D71F8O202JJX91 sequence
tctggccatgtctcaactttgtgc

SEQ ID NO: 9688 - DNA, 21 bp, Artificial
  HSbrain_494; human brain D4G3XZT01CD47E sequence
ccttagatgaccatctgtgtg

SEQ ID NO: 9689 - DNA, 18 bp, Artificial
  HSbrain_495; human brain D4HE26K01AQHLJ sequence
agggtcaggatgagggtc

SEQ ID NO: 9690 - DNA, 20 bp, Artificial
  HSbrain_496; human brain D71F8O201B77EZ sequence
agtgttcagagcagctaact

SEQ ID NO: 9691 - DNA, 21 bp, Artificial
  HSbrain_497; human brain D703HKJ02I23JS sequence
tgcagcctgctggcccccatg

SEQ ID NO: 9692 - DNA, 21 bp, Artificial
  HSbrain_498; human brain D4G3XZT02FZA7X sequence
acaacagcctcgttcttcctg

SEQ ID NO: 9693 - DNA, 22 bp, Artificial
  HSbrain_499; human brain D4G3XZT01ALJM1 sequence
atgaatgccatgcagaggcccg

SEQ ID NO: 9694 - DNA, 20 bp, Artificial
  HSbrain_49; human brain D4G3XZT01EL4IC sequence
gggccggctgagcatgaacg

SEQ ID NO: 9695 - DNA, 26 bp, Artificial
  HSbrain_501; human brain D71F8O202HEILN sequence
gtccagaaaatgactccaagtgtgtg

SEQ ID NO: 9696 - DNA, 20 bp, Artificial
  HSbrain_501; human brain D71F8O202J5687 sequence
aaatgactccaagtgtgtgg

SEQ ID NO: 9697 - DNA, 20 bp, Artificial
  HSbrain_502; human brain D71F8O201CK1FF sequence
aacccaggcatctgtgcccc

SEQ ID NO: 9698 - DNA, 20 bp, Artificial
  HSbrain_503; human brain D71F8O202F7VXR sequence
gacaaggcgtgggccacagc

SEQ ID NO: 9699 - DNA, 22 bp, Artificial
  HSbrain_504; human brain D703HKJ02FST7Y sequence
tgccatctccctggctgacagc

SEQ ID NO: 9700 - DNA, 19 bp, Artificial
  HSbrain_505; human brain D4HE26K01ARKLS sequence
tctggggtccagggaatcc

SEQ ID NO: 9701 - DNA, 18 bp, Artificial
  HSbrain_506; human brain D4G3YLC02FLRUM sequence
ccaggaatcctgctgtgg

SEQ ID NO: 9702 - DNA, 19 bp, Artificial
  HSbrain_509; human brain D703HKJ01AIH99 sequence
aagtgtgtcatgaacttgg

SEQ ID NO: 9703 - DNA, 18 bp, Artificial
  HSbrain_50; human brain D4G3XZT02G1NR7 sequence
tgccgagacagagggtgg

SEQ ID NO: 9704 - DNA, 21 bp, Artificial
  HSbrain_510; human brain D71F8O201CHX3V sequence
agggcagagggagaggatctg

SEQ ID NO: 9705 - DNA, 21 bp, Artificial
  HSbrain_512; human brain D71F8O202HLORA sequence
gttctcttgtgtgtgtctccc

SEQ ID NO: 9706 - DNA, 21 bp, Artificial
  HSbrain_513; human brain D71F8O202IDFOD sequence
tgagagtgctttagggtaagg

SEQ ID NO: 9707 - DNA, 21 bp, Artificial
  HSbrain_514; human brain D71F8O201DDKQV sequence
attgggtggagactggtgtgg

SEQ ID NO: 9708 - DNA, 22 bp, Artificial
  HSbrain_515; human brain D4HE26K01BT5MB sequence
aagcctttgtgtccccttctcc

SEQ ID NO: 9709 - DNA, 23 bp, Artificial
  HSbrain_516; human brain D4G3YLC01ECJFS sequence
tggggagggacgcagggcgcccg

SEQ ID NO: 9710 - DNA, 19 bp, Artificial
  HSbrain_517; human brain D71F8O202GMMSW sequence
tggagcacagccaagatgg

SEQ ID NO: 9711 - DNA, 27 bp, Artificial
  HSbrain_518; human brain D71F8O202J0P92 sequence
ttggggaagaggccatgggagctgtgg

SEQ ID NO: 9712 - DNA, 22 bp, Artificial
  HSbrain_519; human brain D71F8O201AF0BI sequence
tctttgtgccctggtgttggtg

SEQ ID NO: 9713 - DNA, 20 bp, Artificial
  HSbrain_51; human brain D703HKJ01AP4UD sequence
atgcccaagtttgccttctc

SEQ ID NO: 9714 - DNA, 23 bp, Artificial
  HSbrain_520; human brain D703HKJ02FKE9O sequence
ttcacacaagcccagctcctctg

SEQ ID NO: 9715 - DNA, 26 bp, Artificial
  HSbrain_521; human brain D4G3XZT01AQ2ZC sequence
ccgtgccctcgagagggacgacttcg

SEQ ID NO: 9716 - DNA, 19 bp, Artificial
  HSbrain_522; human brain D4G3YLC01BXZBS sequence
gctggctgctggaagaagg

SEQ ID NO: 9717 - DNA, 18 bp, Artificial
  HSbrain_523; human brain D4G3XZT02JBX9L sequence
agagcaccaagtctggcc

SEQ ID NO: 9718 - DNA, 20 bp, Artificial
  HSbrain_524; human brain D703HKJ01B7LA2 sequence
gtgaggatggcaggacagcc

SEQ ID NO: 9719 - DNA, 20 bp, Artificial
  HSbrain_525; human brain D71F8O202JEZRR sequence
tcccaacatcccatcccagc

SEQ ID NO: 9720 - DNA, 25 bp, Artificial
  HSbrain_526; human brain D71F8O202G3PT7 sequence
tctgcagggagagccctggccaccc

SEQ ID NO: 9721 - DNA, 22 bp, Artificial
  HSbrain_527; human brain D71F8O202JN77S sequence
cgaggaccccccctgcctggcc

SEQ ID NO: 9722 - DNA, 20 bp, Artificial
  HSbrain_528; human brain D4G3XZT01EGZK3 sequence
aggaggaggtgactgctgtg

SEQ ID NO: 9723 - DNA, 21 bp, Artificial
  HSbrain_529; human brain D4G3YLC02JCI56 sequence
aagggtcaatgcattttgggg

SEQ ID NO: 9724 - DNA, 20 bp, Artificial
  HSbrain_52; human brain D703HKJ01A4IYJ sequence
ccgtgtgtttgaggcccagc

SEQ ID NO: 9725 - DNA, 24 bp, Artificial
  HSbrain_531; human brain D703HKJ01AMP4Z sequence
gtgcttgtgtgtatgtctatgtgt

SEQ ID NO: 9726 - DNA, 19 bp, Artificial
  HSbrain_532; human brain D71F8O201DZK3N sequence
taatgagaattctgggctt

SEQ ID NO: 9727 - DNA, 18 bp, Artificial
  HSbrain_534; human brain D71F8O202F3FAN sequence
ggtagatgcagcggagtc

SEQ ID NO: 9728 - DNA, 19 bp, Artificial
  HSbrain_535; human brain D4G3YLC02HMN3I sequence
atgatcacatcctattccg

SEQ ID NO: 9729 - DNA, 18 bp, Artificial
  HSbrain_536; human brain D4G3XZT01EMONJ sequence
gaaaaggtcatggaggcc

SEQ ID NO: 9730 - DNA, 22 bp, Artificial
  HSbrain_537; human brain D703HKJ02IRNDP sequence
atgggtgatgggtgtggtgtcc

SEQ ID NO: 9731 - DNA, 24 bp, Artificial
  HSbrain_538; human brain D703HKJ01A34S0 sequence
actgactttaaggacctggtcttg

SEQ ID NO: 9732 - DNA, 18 bp, Artificial
  HSbrain_539, HSbrain_542, HSbrain_649; human brain D703HKJ02HSXRM sequence
tggagacctggccaaggt

SEQ ID NO: 9733 - DNA, 18 bp, Artificial
  HSbrain_53; human brain D71F8O202JONDG sequence
tctgccctcctactcccc

SEQ ID NO: 9734 - DNA, 19 bp, Artificial
  HSbrain_541, HSbrain_544, HSbrain_545; human brain D4G3XZT01D9DPR sequence
tatgcccctgtcatctctg

SEQ ID NO: 9735 - DNA, 21 bp, Artificial
  HSbrain_547; human brain D4G3YLC01CVZ8H sequence
ttccgagggagtcaggatggg

SEQ ID NO: 9736 - DNA, 26 bp, Artificial
  HSbrain_548; human brain D4HE26K01C33SA sequence
gggaagggagacgaggtgtgctgttc

SEQ ID NO: 9737 - DNA, 18 bp, Artificial
  HSbrain_549; human brain D71F8O201AYO1E sequence
ggaggcggtggtggtggt

SEQ ID NO: 9738 - DNA, 21 bp, Artificial
  HSbrain_54; human brain D71F8O201C3WO2 sequence
gacttgggaggcggactactc

SEQ ID NO: 9739 - DNA, 19 bp, Artificial
  HSbrain_550; human brain D4G3XZT01B5CHX sequence
atgtgtgaggagagggtgg

SEQ ID NO: 9740 - DNA, 18 bp, Artificial
  HSbrain_551; human brain D703HKJ01C8635 sequence
ccagcctggagggaaggg

SEQ ID NO: 9741 - DNA, 19 bp, Artificial
  HSbrain_552; human brain D71F8O201BY8PH sequence
tgcagccctcccagcgtcg

SEQ ID NO: 9742 - DNA, 22 bp, Artificial
  HSbrain_553; human brain D4G3YLC02IS1C3 sequence
gtatggtgggtgtcctgaattc

SEQ ID NO: 9743 - DNA, 22 bp, Artificial
  HSbrain_554; human brain D4G3YLC01AKLSJ sequence
gtgtttgggagcctcatcattg

SEQ ID NO: 9744 - DNA, 22 bp, Artificial
  HSbrain_555; human brain D703HKJ02GP9KC sequence
ttgctggctgcagccgtgggcc

SEQ ID NO: 9745 - DNA, 21 bp, Artificial
  HSbrain_556; human brain D703HKJ01EHARY sequence
ggttccccatgtacagctatg

SEQ ID NO: 9746 - DNA, 22 bp, Artificial
  HSbrain_557; human brain D703HKJ02F8HR7 sequence
tgcagccttgacccaggttggg

SEQ ID NO: 9747 - DNA, 23 bp, Artificial
  HSbrain_557; human brain D703HKJ02JM0UR sequence
tgcagccttgacccaggttgggc

SEQ ID NO: 9748 - DNA, 24 bp, Artificial
  HSbrain_559; human brain D703HKJ02I8L6X sequence
ttctggaatgggagacagaggtgg

SEQ ID NO: 9749 - DNA, 18 bp, Artificial
  HSbrain_55; human brain D4G3YLC02F1SDK sequence
ggacggggtggctggacc

SEQ ID NO: 9750 - DNA, 20 bp, Artificial
  HSbrain_561; human brain D71F8O201CX4OH sequence
ttaggccgcagatctgggtg

SEQ ID NO: 9751 - DNA, 18 bp, Artificial
  HSbrain_562; human brain D703HKJ01CSIRZ sequence
ttgaggctgcaccccggg

SEQ ID NO: 9752 - DNA, 21 bp, Artificial
  HSbrain_563; human brain D4HE26K02I4VKN sequence
atttctgatgctcttcccctg

SEQ ID NO: 9753 - DNA, 21 bp, Artificial
  HSbrain_564; human brain D4G3XZT02HZIO7 sequence
aaggtgaaggtgaaactggtt

SEQ ID NO: 9754 - DNA, 23 bp, Artificial
  HSbrain_565; human brain D71F8O202G7TET sequence
ctctgccagagccagctcctggt

SEQ ID NO: 9755 - DNA, 22 bp, Artificial
  HSbrain_566; human brain D703HKJ02G94J2 sequence
acctcgcaggagacgcctcggc

SEQ ID NO: 9756 - DNA, 26 bp, Artificial
  HSbrain_567; human brain D4G3YLC01DJK7G sequence
tctgggtgacgctgctgagcatggtg

SEQ ID NO: 9757 - DNA, 21 bp, Artificial
  HSbrain_568; human brain D703HKJ01CL01J sequence
tggctgggtttgcgtgcaggt

SEQ ID NO: 9758 - DNA, 18 bp, Artificial
  HSbrain_569; human brain D71F8O201DYYMN sequence
tttcctccgccgctgtcg

SEQ ID NO: 9759 - DNA, 20 bp, Artificial
  HSbrain_56; human brain D4G3XZT02JEJ8R sequence
aggctggaacatggcagagg

SEQ ID NO: 9760 - DNA, 22 bp, Artificial
  HSbrain_570; human brain D4G3XZT01B022U, human brain D4G3XZT01C61GX, human brain D4G3XZT02JXSTE, human brain D71F8O202HDRE0, human brain D71F8O202HZZHG sequence
ctggctgcttcccttggtctcc

SEQ ID NO: 9761 - DNA, 20 bp, Artificial
  HSbrain_570; human brain D4G3XZT02F6MZQ sequence
tggctgcttcccttggtctc

SEQ ID NO: 9762 - DNA, 21 bp, Artificial
  HSbrain_570; human brain D71F8O201DB4EM sequence
ctggctgcttcccttggtctc

SEQ ID NO: 9763 - DNA, 21 bp, Artificial
  HSbrain_570; human brain D71F8O201DG63P sequence
tggctgcttcccttggtctcc

SEQ ID NO: 9764 - DNA, 19 bp, Artificial
  HSbrain_571; human brain D703HKJ02H9ZNH, human brain D71F8O201AYW8S sequence
cactgcttcacttgctgcc

SEQ ID NO: 9765 - DNA, 18 bp, Artificial
  HSbrain_572; human brain D71F8O202JX408 sequence
aaagaggaggtgcagctg

SEQ ID NO: 9766 - DNA, 19 bp, Artificial
  HSbrain_573; human brain D703HKJ02I7HQ8 sequence
aatggcggtagttggtgtg

SEQ ID NO: 9767 - DNA, 23 bp, Artificial
  HSbrain_574; human brain D703HKJ01EJS3A sequence
cccgcgtgtgcccactgtgctcc

SEQ ID NO: 9768 - DNA, 19 bp, Artificial
  HSbrain_575; human brain D4G3XZT01DC4S2 sequence
cactcctccttcctcctgc

SEQ ID NO: 9769 - DNA, 19 bp, Artificial
  HSbrain_578; human brain D4G3XZT02I1P4A, human brain D4G3XZT02JNXTL, human brain D703HKJ01EDCNA, human brain D71F8O201BU0Q6 sequence
tctgcaagtgtcagaggcg

SEQ ID NO: 9770 - DNA, 22 bp, Artificial
  HSbrain_578; human brain D4G3YLC02GE5S7, human brain D4HE26K01EEUHV, human brain D4HE26K02HDVTV, human brain D703HKJ02JVO9C, human brain D71F8O202GUS8Y sequence
tctgcaagtgtcagaggcgagg

SEQ ID NO: 9771 - DNA, 20 bp, Artificial
  HSbrain_57; human brain D4HE26K01DKPVG sequence
ggtgggtgagcggcagaacg

SEQ ID NO: 9772 - DNA, 22 bp, Artificial
  HSbrain_580; human brain D703HKJ01EJJWH sequence
gtacgatgagtttccaggctgg

SEQ ID NO: 9773 - DNA, 22 bp, Artificial
  HSbrain_581; human brain D71F8O202F35FX sequence
ttttctccagcggcctcaggtt

SEQ ID NO: 9774 - DNA, 23 bp, Artificial
  HSbrain_582; human brain D71F8O201DY846 sequence
tgttgtacttttttttttgttcg

SEQ ID NO: 9775 - DNA, 21 bp, Artificial
  HSbrain_583, PT_36; chimp brain 133908, human brain D71F8O201EKRHK sequence
cactgggcaccaagtctgtgt

SEQ ID NO: 9776 - DNA, 20 bp, Artificial
  HSbrain_583; human brain D4G3YLC01C8KOA sequence
cactgggcaccaagtctgtg

SEQ ID NO: 9777 - DNA, 20 bp, Artificial
  HSbrain_584; human brain D703HKJ02JFPOU sequence
ctgggaggcagggctattgg

SEQ ID NO: 9778 - DNA, 20 bp, Artificial
  HSbrain_585; human brain D71F8O202J0IA5 sequence
gtggcatggtgaccagtctg

SEQ ID NO: 9779 - DNA, 21 bp, Artificial
  HSbrain_586; human brain D71F8O201B1HF7 sequence
tgcttcctagtgccgagcccc

SEQ ID NO: 9780 - DNA, 22 bp, Artificial
  HSbrain_587; human brain D703HKJ01AYYJX sequence
tccacagggtccagatccgagt

SEQ ID NO: 9781 - DNA, 18 bp, Artificial
  HSbrain_590; human brain D703HKJ01CSEU4 sequence
gaggccatgggactggtg

SEQ ID NO: 9782 - DNA, 19 bp, Artificial
  HSbrain_592; human brain D703HKJ01ERSG3 sequence
tgggagccgggagccactg

SEQ ID NO: 9783 - DNA, 19 bp, Artificial
  HSbrain_593; human brain D4HE26K02ID1PP sequence
aaggtgggcgaggcctagg

SEQ ID NO: 9784 - DNA, 21 bp, Artificial
  HSbrain_594; human brain D4G3YLC01EWXWF sequence
gagcagcccactcctgtcctg

SEQ ID NO: 9785 - DNA, 20 bp, Artificial
  HSbrain_595, HSbrain_63; human brain D4G3XZT01D81GJ sequence
gagggatgaagggggaaccc

SEQ ID NO: 9786 - DNA, 25 bp, Artificial
  HSbrain_596; human brain D71F8O201BWDWE sequence
ccacaggagcaagggatgtctgagc

SEQ ID NO: 9787 - DNA, 25 bp, Artificial
  HSbrain_597; human brain D4G3YLC01C5U6H sequence
gaggatggactagaaggcctgggcc

SEQ ID NO: 9788 - DNA, 21 bp, Artificial
  HSbrain_599; human brain D703HKJ01BUZR6 sequence
tgggacagctggagaggagtc

SEQ ID NO: 9789 - DNA, 20 bp, Artificial
  HSbrain_59; human brain D71F8O201CTIWK sequence
ggtgagctttaatctgaggg

SEQ ID NO: 9790 - DNA, 21 bp, Artificial
  HSbrain_5; human brain D4HE26K02H8Z74 sequence
gctgtgatggtgtcaggcctc

SEQ ID NO: 9791 - DNA, 24 bp, Artificial
  HSbrain_600; human brain D703HKJ02H1ZYV sequence
ctcctatggagtatccgtccaagg

SEQ ID NO: 9792 - DNA, 18 bp, Artificial
  HSbrain_601; human brain D71F8O202JNFWM sequence
acaatatcctgtgctggt

SEQ ID NO: 9793 - DNA, 24 bp, Artificial
  HSbrain_602; human brain D71F8O201EF19S sequence
ctgcctgtgatgaatgctaagtgg

SEQ ID NO: 9794 - DNA, 18 bp, Artificial
  HSbrain_603; human brain D71F8O202IVG9G sequence
tgaactgggagctctagc

SEQ ID NO: 9795 - DNA, 21 bp, Artificial
  HSbrain_604; human brain D4G3YLC01APU1Q sequence
ggactaggagtttacgtgctt

SEQ ID NO: 9796 - DNA, 21 bp, Artificial
  HSbrain_605; human brain D71F8O201B14O9 sequence
tgagcatgaggagccaggctt

SEQ ID NO: 9797 - DNA, 21 bp, Artificial
  HSbrain_606; human brain D4G3YLC01CPBWK sequence
ttccttggcccacagtgtccc

SEQ ID NO: 9798 - DNA, 22 bp, Artificial
  HSbrain_607; human brain D71F8O202H8O56 sequence
tagggagtgcgtagcagggtgg

SEQ ID NO: 9799 - DNA, 19 bp, Artificial
  HSbrain_608; human brain D703HKJ01CMW4Y sequence
ggtccgctgggaggagtgc

SEQ ID NO: 9800 - DNA, 23 bp, Artificial
  HSbrain_609; human brain D4G3YLC01CP72I sequence
ccggcttggtcctgcggtccctt

SEQ ID NO: 9801 - DNA, 19 bp, Artificial
  HSbrain_60; human brain D4G3XZT02JGIZS sequence
ctttagaatgctgacatct

SEQ ID NO: 9802 - DNA, 19 bp, Artificial
  HSbrain_611; human brain D71F8O201C3O4A sequence
gtggaggcttgtcaggggg

SEQ ID NO: 9803 - DNA, 20 bp, Artificial
  HSbrain_612; human brain D4G3XZT02JIPM7 sequence
ggtggaggggaggccagtgt

SEQ ID NO: 9804 - DNA, 21 bp, Artificial
  HSbrain_613; human brain D703HKJ02I8JUL sequence
caccagtgacccgagccctcc

SEQ ID NO: 9805 - DNA, 27 bp, Artificial
  HSbrain_614; human brain D71F8O202FWEMN sequence
ctgccagtgtctcctcccacggggctc

SEQ ID NO: 9806 - DNA, 21 bp, Artificial
  HSbrain_615; human brain D4G3XZT02JZ9F7 sequence
cgagccaatttcctcatcgtc

SEQ ID NO: 9807 - DNA, 24 bp, Artificial
  HSbrain_616; human brain D703HKJ01CGNE3 sequence
gcggcatggtctggttcagtgagg

SEQ ID NO: 9808 - DNA, 20 bp, Artificial
  HSbrain_617; human brain D4G3XZT01BZ46B sequence
gctcactgctgccatggtgg

SEQ ID NO: 9809 - DNA, 21 bp, Artificial
  HSbrain_618; human brain D71F8O202I53D9 sequence
aagagccaagagctggaggtg

SEQ ID NO: 9810 - DNA, 21 bp, Artificial
  HSbrain_619; human brain D4G3XZT01A4JA2 sequence
tgtctagtgtgaagactgtgg

SEQ ID NO: 9811 - DNA, 21 bp, Artificial
  HSbrain_61; human brain D4G3XZT01EAW3W sequence
cctgggggaggacgatgagga

SEQ ID NO: 9812 - DNA, 25 bp, Artificial
  HSbrain_620; human brain D71F8O201DUQZL sequence
gcccactggggaggctgctgtgccc

SEQ ID NO: 9813 - DNA, 19 bp, Artificial
  HSbrain_621; human brain D4G3YLC02JPS04 sequence
cagtgacatgtctgccccc

SEQ ID NO: 9814 - DNA, 18 bp, Artificial
  HSbrain_622; human brain D4G3XZT02HJVY2 sequence
aaggctggcagtgtggtg

SEQ ID NO: 9815 - DNA, 26 bp, Artificial
  HSbrain_624; human brain D71F8O202FNA1J sequence
cccattcttgccttgtgtctttcagt

SEQ ID NO: 9816 - DNA, 19 bp, Artificial
  HSbrain_625; human brain D703HKJ02GY2NU sequence
acggcctgttctgtgaagc

SEQ ID NO: 9817 - DNA, 19 bp, Artificial
  HSbrain_626; human brain D4G3XZT02IP1IO sequence
ctgagccctgtcctcccgc

SEQ ID NO: 9818 - DNA, 22 bp, Artificial
  HSbrain_627, HSbrain_77; human brain D71F8O201AVQJX sequence
cttctcctggcaaagcctcctc

SEQ ID NO: 9819 - DNA, 23 bp, Artificial
  HSbrain_628; human brain D703HKJ01DYWQM sequence
ccccagctggaggccttctcccc

SEQ ID NO: 9820 - DNA, 22 bp, Artificial
  HSbrain_628; human brain D71F8O202FIREJ sequence
cccagctggaggccttctcccc

SEQ ID NO: 9821 - DNA, 28 bp, Artificial
  HSbrain_62; human brain D4G3YLC02HK237 sequence
ccagctctacaggaggtccagattcacc

SEQ ID NO: 9822 - DNA, 22 bp, Artificial
  HSbrain_630; human brain D703HKJ02GXD2F sequence
tggaaagcaaagggtgcattgg

SEQ ID NO: 9823 - DNA, 21 bp, Artificial
  HSbrain_632, HSbrain_735; human brain D71F8O202J3LT9 sequence
tctgggaggggctgggtttgg

SEQ ID NO: 9824 - DNA, 19 bp, Artificial
  HSbrain_633; human brain D71F8O201CZKYH sequence
tggttcgtgcttccgagtt

SEQ ID NO: 9825 - DNA, 19 bp, Artificial
  HSbrain_634; human brain D71F8O202GR5IC sequence
ctgctccaggagccggctg

SEQ ID NO: 9826 - DNA, 23 bp, Artificial
  HSbrain_635; human brain D71F8O201DP7OZ sequence
cccttgtgagctggatagacttg

SEQ ID NO: 9827 - DNA, 21 bp, Artificial
  HSbrain_636; human brain D71F8O202F1KG9 sequence
tggctgggtttgtcagaggtc

SEQ ID NO: 9828 - DNA, 23 bp, Artificial
  HSbrain_637; human brain D4G3XZT01CX2SV sequence
ttggggaggggtatgccatcctg

SEQ ID NO: 9829 - DNA, 23 bp, Artificial
  HSbrain_637; human brain D71F8O201A76GY sequence
tttggggaggggtatgccatcct

SEQ ID NO: 9830 - DNA, 23 bp, Artificial
  HSbrain_638; human brain D4G3YLC02JEJ3W sequence
ctgcgtcccagcttggaggcccc

SEQ ID NO: 9831 - DNA, 23 bp, Artificial
  HSbrain_639; human brain D703HKJ02H9ZN1 sequence
actctctagcatcctggacactc

SEQ ID NO: 9832 - DNA, 19 bp, Artificial
  HSbrain_640; human brain D71F8O202G03S0 sequence
agttcaaggaagctgatgg

SEQ ID NO: 9833 - DNA, 19 bp, Artificial
  HSbrain_641; human brain D703HKJ01BPIZI sequence
tgaaagaggcaagcttgtc

SEQ ID NO: 9834 - DNA, 18 bp, Artificial
  HSbrain_642; human brain D71F8O201EZ0F2 sequence
gagcggaaggctgcagcc

SEQ ID NO: 9835 - DNA, 26 bp, Artificial
  HSbrain_643; human brain D71F8O201DBSEY sequence
gcttctggggaaatggcaggtggttg

SEQ ID NO: 9836 - DNA, 21 bp, Artificial
  HSbrain_644; human brain D4G3XZT01ERV0D, human brain D4G3XZT02F3L1I, human brain D4G3XZT02IW4C2 sequence
tgaagcgcctgtgctctgccg

SEQ ID NO: 9837 - DNA, 22 bp, Artificial
  HSbrain_645, PT_48; chimp brain 147161, human brain D703HKJ01BG47F sequence
aagcattctttcattggttggt

SEQ ID NO: 9838 - DNA, 21 bp, Artificial
  HSbrain_645, PT_48; chimp brain 203780, human brain D71F8O201ENAHE sequence
aagcattctttcattggttgg

SEQ ID NO: 9839 - DNA, 20 bp, Artificial
  HSbrain_646; human brain D703HKJ01E6OR3 sequence
tacaggatccttcagcactg

SEQ ID NO: 9840 - DNA, 22 bp, Artificial
  HSbrain_647; human brain D703HKJ01BKXZJ sequence
cccagccacgcctccttggacc

SEQ ID NO: 9841 - DNA, 19 bp, Artificial
  HSbrain_648; human brain D703HKJ01DH92I sequence
tggtttcctggggctgcgg

SEQ ID NO: 9842 - DNA, 19 bp, Artificial
  HSbrain_64; human brain D4G3XZT01DZ2CT sequence
cctgattgcggcgggggcc

SEQ ID NO: 9843 - DNA, 20 bp, Artificial
  HSbrain_650; human brain D71F8O202IJHTV sequence
ttctggcaaggccccggggt

SEQ ID NO: 9844 - DNA, 23 bp, Artificial
  HSbrain_651; human brain D4G3YLC02GY3ZR sequence
cgctgggggaggaggccgtggcc

SEQ ID NO: 9845 - DNA, 19 bp, Artificial
  HSbrain_652; human brain D4G3XZT01AKOZA sequence
aacccacctgctgctgtcc

SEQ ID NO: 9846 - DNA, 20 bp, Artificial
  HSbrain_653; human brain D4G3XZT01BDOM4 sequence
atcggcggcttgctgagtcc

SEQ ID NO: 9847 - DNA, 23 bp, Artificial
  HSbrain_654; human brain D71F8O202H9U43 sequence
gcctgggcgccaaggacagccgc

SEQ ID NO: 9848 - DNA, 20 bp, Artificial
  HSbrain_655; human brain D703HKJ01AJT7T sequence
tgcacggcactggggacacg

SEQ ID NO: 9849 - DNA, 21 bp, Artificial
  HSbrain_655; human brain D71F8O202ICXMB sequence
tgcacggcactggggacacgt

SEQ ID NO: 9850 - DNA, 24 bp, Artificial
  HSbrain_656; human brain D4G3XZT01BA788 sequence
cggggcagcggtggcggcacagcc

SEQ ID NO: 9851 - DNA, 19 bp, Artificial
  HSbrain_657; human brain D4G3XZT02GAGBM sequence
tccctggggcagctgcttg

SEQ ID NO: 9852 - DNA, 19 bp, Artificial
  HSbrain_658; human brain D71F8O201D9RBZ sequence
ccacagacaaggcaggccc

SEQ ID NO: 9853 - DNA, 20 bp, Artificial
  HSbrain_659; human brain D703HKJ01DBQ0T sequence
gtgagggggctgccaggggt

SEQ ID NO: 9854 - DNA, 21 bp, Artificial
  HSbrain_65; human brain D4G3XZT01BI9GV, human brain D4G3XZT01CLR64 sequence
acggccagagaggtgaccccg

SEQ ID NO: 9855 - DNA, 20 bp, Artificial
  HSbrain_65; human brain D71F8O201D8N4U sequence
acggccagagaggtgacccc

SEQ ID NO: 9856 - DNA, 27 bp, Artificial
  HSbrain_660; human brain D71F8O201C3RQQ sequence
ttttgggggcagctggccacgggcacc

SEQ ID NO: 9857 - DNA, 23 bp, Artificial
  HSbrain_661; human brain D4HE26K01EB691 sequence
agtccctggggcttgggttttcc

SEQ ID NO: 9858 - DNA, 19 bp, Artificial
  HSbrain_662; human brain D703HKJ02F89QS sequence
ccgagagctgcctggtgtc

SEQ ID NO: 9859 - DNA, 19 bp, Artificial
  HSbrain_663; human brain D71F8O201A0Q27 sequence
accttctgtagccagagcc

SEQ ID NO: 9860 - DNA, 18 bp, Artificial
  HSbrain_664; human brain D71F8O201A5J6S sequence
ctgggcagggtacaaggg

SEQ ID NO: 9861 - DNA, 22 bp, Artificial
  HSbrain_665; human brain D71F8O202IT0DM sequence
gggaggggactgttgaggttct

SEQ ID NO: 9862 - DNA, 21 bp, Artificial
  HSbrain_668, HSbrain_676, HSbrain_679, HSbrain_685, HSbrain_688; human brain D4G3XZT02IWWDV sequence
agctgaggcggccccctgccc

SEQ ID NO: 9863 - DNA, 24 bp, Artificial
  HSbrain_668, HSbrain_676, HSbrain_679, HSbrain_685, HSbrain_688; human brain D4G3YLC01AZKZU sequence
agctgaggcggccccctgcccacc

SEQ ID NO: 9864 - DNA, 22 bp, Artificial
  HSbrain_668, HSbrain_676, HSbrain_679, HSbrain_685, HSbrain_688; human brain D703HKJ01A9TJE sequence
ctgaggcggccccctgcccacc

SEQ ID NO: 9865 - DNA, 21 bp, Artificial
  HSbrain_669, HSbrain_673, HSbrain_677, HSbrain_680, HSbrain_684, HSbrain_687; human brain D4G3XZT02FMYGP sequence
gtgggtgccgtaggggtcggg

SEQ ID NO: 9866 - DNA, 19 bp, Artificial
  HSbrain_66; human brain D4G3XZT02IFGT9 sequence
agaggtggggccgagactt

SEQ ID NO: 9867 - DNA, 24 bp, Artificial
  HSbrain_671; human brain D4G3XZT01BV5DK sequence
acctgcggagtgtctgctctatcc

SEQ ID NO: 9868 - DNA, 19 bp, Artificial
  HSbrain_675; human brain D703HKJ02JVXE2 sequence
ctctgcttttctcttcgcc

SEQ ID NO: 9869 - DNA, 21 bp, Artificial
  HSbrain_67; human brain D71F8O201C950K sequence
tccaccccttacacctgccct

SEQ ID NO: 9870 - DNA, 19 bp, Artificial
  HSbrain_682; human brain D71F8O201CSFGY sequence
ttttctaagctggttggtt

SEQ ID NO: 9871 - DNA, 22 bp, Artificial
  HSbrain_689; human brain D4G3YLC01BRLWS sequence
ctcaaggctgatttgaagaagg

SEQ ID NO: 9872 - DNA, 21 bp, Artificial
  HSbrain_68; human brain D4G3XZT01A933M sequence
agacgctggagctgagtgcgg

SEQ ID NO: 9873 - DNA, 23 bp, Artificial
  HSbrain_68; human brain D703HKJ01CPI6Y sequence
ctggagctgagtgcggatgggcg

SEQ ID NO: 9874 - DNA, 23 bp, Artificial
  HSbrain_690; human brain D71F8O202FDY0A sequence
ctcctctgtcctctccctttccc

SEQ ID NO: 9875 - DNA, 18 bp, Artificial
  HSbrain_691; human brain D71F8O202HQ8DI sequence
aagagagaagggagaggg

SEQ ID NO: 9876 - DNA, 24 bp, Artificial
  HSbrain_692; human brain D71F8O201CV3QF sequence
tgaaggcctggggcgggaagaagg

SEQ ID NO: 9877 - DNA, 25 bp, Artificial
  HSbrain_693; human brain D4G3YLC01CDSC7 sequence
agcctcgggcccccacggcgccttc

SEQ ID NO: 9878 - DNA, 22 bp, Artificial
  HSbrain_694; human brain D71F8O202IYPLF sequence
tggagtggccagtgtggcagtg

SEQ ID NO: 9879 - DNA, 24 bp, Artificial
  HSbrain_695; human brain D71F8O202G48SG sequence
caaggctgagccaggccaggttgg

SEQ ID NO: 9880 - DNA, 22 bp, Artificial
  HSbrain_696; human brain D71F8O201ESJIR sequence
cccctcatctgaccagctgctc

SEQ ID NO: 9881 - DNA, 22 bp, Artificial
  HSbrain_697; human brain D71F8O201B1KP0 sequence
tggaacgacgtggccgggctgg

SEQ ID NO: 9882 - DNA, 25 bp, Artificial
  HSbrain_698; human brain D4HE26K01DTP4Q sequence
gtggggctagccggctgtctggagg

SEQ ID NO: 9883 - DNA, 19 bp, Artificial
  HSbrain_699; human brain D4G3XZT01CYQCU sequence
ttttgggtagctgatcttg

SEQ ID NO: 9884 - DNA, 22 bp, Artificial
  HSbrain_69; human brain D4G3XZT02GEO30 sequence
gaagttctgaggctggacatcg

SEQ ID NO: 9885 - DNA, 18 bp, Artificial
  HSbrain_6; human brain D71F8O201DWJYC sequence
ttggggcatgctgatggg

SEQ ID NO: 9886 - DNA, 22 bp, Artificial
  HSbrain_700; human brain D71F8O201BIX8D sequence
atctgtggccagagaggtttgc

SEQ ID NO: 9887 - DNA, 20 bp, Artificial
  HSbrain_701; human brain D71F8O202I58VI sequence
agagggcggagtcagagtga

SEQ ID NO: 9888 - DNA, 23 bp, Artificial
  HSbrain_702; human brain D71F8O201CBMCD sequence
aagaatggcacagggcacatggt

SEQ ID NO: 9889 - DNA, 22 bp, Artificial
  HSbrain_702; human brain D71F8O201E1NNO sequence
aagaatggcacagggcacatgg

SEQ ID NO: 9890 - DNA, 19 bp, Artificial
  HSbrain_703; human brain D71F8O201AYU4Z sequence
agggagacaggagacaggc

SEQ ID NO: 9891 - DNA, 22 bp, Artificial
  HSbrain_704; human brain D71F8O201EXUKV sequence
agttggcaagcgagcaatttcc

SEQ ID NO: 9892 - DNA, 23 bp, Artificial
  HSbrain_705; human brain D703HKJ01C2LEY sequence
ggcagagcctcggtgcagcaggg

SEQ ID NO: 9893 - DNA, 20 bp, Artificial
  HSbrain_707; human brain D703HKJ02HUM5L sequence
ggatctggatgctgcctgtg

SEQ ID NO: 9894 - DNA, 28 bp, Artificial
  HSbrain_708; human brain D4G3XZT01AFAY5 sequence
agtggacacgggagcagggggtttagtg

SEQ ID NO: 9895 - DNA, 26 bp, Artificial
  HSbrain_709; human brain D4G3XZT01B3DO5 sequence
ctgggcacggtggtggtggattaccg

SEQ ID NO: 9896 - DNA, 18 bp, Artificial
  HSbrain_70; human brain D4G3YLC02F9SQ5 sequence
tcagggctcagggattgg

SEQ ID NO: 9897 - DNA, 24 bp, Artificial
  HSbrain_710; human brain D71F8O202IBOU8 sequence
tagcatgcgtgcagctctctcctg

SEQ ID NO: 9898 - DNA, 21 bp, Artificial
  HSbrain_711; human brain D71F8O201A9E7F sequence
tcctgggttgcggcgtctgct

SEQ ID NO: 9899 - DNA, 19 bp, Artificial
  HSbrain_712; human brain D71F8O202G6A91 sequence
gttgtaccttggtgggggg

SEQ ID NO: 9900 - DNA, 19 bp, Artificial
  HSbrain_713; human brain D71F8O202IW8BK sequence
tgagctggaggggggtctc

SEQ ID NO: 9901 - DNA, 22 bp, Artificial
  HSbrain_714; human brain D4G3YLC01ASDDV sequence
accctcagtccgtattggtctc

SEQ ID NO: 9902 - DNA, 20 bp, Artificial
  HSbrain_714; human brain D703HKJ02GWNUS sequence
accctcagtccgtattggtc

SEQ ID NO: 9903 - DNA, 20 bp, Artificial
  HSbrain_714; human brain D71F8O202GYQ6I sequence
ctcagtccgtattggtctct

SEQ ID NO: 9904 - DNA, 21 bp, Artificial
  HSbrain_715; human brain D4G3XZT02GJEN4 sequence
tgcctggcgggaaggtcctgg

SEQ ID NO: 9905 - DNA, 22 bp, Artificial
  HSbrain_715; human brain D703HKJ02JLXBL sequence
ctgcctggcgggaaggtcctgg

SEQ ID NO: 9906 - DNA, 19 bp, Artificial
  HSbrain_716; human brain D4G3XZT01EVL9W sequence
tccccagtggccaccttgg

SEQ ID NO: 9907 - DNA, 22 bp, Artificial
  HSbrain_716; human brain D71F8O201B3M5S sequence
ccgtccccagtggccaccttgg

SEQ ID NO: 9908 - DNA, 21 bp, Artificial
  HSbrain_716; human brain D71F8O201DVINU sequence
cgtccccagtggccaccttgg

SEQ ID NO: 9909 - DNA, 19 bp, Artificial
  HSbrain_717; human brain D4G3XZT02HF95B sequence
ttgccttgccccatctttt

SEQ ID NO: 9910 - DNA, 20 bp, Artificial
  HSbrain_718; human brain D71F8O202GTH5B sequence
tgaccccattgtcctcttcc

SEQ ID NO: 9911 - DNA, 19 bp, Artificial
  HSbrain_719; human brain D703HKJ01AXBCK sequence
tgggtttccaggagctgcc

SEQ ID NO: 9912 - DNA, 19 bp, Artificial
  HSbrain_71; human brain D71F8O202JPOF6 sequence
tgccctgcatggtgtcccc

SEQ ID NO: 9913 - DNA, 25 bp, Artificial
  HSbrain_720; human brain D4HE26K01E3QJ0 sequence
caggggttttaggaggaaggcttgg

SEQ ID NO: 9914 - DNA, 18 bp, Artificial
  HSbrain_721; human brain D703HKJ01BW5HU sequence
agccagaggagttgtccg

SEQ ID NO: 9915 - DNA, 21 bp, Artificial
  HSbrain_722; human brain D703HKJ02INYWO sequence
gacttctggtacagcccaacc

SEQ ID NO: 9916 - DNA, 25 bp, Artificial
  HSbrain_723; human brain D703HKJ01CZK6V sequence
agtgatgacaacctgtgggcgtgcc

SEQ ID NO: 9917 - DNA, 19 bp, Artificial
  HSbrain_724; human brain D71F8O202F8ADW sequence
ggaagagcgggcagagtgg

SEQ ID NO: 9918 - DNA, 21 bp, Artificial
  HSbrain_725; human brain D4HE26K01B4NGE sequence
cctggacctctggcagctctg

SEQ ID NO: 9919 - DNA, 18 bp, Artificial
  HSbrain_726; human brain D71F8O202I4BAF sequence
tttgcagtggctgcttgg

SEQ ID NO: 9920 - DNA, 21 bp, Artificial
  HSbrain_727; human brain D71F8O202GZ33A sequence
ccactccagggtctcagagcc

SEQ ID NO: 9921 - DNA, 24 bp, Artificial
  HSbrain_728; human brain D71F8O201C758W sequence
tgaaggcagtggagaagatggtgg

SEQ ID NO: 9922 - DNA, 23 bp, Artificial
  HSbrain_729; human brain D703HKJ02IVXKZ sequence
ttgggataggcgttcagagaagg

SEQ ID NO: 9923 - DNA, 23 bp, Artificial
  HSbrain_72; human brain D703HKJ01C1PW5 sequence
ggtagccgagcctacgggggtgg

SEQ ID NO: 9924 - DNA, 18 bp, Artificial
  HSbrain_730; human brain D703HKJ01EPVFA sequence
tttgtgggtctgaggttg

SEQ ID NO: 9925 - DNA, 18 bp, Artificial
  HSbrain_731; human brain D4G3XZT02FOOVI sequence
ctcggtccgcgcgtcctg

SEQ ID NO: 9926 - DNA, 22 bp, Artificial
  HSbrain_732; human brain D4HE26K02IHQLN sequence
tggtcactctgagttgctcctg

SEQ ID NO: 9927 - DNA, 19 bp, Artificial
  HSbrain_733; human brain D4G3XZT01DDJPQ sequence
atgtgtgtgtgttcatggg

SEQ ID NO: 9928 - DNA, 22 bp, Artificial
  HSbrain_734; human brain D4HE26K01DE0HY sequence
aatctgccagcttccacagtgg

SEQ ID NO: 9929 - DNA, 22 bp, Artificial
  HSbrain_735; human brain D4HE26K02IWDI8 sequence
ctctgggaggggctgggtttgg

SEQ ID NO: 9930 - DNA, 18 bp, Artificial
  HSbrain_736; human brain D71F8O201B1GD1 sequence
ggccgcgtggcctaaagg

SEQ ID NO: 9931 - DNA, 24 bp, Artificial
  HSbrain_737; human brain D4G3XZT01CLJCF sequence
gccatgtgaaagtacggttcagtg

SEQ ID NO: 9932 - DNA, 20 bp, Artificial
  HSbrain_738; human brain D703HKJ02IPK1F sequence
tgagcccagggagaagatgg

SEQ ID NO: 9933 - DNA, 22 bp, Artificial
  HSbrain_739; human brain D71F8O201A6OA5 sequence
tctaggtcaaggcctgtccctg

SEQ ID NO: 9934 - DNA, 19 bp, Artificial
  HSbrain_740; human brain D4HE26K02FYFS5 sequence
gggaggtggtggttatgtg

SEQ ID NO: 9935 - DNA, 19 bp, Artificial
  HSbrain_741; human brain D4G3XZT02G6J1X sequence
tgggagggaagacagctgg

SEQ ID NO: 9936 - DNA, 20 bp, Artificial
  HSbrain_741; human brain D71F8O202FLHNZ sequence
ttgggagggaagacagctgg

SEQ ID NO: 9937 - DNA, 20 bp, Artificial
  HSbrain_742; human brain D4G3XZT01D9PC9 sequence
atcgcttccaaatctaggtc

SEQ ID NO: 9938 - DNA, 21 bp, Artificial
  HSbrain_743; human brain D4G3YLC01AT5AQ sequence
tgggatgggaagagacccggg

SEQ ID NO: 9939 - DNA, 18 bp, Artificial
  HSbrain_745; human brain D703HKJ02HI84W sequence
actcagagccagggaggg

SEQ ID NO: 9940 - DNA, 19 bp, Artificial
  HSbrain_746; human brain D703HKJ01DQBD5 sequence
tgacggacgaggaggagcg

SEQ ID NO: 9941 - DNA, 21 bp, Artificial
  HSbrain_747; human brain D71F8O202FJBX7 sequence
ctctctggttccagcctattg

SEQ ID NO: 9942 - DNA, 26 bp, Artificial
  HSbrain_748; human brain D71F8O201CDK0P sequence
agactggtgagcagactggtgggatc

SEQ ID NO: 9943 - DNA, 22 bp, Artificial
  HSbrain_749; human brain D4HE26K02HSUG8 sequence
atggaggaaagcctggggctgg

SEQ ID NO: 9944 - DNA, 21 bp, Artificial
  HSbrain_74; human brain D4HE26K01DS96B sequence
agctggttggggtggcttagc

SEQ ID NO: 9945 - DNA, 24 bp, Artificial
  HSbrain_750; human brain D703HKJ02IK9I1 sequence
aggacgagatggcccgccacttgc

SEQ ID NO: 9946 - DNA, 19 bp, Artificial
  HSbrain_751; human brain D4G3XZT02F6C8M sequence
agagctgggtcggtactgc

SEQ ID NO: 9947 - DNA, 24 bp, Artificial
  HSbrain_752; human brain D4G3YLC01B5LJ2 sequence
gaggctgagctggagctggagatg

SEQ ID NO: 9948 - DNA, 20 bp, Artificial
  HSbrain_753; human brain D4G3XZT02IO02T, human brain D703HKJ01BCVFZ sequence
tagcagccagagataattgg

SEQ ID NO: 9949 - DNA, 21 bp, Artificial
  HSbrain_754; human brain D71F8O202IFAPJ sequence
ctggactgcctggagaaagcg

SEQ ID NO: 9950 - DNA, 22 bp, Artificial
  HSbrain_755; human brain D71F8O201EFDDZ sequence
ttaagatgactccagctcaggc

SEQ ID NO: 9951 - DNA, 21 bp, Artificial
  HSbrain_756; human brain D703HKJ02HS3W0 sequence
atcaggcccaagtggaggctc

SEQ ID NO: 9952 - DNA, 20 bp, Artificial
  HSbrain_757; human brain D71F8O202G2S7V sequence
atcacatctgagagtcattt

SEQ ID NO: 9953 - DNA, 21 bp, Artificial
  HSbrain_759; human brain D71F8O201A3PDZ sequence
ctccttggtcctcctgatatc

SEQ ID NO: 9954 - DNA, 21 bp, Artificial
  HSbrain_759; human brain D71F8O201DR2AC sequence
actcaggtggtgcaaggaagg

SEQ ID NO: 9955 - DNA, 23 bp, Artificial
  HSbrain_75; human brain D71F8O202FZX0R sequence
gtgattgggaggatgagccctgg

SEQ ID NO: 9956 - DNA, 21 bp, Artificial
  HSbrain_760; human brain D4HE26K01A03IV, human brain D4HE26K02GUMUI, human brain D71F8O201EVTYL sequence
cctcccatgccaagaactccc

SEQ ID NO: 9957 - DNA, 19 bp, Artificial
  HSbrain_760; human brain D4HE26K02FO186 sequence
cctcccatgccaagaactc

SEQ ID NO: 9958 - DNA, 21 bp, Artificial
  HSbrain_760; human brain D703HKJ01A52S2, human brain D703HKJ02G662V, human brain D71F8O201CVHH5 sequence
tcctcccatgccaagaactcc

SEQ ID NO: 9959 - DNA, 20 bp, Artificial
  HSbrain_760; human brain D703HKJ01DPKA7, human brain D703HKJ02JG7HN sequence
ggttcttagcataggaggtc

SEQ ID NO: 9960 - DNA, 22 bp, Artificial
  HSbrain_760; human brain D703HKJ02G6LJT sequence
gtcctcccatgccaagaactcc

SEQ ID NO: 9961 - DNA, 22 bp, Artificial
  HSbrain_760; human brain D71F8O201EMODN sequence
ggttcttagcataggaggtctt

SEQ ID NO: 9962 - DNA, 20 bp, Artificial
  HSbrain_761; human brain D4G3XZT01EEEG2 sequence
tcgggtagggggagtctggg

SEQ ID NO: 9963 - DNA, 23 bp, Artificial
  HSbrain_761; human brain D71F8O201ELNZG sequence
cgggtagggggagtctgggcttc

SEQ ID NO: 9964 - DNA, 19 bp, Artificial
  HSbrain_762; human brain D4G3XZT01EIAT4 sequence
atcctggtgttcagtctgg

SEQ ID NO: 9965 - DNA, 19 bp, Artificial
  HSbrain_762; human brain D703HKJ01D7W4S sequence
cgaggaggtgcagcggctc

SEQ ID NO: 9966 - DNA, 18 bp, Artificial
  HSbrain_762; human brain D71F8O201A80DX sequence
gaggtgcagcggctcagg

SEQ ID NO: 9967 - DNA, 21 bp, Artificial
  HSbrain_763; human brain D4HE26K01AGJ4L sequence
ggagcacaaggatgtgatgtg

SEQ ID NO: 9968 - DNA, 18 bp, Artificial
  HSbrain_763; human brain D4HE26K02IZI67 sequence
aaggatgtgatgtgaggc

SEQ ID NO: 9969 - DNA, 19 bp, Artificial
  HSbrain_766; human brain D4HE26K02IT3KI sequence
atggtgcagtgctttggcc

SEQ ID NO: 9970 - DNA, 24 bp, Artificial
  HSbrain_766; human brain D71F8O201B2JGC sequence
tgactgtggccatggtgtgcacca

SEQ ID NO: 9971 - DNA, 19 bp, Artificial
  HSbrain_767; human brain D71F8O201A4DDC sequence
ttgttctcctcagcctggg

SEQ ID NO: 9972 - DNA, 24 bp, Artificial
  HSbrain_768; human brain D703HKJ01BX7E3 sequence
gcttctgccgaggtgtccctgatg

SEQ ID NO: 9973 - DNA, 19 bp, Artificial
  HSbrain_768; human brain D703HKJ02FP8YC sequence
catttttgacctggggcgg

SEQ ID NO: 9974 - DNA, 19 bp, Artificial
  HSbrain_769; human brain D71F8O202I1G0T sequence
aagcagaaggggctccctg

SEQ ID NO: 9975 - DNA, 24 bp, Artificial
  HSbrain_76; human brain D4G3YLC02HB3RY sequence
atattccttccagacaaaagaccg

SEQ ID NO: 9976 - DNA, 20 bp, Artificial
  HSbrain_770; human brain D4G3YLC02GA59T sequence
ttcgttgtgtctgtagtgtc

SEQ ID NO: 9977 - DNA, 22 bp, Artificial
  HSbrain_771; human brain D4G3YLC01C8VE3 sequence
atggggacagggatcagcatgg

SEQ ID NO: 9978 - DNA, 21 bp, Artificial
  HSbrain_771; human brain D71F8O202FVZN0 sequence
tcccctgctcccttgttcccc

SEQ ID NO: 9979 - DNA, 23 bp, Artificial
  HSbrain_772; human brain D4HE26K01EUOBE sequence
tgggtagagaaggagctcagagg

SEQ ID NO: 9980 - DNA, 18 bp, Artificial
  HSbrain_772; human brain D71F8O202H6I4Y sequence
ttgagccctccctctctc

SEQ ID NO: 9981 - DNA, 22 bp, Artificial
  HSbrain_773; human brain D703HKJ01BES3W sequence
cgctgttgaggactgaattact

SEQ ID NO: 9982 - DNA, 21 bp, Artificial
  HSbrain_773; human brain D703HKJ01DHBAQ sequence
ttgaggcgctgttgaggactg

SEQ ID NO: 9983 - DNA, 20 bp, Artificial
  HSbrain_773; human brain D703HKJ01DM18G sequence
agatgtctttgggttaaatt

SEQ ID NO: 9984 - DNA, 23 bp, Artificial
  HSbrain_774; human brain D703HKJ02JFR84 sequence
cgtccgtggaccacgaggagctg

SEQ ID NO: 9985 - DNA, 24 bp, Artificial
  HSbrain_775; human brain D703HKJ02H3DNE sequence
tccatagagtggactgtctgtgct

SEQ ID NO: 9986 - DNA, 20 bp, Artificial
  HSbrain_776; human brain D4G3XZT02HKAAC sequence
ccgtccgcgtgtggaaggtc

SEQ ID NO: 9987 - DNA, 22 bp, Artificial
  HSbrain_777; human brain D703HKJ01DVPH7 sequence
ctccagtactctgaccagcccc

SEQ ID NO: 9988 - DNA, 19 bp, Artificial
  HSbrain_777; human brain D703HKJ02GA76W sequence
tgattccccaggtgatgcc

SEQ ID NO: 9989 - DNA, 20 bp, Artificial
  HSbrain_778; human brain D4G3XZT02IFY8J sequence
tgatggcagtgctgaggatg

SEQ ID NO: 9990 - DNA, 18 bp, Artificial
  HSbrain_778; human brain D703HKJ01CU9IG sequence
agcagacatcgctcatgg

SEQ ID NO: 9991 - DNA, 22 bp, Artificial
  HSbrain_781; human brain D71F8O202JLONY sequence
tctcgggttccagcttcttggc

SEQ ID NO: 9992 - DNA, 24 bp, Artificial
  HSbrain_782, HSbrain_787, HSbrain_790; human brain D71F8O202JRZFM sequence
gtgggcttcaatgtcaagaatgtg

SEQ ID NO: 9993 - DNA, 21 bp, Artificial
  HSbrain_784; human brain D4G3XZT01D3WH1 sequence
gtgggcatggtgactgtcatt

SEQ ID NO: 9994 - DNA, 19 bp, Artificial
  HSbrain_785; human brain D4G3XZT02JHRXA, human brain D4G3YLC01B6U43, human brain D703HKJ02FH52N, human brain D71F8O201C8ONN, human brain D71F8O202JMZVT sequence
gcccggagagctgggagcc

SEQ ID NO: 9995 - DNA, 18 bp, Artificial
  HSbrain_785; human brain D703HKJ02I8J8B, human brain D71F8O202I0OLA sequence
cccggagagctgggagcc

SEQ ID NO: 9996 - DNA, 23 bp, Artificial
  HSbrain_785; human brain D71F8O201BB31W sequence
ctggctcccttctctccgtctgc

SEQ ID NO: 9997 - DNA, 23 bp, Artificial
  HSbrain_786; human brain D4G3XZT02IWRE5 sequence
ggaggagtggagtgtgcttgtcg

SEQ ID NO: 9998 - DNA, 25 bp, Artificial
  HSbrain_789; human brain D4G3XZT02FYU7Q sequence
ctgtggcatccacgaaactaccttc

SEQ ID NO: 9999 - DNA, 24 bp, Artificial
  HSbrain_78; human brain D71F8O202FRB0V sequence
atgaatgcagtgattgtgggaagt

SEQ ID NO: 10000 - DNA, 21 bp, Artificial
  HSbrain_791, HSbrain_792; human brain D71F8O201B5CCX sequence
tcagggctcgccctccgtggg

SEQ ID NO: 10001 - DNA, 25 bp, Artificial
  HSbrain_794; human brain D703HKJ01D26T4 sequence
ctgagaggggttcctcgtggcctgt

SEQ ID NO: 10002 - DNA, 19 bp, Artificial
  HSbrain_795; human brain D4G3XZT02FNPOH, human brain D4G3XZT02GQ1HQ, human brain D4G3YLC01ARSHS sequence
ttggctggtctctgctccg

SEQ ID NO: 10003 - DNA, 20 bp, Artificial
  HSbrain_795; human brain D4G3YLC01DSCTC, human brain D4HE26K01AD044, human brain D703HKJ01BH74S, human brain D703HKJ02F7KZ4 sequence
ttggctggtctctgctccgc

SEQ ID NO: 10004 - DNA, 19 bp, Artificial
  HSbrain_795; human brain D703HKJ01DTKS2 sequence
gggtggtctctagccaagg

SEQ ID NO: 10005 - DNA, 22 bp, Artificial
  HSbrain_796; human brain D4HE26K01D9RDW sequence
aactgttcatcggctgagaggg

SEQ ID NO: 10006 - DNA, 24 bp, Artificial
  HSbrain_796; human brain D71F8O201DE1LD sequence
catcagttgatgatacgcccgagc

SEQ ID NO: 10007 - DNA, 26 bp, Artificial
  HSbrain_797; human brain D703HKJ02IZ8QL sequence
cctaattgggctgatttgcctgctgc

SEQ ID NO: 10008 - DNA, 22 bp, Artificial
  HSbrain_797; human brain D71F8O201D4FEP sequence
ctaattgggctgatttgcctgc

SEQ ID NO: 10009 - DNA, 23 bp, Artificial
  HSbrain_797; human brain D71F8O201DWAW6 sequence
agggctgagactggggtggggcc

SEQ ID NO: 10010 - DNA, 22 bp, Artificial
  HSbrain_798; human brain D703HKJ02GDQME sequence
accagctggtcggtgatcctct

SEQ ID NO: 10011 - DNA, 20 bp, Artificial
  HSbrain_799, PT_321; chimp brain 97867, human brain D4G3XZT02H7Z1H, human brain D4G3XZT02HP7HM, human brain D4G3YLC02JIUSH, human brain D703HKJ01BTTKZ, human brain D703HKJ02FR1O6, human brain D703HKJ02HAS9W, human brain D703HKJ02IPT3Z, human brain D71F8O201C1OQN
tacccagagcatgcagtgtg

SEQ ID NO: 10012 - DNA, 21 bp, Artificial
  HSbrain_799; human brain D4G3XZT01C7IYM sequence
atacccagagcatgcagtgtg

SEQ ID NO: 10013 - DNA, 18 bp, Artificial
  HSbrain_799; human brain D4G3XZT01CVO3K, human brain D4G3YLC01E2ZFG, human brain D703HKJ02IZJ2P, human brain D71F8O201EAAH8 sequence
cccagagcatgcagtgtg

SEQ ID NO: 10014 - DNA, 19 bp, Artificial
  HSbrain_799; human brain D4G3YLC01EWN0H sequence
ctcattgcatgggctgtgt

SEQ ID NO: 10015 - DNA, 19 bp, Artificial
  HSbrain_799; human brain D4G3YLC02IKEC9 sequence
tacccagagcatgcagtgt

SEQ ID NO: 10016 - DNA, 20 bp, Artificial
  HSbrain_799; human brain D71F8O201EZUSI sequence
acccagagcatgcagtgtga

SEQ ID NO: 10017 - DNA, 19 bp, Artificial
  HSbrain_799; human brain D71F8O202I8EXJ, human brain D71F8O202IJSC5, human brain D71F8O202JMZOS sequence
acccagagcatgcagtgtg

SEQ ID NO: 10018 - DNA, 22 bp, Artificial
  HSbrain_79; human brain D4G3YLC02H7JB7 sequence
tctgctgggtctgggaggaggg

SEQ ID NO: 10019 - DNA, 19 bp, Artificial
  HSbrain_7; human brain D71F8O201DVN2N sequence
ctgtgctgtggctctccga

SEQ ID NO: 10020 - DNA, 19 bp, Artificial
  HSbrain_800; human brain D71F8O202F2183 sequence
aagtgaccgcagtgggagc

SEQ ID NO: 10021 - DNA, 26 bp, Artificial
  HSbrain_801; human brain D703HKJ01BSDO2 sequence
aaatccactggtgagggagtcattcg

SEQ ID NO: 10022 - DNA, 23 bp, Artificial
  HSbrain_801; human brain D71F8O202HCPHQ sequence
tccactggtgagggagtcattcg

SEQ ID NO: 10023 - DNA, 18 bp, Artificial
  HSbrain_803; human brain D4G3YLC01BWSQQ sequence
ataactttggccagttgg

SEQ ID NO: 10024 - DNA, 22 bp, Artificial
  HSbrain_804; human brain D4HE26K01EI50W sequence
gctcctgattggctggtggtgg

SEQ ID NO: 10025 - DNA, 20 bp, Artificial
  HSbrain_805; human brain D703HKJ01BWSCB sequence
ctgccaggggagctctgctg

SEQ ID NO: 10026 - DNA, 19 bp, Artificial
  HSbrain_806; human brain D4G3XZT01BJGN7 sequence
tccccaggtgctgaaatgg

SEQ ID NO: 10027 - DNA, 20 bp, Artificial
  HSbrain_807; human brain D4G3XZT02J31ED sequence
ttgttctcaaactggctgtc

SEQ ID NO: 10028 - DNA, 21 bp, Artificial
  HSbrain_807; human brain D71F8O202I587O sequence
tgcagccacttggggaactgg

SEQ ID NO: 10029 - DNA, 21 bp, Artificial
  HSbrain_808; human brain D4G3YLC01B1XUR sequence
ttcagtgagacgggggctggc

SEQ ID NO: 10030 - DNA, 20 bp, Artificial
  HSbrain_808; human brain D4G3YLC01EHIFZ sequence
ttcagtgagacgggggctgg

SEQ ID NO: 10031 - DNA, 26 bp, Artificial
  HSbrain_809; human brain D4G3XZT02JDXCZ sequence
ctgcatccagtctgtgtcctcctgtc

SEQ ID NO: 10032 - DNA, 24 bp, Artificial
  HSbrain_80; human brain D4G3XZT02F1KND sequence
ctctgcacggtcacaggctccacg

SEQ ID NO: 10033 - DNA, 20 bp, Artificial
  HSbrain_811; human brain D4G3XZT01B7O5R, human brain D4G3XZT01B9BPL, human brain D4G3YLC02I5R2K, human brain D703HKJ01E043O, human brain D703HKJ02JYHJM, human brain D71F8O201CGV6W, human brain D71F8O202H5N08 sequence
tatcatggagttggtaaagc

SEQ ID NO: 10034 - DNA, 22 bp, Artificial
  HSbrain_811; human brain D703HKJ02F3PU3 sequence
ttttaccacctccaggagactg

SEQ ID NO: 10035 - DNA, 19 bp, Artificial
  HSbrain_812, HSbrain_815, HSbrain_879, HSbrain_892, MQbrain_1917, MQbrain_1924,MQbrain_2000, MQbrain_2679; human brain D4G3XZT02F9SAR, human brain D71F8O202HMGPB, macaque brain D4G3X1F01A3S38, macaque brain D708I2V01CRF8C, macaque brain D708YRU01EKC5J
gaaaagctgggttgagagg

SEQ ID NO: 10036 - DNA, 20 bp, Artificial
  HSbrain_81; human brain D4HE26K02H44W3 sequence
tccgcgagagcccgggctcc

SEQ ID NO: 10037 - DNA, 19 bp, Artificial
  HSbrain_821; human brain D4G3XZT01A0DY4, human brain D4G3XZT01CB1GF, human brain D4G3XZT02FTUE8, human brain D4G3YLC01CZXO2, human brain D4G3YLC02J1G9S, human brain D4HE26K02HYF99, human brain D4HE26K02J6XVD, human brain D703HKJ01E3ART, human brain D71F8O202F6KVG sequence
aaaagctgggttgagaagg

SEQ ID NO: 10038 - DNA, 20 bp, Artificial
  HSbrain_821; human brain D4G3XZT02F0KI0, human brain D4HE26K02F3A2H, human brain D703HKJ02IHXXX sequence
gaaaagctgggttgagaagg

SEQ ID NO: 10039 - DNA, 20 bp, Artificial
  HSbrain_82; human brain D4G3XZT01BZG1N sequence
aactggcccctgaagtgatg

SEQ ID NO: 10040 - DNA, 21 bp, Artificial
  HSbrain_83; human brain D4G3YLC01C0ZO1 sequence
ggcctctgtgacgtcacggtg

SEQ ID NO: 10041 - DNA, 18 bp, Artificial
  HSbrain_848, MQbrain_1939; human brain D4G3XZT01BPANQ, human brain D703HKJ02IQOAI, macaque brain D4G3X1F01CN1J2, macaque brain D4G3X1F02JEPTT, macaque brain D4HK4YF01CBFIB, macaque brain D708YRU01BHMK9 sequence
cagtgcaatgatattgtc

SEQ ID NO: 10042 - DNA, 21 bp, Artificial
  HSbrain_84; human brain D4HE26K01CA2T6, human brain D703HKJ01DC3AF sequence
tctctggccttggaatccttt

SEQ ID NO: 10043 - DNA, 22 bp, Artificial
  HSbrain_84; human brain D703HKJ01BREHG sequence
tctctggccttggaatcctttc

SEQ ID NO: 10044 - DNA, 22 bp, Artificial
  HSbrain_84; human brain D71F8O202FVMU9 sequence
ttctctggccttggaatccttt

SEQ ID NO: 10045 - DNA, 19 bp, Artificial
  HSbrain_85; human brain D71F8O202FXU6T sequence
gctgtgagggggataggtc

SEQ ID NO: 10046 - DNA, 19 bp, Artificial
  HSbrain_869, PT_210; chimp brain 28146, human brain D71F8O202G79H0 sequence
aaaagctgagttgagaggg

SEQ ID NO: 10047 - DNA, 21 bp, Artificial
  HSbrain_86; human brain D71F8O202I1K9W sequence
gtgccctctagccttgctgcc

SEQ ID NO: 10048 - DNA, 24 bp, Artificial
  HSbrain_87; human brain D4G3XZT02GXW2B sequence
tttccctgccagggaagctaaccc

SEQ ID NO: 10049 - DNA, 22 bp, Artificial
  HSbrain_884; human brain D703HKJ02JYD0E sequence
tctaatccttgctacctgggtg

SEQ ID NO: 10050 - DNA, 22 bp, Artificial
  HSbrain_8; human brain D4G3XZT02JI9JE sequence
ctgggctgggggaaggaggggg

SEQ ID NO: 10051 - DNA, 20 bp, Artificial
  HSbrain_90; human brain D4G3YLC01BE84K sequence
acttgtggctgctctggagg

SEQ ID NO: 10052 - DNA, 18 bp, Artificial
  HSbrain_916, MQbrain_2520; human brain D4G3XZT02GZICM, macaque brain D4HK8WR01BD0BP, macaque brain D4HK8WR02GET3N, macaque brain D708YRU01EUULX sequence
tgtcactcggctcggccc

SEQ ID NO: 10053 - DNA, 19 bp, Artificial
  HSbrain_91; human brain D703HKJ02HZF38 sequence
gagaagagtcacaggaagc

SEQ ID NO: 10054 - DNA, 18 bp, Artificial
  HSbrain_92; human brain D71F8O202GAZ3G sequence
gagagactgcggagcttc

SEQ ID NO: 10055 - DNA, 21 bp, Artificial
  HSbrain_932, MQbrain_2075, PT_326; chimp brain 144537, human brain D71F8O202JQQRF, macaque brain D708I2V01D9B27, macaque brain D708I2V02FIPO0, macaque brain D708ZXV02HQBBI sequence
tccagtaccacgtgtcagggc

SEQ ID NO: 10056 - DNA, 22 bp, Artificial
  HSbrain_932, MQbrain_2075, PT_326; chimp brain 212487, human brain D4G3XZT01D9PDM, human brain D4G3XZT02I3P9Y, human brain D4G3XZT02JHIKP, human brain D4G3YLC02FVA8P, human brain D4G3YLC02FWFNX, human brain D703HKJ01AHPG5, human brain D703HKJ01D6A0A, human brain D703HKJ02IMBC1
tccagtaccacgtgtcagggcc

SEQ ID NO: 10057 - DNA, 20 bp, Artificial
  HSbrain_932, MQbrain_2075, PT_326; chimp brain 99499, human brain D4G3XZT01AMAQH, human brain D4G3XZT01EGTS9, human brain D4G3XZT02HFCLZ, human brain D4G3YLC01ATRN4, human brain D4G3YLC02G1KDN, macaque brain D4G3X1F01BURZE, macaque brain D4HK4YF01C5WXN
tccagtaccacgtgtcaggg

SEQ ID NO: 10058 - DNA, 21 bp, Artificial
  HSbrain_932, MQbrain_2075; human brain D703HKJ01AIAU9, human brain D703HKJ02H5GEK, human brain D71F8O201D8LBW, macaque brain D4G3X1F02JS3S4, macaque brain D4HK4YF01DBQKW, macaque brain D4HK4YF02I5LEB, macaque brain D708I2V02G1K18
gggcctgatgtggtgctgggg

SEQ ID NO: 10059 - DNA, 18 bp, Artificial
  HSbrain_932, MQbrain_2075; human brain D703HKJ02HUTBD, macaque brain D708YRU01D66MQ sequence
cctccagtaccacgtgtc

SEQ ID NO: 10060 - DNA, 21 bp, Artificial
  HSbrain_932, MQbrain_2075; human brain D71F8O202HSKG8, macaque brain D4G3X1F02JCH4J, macaque brain D4HK8WR02GTLWN, macaque brain D708YRU01DNLZ0, macaque brain D708YRU02IB06B, macaque brain D708ZXV01BI72A sequence
tgggcctgatgtggtgctggg

SEQ ID NO: 10061 - DNA, 19 bp, Artificial
  HSbrain_932, PT_326; chimp brain 186903, human brain D71F8O202HWFK0 sequence
tccagtaccacgtgtcagg

SEQ ID NO: 10062 - DNA, 19 bp, Artificial
  HSbrain_93; human brain D4G3XZT02GFFZC, human brain D4G3YLC01ALZYM, human brain D4HE26K02GUVE3, human brain D703HKJ02FOP1A sequence
acccttgagcctgatccct

SEQ ID NO: 10063 - DNA, 22 bp, Artificial
  HSbrain_93; human brain D4G3YLC01ATAAW sequence
cctgacccttgagcctgatccc

SEQ ID NO: 10064 - DNA, 18 bp, Artificial
  HSbrain_93; human brain D703HKJ01AP2WY sequence
cccttgagcctgatccct

SEQ ID NO: 10065 - DNA, 22 bp, Artificial
  HSbrain_941, MQbrain_2641, PT_327; chimp brain 202966, human brain D4G3XZT02HPC8L, human brain D4G3XZT02JJUX3, human brain D4G3YLC01ALMGK, human brain D4HE26K02GUUU3, human brain D703HKJ01BPS9H, human brain D703HKJ02F0H5O, human brain D71F8O201B76OH, human brain D71F8O201CD3T9,
atggttgaccagagagcacacg

SEQ ID NO: 10066 - DNA, 21 bp, Artificial
  HSbrain_941, MQbrain_2641; human brain D703HKJ01CE01Q, macaque brain D708YRU01BBZLZ sequence
tggttgaccagagagcacacg

SEQ ID NO: 10067 - DNA, 23 bp, Artificial
  HSbrain_941; human brain D4G3XZT02F59FV, human brain D4G3YLC01E5T4T sequence
tttgtgacctggtccactaaccc

SEQ ID NO: 10068 - DNA, 17 bp, Artificial
  HSbrain_941; human brain D4G3YLC01BIBMP, human brain D71F8O202JJN42 sequence
tgacctggtccactaac

SEQ ID NO: 10069 - DNA, 18 bp, Artificial
  HSbrain_941; human brain D4G3YLC02I9WMK, human brain D71F8O201DGO7F, human brain D71F8O202FU55E, human brain D71F8O202HD2L8, human brain D71F8O202JHZNV sequence
ttgtgacctggtccacta

SEQ ID NO: 10070 - DNA, 21 bp, Artificial
  HSbrain_941; human brain D71F8O201AULYH sequence
ttgtgacctggtccactaacc

SEQ ID NO: 10071 - DNA, 22 bp, Artificial
  HSbrain_94; human brain D4G3YLC01CAPLO sequence
cgagtggccagcgcctggcgtc

SEQ ID NO: 10072 - DNA, 20 bp, Artificial
  HSbrain_95; human brain D4HE26K02GGGUX sequence
atcagggcttgtggaatggg

SEQ ID NO: 10073 - DNA, 18 bp, Artificial
  HSbrain_96; human brain D4G3YLC01AKF49 sequence
tgaggctgggggacgcgc

SEQ ID NO: 10074 - DNA, 26 bp, Artificial
  HSbrain_970; human brain D4G3XZT01CYJ20, human brain D703HKJ01DPAIG sequence
tagtgcaatattgcttatagggtttt

SEQ ID NO: 10075 - DNA, 22 bp, Artificial
  HSbrain_970; human brain D703HKJ01A8XMZ sequence
agtgcaatattgcttatagggt

SEQ ID NO: 10076 - DNA, 23 bp, Artificial
  HSbrain_97; human brain D71F8O202GM6S2 sequence
ctaacagcctttgcaacctcctc

SEQ ID NO: 10077 - DNA, 20 bp, Artificial
  HSbrain_98; human brain D703HKJ01CYA9R sequence
tagtgtggtggatagagtgc

SEQ ID NO: 10078 - DNA, 22 bp, Artificial
  HSbrain_9; human brain D703HKJ02I2P0U sequence
tttctagcctctctgccaagtg

SEQ ID NO: 10079 - DNA, 22 bp, Artificial
  MM_107; mouse brain 4478 sequence
ataagtgcgtgcatgtatatgt

SEQ ID NO: 10080 - DNA, 22 bp, Artificial
  MM_112; mouse Mouse_libRAKE_cand671_probe21 sequence
tgaggccctgttggaaggggtc

SEQ ID NO: 10081 - DNA, 22 bp, Artificial
  MM_13; mouse Mouse_libRAKE_cand249_probe34 sequence
agggaccagccgggggctggag

SEQ ID NO: 10082 - DNA, 22 bp, Artificial
  MM_14; mouse Mouse_libRAKE_cand133_probe42 sequence
gcaaaccagtatgacagggaaa

SEQ ID NO: 10083 - DNA, 20 bp, Artificial
  MM_154; mouse brain 13246 sequence
ttgttcctggggaaattcac

SEQ ID NO: 10084 - DNA, 22 bp, Artificial
  MM_183; mouse Mouse_libRAKE_mmHP2056767_probe6 sequence
aggatctgtttctgtgaacatt

SEQ ID NO: 10085 - DNA, 23 bp, Artificial
  MM_205; mouse brain 21444 sequence
tttgtttttttgcattttccctt

SEQ ID NO: 10086 - DNA, 22 bp, Artificial
  MM_225; mouse brain 31512 sequence
catttagccaaagcctgactgt

SEQ ID NO: 10087 - DNA, 20 bp, Artificial
  MM_233; mouse brain 224 sequence
atctcccctaccttttccag

SEQ ID NO: 10088 - DNA, 19 bp, Artificial
  MM_244; mouse brain 27868 sequence
gcgtccccgtggctgcgcg

SEQ ID NO: 10089 - DNA, 18 bp, Artificial
  MM_245; mouse brain 1032 sequence
tgatttggttgtttgggt

SEQ ID NO: 10090 - DNA, 22 bp, Artificial
  MM_253; mouse Mouse_libRAKE_mmHP773617_probe40 sequence
agggacatcacacctagagaac

SEQ ID NO: 10091 - DNA, 22 bp, Artificial
  MM_278; mouse Mouse_libRAKE_mmHP1257739_probe10 sequence
ctgtgccacatgtgacatgagg

SEQ ID NO: 10092 - DNA, 22 bp, Artificial
  MM_294; mouse Mouse_libRAKE_cand503_probe24 sequence
ggattgccaggagtgccccgag

SEQ ID NO: 10093 - DNA, 21 bp, Artificial
  MM_319; mouse brain 22437 sequence
tacgtcatcgtcgtcatcgtt

SEQ ID NO: 10094 - DNA, 23 bp, Artificial
  MM_319; mouse brain 25907 sequence
tacgtcatcgtcgtcatcgttat

SEQ ID NO: 10095 - DNA, 20 bp, Artificial
  MM_319; mouse brain 28255 sequence
tacgtcatcgtcgtcatcgt

SEQ ID NO: 10096 - DNA, 24 bp, Artificial
  MM_319; mouse brain 29880 sequence
tacgtcatcgtcgtcatcgttatc

SEQ ID NO: 10097 - DNA, 19 bp, Artificial
  MM_328; mouse brain 1217 sequence
taagtgcgcgcatgtatat

SEQ ID NO: 10098 - DNA, 22 bp, Artificial
  MM_338; mouse Mouse_libRAKE_cand937_probe15 sequence
gcagaagttgacgcggctctcc

SEQ ID NO: 10099 - DNA, 22 bp, Artificial
  MM_338; mouse Mouse_libRAKE_cand937_probe3 sequence
cctggaggtgatgtcaaagcag

SEQ ID NO: 10100 - DNA, 22 bp, Artificial
  MM_352; mouse Mouse_libRAKE_mmHP1541151_probe37 sequence
caaagaactctgaggaagttca

SEQ ID NO: 10101 - DNA, 18 bp, Artificial
  MM_50; mouse brain 6126 sequence
tgggttctgcccgcgcag

SEQ ID NO: 10102 - DNA, 18 bp, Artificial
  MM_51; mouse brain 21604 sequence
gtccatgttttcccaggt

SEQ ID NO: 10103 - DNA, 18 bp, Artificial
  MM_56; mouse brain 16507 sequence
tgtggtagtagattgtat

SEQ ID NO: 10104 - DNA, 18 bp, Artificial
  MM_7; mouse brain 8123 sequence
tatgtgttcctgtggtgg

SEQ ID NO: 10105 - DNA, 22 bp, Artificial
  MM_94; mouse Mouse_libRAKE_mmHP1647699_probe10 sequence
aggatttcatgctgatctggct

SEQ ID NO: 10106 - DNA, 18 bp, Artificial
  MM_95; mouse brain 4464 sequence
agtccagttttcccagga

SEQ ID NO: 10107 - DNA, 24 bp, Artificial
  MQbrain_1, MQbrain_222; macaque brain D4HK8WR02IEGMG sequence
ctgtccaagccagtggatgtttcc

SEQ ID NO: 10108 - DNA, 23 bp, Artificial
  MQbrain_1000; macaque brain D4HK8WR02IS78I sequence
tgggatgtaccgctgagctgttc

SEQ ID NO: 10109 - DNA, 21 bp, Artificial
  MQbrain_1001; macaque brain D708I2V01DJ4K5 sequence
ggcaagccagggcaggagtcc

SEQ ID NO: 10110 - DNA, 22 bp, Artificial
  MQbrain_1002, MQbrain_1128, MQbrain_1462; macaque brain D4HK8WR02G5WRB sequence
agcagcattgtcactgtagagg

SEQ ID NO: 10111 - DNA, 20 bp, Artificial
  MQbrain_1003; macaque brain D708YRU02IACVP sequence
ggtggagggtggaggcgtcg

SEQ ID NO: 10112 - DNA, 24 bp, Artificial
  MQbrain_1004, MQbrain_1294; macaque brain D4HK4YF02GD4K3 sequence
ttagtgcctgagattgctcggatc

SEQ ID NO: 10113 - DNA, 23 bp, Artificial
  MQbrain_1005, MQbrain_1142, MQbrain_1151, MQbrain_1252, MQbrain_1254, MQbrain_1310, MQbrain_136, MQbrain_1467, MQbrain_1468, MQbrain_1533, MQbrain_1613, MQbrain_1639, MQbrain_2, MQbrain_408, MQbrain_410, MQbrain_460, MQbrain_588, MQbrain_652, MQbrain_662,
gaggctggtgatggctacggagg

SEQ ID NO: 10114 - DNA, 26 bp, Artificial
  MQbrain_1006; macaque brain D4HK8WR02J2L4C sequence
ggttgggatttgggggctgagctgtc

SEQ ID NO: 10115 - DNA, 22 bp, Artificial
  MQbrain_1007, MQbrain_1159; macaque brain D4G3X1F01C0N8W sequence
cgtggggcagggagctgggccc

SEQ ID NO: 10116 - DNA, 21 bp, Artificial
  MQbrain_1008, MQbrain_1009, MQbrain_1017, MQbrain_1150; macaque brain D708ZXV02IK8I7 sequence
gagtctgtgaggcaggagagc

SEQ ID NO: 10117 - DNA, 25 bp, Artificial
  MQbrain_100; macaque brain D4HK4YF01BOU8E sequence
tgggcttccaaggaactttaggacc

SEQ ID NO: 10118 - DNA, 20 bp, Artificial
  MQbrain_100; macaque brain D4HK4YF02FHQXN sequence
ctgggcttccaaggaacttt

SEQ ID NO: 10119 - DNA, 18 bp, Artificial
  MQbrain_1010; macaque brain D708I2V01AYSWN sequence
gacagggccaggagccgt

SEQ ID NO: 10120 - DNA, 24 bp, Artificial
  MQbrain_1011; macaque brain D708YRU01CTO42 sequence
agcagggtgttctgggcaaattgg

SEQ ID NO: 10121 - DNA, 19 bp, Artificial
  MQbrain_1012; macaque brain D4HK8WR01AZWBU sequence
gggaggaggcagaggaagc

SEQ ID NO: 10122 - DNA, 19 bp, Artificial
  MQbrain_1013; macaque brain D4G3X1F02JSTDP sequence
tcctaggggagttggatgg

SEQ ID NO: 10123 - DNA, 18 bp, Artificial
  MQbrain_1014; macaque brain D708I2V02JNYVL sequence
agagccctgtctttcctc

SEQ ID NO: 10124 - DNA, 26 bp, Artificial
  MQbrain_1015; macaque brain D708I2V02JXM8Y sequence
atggccaatgagctccctcatggtgc

SEQ ID NO: 10125 - DNA, 19 bp, Artificial
  MQbrain_1016; macaque brain D4G3X1F01D375P, macaque brain D4HK8WR02GV2B8 sequence
cagcaggtctccaaggatg

SEQ ID NO: 10126 - DNA, 18 bp, Artificial
  MQbrain_1016; macaque brain D4HK8WR01AJW9H, macaque brain D708YRU02IJ1U6 sequence
agcaggtctccaaggatg

SEQ ID NO: 10127 - DNA, 20 bp, Artificial
  MQbrain_1016; macaque brain D4HK8WR01CSY0U sequence
gcagcaggtctccaaggatg

SEQ ID NO: 10128 - DNA, 19 bp, Artificial
  MQbrain_1018; macaque brain D4HK8WR01CV8NT sequence
ggaggcttagggaccaagg

SEQ ID NO: 10129 - DNA, 25 bp, Artificial
  MQbrain_1019; macaque brain D708ZXV02G8DFJ sequence
aatgtgtggcttagatgatttgttc

SEQ ID NO: 10130 - DNA, 18 bp, Artificial
  MQbrain_101; macaque brain D708YRU01BADLT sequence
gatgagagctggctggtg

SEQ ID NO: 10131 - DNA, 20 bp, Artificial
  MQbrain_1020; macaque brain D708YRU01D6O95 sequence
ttgcgaaggtgtctgggtcg

SEQ ID NO: 10132 - DNA, 22 bp, Artificial
  MQbrain_1021; macaque brain D4HK8WR02JHNRU sequence
tgaaggaggggcctgaaggagg

SEQ ID NO: 10133 - DNA, 21 bp, Artificial
  MQbrain_1022, MQbrain_1136; macaque brain D4HK8WR02HMTF2 sequence
gcttgcctgaggtcacctgtc

SEQ ID NO: 10134 - DNA, 19 bp, Artificial
  MQbrain_1023, MQbrain_1135; macaque brain D708I2V02JUE9H sequence
gtgcctttcctacctcatc

SEQ ID NO: 10135 - DNA, 27 bp, Artificial
  MQbrain_1024; macaque brain D708I2V01CZ99W sequence
ctacctgcggggtccagcagcctttgt

SEQ ID NO: 10136 - DNA, 27 bp, Artificial
  MQbrain_1025, MQbrain_1026, MQbrain_1732, MQbrain_1742; macaque brain D708YRU01EAHSI sequence
tagggtgaaatgtggagcagtctgtgg

SEQ ID NO: 10137 - DNA, 26 bp, Artificial
  MQbrain_1027; macaque brain D708YRU01EMO3Y sequence
agtgactggaaaatgggtgctgatgg

SEQ ID NO: 10138 - DNA, 18 bp, Artificial
  MQbrain_1028, MQbrain_1406; macaque brain D708YRU02IAMPF sequence
tggatgcagggccggtcg

SEQ ID NO: 10139 - DNA, 20 bp, Artificial
  MQbrain_1029, MQbrain_1032, MQbrain_1035, MQbrain_1041; macaque brain D4HK4YF02I5QX3 sequence
ctgagcagacctggaaggtg

SEQ ID NO: 10140 - DNA, 22 bp, Artificial
  MQbrain_1029, MQbrain_1032, MQbrain_1035, MQbrain_1041; macaque brain D708ZXV01DOKFV sequence
actgagcagacctggaaggtgt

SEQ ID NO: 10141 - DNA, 23 bp, Artificial
  MQbrain_102; macaque brain D708I2V01BI6BF sequence
ctcctgtcctgcccacgccaacc

SEQ ID NO: 10142 - DNA, 21 bp, Artificial
  MQbrain_1030, MQbrain_1090, MQbrain_1590, MQbrain_1712, MQbrain_414, MQbrain_640; macaque brain D4HK8WR01DMAI2 sequence
tccgcggaggtttcggcagtg

SEQ ID NO: 10143 - DNA, 18 bp, Artificial
  MQbrain_1031; macaque brain D4HK4YF01AZ0IQ sequence
aggccaggctcacaggtg

SEQ ID NO: 10144 - DNA, 20 bp, Artificial
  MQbrain_1033; macaque brain D4HK8WR02HI3N3 sequence
ctggtgagcaaaggtgcttg

SEQ ID NO: 10145 - DNA, 16 bp, Artificial
  MQbrain_1034; macaque brain D4G3X1F01A02LP sequence
agctggcccaatgggg

SEQ ID NO: 10146 - DNA, 18 bp, Artificial
  MQbrain_1036; macaque brain D708YRU01B3DEU sequence
agagctgatggtggtgtg

SEQ ID NO: 10147 - DNA, 20 bp, Artificial
  MQbrain_1037; macaque brain D4HK4YF02H8BUX sequence
cgatgagagcattgccaagg

SEQ ID NO: 10148 - DNA, 25 bp, Artificial
  MQbrain_1038; macaque brain D708ZXV01AYJRQ sequence
atggatgttgatgccaaagtttgtg

SEQ ID NO: 10149 - DNA, 24 bp, Artificial
  MQbrain_1039; macaque brain D4HK8WR01D6O4L sequence
ctgcagcccctccaacgggctttt

SEQ ID NO: 10150 - DNA, 18 bp, Artificial
  MQbrain_103; macaque brain D4HK8WR01A1B2I sequence
ggaaggcctagcacgtgt

SEQ ID NO: 10151 - DNA, 23 bp, Artificial
  MQbrain_1040; macaque brain D4G3X1F01AL3O9 sequence
aggctgctcttctcctcttttgg

SEQ ID NO: 10152 - DNA, 23 bp, Artificial
  MQbrain_1042; macaque brain D708YRU02HRRSM sequence
actgagaacagtctgctgctgct

SEQ ID NO: 10153 - DNA, 20 bp, Artificial
  MQbrain_1043; macaque brain D708YRU01A7GII sequence
gggaagagagagggtggggg

SEQ ID NO: 10154 - DNA, 24 bp, Artificial
  MQbrain_1044; macaque brain D708ZXV01A0DPL sequence
gttgccatgaggtagggtgcaggc

SEQ ID NO: 10155 - DNA, 22 bp, Artificial
  MQbrain_1045; macaque brain D708I2V02IKR7H sequence
accccttgaagtggctgcctgg

SEQ ID NO: 10156 - DNA, 18 bp, Artificial
  MQbrain_1046; macaque brain D4G3X1F02F2UN1 sequence
tgaagtggatggcacctg

SEQ ID NO: 10157 - DNA, 20 bp, Artificial
  MQbrain_1047; macaque brain D4HK4YF02I24O5 sequence
ctttcctgtggctgtgcatg

SEQ ID NO: 10158 - DNA, 28 bp, Artificial
  MQbrain_1048; macaque brain D708ZXV01A94WB sequence
tccggcagcgcgatggctgggttcccgg

SEQ ID NO: 10159 - DNA, 20 bp, Artificial
  MQbrain_1049; macaque brain D708YRU02HI8T8 sequence
agatgggagggagctgctgc

SEQ ID NO: 10160 - DNA, 25 bp, Artificial
  MQbrain_104; macaque brain D708ZXV02FO89W sequence
ctgtgctggaggcccaggctttggg

SEQ ID NO: 10161 - DNA, 23 bp, Artificial
  MQbrain_1050; macaque brain D708ZXV02JKFCL sequence
attttattttgttccttccagtt

SEQ ID NO: 10162 - DNA, 20 bp, Artificial
  MQbrain_1051; macaque brain D708YRU01ED1F4 sequence
gtctgaaggccagcctgtgt

SEQ ID NO: 10163 - DNA, 22 bp, Artificial
  MQbrain_1052; macaque brain D708YRU01A2TRR sequence
aggctgccaggggtgagtgagc

SEQ ID NO: 10164 - DNA, 19 bp, Artificial
  MQbrain_1053; macaque brain D708I2V02HFR9M sequence
atgctggagctggggaggg

SEQ ID NO: 10165 - DNA, 22 bp, Artificial
  MQbrain_1054, MQbrain_1066, MQbrain_1123, MQbrain_1155, MQbrain_1436; macaque brain D4HK8WR02HX4ZZ sequence
atttggattgagggaatgtctg

SEQ ID NO: 10166 - DNA, 20 bp, Artificial
  MQbrain_1055, MQbrain_919; macaque brain D708YRU02I1J7P sequence
gggaaggagacgctacagcg

SEQ ID NO: 10167 - DNA, 18 bp, Artificial
  MQbrain_1056, MQbrain_1057, MQbrain_1080, MQbrain_1173; macaque brain D4HK4YF01E1RNP sequence
atgagaggttgatggatt

SEQ ID NO: 10168 - DNA, 22 bp, Artificial
  MQbrain_1056, MQbrain_1057, MQbrain_1080, MQbrain_1173; macaque brain D708YRU02J5ZGY sequence
atgagaggttgatggattaatt

SEQ ID NO: 10169 - DNA, 25 bp, Artificial
  MQbrain_1058; macaque brain D708I2V02J4NAL sequence
tgaaagcctttgtgttggagactcc

SEQ ID NO: 10170 - DNA, 23 bp, Artificial
  MQbrain_1059, MQbrain_172; macaque brain D708ZXV01AQUXD sequence
accagctcttgggcctcaacctc

SEQ ID NO: 10171 - DNA, 18 bp, Artificial
  MQbrain_105; macaque brain D4HK8WR01DST31 sequence
acttagctgcagactagg

SEQ ID NO: 10172 - DNA, 22 bp, Artificial
  MQbrain_1060; macaque brain D708ZXV02FWOT8 sequence
tgtccatggtagagctctggtc

SEQ ID NO: 10173 - DNA, 24 bp, Artificial
  MQbrain_1061; macaque brain D4HK8WR02HBYKO sequence
gatgcagcaggggcccgagcgctg

SEQ ID NO: 10174 - DNA, 18 bp, Artificial
  MQbrain_1062, MQbrain_167; macaque brain D708I2V01DE21J sequence
ccctggggccccctggtc

SEQ ID NO: 10175 - DNA, 18 bp, Artificial
  MQbrain_1063, MQbrain_1069, MQbrain_1178, MQbrain_1435, MQbrain_1506; macaque brain D4G3X1F01B32PE sequence
ctcctgggccctgctgtc

SEQ ID NO: 10176 - DNA, 21 bp, Artificial
  MQbrain_1064, MQbrain_1143, MQbrain_1520; macaque brain D4HK8WR02JBKY5 sequence
ccagcccttcttggatgggtc

SEQ ID NO: 10177 - DNA, 23 bp, Artificial
  MQbrain_1065; macaque brain D708I2V02JNCQJ sequence
actcctaaagggacagcctgatg

SEQ ID NO: 10178 - DNA, 23 bp, Artificial
  MQbrain_1067, MQbrain_1306, MQbrain_1711, MQbrain_198, MQbrain_242, MQbrain_387, MQbrain_657, MQbrain_799, MQbrain_832, MQbrain_94, MQbrain_952; macaque brain D4G3X1F01CL9CA sequence
ggcgaggttctctggtcctcagg

SEQ ID NO: 10179 - DNA, 21 bp, Artificial
  MQbrain_1068; macaque brain D708ZXV01EEVHR sequence
ctgggctgggcctgggcgggt

SEQ ID NO: 10180 - DNA, 18 bp, Artificial
  MQbrain_106; macaque brain D708YRU02IDGHH sequence
tcgggcgggcgggaggtg

SEQ ID NO: 10181 - DNA, 19 bp, Artificial
  MQbrain_106; macaque brain D708YRU02IOVJ3 sequence
tcgggcgggcgggaggtgc

SEQ ID NO: 10182 - DNA, 20 bp, Artificial
  MQbrain_107, MQbrain_561; macaque brain D708YRU01CFO26 sequence
ctcctgggggcctggcgagg

SEQ ID NO: 10183 - DNA, 18 bp, Artificial
  MQbrain_1070, MQbrain_1566; macaque brain D708YRU02FWCNA sequence
gccaagagtgagtggttg

SEQ ID NO: 10184 - DNA, 21 bp, Artificial
  MQbrain_1071, MQbrain_1105, MQbrain_1106; macaque brain D708YRU01B4GRD sequence
gcggggcagcagttggtcagg

SEQ ID NO: 10185 - DNA, 20 bp, Artificial
  MQbrain_1072; macaque brain D4HK4YF02IJ5W8 sequence
acgacgagctcaagaaggtg

SEQ ID NO: 10186 - DNA, 20 bp, Artificial
  MQbrain_1073; macaque brain D708I2V01BF8A8 sequence
cccctctggctttggcggtc

SEQ ID NO: 10187 - DNA, 18 bp, Artificial
  MQbrain_1075, MQbrain_1083; macaque brain D4HK4YF01DREER sequence
cctcctgtctcctctccc

SEQ ID NO: 10188 - DNA, 19 bp, Artificial
  MQbrain_1076; macaque brain D708I2V01BEPS4 sequence
aggctggtgggtgtgccct

SEQ ID NO: 10189 - DNA, 18 bp, Artificial
  MQbrain_1077; macaque brain D4HK8WR02JN461 sequence
ttgtgagcaggagaaagg

SEQ ID NO: 10190 - DNA, 19 bp, Artificial
  MQbrain_1078, MQbrain_1125; macaque brain D708YRU01B4BMF sequence
ctcaccttcaagtggctcc

SEQ ID NO: 10191 - DNA, 23 bp, Artificial
  MQbrain_1079, MQbrain_1109, MQbrain_1170; macaque brain D708YRU02GRYLQ sequence
tttggtgggattgtctgtggctc

SEQ ID NO: 10192 - DNA, 20 bp, Artificial
  MQbrain_108, MQbrain_459; macaque brain D708YRU01DA3J5 sequence
ttggtgtggggttgagggtg

SEQ ID NO: 10193 - DNA, 18 bp, Artificial
  MQbrain_1081, MQbrain_1253, MQbrain_1648, MQbrain_650; macaque brain D708I2V02HK1VE sequence
cttgtccatggcaaatgc

SEQ ID NO: 10194 - DNA, 20 bp, Artificial
  MQbrain_1081, MQbrain_1253, MQbrain_1648, MQbrain_650; macaque brain D708ZXV02JU00T sequence
atcttgtccatggcaaatgc

SEQ ID NO: 10195 - DNA, 20 bp, Artificial
  MQbrain_1082; macaque brain D708ZXV02H2VWJ sequence
atggctggcagcagggctct

SEQ ID NO: 10196 - DNA, 22 bp, Artificial
  MQbrain_1084, MQbrain_1344, MQbrain_1367, MQbrain_1416, MQbrain_1544, MQbrain_317, MQbrain_341, MQbrain_527, MQbrain_962; macaque brain D708YRU01ARMD9 sequence
aggctgaaggggatgctaaagg

SEQ ID NO: 10197 - DNA, 20 bp, Artificial
  MQbrain_1085; macaque brain D4HK4YF01B97KG sequence
ttgttgctggcctggctgtc

SEQ ID NO: 10198 - DNA, 26 bp, Artificial
  MQbrain_1086; macaque brain D4HK8WR02JXWW5 sequence
atgaagatcgttggacaggccacatg

SEQ ID NO: 10199 - DNA, 22 bp, Artificial
  MQbrain_1087; macaque brain D4HK4YF01AOQ20 sequence
gctcatggagcagtgctgggcc

SEQ ID NO: 10200 - DNA, 18 bp, Artificial
  MQbrain_1088, MQbrain_403, MQbrain_404; macaque brain D708ZXV02IGAFX sequence
gggtgagggattgcttcg

SEQ ID NO: 10201 - DNA, 21 bp, Artificial
  MQbrain_1089, MQbrain_907; macaque brain D4G3X1F02GS3D2 sequence
cgatgaagttctggttgctgg

SEQ ID NO: 10202 - DNA, 19 bp, Artificial
  MQbrain_1091, MQbrain_1223, MQbrain_1224, MQbrain_1678; macaque brain D708I2V01DD3IX, macaque brain D708YRU01AXAO0 sequence
aagctgctggagggcgagg

SEQ ID NO: 10203 - DNA, 18 bp, Artificial
  MQbrain_1091, MQbrain_1223, MQbrain_1224, MQbrain_1678; macaque brain D708YRU02IBHSS sequence
agctgctggagggcgagg

SEQ ID NO: 10204 - DNA, 24 bp, Artificial
  MQbrain_1092; macaque brain D4HK8WR02FLZ94 sequence
agcccctgtgactttgtctggttt

SEQ ID NO: 10205 - DNA, 21 bp, Artificial
  MQbrain_1093; macaque brain D708I2V01ESQK8 sequence
tgtcccttgcccagcacagcc

SEQ ID NO: 10206 - DNA, 23 bp, Artificial
  MQbrain_1094, MQbrain_1440; macaque brain D708I2V01CFUA0 sequence
tgtcatgatatctgtgtggcccc

SEQ ID NO: 10207 - DNA, 19 bp, Artificial
  MQbrain_1095, MQbrain_889; macaque brain D4HK8WR02FUQJP sequence
gtgacaacatgctggagcc

SEQ ID NO: 10208 - DNA, 18 bp, Artificial
  MQbrain_1095, MQbrain_889; macaque brain D708YRU01AXTPM sequence
aatggtgacaacatgctg

SEQ ID NO: 10209 - DNA, 18 bp, Artificial
  MQbrain_1096, MQbrain_1275; macaque brain D4G3X1F02J3GCZ sequence
aggctagggagaagtgtt

SEQ ID NO: 10210 - DNA, 21 bp, Artificial
  MQbrain_1097; macaque brain D708YRU02HDUZU sequence
aatggctgccagccatggagg

SEQ ID NO: 10211 - DNA, 18 bp, Artificial
  MQbrain_1098; macaque brain D708ZXV02F929L sequence
gggagaagggacagcttt

SEQ ID NO: 10212 - DNA, 21 bp, Artificial
  MQbrain_1099; macaque brain D4HK4YF01DUKDT sequence
gatgcagccatgccctgaatg

SEQ ID NO: 10213 - DNA, 18 bp, Artificial
  MQbrain_109; macaque brain D708I2V02GV22O sequence
cccagtactcctctgccc

SEQ ID NO: 10214 - DNA, 20 bp, Artificial
  MQbrain_10; macaque brain D708YRU02JSTL4 sequence
ttgggaggctgaggggaagt

SEQ ID NO: 10215 - DNA, 18 bp, Artificial
  MQbrain_1100, MQbrain_1169, MQbrain_1262, MQbrain_1466, MQbrain_899; macaque brain D4G3X1F02JLDKG sequence
atgtctggaaggctgtgg

SEQ ID NO: 10216 - DNA, 20 bp, Artificial
  MQbrain_1101; macaque brain D708ZXV02IC6NZ sequence
ggttggtgatggtggtactg

SEQ ID NO: 10217 - DNA, 19 bp, Artificial
  MQbrain_1102; macaque brain D4HK8WR01AP7KN sequence
gaggagcgggatgagggtg

SEQ ID NO: 10218 - DNA, 21 bp, Artificial
  MQbrain_1103; macaque brain D708I2V01E7PV4 sequence
ccctctgggtctgctgggttg

SEQ ID NO: 10219 - DNA, 21 bp, Artificial
  MQbrain_1104, MQbrain_1140, MQbrain_1172, MQbrain_989; macaque brain D4HK8WR01CTQEW sequence
gaggtgcctgagagaccctgg

SEQ ID NO: 10220 - DNA, 18 bp, Artificial
  MQbrain_1107, MQbrain_1121, MQbrain_1161; macaque brain D708YRU02GB8D6 sequence
gaaagggctgctggggtg

SEQ ID NO: 10221 - DNA, 20 bp, Artificial
  MQbrain_1108; macaque brain D708YRU01BJBBI sequence
agggtgggtcacttcgcggc

SEQ ID NO: 10222 - DNA, 24 bp, Artificial
  MQbrain_110; macaque brain D708I2V02GYTW3 sequence
gcgctggacaagccgggcaagtcg

SEQ ID NO: 10223 - DNA, 21 bp, Artificial
  MQbrain_1110; macaque brain D708I2V01C5HEC sequence
gttgcccaaggctgcactggg

SEQ ID NO: 10224 - DNA, 26 bp, Artificial
  MQbrain_1111; macaque brain D708ZXV01AXG83 sequence
ggtggccttgggaccagagctggatt

SEQ ID NO: 10225 - DNA, 23 bp, Artificial
  MQbrain_1112; macaque brain D4G3X1F02I29UD sequence
tggggtgactggaggaagccagg

SEQ ID NO: 10226 - DNA, 24 bp, Artificial
  MQbrain_1113; macaque brain D708ZXV01AX14C sequence
attctgacattacaatggtggagt

SEQ ID NO: 10227 - DNA, 19 bp, Artificial
  MQbrain_1114; macaque brain D708ZXV02ILTZZ sequence
atgtgctgtgttctcatcc

SEQ ID NO: 10228 - DNA, 21 bp, Artificial
  MQbrain_1115, MQbrain_299; macaque brain D4HK8WR02HWA9G sequence
ccatccctaccccatgctgcc

SEQ ID NO: 10229 - DNA, 22 bp, Artificial
  MQbrain_1116; macaque brain D4G3X1F01AOAKC sequence
ttgggggaagtgaagctgtgtg

SEQ ID NO: 10230 - DNA, 23 bp, Artificial
  MQbrain_1117, MQbrain_898; macaque brain D708ZXV02GBBKW sequence
tggaaggtggatctggagatgtt

SEQ ID NO: 10231 - DNA, 23 bp, Artificial
  MQbrain_1118; macaque brain D708I2V01DRAQX sequence
agctgagggcccaggcgggagtg

SEQ ID NO: 10232 - DNA, 20 bp, Artificial
  MQbrain_1119; macaque brain D708ZXV02FY5SA sequence
ctgccctggctctggcatgt

SEQ ID NO: 10233 - DNA, 21 bp, Artificial
  MQbrain_111; macaque brain D4HK8WR02GHWDU sequence
gtggggttgagggtggggttt

SEQ ID NO: 10234 - DNA, 25 bp, Artificial
  MQbrain_1120; macaque brain D708ZXV02HM98M sequence
ctatggctgaggtagtgatggaagg

SEQ ID NO: 10235 - DNA, 25 bp, Artificial
  MQbrain_1122; macaque brain D4HK8WR01CJJOM sequence
tggctggtggtggcacatcttccgc

SEQ ID NO: 10236 - DNA, 21 bp, Artificial
  MQbrain_1124; macaque brain D708YRU02JO86X sequence
aagggtgtcactgagctgtgt

SEQ ID NO: 10237 - DNA, 20 bp, Artificial
  MQbrain_1126, MQbrain_88; macaque brain D708I2V01D5X98 sequence
gtgtctcttgtgaggtcagc

SEQ ID NO: 10238 - DNA, 20 bp, Artificial
  MQbrain_1127; macaque brain D4G3X1F01ELMHI sequence
cgtcacggatcaggccattg

SEQ ID NO: 10239 - DNA, 20 bp, Artificial
  MQbrain_1129; macaque brain D4HK4YF01ETM06 sequence
gaaatgtgaatgcgatggtg

SEQ ID NO: 10240 - DNA, 18 bp, Artificial
  MQbrain_112; macaque brain D708YRU02I5LD0 sequence
tggtcagcctgtgggtgg

SEQ ID NO: 10241 - DNA, 20 bp, Artificial
  MQbrain_1130; macaque brain D4HK8WR02JWIIX sequence
attgtgtggtctgttcgtgg

SEQ ID NO: 10242 - DNA, 21 bp, Artificial
  MQbrain_1131; macaque brain D708YRU01B8K0X sequence
tttgactggagaggctgattt

SEQ ID NO: 10243 - DNA, 20 bp, Artificial
  MQbrain_1132; macaque brain D708I2V02FKG31, macaque brain D708YRU01BNX7H, macaque brain D708YRU02F90DF, macaque brain D708YRU02I2ZDT, macaque brain D708ZXV01BOE8U, macaque brain D708ZXV02H2S5T, macaque brain D708ZXV02H31BV sequence
tggaggaaaggcagttcctt

SEQ ID NO: 10244 - DNA, 21 bp, Artificial
  MQbrain_1132; macaque brain D708YRU01EWEYR sequence
tggaggaaaggcagttccttt

SEQ ID NO: 10245 - DNA, 22 bp, Artificial
  MQbrain_1133; macaque brain D708ZXV01CB3M1 sequence
atggggttgacagctcagctgg

SEQ ID NO: 10246 - DNA, 21 bp, Artificial
  MQbrain_1134; macaque brain D708I2V02F1HXW sequence
ttgctgtgtgaccaccattcc

SEQ ID NO: 10247 - DNA, 24 bp, Artificial
  MQbrain_1134; macaque brain D708YRU02GOPU8 sequence
ttgctgtgtgaccaccattcctgc

SEQ ID NO: 10248 - DNA, 18 bp, Artificial
  MQbrain_1137; macaque brain D4G3X1F02JRQZD sequence
tctgggtcccctccagcc

SEQ ID NO: 10249 - DNA, 20 bp, Artificial
  MQbrain_1138, MQbrain_1247; macaque brain D708I2V02HULGV sequence
gttgtggccgatgtcttagc

SEQ ID NO: 10250 - DNA, 26 bp, Artificial
  MQbrain_1139; macaque brain D708ZXV01D35HT sequence
ggttgattctgtgctaagtgcttctg

SEQ ID NO: 10251 - DNA, 19 bp, Artificial
  MQbrain_113; macaque brain D708I2V02ISMWD sequence
gctcctccctcgcgccctc

SEQ ID NO: 10252 - DNA, 19 bp, Artificial
  MQbrain_1141; macaque brain D4HK4YF01C6ECQ sequence
caacttgccaatgtactgc

SEQ ID NO: 10253 - DNA, 23 bp, Artificial
  MQbrain_1144, MQbrain_1806, MQbrain_1817, MQbrain_1840; macaque brain D4HK8WR01EGPM1 sequence
agcatgtgattgaggccctgtgc

SEQ ID NO: 10254 - DNA, 21 bp, Artificial
  MQbrain_1145; macaque brain D708YRU01CN02N sequence
aggcagcagaggcagcgatgg

SEQ ID NO: 10255 - DNA, 18 bp, Artificial
  MQbrain_1146; macaque brain D708I2V02FUJPG sequence
ttgaagccgcagcgaacc

SEQ ID NO: 10256 - DNA, 23 bp, Artificial
  MQbrain_1147, MQbrain_701; macaque brain D4HK8WR01C0IN8 sequence
aggaatggatgtgccctgggctg

SEQ ID NO: 10257 - DNA, 24 bp, Artificial
  MQbrain_1148; macaque brain D708I2V02I96ID sequence
tgaggtgctgctgctgggtctgtc

SEQ ID NO: 10258 - DNA, 25 bp, Artificial
  MQbrain_1149, MQbrain_439; macaque brain D4HK4YF01DRCXI sequence
ctttgaccctgctgggtttaagctg

SEQ ID NO: 10259 - DNA, 25 bp, Artificial
  MQbrain_114; macaque brain D708YRU02FO7PF sequence
cgaggggagaagaggaaacgagatg

SEQ ID NO: 10260 - DNA, 21 bp, Artificial
  MQbrain_1152, MQbrain_1708; macaque brain D4HK8WR02HK44L sequence
aagtggaggtaactggcgatg

SEQ ID NO: 10261 - DNA, 18 bp, Artificial
  MQbrain_1153, MQbrain_365; macaque brain D708I2V01EF0QD sequence
tgtgacttggggtcagcc

SEQ ID NO: 10262 - DNA, 20 bp, Artificial
  MQbrain_1154, MQbrain_1381; macaque brain D708I2V01ALEMF sequence
aagctgaggtttcttgggtc

SEQ ID NO: 10263 - DNA, 20 bp, Artificial
  MQbrain_1156, MQbrain_1479; macaque brain D4HK8WR01CMCF3 sequence
ttggcttggcaaaagaaatt

SEQ ID NO: 10264 - DNA, 18 bp, Artificial
  MQbrain_1157, MQbrain_184; macaque brain D708YRU02HERZ7 sequence
aggagctggagagtctgg

SEQ ID NO: 10265 - DNA, 26 bp, Artificial
  MQbrain_1158, MQbrain_1176; macaque brain D4G3X1F01DDREM sequence
tgtgccaggttttggaagcaggagtt

SEQ ID NO: 10266 - DNA, 20 bp, Artificial
  MQbrain_115; macaque brain D708ZXV01C8EOB sequence
aagtggagggtgctgtggtg

SEQ ID NO: 10267 - DNA, 25 bp, Artificial
  MQbrain_1160; macaque brain D708YRU02JI65L sequence
cgtaggtggagaggagttggaggtg

SEQ ID NO: 10268 - DNA, 22 bp, Artificial
  MQbrain_1162; macaque brain D4HK8WR02JHLTA sequence
aaccagctgcagtgggtccacc

SEQ ID NO: 10269 - DNA, 21 bp, Artificial
  MQbrain_1163; macaque brain D708ZXV02IPFL1 sequence
agtgctgagaagcaggagttt

SEQ ID NO: 10270 - DNA, 21 bp, Artificial
  MQbrain_1164; macaque brain D708I2V01D7ISS sequence
aactgactggtggaaagggcg

SEQ ID NO: 10271 - DNA, 19 bp, Artificial
  MQbrain_1165; macaque brain D708ZXV02I2445 sequence
aactctgacctggcccact

SEQ ID NO: 10272 - DNA, 19 bp, Artificial
  MQbrain_1166; macaque brain D708ZXV02JQ94X sequence
gcagcagcggcggtggcgg

SEQ ID NO: 10273 - DNA, 18 bp, Artificial
  MQbrain_1167; macaque brain D708I2V02JQTSD sequence
tcttctctccgtggaccc

SEQ ID NO: 10274 - DNA, 18 bp, Artificial
  MQbrain_1168, MQbrain_1892, MQbrain_800, MQbrain_808, MQbrain_809; macaque brain D708YRU01C2TP1 sequence
tgggagtccctgggtttg

SEQ ID NO: 10275 - DNA, 18 bp, Artificial
  MQbrain_116; macaque brain D4G3X1F02JW7RK sequence
atttgtgggtctggcatc

SEQ ID NO: 10276 - DNA, 25 bp, Artificial
  MQbrain_1171; macaque brain D708I2V01CRBR8 sequence
gtagtcactggagctggggtcgctg

SEQ ID NO: 10277 - DNA, 18 bp, Artificial
  MQbrain_1174; macaque brain D708I2V02FYJET sequence
ctgtccagctgggctgtg

SEQ ID NO: 10278 - DNA, 22 bp, Artificial
  MQbrain_1175; macaque brain D708ZXV02I4KU3 sequence
aacggcgccaggaacccctgcg

SEQ ID NO: 10279 - DNA, 23 bp, Artificial
  MQbrain_1177; macaque brain D708YRU02HMS2K sequence
ttgattgtgtgtgcccgattgtg

SEQ ID NO: 10280 - DNA, 22 bp, Artificial
  MQbrain_1179; macaque brain D708YRU02H7HFC sequence
ctgggcctgctgtttcttcttc

SEQ ID NO: 10281 - DNA, 19 bp, Artificial
  MQbrain_117; macaque brain D4HK4YF01C0BFZ sequence
tgatgccatcctctatctc

SEQ ID NO: 10282 - DNA, 18 bp, Artificial
  MQbrain_1180; macaque brain D708ZXV02JQMM5 sequence
tgcccaagggacctgggg

SEQ ID NO: 10283 - DNA, 20 bp, Artificial
  MQbrain_1181; macaque brain D4HK8WR02GHZUP sequence
acgacttccgtgatgcctcg

SEQ ID NO: 10284 - DNA, 21 bp, Artificial
  MQbrain_1182; macaque brain D708ZXV02FL7MH sequence
gacctgagagactggagttcc

SEQ ID NO: 10285 - DNA, 28 bp, Artificial
  MQbrain_1183; macaque brain D708ZXV01D5MVR sequence
gagctcgcagtccaggtggaacagaccg

SEQ ID NO: 10286 - DNA, 21 bp, Artificial
  MQbrain_1184; macaque brain D708ZXV02IPS3N sequence
ggaggaatgggcagcctgtcg

SEQ ID NO: 10287 - DNA, 19 bp, Artificial
  MQbrain_1185; macaque brain D708I2V01CQ5EE sequence
tcccctgctgtgcctcagt

SEQ ID NO: 10288 - DNA, 21 bp, Artificial
  MQbrain_1186; macaque brain D708ZXV01D7U5X sequence
agaggtctgaggaaacttgtc

SEQ ID NO: 10289 - DNA, 21 bp, Artificial
  MQbrain_1187; macaque brain D708YRU01B9FAA sequence
tctgcccttcccatgtctgtc

SEQ ID NO: 10290 - DNA, 22 bp, Artificial
  MQbrain_1188; macaque brain D708ZXV01A7CVH sequence
cctgagggctcagcctccagcc

SEQ ID NO: 10291 - DNA, 19 bp, Artificial
  MQbrain_1189; macaque brain D708I2V01DCHO2 sequence
aacagctgaaagctaaagg

SEQ ID NO: 10292 - DNA, 19 bp, Artificial
  MQbrain_118; macaque brain D708YRU02F0ZRF sequence
ttgcagcggctgatccagg

SEQ ID NO: 10293 - DNA, 18 bp, Artificial
  MQbrain_1190; macaque brain D4HK8WR01AMN9M sequence
aaaggtgagcggggcctg

SEQ ID NO: 10294 - DNA, 22 bp, Artificial
  MQbrain_1191; macaque brain D4HK8WR01BFQZO sequence
tagggtgaacatcctcagtgtg

SEQ ID NO: 10295 - DNA, 18 bp, Artificial
  MQbrain_1192; macaque brain D708ZXV02G71N1 sequence
agtgggagaggtgaaatg

SEQ ID NO: 10296 - DNA, 19 bp, Artificial
  MQbrain_1193; macaque brain D708I2V01A04EC sequence
cttctgtgctcggtgctcc

SEQ ID NO: 10297 - DNA, 21 bp, Artificial
  MQbrain_1194; macaque brain D708YRU01AOGYU sequence
ttcccagagcaaactgttccc

SEQ ID NO: 10298 - DNA, 21 bp, Artificial
  MQbrain_1195; macaque brain D4HK4YF02GLEUK sequence
cttggaagagcaccttaggcc

SEQ ID NO: 10299 - DNA, 18 bp, Artificial
  MQbrain_1196; macaque brain D708I2V01B0V9N sequence
tgtccaggaggagctgct

SEQ ID NO: 10300 - DNA, 20 bp, Artificial
  MQbrain_1197; macaque brain D708ZXV02I4NTJ sequence
aggcgcagctgagaattctg

SEQ ID NO: 10301 - DNA, 19 bp, Artificial
  MQbrain_1198; macaque brain D708ZXV02IATY7 sequence
gggagcggttgcggagagg

SEQ ID NO: 10302 - DNA, 19 bp, Artificial
  MQbrain_1199; macaque brain D708ZXV02ICNWH sequence
aggaagctgcagctggagc

SEQ ID NO: 10303 - DNA, 20 bp, Artificial
  MQbrain_119; macaque brain D4HK8WR01A1ZKB, macaque brain D708YRU02F0WBW sequence
ctggcttggagtcagaaggt

SEQ ID NO: 10304 - DNA, 20 bp, Artificial
  MQbrain_119; macaque brain D4HK8WR02GOSGJ sequence
cctggcttggagtcagaagg

SEQ ID NO: 10305 - DNA, 19 bp, Artificial
  MQbrain_11; macaque brain D708YRU01A8322 sequence
aagggaggaagggtgatgg

SEQ ID NO: 10306 - DNA, 19 bp, Artificial
  MQbrain_1200; macaque brain D4HK8WR02G8ZFQ sequence
ctgcaactgtctgctgctc

SEQ ID NO: 10307 - DNA, 21 bp, Artificial
  MQbrain_1201, MQbrain_1404, MQbrain_300; macaque brain D708ZXV02F2ZIM sequence
ttggtcgtggacgtggtcagc

SEQ ID NO: 10308 - DNA, 18 bp, Artificial
  MQbrain_1202; macaque brain D708I2V01C0RJ8 sequence
gttgtgcacgggaggctg

SEQ ID NO: 10309 - DNA, 23 bp, Artificial
  MQbrain_1203; macaque brain D708YRU01ELIYB sequence
ctgtggtagcccagagatgaatg

SEQ ID NO: 10310 - DNA, 27 bp, Artificial
  MQbrain_1204; macaque brain D4HK8WR01BGLS8 sequence
ggctctgtgcctgtctctccagcccgg

SEQ ID NO: 10311 - DNA, 20 bp, Artificial
  MQbrain_1205, MQbrain_484; macaque brain D4HK8WR02FXNDD sequence
gctgaggtcccaggaggctg

SEQ ID NO: 10312 - DNA, 21 bp, Artificial
  MQbrain_1206; macaque brain D708ZXV02GR33A sequence
attgggggtgatggcagcctc

SEQ ID NO: 10313 - DNA, 22 bp, Artificial
  MQbrain_1207, MQbrain_591; macaque brain D708YRU02IFCS5 sequence
agggtgtcgagtgcctgcggct

SEQ ID NO: 10314 - DNA, 22 bp, Artificial
  MQbrain_1208; macaque brain D708YRU01CU45E sequence
ttggcttggggatggctgtcgc

SEQ ID NO: 10315 - DNA, 22 bp, Artificial
  MQbrain_1209; macaque brain D708I2V01A3Q1L sequence
ggggcctccgggtgggcaagct

SEQ ID NO: 10316 - DNA, 20 bp, Artificial
  MQbrain_120; macaque brain D708YRU02HS9N7 sequence
gggcgaggaggaagccggct

SEQ ID NO: 10317 - DNA, 19 bp, Artificial
  MQbrain_1210; macaque brain D708I2V01AV11D sequence
agcatggagggcaggcagg

SEQ ID NO: 10318 - DNA, 20 bp, Artificial
  MQbrain_1211; macaque brain D708YRU01BIZE0 sequence
gacctgaggatgggggcgtg

SEQ ID NO: 10319 - DNA, 23 bp, Artificial
  MQbrain_1212; macaque brain D708YRU01CMVMD sequence
gggccttgggagagagcaacttg

SEQ ID NO: 10320 - DNA, 24 bp, Artificial
  MQbrain_1213; macaque brain D708I2V01BEDPV sequence
ctcttcctttcccctgccccaagt

SEQ ID NO: 10321 - DNA, 19 bp, Artificial
  MQbrain_1214, MQbrain_1216, MQbrain_1217; macaque brain D708ZXV02H9AKX sequence
gtttccacagctgtagttg

SEQ ID NO: 10322 - DNA, 19 bp, Artificial
  MQbrain_1215; macaque brain D708ZXV01BVD40 sequence
tgtcggggacggtaaccgg

SEQ ID NO: 10323 - DNA, 26 bp, Artificial
  MQbrain_1218; macaque brain D708ZXV02IQDT8 sequence
gcctgaggctgagtgaggtgtgcttg

SEQ ID NO: 10324 - DNA, 18 bp, Artificial
  MQbrain_1219; macaque brain D4HK4YF02HS9XG sequence
accccctgctgtgccccc

SEQ ID NO: 10325 - DNA, 22 bp, Artificial
  MQbrain_121; macaque brain D708YRU01DOZP0 sequence
gtcagagggaagtggcaaattg

SEQ ID NO: 10326 - DNA, 21 bp, Artificial
  MQbrain_1220; macaque brain D708ZXV01AEJ0I sequence
cccatctcagctagctcatct

SEQ ID NO: 10327 - DNA, 22 bp, Artificial
  MQbrain_1221; macaque brain D708I2V01BO00F sequence
atcagatggtttggtttctgct

SEQ ID NO: 10328 - DNA, 21 bp, Artificial
  MQbrain_1222; macaque brain D708I2V01E7E0X sequence
ctggacatcgagatcgccacc

SEQ ID NO: 10329 - DNA, 22 bp, Artificial
  MQbrain_1222; macaque brain D708YRU01DH0PO sequence
ctggacatcgagatcgccacct

SEQ ID NO: 10330 - DNA, 21 bp, Artificial
  MQbrain_1225; macaque brain D4HK4YF02I7P98, macaque brain D708ZXV02JV5LI sequence
aacactggccttgctgtcctc

SEQ ID NO: 10331 - DNA, 19 bp, Artificial
  MQbrain_1226; macaque brain D708YRU02G8TUG sequence
gcggttgggggtgaggcgc

SEQ ID NO: 10332 - DNA, 22 bp, Artificial
  MQbrain_1227; macaque brain D4HK4YF01BBFD1 sequence
aaagggcagttccatgagtacc

SEQ ID NO: 10333 - DNA, 26 bp, Artificial
  MQbrain_1228; macaque brain D708ZXV02G99EA sequence
gcagtccctggcttcctcccctaccc

SEQ ID NO: 10334 - DNA, 20 bp, Artificial
  MQbrain_1229; macaque brain D708YRU01DPWPV sequence
gaagggccctggggtagttt

SEQ ID NO: 10335 - DNA, 21 bp, Artificial
  MQbrain_122; macaque brain D4HK4YF02HW39Z sequence
gagagagagatggcgagactg

SEQ ID NO: 10336 - DNA, 24 bp, Artificial
  MQbrain_122; macaque brain D4HK8WR01CDGQX sequence
tgagagagagagatggcgagactg

SEQ ID NO: 10337 - DNA, 22 bp, Artificial
  MQbrain_1230; macaque brain D4HK8WR02IK4R6 sequence
attactggagtccctaatcacg

SEQ ID NO: 10338 - DNA, 20 bp, Artificial
  MQbrain_1231; macaque brain D708I2V02FVT1Z sequence
ggttgtgctggagaaggccc

SEQ ID NO: 10339 - DNA, 25 bp, Artificial
  MQbrain_1232; macaque brain D708I2V01CBO7L sequence
ggggcacctatgagatggccatgct

SEQ ID NO: 10340 - DNA, 21 bp, Artificial
  MQbrain_1232; macaque brain D708YRU02JVOGS sequence
atgagatggccatgctgaatc

SEQ ID NO: 10341 - DNA, 25 bp, Artificial
  MQbrain_1233; macaque brain D708ZXV01CJD4G sequence
tcccctggggacactgaggaggtgg

SEQ ID NO: 10342 - DNA, 20 bp, Artificial
  MQbrain_1234; macaque brain D708YRU01AEVNM sequence
cttctggaccaggtgtggtg

SEQ ID NO: 10343 - DNA, 18 bp, Artificial
  MQbrain_1235, MQbrain_1323, MQbrain_1417, MQbrain_153, MQbrain_155, MQbrain_1958, MQbrain_1985, MQbrain_579; macaque brain D4HK8WR01CEUZR sequence
gaggagtacccagacagg

SEQ ID NO: 10344 - DNA, 18 bp, Artificial
  MQbrain_1236, MQbrain_1237, MQbrain_1812, MQbrain_1813; macaque brain D4HK8WR01C9Y9P sequence
ccaggagagagggacagg

SEQ ID NO: 10345 - DNA, 20 bp, Artificial
  MQbrain_1238; macaque brain D708I2V02F5L1Z sequence
ctggggctccagaggccagg

SEQ ID NO: 10346 - DNA, 18 bp, Artificial
  MQbrain_1239; macaque brain D708ZXV02FS573 sequence
atcacattgccagggttg

SEQ ID NO: 10347 - DNA, 22 bp, Artificial
  MQbrain_123; macaque brain D4HK4YF02G72TA sequence
ttgctgggggctgctgagaagg

SEQ ID NO: 10348 - DNA, 19 bp, Artificial
  MQbrain_1240; macaque brain D708ZXV02HDRW7 sequence
ccacggcagatgtctggtc

SEQ ID NO: 10349 - DNA, 22 bp, Artificial
  MQbrain_1241; macaque brain D708I2V01CBKV0 sequence
aacgtgaaaggaaagggggacc

SEQ ID NO: 10350 - DNA, 19 bp, Artificial
  MQbrain_1242; macaque brain D708I2V02G6XKO sequence
atgctgtcttggaatggtg

SEQ ID NO: 10351 - DNA, 24 bp, Artificial
  MQbrain_1243; macaque brain D4HK8WR02GJRFM sequence
aacttgtgttcgaagcctgtagcc

SEQ ID NO: 10352 - DNA, 18 bp, Artificial
  MQbrain_1244; macaque brain D708YRU01ENKL8 sequence
aagctccctggcagcctg

SEQ ID NO: 10353 - DNA, 19 bp, Artificial
  MQbrain_1245; macaque brain D708ZXV01CI1GF sequence
ttgagcctgagtcctacct

SEQ ID NO: 10354 - DNA, 21 bp, Artificial
  MQbrain_1246; macaque brain D708YRU01DSVZP sequence
agctgtgctacgtcgccctgg

SEQ ID NO: 10355 - DNA, 18 bp, Artificial
  MQbrain_1248, MQbrain_1694; macaque brain D4HK8WR01B82O1 sequence
gactgtggatggcccctc

SEQ ID NO: 10356 - DNA, 26 bp, Artificial
  MQbrain_1249; macaque brain D708YRU02GJQ73 sequence
aagggccgcattggctgtgaggtgtc

SEQ ID NO: 10357 - DNA, 20 bp, Artificial
  MQbrain_124; macaque brain D4HK4YF02JWE0F sequence
tggcctgcgagggggcatcc

SEQ ID NO: 10358 - DNA, 20 bp, Artificial
  MQbrain_1250; macaque brain D4G3X1F01C9WX4 sequence
ttggagtggtgacaagtatc

SEQ ID NO: 10359 - DNA, 17 bp, Artificial
  MQbrain_1251; macaque brain D708YRU01EGJVP, macaque brain D708ZXV01EC1Y8 sequence
taggttgtgtggttaaa

SEQ ID NO: 10360 - DNA, 19 bp, Artificial
  MQbrain_1255; macaque brain D708YRU01CZ0DU sequence
gaggaaagagtgaggggtg

SEQ ID NO: 10361 - DNA, 22 bp, Artificial
  MQbrain_1256; macaque brain D708ZXV01BGNUJ sequence
gatttgggtcagatagatttgg

SEQ ID NO: 10362 - DNA, 18 bp, Artificial
  MQbrain_1257; macaque brain D4HK8WR02IO047 sequence
gttctagcttggtctctg

SEQ ID NO: 10363 - DNA, 20 bp, Artificial
  MQbrain_1258; macaque brain D708YRU02H0HTZ sequence
acctgttgcctccttgagtc

SEQ ID NO: 10364 - DNA, 18 bp, Artificial
  MQbrain_1259; macaque brain D4HK8WR02FVPAY sequence
tcttccagaggtaccgct

SEQ ID NO: 10365 - DNA, 25 bp, Artificial
  MQbrain_125; macaque brain D4HK8WR01CNIHF sequence
tgttgagttttccccttcagctgcc

SEQ ID NO: 10366 - DNA, 20 bp, Artificial
  MQbrain_1260; macaque brain D708I2V02JJ4HZ sequence
aggcagggaggggtccattc

SEQ ID NO: 10367 - DNA, 21 bp, Artificial
  MQbrain_1261; macaque brain D708ZXV02FM6CY sequence
gggacagaaagtagtcagacg

SEQ ID NO: 10368 - DNA, 21 bp, Artificial
  MQbrain_1263; macaque brain D708I2V02IZAPO sequence
tctggtggttgagctgagagg

SEQ ID NO: 10369 - DNA, 19 bp, Artificial
  MQbrain_1264; macaque brain D4HK8WR02GJ0UL sequence
ggaatctgcctgggcctgg

SEQ ID NO: 10370 - DNA, 23 bp, Artificial
  MQbrain_1265; macaque brain D4HK8WR02IHLFQ sequence
gtggtgctgggtatcagtctggg

SEQ ID NO: 10371 - DNA, 20 bp, Artificial
  MQbrain_1266, MQbrain_1730, MQbrain_1739, MQbrain_1743, MQbrain_1749, MQbrain_1751, MQbrain_1758, MQbrain_1766, MQbrain_1769, MQbrain_1775, MQbrain_1785, MQbrain_1788, MQbrain_1797, MQbrain_1816, MQbrain_1818, MQbrain_1822, MQbrain_1830, MQbrain_1835, MQbrain_1852,
tttggcaaagtgaaagaagg

SEQ ID NO: 10372 - DNA, 18 bp, Artificial
  MQbrain_1267; macaque brain D708I2V02HKPCF sequence
gcctttgccatcactgcc

SEQ ID NO: 10373 - DNA, 21 bp, Artificial
  MQbrain_1268; macaque brain D708I2V02HIVC2, macaque brain D708YRU01BDA2K sequence
ctggggcacggtgagtcattc

SEQ ID NO: 10374 - DNA, 20 bp, Artificial
  MQbrain_1268; macaque brain D708YRU02H6UPN sequence
ctggggcacggtgagtcatt

SEQ ID NO: 10375 - DNA, 18 bp, Artificial
  MQbrain_1269; macaque brain D708I2V01EVFR4 sequence
agatggtgtgactgttgc

SEQ ID NO: 10376 - DNA, 19 bp, Artificial
  MQbrain_126; macaque brain D708ZXV01BLPKE sequence
attctcctaagggtcagtg

SEQ ID NO: 10377 - DNA, 19 bp, Artificial
  MQbrain_1270; macaque brain D708ZXV02G8YJ6 sequence
tggaggtgtgagaagcctg

SEQ ID NO: 10378 - DNA, 18 bp, Artificial
  MQbrain_1271; macaque brain D708ZXV02FQ1H7 sequence
ggggcagattaaatggtc

SEQ ID NO: 10379 - DNA, 22 bp, Artificial
  MQbrain_1272; macaque brain D708I2V01CFI9G sequence
ggtggatgaggtggcttctggc

SEQ ID NO: 10380 - DNA, 23 bp, Artificial
  MQbrain_1273, MQbrain_916; macaque brain D4HK8WR02GY07H sequence
tgaagcagctggctagtggcttg

SEQ ID NO: 10381 - DNA, 18 bp, Artificial
  MQbrain_1274; macaque brain D708ZXV02FFDHA sequence
attattgtgtgataatgg

SEQ ID NO: 10382 - DNA, 20 bp, Artificial
  MQbrain_1276; macaque brain D708YRU02ITYDF sequence
ccttctgggagctgggtagg

SEQ ID NO: 10383 - DNA, 19 bp, Artificial
  MQbrain_1277; macaque brain D708ZXV02JZ0MX sequence
tttcattcaggtggtggtt

SEQ ID NO: 10384 - DNA, 18 bp, Artificial
  MQbrain_1278; macaque brain D708I2V02JUJQI sequence
ggctgtctcctctggatc

SEQ ID NO: 10385 - DNA, 24 bp, Artificial
  MQbrain_1279; macaque brain D708ZXV01B8Y9I sequence
gactggggtggcggcacactaggg

SEQ ID NO: 10386 - DNA, 18 bp, Artificial
  MQbrain_127; macaque brain D708YRU01EF3GR sequence
accctggggttgctgagc

SEQ ID NO: 10387 - DNA, 24 bp, Artificial
  MQbrain_1280; macaque brain D708I2V02JLNOE sequence
gaggaggaggcctgtgagcactgg

SEQ ID NO: 10388 - DNA, 19 bp, Artificial
  MQbrain_1281; macaque brain D708ZXV01C51VW sequence
cttccgcggcaccacttgt

SEQ ID NO: 10389 - DNA, 23 bp, Artificial
  MQbrain_1282; macaque brain D708I2V01CE6EO sequence
gattctgagctgggagataactg

SEQ ID NO: 10390 - DNA, 24 bp, Artificial
  MQbrain_1283; macaque brain D708I2V02FMJW1 sequence
gtgagtggggaggcatttctgcgg

SEQ ID NO: 10391 - DNA, 19 bp, Artificial
  MQbrain_1284; macaque brain D708I2V01CAJI1 sequence
ttttggtgagtggaacctg

SEQ ID NO: 10392 - DNA, 22 bp, Artificial
  MQbrain_1285; macaque brain D708I2V01AW1NW sequence
ttcctgtggggcggatgctgcg

SEQ ID NO: 10393 - DNA, 21 bp, Artificial
  MQbrain_1285; macaque brain D708ZXV02JRUER sequence
ctgtggggcggatgctgcggt

SEQ ID NO: 10394 - DNA, 18 bp, Artificial
  MQbrain_1286; macaque brain D708YRU01A4OW6 sequence
gctgactggaccctgggt

SEQ ID NO: 10395 - DNA, 21 bp, Artificial
  MQbrain_1287; macaque brain D4HK8WR01DRW3U, macaque brain D4HK8WR02J4IE2 sequence
aaggccatctggagtgttctg

SEQ ID NO: 10396 - DNA, 22 bp, Artificial
  MQbrain_1288; macaque brain D708YRU02HLLWI sequence
agatggagcctggggttctctg

SEQ ID NO: 10397 - DNA, 19 bp, Artificial
  MQbrain_1289; macaque brain D708ZXV01BVJI4 sequence
ccataggaaggggaaggct

SEQ ID NO: 10398 - DNA, 21 bp, Artificial
  MQbrain_128; macaque brain D4G3X1F01DBIWC sequence
gacatggcgagtgcagtgctg

SEQ ID NO: 10399 - DNA, 23 bp, Artificial
  MQbrain_1290; macaque brain D708I2V02H92UD sequence
cctggaatggcagctctgctagc

SEQ ID NO: 10400 - DNA, 18 bp, Artificial
  MQbrain_1291; macaque brain D708I2V01D1FII sequence
agggaaatgggcagactg

SEQ ID NO: 10401 - DNA, 19 bp, Artificial
  MQbrain_1292, MQbrain_1522, MQbrain_1657, MQbrain_212, MQbrain_641, MQbrain_839; macaque brain D708YRU02IMH5D sequence
attggagggttgagctttg

SEQ ID NO: 10402 - DNA, 24 bp, Artificial
  MQbrain_1293, PT_188; chimp brain 125859, macaque brain D708ZXV02HRL9A sequence
ctaccccaggatgccagcatagtt

SEQ ID NO: 10403 - DNA, 25 bp, Artificial
  MQbrain_1293; macaque brain D708I2V01EWK3B sequence
actaccccaggatgccagcatagtt

SEQ ID NO: 10404 - DNA, 18 bp, Artificial
  MQbrain_1293; macaque brain D708ZXV02GVD2P sequence
ctaccccaggatgccagc

SEQ ID NO: 10405 - DNA, 20 bp, Artificial
  MQbrain_1295; macaque brain D708I2V02H125E sequence
gtgctgtggccagcctgctg

SEQ ID NO: 10406 - DNA, 18 bp, Artificial
  MQbrain_1296; macaque brain D4HK8WR01A29UE sequence
agatgaagtccaggcttg

SEQ ID NO: 10407 - DNA, 18 bp, Artificial
  MQbrain_1297; macaque brain D4G3X1F01BW52D sequence
aaggaaacctggcctggg

SEQ ID NO: 10408 - DNA, 18 bp, Artificial
  MQbrain_1298; macaque brain D4HK8WR01DL813 sequence
ggaagatgggagccaggg

SEQ ID NO: 10409 - DNA, 18 bp, Artificial
  MQbrain_1299; macaque brain D4G3X1F01AY2VT sequence
gagctgggtgtgtctgcg

SEQ ID NO: 10410 - DNA, 18 bp, Artificial
  MQbrain_129; macaque brain D708YRU02J035A sequence
tgggaaaggctgggtggg

SEQ ID NO: 10411 - DNA, 29 bp, Artificial
  MQbrain_12; macaque brain D708I2V02F8NY5 sequence
tcagtgcttaggcctggggtccagcctgg

SEQ ID NO: 10412 - DNA, 22 bp, Artificial
  MQbrain_1300; macaque brain D4HK4YF01DNLO3 sequence
tctgggtcctggcctgggtagg

SEQ ID NO: 10413 - DNA, 20 bp, Artificial
  MQbrain_1301; macaque brain D708YRU01CH1JT sequence
ccctccgggacgcgcgtggt

SEQ ID NO: 10414 - DNA, 20 bp, Artificial
  MQbrain_1302; macaque brain D4HK4YF01AM6IR sequence
ctctcgagtggagcattgtg

SEQ ID NO: 10415 - DNA, 24 bp, Artificial
  MQbrain_1303; macaque brain D708I2V01D4FM0 sequence
gaggactgactggctggcctgggg

SEQ ID NO: 10416 - DNA, 20 bp, Artificial
  MQbrain_1304; macaque brain D708ZXV01BKLO3 sequence
cgagtgttgtctacgagggc

SEQ ID NO: 10417 - DNA, 18 bp, Artificial
  MQbrain_1305; macaque brain D4G3X1F02IRYGH sequence
agtgtgaggagggggacg

SEQ ID NO: 10418 - DNA, 18 bp, Artificial
  MQbrain_1307; macaque brain D4HK8WR01DQFCX sequence
ttggggaggaagttggtg

SEQ ID NO: 10419 - DNA, 23 bp, Artificial
  MQbrain_1308, MQbrain_1798, MQbrain_1802; macaque brain D4HK8WR01C4726 sequence
aagcaagagatggctagtgcttc

SEQ ID NO: 10420 - DNA, 19 bp, Artificial
  MQbrain_1309; macaque brain D708YRU01CXEM4 sequence
ctgctctggccgcctgtct

SEQ ID NO: 10421 - DNA, 18 bp, Artificial
  MQbrain_130; macaque brain D4HK8WR01B1CDQ sequence
ggggttgtggggtctttg

SEQ ID NO: 10422 - DNA, 22 bp, Artificial
  MQbrain_1311; macaque brain D708YRU01ERYBK sequence
cgaaagggggagggggaaggtc

SEQ ID NO: 10423 - DNA, 20 bp, Artificial
  MQbrain_1312, MQbrain_601; macaque brain D4HK8WR02FYTLC sequence
gaaagccgccatggccctgg

SEQ ID NO: 10424 - DNA, 22 bp, Artificial
  MQbrain_1312, MQbrain_601; macaque brain D708I2V02GYIPP sequence
gatgccatgaaagccgccatgg

SEQ ID NO: 10425 - DNA, 18 bp, Artificial
  MQbrain_1313, MQbrain_688; macaque brain D708I2V02HGG5X sequence
gtgggaggggctgttgtg

SEQ ID NO: 10426 - DNA, 23 bp, Artificial
  MQbrain_1314; macaque brain D708ZXV02FX7F9 sequence
gtggagtcagcattgtgccctgg

SEQ ID NO: 10427 - DNA, 20 bp, Artificial
  MQbrain_1315; macaque brain D708I2V02JCR35 sequence
cgagatcaccgcagagggct

SEQ ID NO: 10428 - DNA, 23 bp, Artificial
  MQbrain_1316; macaque brain D708YRU01CO81Z sequence
gaaggcccaggctgagagacccc

SEQ ID NO: 10429 - DNA, 21 bp, Artificial
  MQbrain_1317; macaque brain D708YRU02IDZLF sequence
tgtgggacctctggccttggc

SEQ ID NO: 10430 - DNA, 22 bp, Artificial
  MQbrain_1318; macaque brain D4G3X1F01DYGPY, macaque brain D4HK4YF02FPH4M, macaque brain D708YRU01DX0Y7, macaque brain D708ZXV02FTKWL sequence
ctgccatctggtaccagccttt

SEQ ID NO: 10431 - DNA, 19 bp, Artificial
  MQbrain_1318; macaque brain D4G3X1F02JA2GO sequence
ctgccatctggtaccagcc

SEQ ID NO: 10432 - DNA, 21 bp, Artificial
  MQbrain_1318; macaque brain D4HK4YF02I6VOA sequence
ctgccatctggtaccagcctt

SEQ ID NO: 10433 - DNA, 21 bp, Artificial
  MQbrain_1319; macaque brain D708ZXV02JKMAV sequence
ctgtttgctggaggcatgctg

SEQ ID NO: 10434 - DNA, 18 bp, Artificial
  MQbrain_131; macaque brain D4HK8WR02FL6EH sequence
ggaggagttggagccatg

SEQ ID NO: 10435 - DNA, 19 bp, Artificial
  MQbrain_1320; macaque brain D4HK8WR01BB8I7 sequence
tgatggtgacttgtcttgc

SEQ ID NO: 10436 - DNA, 18 bp, Artificial
  MQbrain_1321; macaque brain D708ZXV02HLD69 sequence
ctgctgggactgagaagg

SEQ ID NO: 10437 - DNA, 23 bp, Artificial
  MQbrain_1322; macaque brain D708ZXV02I4M25 sequence
attctcttggaagcgaaggtgtc

SEQ ID NO: 10438 - DNA, 18 bp, Artificial
  MQbrain_1324; macaque brain D4HK4YF02HK77O sequence
atggtggcggctcgagtg

SEQ ID NO: 10439 - DNA, 19 bp, Artificial
  MQbrain_1325; macaque brain D708ZXV02JC7FX sequence
tctgccgggccccctgggt

SEQ ID NO: 10440 - DNA, 21 bp, Artificial
  MQbrain_1326; macaque brain D4HK4YF01EUXK4 sequence
ggatgtgtgcgaagcctgacg

SEQ ID NO: 10441 - DNA, 18 bp, Artificial
  MQbrain_1327; macaque brain D708I2V01B3HL5 sequence
aaaggctcaaggagagtg

SEQ ID NO: 10442 - DNA, 22 bp, Artificial
  MQbrain_1328; macaque brain D708I2V02G6MA6 sequence
cacaggccccaggctagtgtcc

SEQ ID NO: 10443 - DNA, 19 bp, Artificial
  MQbrain_1329; macaque brain D4HK4YF02FWAQH sequence
tgtcttaggagtcagtatg

SEQ ID NO: 10444 - DNA, 20 bp, Artificial
  MQbrain_132; macaque brain D4HK4YF01BDGY9 sequence
gttgtatagttgtgtaatgg

SEQ ID NO: 10445 - DNA, 19 bp, Artificial
  MQbrain_1330; macaque brain D4HK4YF01BHGAE sequence
tctggtgcaaggaattatg

SEQ ID NO: 10446 - DNA, 21 bp, Artificial
  MQbrain_1331; macaque brain D708YRU01AKN7P sequence
gtggccggggaggagaggtgc

SEQ ID NO: 10447 - DNA, 20 bp, Artificial
  MQbrain_1332; macaque brain D708ZXV01EUW1M sequence
ctgtgaagccctcgcaactc

SEQ ID NO: 10448 - DNA, 24 bp, Artificial
  MQbrain_1333; macaque brain D708YRU02H7TSP sequence
gtcttttgaattgaggagttagtc

SEQ ID NO: 10449 - DNA, 20 bp, Artificial
  MQbrain_1334; macaque brain D708ZXV02FY7I7 sequence
gagacaggcccttgcagagg

SEQ ID NO: 10450 - DNA, 19 bp, Artificial
  MQbrain_1335; macaque brain D708ZXV01CCMRK sequence
ggagcctgaggagccaagc

SEQ ID NO: 10451 - DNA, 23 bp, Artificial
  MQbrain_1336; macaque brain D708I2V01C5AWG sequence
ctggcgggtgcttaggccgagtt

SEQ ID NO: 10452 - DNA, 18 bp, Artificial
  MQbrain_1337, MQbrain_392, MQbrain_534; macaque brain D708YRU02HGRU4 sequence
agggggctgaggatgagg

SEQ ID NO: 10453 - DNA, 18 bp, Artificial
  MQbrain_1338; macaque brain D4HK8WR01B9AY6 sequence
tcctgacttggagtgctg

SEQ ID NO: 10454 - DNA, 18 bp, Artificial
  MQbrain_1339, MQbrain_1493; macaque brain D4HK8WR02GNA6O sequence
gtggcagtgggggctctg

SEQ ID NO: 10455 - DNA, 23 bp, Artificial
  MQbrain_133; macaque brain D708ZXV02HZX2A sequence
ttactgaagtagcacctagaagg

SEQ ID NO: 10456 - DNA, 19 bp, Artificial
  MQbrain_1340; macaque brain D708I2V02F56ZR sequence
aagccagggcctgaagagg

SEQ ID NO: 10457 - DNA, 23 bp, Artificial
  MQbrain_1341; macaque brain D4HK4YF02HPOQK sequence
tatcttaccttagagaatgtgcc

SEQ ID NO: 10458 - DNA, 19 bp, Artificial
  MQbrain_1342; macaque brain D4HK4YF02HRNW3 sequence
tccagcccagggaagctcc

SEQ ID NO: 10459 - DNA, 21 bp, Artificial
  MQbrain_1343; macaque brain D4HK8WR02IMRHZ sequence
tttgttacgacctggaagatt

SEQ ID NO: 10460 - DNA, 24 bp, Artificial
  MQbrain_1345; macaque brain D708I2V02IABT0 sequence
aggggaatttggaaggagaggttc

SEQ ID NO: 10461 - DNA, 19 bp, Artificial
  MQbrain_1346; macaque brain D708I2V01BME5V sequence
gaggggaatgtgttgagtt

SEQ ID NO: 10462 - DNA, 22 bp, Artificial
  MQbrain_1347; macaque brain D4HK8WR01EOXJ3 sequence
atttttagtccagagctctatg

SEQ ID NO: 10463 - DNA, 25 bp, Artificial
  MQbrain_1348; macaque brain D708YRU02HAJQ5 sequence
aagggtttggggtcactttgttgtg

SEQ ID NO: 10464 - DNA, 20 bp, Artificial
  MQbrain_1349; macaque brain D708I2V02I3D6T sequence
ggtgaggagaagagaggttg

SEQ ID NO: 10465 - DNA, 21 bp, Artificial
  MQbrain_134; macaque brain D4G3X1F01EVYJI sequence
gctttagagctggagttgggg

SEQ ID NO: 10466 - DNA, 20 bp, Artificial
  MQbrain_1350; macaque brain D4HK8WR02GB0Q1 sequence
attctcctccctgggatttg

SEQ ID NO: 10467 - DNA, 25 bp, Artificial
  MQbrain_1351; macaque brain D708I2V01DZWHF sequence
agagacagtcatgctgggtgtgtcc

SEQ ID NO: 10468 - DNA, 22 bp, Artificial
  MQbrain_1352; macaque brain D708I2V01AI71S sequence
gtggctgaggctggccaagacg

SEQ ID NO: 10469 - DNA, 22 bp, Artificial
  MQbrain_1353; macaque brain D708YRU01DCX29 sequence
gaaagagtgaggtggctggatc

SEQ ID NO: 10470 - DNA, 20 bp, Artificial
  MQbrain_1354; macaque brain D708ZXV01AD2FP sequence
ctcccagctggctgaggtgg

SEQ ID NO: 10471 - DNA, 23 bp, Artificial
  MQbrain_1355; macaque brain D708YRU02JLJK9 sequence
ttggtgctcagccctcccactgg

SEQ ID NO: 10472 - DNA, 18 bp, Artificial
  MQbrain_1356; macaque brain D708I2V01A20VD sequence
gtcctgactgcctcttgg

SEQ ID NO: 10473 - DNA, 20 bp, Artificial
  MQbrain_1357; macaque brain D708I2V02F8IRM sequence
tgggagcgggcgggagcggg

SEQ ID NO: 10474 - DNA, 26 bp, Artificial
  MQbrain_1358; macaque brain D4HK8WR02I6FO9 sequence
gtcatagtgggtggccctctttgtcc

SEQ ID NO: 10475 - DNA, 20 bp, Artificial
  MQbrain_1359; macaque brain D4HK8WR02IG5AM sequence
gggtgcaagtgatggaggtg

SEQ ID NO: 10476 - DNA, 18 bp, Artificial
  MQbrain_135; macaque brain D708YRU02G028A sequence
acccagagcacagcctcc

SEQ ID NO: 10477 - DNA, 20 bp, Artificial
  MQbrain_1360; macaque brain D708YRU01EIRPY sequence
tgccactttcttgctcttcc

SEQ ID NO: 10478 - DNA, 22 bp, Artificial
  MQbrain_1361; macaque brain D708I2V02I1023 sequence
cagagagcaaggagccttcccc

SEQ ID NO: 10479 - DNA, 19 bp, Artificial
  MQbrain_1362; macaque brain D708I2V01EZW8G sequence
aagccctggctggcagcgg

SEQ ID NO: 10480 - DNA, 24 bp, Artificial
  MQbrain_1363; macaque brain D4HK4YF01ET17K sequence
agagcaggggctgttgccgaaagg

SEQ ID NO: 10481 - DNA, 23 bp, Artificial
  MQbrain_1364; macaque brain D4G3X1F02H1ZWD sequence
agcctcttttgtccttcccactc

SEQ ID NO: 10482 - DNA, 24 bp, Artificial
  MQbrain_1364; macaque brain D4G3X1F02J46K8 sequence
agcctcttttgtccttcccactcc

SEQ ID NO: 10483 - DNA, 18 bp, Artificial
  MQbrain_1365; macaque brain D708I2V01B6SBF sequence
gatgctgggcttgggtgg

SEQ ID NO: 10484 - DNA, 19 bp, Artificial
  MQbrain_1366; macaque brain D708I2V02JK3HX sequence
gcagggtgcaggtcaatgt

SEQ ID NO: 10485 - DNA, 18 bp, Artificial
  MQbrain_1368; macaque brain D708I2V02HE8B1 sequence
ctgcctggtgctgctgtt

SEQ ID NO: 10486 - DNA, 21 bp, Artificial
  MQbrain_1369; macaque brain D4HK8WR01BNBFU sequence
gactagggttgggcagaggtc

SEQ ID NO: 10487 - DNA, 21 bp, Artificial
  MQbrain_1370; macaque brain D4HK4YF01AFUJ7 sequence
aaggtggagctgagatgagcc

SEQ ID NO: 10488 - DNA, 19 bp, Artificial
  MQbrain_1371; macaque brain D708ZXV01BCS3E sequence
gtggcagtgagactgtggg

SEQ ID NO: 10489 - DNA, 21 bp, Artificial
  MQbrain_1372; macaque brain D4HK4YF01CTCKL sequence
acttctgggaaatggcaggtg

SEQ ID NO: 10490 - DNA, 21 bp, Artificial
  MQbrain_1373; macaque brain D708YRU02IWHUZ sequence
gcctgtgagagctctgccttg

SEQ ID NO: 10491 - DNA, 18 bp, Artificial
  MQbrain_1374; macaque brain D4G3X1F01EA9R5 sequence
aggggtggggaagagctg

SEQ ID NO: 10492 - DNA, 24 bp, Artificial
  MQbrain_1375; macaque brain D4HK8WR02HNETC sequence
gaagaatggtggagtgcggaaggg

SEQ ID NO: 10493 - DNA, 25 bp, Artificial
  MQbrain_1376; macaque brain D708ZXV02I9XPM sequence
ctgccttggcaaggggtccagaagg

SEQ ID NO: 10494 - DNA, 20 bp, Artificial
  MQbrain_1377; macaque brain D708I2V02G9P68 sequence
gaagacacagctcagcttgg

SEQ ID NO: 10495 - DNA, 19 bp, Artificial
  MQbrain_1378; macaque brain D4HK4YF01AGL9U sequence
gactctggctggcatgctg

SEQ ID NO: 10496 - DNA, 21 bp, Artificial
  MQbrain_1379; macaque brain D708ZXV01BN5BX sequence
ctctcccgggtccctggcacc

SEQ ID NO: 10497 - DNA, 20 bp, Artificial
  MQbrain_1380; macaque brain D708ZXV01CVGMX sequence
aggaaggggcgatgggtggg

SEQ ID NO: 10498 - DNA, 23 bp, Artificial
  MQbrain_1382; macaque brain D4HK8WR02GKAU8 sequence
ctctgcttcctcctcacaacccc

SEQ ID NO: 10499 - DNA, 19 bp, Artificial
  MQbrain_1383; macaque brain D708ZXV01A2MYP sequence
aatgaggtggcgcaggctt

SEQ ID NO: 10500 - DNA, 19 bp, Artificial
  MQbrain_1384; macaque brain D708ZXV01CKX3H sequence
gatggaggcctgacttgct

SEQ ID NO: 10501 - DNA, 21 bp, Artificial
  MQbrain_1385; macaque brain D4G3X1F02HJZ7U sequence
cacattgtgcccagctctccc

SEQ ID NO: 10502 - DNA, 18 bp, Artificial
  MQbrain_1386, MQbrain_93; macaque brain D708YRU01EJ5MQ sequence
tttgggactggcctttga

SEQ ID NO: 10503 - DNA, 21 bp, Artificial
  MQbrain_1387; macaque brain D4G3X1F02IMOAK sequence
aggggcgggtgggtctggatg

SEQ ID NO: 10504 - DNA, 25 bp, Artificial
  MQbrain_1388; macaque brain D4G3X1F01D6E74 sequence
gaaggaggtgctgacccctgggtgc

SEQ ID NO: 10505 - DNA, 22 bp, Artificial
  MQbrain_1389; macaque brain D708ZXV01DRNE0 sequence
agttccgctccaggcctagtcc

SEQ ID NO: 10506 - DNA, 21 bp, Artificial
  MQbrain_138; macaque brain D708ZXV02JDYA7 sequence
aactcgagtcctattaatgcc

SEQ ID NO: 10507 - DNA, 19 bp, Artificial
  MQbrain_1390; macaque brain D708ZXV02G57VH sequence
gatactgaaggaaggggcc

SEQ ID NO: 10508 - DNA, 26 bp, Artificial
  MQbrain_1392; macaque brain D4G3X1F02IX28A sequence
aggccttgggtggctggagggctttg

SEQ ID NO: 10509 - DNA, 19 bp, Artificial
  MQbrain_1393; macaque brain D4HK8WR01BHXI0 sequence
tgggccaggcaagggagtc

SEQ ID NO: 10510 - DNA, 22 bp, Artificial
  MQbrain_1394; macaque brain D708I2V01EI9ZL sequence
tggactgaggggagctgatttc

SEQ ID NO: 10511 - DNA, 22 bp, Artificial
  MQbrain_1395; macaque brain D708YRU02FITS9 sequence
atggggtggcccttgtggtagg

SEQ ID NO: 10512 - DNA, 20 bp, Artificial
  MQbrain_1396; macaque brain D4HK8WR01D7GL3 sequence
cgctgaggtgtgtgatgatt

SEQ ID NO: 10513 - DNA, 20 bp, Artificial
  MQbrain_1397; macaque brain D708I2V01B9KUK sequence
aagtgtgtgtgtgcgtgtgc

SEQ ID NO: 10514 - DNA, 21 bp, Artificial
  MQbrain_1398; macaque brain D708YRU01D9ME2 sequence
aaggtcattggtaggtgttgc

SEQ ID NO: 10515 - DNA, 24 bp, Artificial
  MQbrain_1399; macaque brain D708ZXV02HWLQU sequence
cacaccctactgcaccttcctgtt

SEQ ID NO: 10516 - DNA, 22 bp, Artificial
  MQbrain_139; macaque brain D708YRU01EWFRF sequence
aggctctgaggatggtcaactc

SEQ ID NO: 10517 - DNA, 21 bp, Artificial
  MQbrain_13; macaque brain D4G3X1F02HBVAE sequence
tcgagggaaaggtcctggctg

SEQ ID NO: 10518 - DNA, 19 bp, Artificial
  MQbrain_1400; macaque brain D708ZXV01BIRQN sequence
tgggagctgggctgtcagg

SEQ ID NO: 10519 - DNA, 22 bp, Artificial
  MQbrain_1401; macaque brain D708I2V02GXZBU sequence
taaaaactctgggtggagaagg

SEQ ID NO: 10520 - DNA, 19 bp, Artificial
  MQbrain_1402; macaque brain D4G3X1F02HJ2MO sequence
cgtggcttccccctgcgcc

SEQ ID NO: 10521 - DNA, 18 bp, Artificial
  MQbrain_1403; macaque brain D708ZXV01EZZV4 sequence
tgaaactgccaaaggagc

SEQ ID NO: 10522 - DNA, 20 bp, Artificial
  MQbrain_1405; macaque brain D4G3X1F01APC67 sequence
ccggacacgtgccagcaatg

SEQ ID NO: 10523 - DNA, 25 bp, Artificial
  MQbrain_1407; macaque brain D708ZXV02JKLP4 sequence
ctggctgctggaaggtctgaagttc

SEQ ID NO: 10524 - DNA, 20 bp, Artificial
  MQbrain_1408; macaque brain D708I2V01BH8LE sequence
ctctgcccatgggggggtgg

SEQ ID NO: 10525 - DNA, 22 bp, Artificial
  MQbrain_140; macaque brain D4G3X1F02H0KON sequence
gacctgagccagacccatgttg

SEQ ID NO: 10526 - DNA, 20 bp, Artificial
  MQbrain_1410; macaque brain D708I2V02JOWE0 sequence
gttatctgtgaagggttgtg

SEQ ID NO: 10527 - DNA, 19 bp, Artificial
  MQbrain_1411; macaque brain D4HK4YF02I2PHF sequence
gtgggcggcaggctggagg

SEQ ID NO: 10528 - DNA, 18 bp, Artificial
  MQbrain_1412; macaque brain D708ZXV02H1XXJ sequence
agggtggtctggtggtgg

SEQ ID NO: 10529 - DNA, 26 bp, Artificial
  MQbrain_1413; macaque brain D4HK4YF01BI5W7 sequence
ctgcccccctgctgtgacagtttctc

SEQ ID NO: 10530 - DNA, 25 bp, Artificial
  MQbrain_1414; macaque brain D708YRU01CR7AR sequence
gagcccgggtctggatttctgtggg

SEQ ID NO: 10531 - DNA, 25 bp, Artificial
  MQbrain_1415; macaque brain D708YRU01BTQTT sequence
cctccctcccttgcccagagcagcc

SEQ ID NO: 10532 - DNA, 20 bp, Artificial
  MQbrain_1418; macaque brain D4HK8WR02HYR4Z sequence
ccccctggacatccttcacc

SEQ ID NO: 10533 - DNA, 18 bp, Artificial
  MQbrain_1419; macaque brain D708I2V01DY7KR sequence
tgggaaggtcctggggtc

SEQ ID NO: 10534 - DNA, 25 bp, Artificial
  MQbrain_141; macaque brain D708I2V02GUNJ7 sequence
gttctgctaggtttgtgctctcctc

SEQ ID NO: 10535 - DNA, 26 bp, Artificial
  MQbrain_1420; macaque brain D708YRU01BLNNF sequence
cttgggaatggcattgagaagtggct

SEQ ID NO: 10536 - DNA, 21 bp, Artificial
  MQbrain_1421; macaque brain D4HK8WR01AXBJH sequence
gctgggtgtgagtgctggtgg

SEQ ID NO: 10537 - DNA, 21 bp, Artificial
  MQbrain_1422; macaque brain D708I2V01D2SFZ sequence
gaaggaggaaacaggcaggcc

SEQ ID NO: 10538 - DNA, 20 bp, Artificial
  MQbrain_1422; macaque brain D708YRU01B1Q29 sequence
gaaggaggaaacaggcaggc

SEQ ID NO: 10539 - DNA, 22 bp, Artificial
  MQbrain_1423; macaque brain D708I2V01EB8IG sequence
ctgtgtctccagcaagtctctc

SEQ ID NO: 10540 - DNA, 18 bp, Artificial
  MQbrain_1424; macaque brain D708YRU01AJCYT sequence
ctggctggctgcccctgg

SEQ ID NO: 10541 - DNA, 23 bp, Artificial
  MQbrain_1425; macaque brain D708I2V02JLS77 sequence
atgccaaggagtcctggcctttg

SEQ ID NO: 10542 - DNA, 19 bp, Artificial
  MQbrain_1426; macaque brain D4HK4YF01DMFI5 sequence
agactgagggagagaaggg

SEQ ID NO: 10543 - DNA, 19 bp, Artificial
  MQbrain_1427; macaque brain D4G3X1F02F1PB3 sequence
gggaaaggcctgagatggg

SEQ ID NO: 10544 - DNA, 20 bp, Artificial
  MQbrain_1428; macaque brain D4HK8WR01DMQW1 sequence
gattggccagttcggtgttg

SEQ ID NO: 10545 - DNA, 18 bp, Artificial
  MQbrain_1429; macaque brain D708I2V01B106N sequence
tctgtggaaaccttggcc

SEQ ID NO: 10546 - DNA, 21 bp, Artificial
  MQbrain_142; macaque brain D708YRU01BI1QL sequence
ggctgggctggtggagggtgc

SEQ ID NO: 10547 - DNA, 18 bp, Artificial
  MQbrain_1430; macaque brain D708ZXV02GXYUL sequence
tttgacatgcagatgggc

SEQ ID NO: 10548 - DNA, 22 bp, Artificial
  MQbrain_1431; macaque brain D4HK4YF01AKYLX sequence
cctctgaccctcgcgtcctgtt

SEQ ID NO: 10549 - DNA, 21 bp, Artificial
  MQbrain_1432; macaque brain D708YRU01D4PCM sequence
gaggcttctgagtttctgccc

SEQ ID NO: 10550 - DNA, 18 bp, Artificial
  MQbrain_1433; macaque brain D708YRU02G18UM sequence
cggaggagtggctggtgc

SEQ ID NO: 10551 - DNA, 22 bp, Artificial
  MQbrain_1434; macaque brain D4HK4YF01CO9XZ sequence
tctgacccccgctgagatggcc

SEQ ID NO: 10552 - DNA, 25 bp, Artificial
  MQbrain_1437; macaque brain D708ZXV01DYJTD sequence
gtgccgagaagcagaccgggggccc

SEQ ID NO: 10553 - DNA, 23 bp, Artificial
  MQbrain_1438; macaque brain D708ZXV02G9XRZ sequence
ctgctgcttcccatctctgcctc

SEQ ID NO: 10554 - DNA, 24 bp, Artificial
  MQbrain_1438; macaque brain D708ZXV02HXPL5 sequence
ctgctgcttcccatctctgcctcc

SEQ ID NO: 10555 - DNA, 20 bp, Artificial
  MQbrain_1439; macaque brain D4HK4YF01DR2AI sequence
ccacctgccacggcgagatc

SEQ ID NO: 10556 - DNA, 18 bp, Artificial
  MQbrain_143; macaque brain D708ZXV01EEI0Z sequence
tgggagggatactggttg

SEQ ID NO: 10557 - DNA, 21 bp, Artificial
  MQbrain_1441; macaque brain D708ZXV01DDY5D sequence
ttgggtctgggaaaaagcttt

SEQ ID NO: 10558 - DNA, 22 bp, Artificial
  MQbrain_1442; macaque brain D708YRU02JMQYE sequence
agtggcagatgtgcagcgagct

SEQ ID NO: 10559 - DNA, 18 bp, Artificial
  MQbrain_1443; macaque brain D4HK4YF02IBMPY sequence
cggagtggaaccgccagg

SEQ ID NO: 10560 - DNA, 20 bp, Artificial
  MQbrain_1444; macaque brain D708I2V01AMFCK sequence
gcttcggtgatggctggcct

SEQ ID NO: 10561 - DNA, 25 bp, Artificial
  MQbrain_1444; macaque brain D708ZXV02HGQN1 sequence
tggcttcggtgatggctggcctctg

SEQ ID NO: 10562 - DNA, 24 bp, Artificial
  MQbrain_1445; macaque brain D4G3X1F02GK9Y0 sequence
tacaaggacctggctgccatcccc

SEQ ID NO: 10563 - DNA, 24 bp, Artificial
  MQbrain_1446; macaque brain D4HK8WR02JA2I7 sequence
cctgccaggaaggtgggggcgtgg

SEQ ID NO: 10564 - DNA, 18 bp, Artificial
  MQbrain_1447; macaque brain D708I2V02GCU5N sequence
gctccagcctggctctcc

SEQ ID NO: 10565 - DNA, 19 bp, Artificial
  MQbrain_1448; macaque brain D708I2V02JRQ80 sequence
gacttggaggggtcagtcc

SEQ ID NO: 10566 - DNA, 22 bp, Artificial
  MQbrain_1449; macaque brain D4HK8WR01ETJJD sequence
ggaccttggggacatctgctgg

SEQ ID NO: 10567 - DNA, 23 bp, Artificial
  MQbrain_144; macaque brain D708I2V02IYRCC sequence
tgccagctgcatctctgagaacc

SEQ ID NO: 10568 - DNA, 20 bp, Artificial
  MQbrain_1450; macaque brain D708ZXV02GRPV6 sequence
ggtaggaagcctgggcaggg

SEQ ID NO: 10569 - DNA, 21 bp, Artificial
  MQbrain_1451; macaque brain D708ZXV02HUCK8 sequence
tgcctttgggaaggtgtgatc

SEQ ID NO: 10570 - DNA, 20 bp, Artificial
  MQbrain_1452; macaque brain D4G3X1F01B5N40 sequence
tgtgaatgagtgttgattgg

SEQ ID NO: 10571 - DNA, 26 bp, Artificial
  MQbrain_1453; macaque brain D708I2V01DDT33 sequence
gcaccggtggcgttggcttcccaagt

SEQ ID NO: 10572 - DNA, 18 bp, Artificial
  MQbrain_1454; macaque brain D4HK8WR01BSXK9 sequence
tgggaagaggaaagctgg

SEQ ID NO: 10573 - DNA, 19 bp, Artificial
  MQbrain_1455; macaque brain D4HK8WR01C6JAR sequence
agggagaaatggggaactg

SEQ ID NO: 10574 - DNA, 23 bp, Artificial
  MQbrain_1456; macaque brain D708YRU02HB731 sequence
gagaggtgttggcagctgccggg

SEQ ID NO: 10575 - DNA, 21 bp, Artificial
  MQbrain_1457; macaque brain D708YRU01BRRMC sequence
ggagtttctggctgtccttgg

SEQ ID NO: 10576 - DNA, 18 bp, Artificial
  MQbrain_1458; macaque brain D708YRU01A5H48 sequence
aggaggaggaagagccgg

SEQ ID NO: 10577 - DNA, 24 bp, Artificial
  MQbrain_1459; macaque brain D4HK8WR02IK18D sequence
tgatccagaccatggggaaagacc

SEQ ID NO: 10578 - DNA, 20 bp, Artificial
  MQbrain_145; macaque brain D708I2V01B9QG9 sequence
ttcttggcaggtgtgggagg

SEQ ID NO: 10579 - DNA, 24 bp, Artificial
  MQbrain_1460; macaque brain D708ZXV02GDUJQ sequence
gactacattaaaggaggaaagctt

SEQ ID NO: 10580 - DNA, 20 bp, Artificial
  MQbrain_1461; macaque brain D708YRU01C637A sequence
ccacttccgggggcagagct

SEQ ID NO: 10581 - DNA, 22 bp, Artificial
  MQbrain_1463, MQbrain_973; macaque brain D708ZXV01DBE5L sequence
gctgagcgctggaaggacacct

SEQ ID NO: 10582 - DNA, 18 bp, Artificial
  MQbrain_1464; macaque brain D708I2V02GKEQS sequence
attccagggctgggggtg

SEQ ID NO: 10583 - DNA, 18 bp, Artificial
  MQbrain_1465; macaque brain D708ZXV01C3WOO sequence
agtctgatgaaagtttgg

SEQ ID NO: 10584 - DNA, 18 bp, Artificial
  MQbrain_1469; macaque brain D4HK4YF01CEOIY sequence
tgaggtagtatggttttg

SEQ ID NO: 10585 - DNA, 21 bp, Artificial
  MQbrain_146; macaque brain D4HK8WR02GOYFH sequence
agacttgacctgccagggctc

SEQ ID NO: 10586 - DNA, 20 bp, Artificial
  MQbrain_1470; macaque brain D708YRU02JRME0 sequence
agagagcggccggaggcgtc

SEQ ID NO: 10587 - DNA, 22 bp, Artificial
  MQbrain_1471; macaque brain D708ZXV02J4CVS sequence
tgctgctttgagagtgggaagg

SEQ ID NO: 10588 - DNA, 23 bp, Artificial
  MQbrain_1472; macaque brain D708YRU02G5ZQ6 sequence
tgtgcgccacgtgacccagcagt

SEQ ID NO: 10589 - DNA, 20 bp, Artificial
  MQbrain_1473; macaque brain D4HK8WR02IWW0F sequence
ctgtgactggctgtatttgc

SEQ ID NO: 10590 - DNA, 18 bp, Artificial
  MQbrain_1474; macaque brain D708ZXV02JC4UD sequence
tttctgtggtgtgaagtg

SEQ ID NO: 10591 - DNA, 19 bp, Artificial
  MQbrain_1475; macaque brain D708YRU02GS7IH sequence
agagggtggaacggatgtg

SEQ ID NO: 10592 - DNA, 22 bp, Artificial
  MQbrain_1476; macaque brain D708I2V02H2G6O sequence
acctctggggtgaagaaactgc

SEQ ID NO: 10593 - DNA, 23 bp, Artificial
  MQbrain_1477; macaque brain D708ZXV01DVVBT sequence
ggacttgccttggactgttgagc

SEQ ID NO: 10594 - DNA, 20 bp, Artificial
  MQbrain_1477; macaque brain D708ZXV02FSIKW sequence
ggacttgccttggactgttg

SEQ ID NO: 10595 - DNA, 21 bp, Artificial
  MQbrain_1478; macaque brain D4HK8WR02HA2OZ sequence
agtgcttcaagggaggaaacc

SEQ ID NO: 10596 - DNA, 20 bp, Artificial
  MQbrain_147; macaque brain D4HK8WR01EK67H sequence
aaaggcttgactcaggaggg

SEQ ID NO: 10597 - DNA, 20 bp, Artificial
  MQbrain_1480; macaque brain D4HK8WR02IAAI9 sequence
tctgagaaggagtgggagtg

SEQ ID NO: 10598 - DNA, 21 bp, Artificial
  MQbrain_1481; macaque brain D4HK8WR01AOEOD, macaque brain D708ZXV02GPM3Y sequence
actgtcagactgcccagtgtg

SEQ ID NO: 10599 - DNA, 22 bp, Artificial
  MQbrain_1481; macaque brain D708YRU01CMCN4 sequence
actgtcagactgcccagtgtgg

SEQ ID NO: 10600 - DNA, 21 bp, Artificial
  MQbrain_1482; macaque brain D708YRU01EY292 sequence
tcttgactttgccagaatggg

SEQ ID NO: 10601 - DNA, 19 bp, Artificial
  MQbrain_1483; macaque brain D4HK8WR02JEZTU sequence
aattctagcctggttagtg

SEQ ID NO: 10602 - DNA, 20 bp, Artificial
  MQbrain_1484; macaque brain D708I2V02HQTOW sequence
gcggaagaggaccctgaagg

SEQ ID NO: 10603 - DNA, 26 bp, Artificial
  MQbrain_1485; macaque brain D708YRU02G6QSY sequence
agccaggagcttctgggatggttgcc

SEQ ID NO: 10604 - DNA, 22 bp, Artificial
  MQbrain_1486; macaque brain D4HK4YF02GW6YC sequence
aaattctactgtgagggagccc

SEQ ID NO: 10605 - DNA, 21 bp, Artificial
  MQbrain_1487, MQbrain_1884, MQbrain_930; macaque brain D708ZXV01CN6TW sequence
tcctgggatgatgccagtggg

SEQ ID NO: 10606 - DNA, 18 bp, Artificial
  MQbrain_1488; macaque brain D4HK8WR01DIPD9 sequence
agccagcagaaggtcttg

SEQ ID NO: 10607 - DNA, 21 bp, Artificial
  MQbrain_1489; macaque brain D708ZXV02FKQ16 sequence
tccttggggacaggcagtgtc

SEQ ID NO: 10608 - DNA, 18 bp, Artificial
  MQbrain_148; macaque brain D708ZXV01CW2NB sequence
gaaggaagctgtggcact

SEQ ID NO: 10609 - DNA, 19 bp, Artificial
  MQbrain_1490; macaque brain D708I2V01EKO1N sequence
accgcagtgaccgtgggtg

SEQ ID NO: 10610 - DNA, 19 bp, Artificial
  MQbrain_1491; macaque brain D4G3X1F01E2K64 sequence
tccccacagccagagggcc

SEQ ID NO: 10611 - DNA, 22 bp, Artificial
  MQbrain_1492; macaque brain D708ZXV02HVD39 sequence
tgctcgctgggttggctccttt

SEQ ID NO: 10612 - DNA, 22 bp, Artificial
  MQbrain_1494; macaque brain D708ZXV01BB6JD sequence
ctgtgtgtgtggctcccatggg

SEQ ID NO: 10613 - DNA, 19 bp, Artificial
  MQbrain_1495; macaque brain D708ZXV01DW400 sequence
ccctgggctggcgtttctg

SEQ ID NO: 10614 - DNA, 19 bp, Artificial
  MQbrain_1496; macaque brain D708I2V01E4N84 sequence
cgcctcagggtcctcggcc

SEQ ID NO: 10615 - DNA, 20 bp, Artificial
  MQbrain_1497; macaque brain D708I2V01CH44H sequence
gcgcggcagctgcagctggc

SEQ ID NO: 10616 - DNA, 22 bp, Artificial
  MQbrain_1498; macaque brain D708I2V02JJMX6 sequence
gaggaccggctgatggccgagc

SEQ ID NO: 10617 - DNA, 28 bp, Artificial
  MQbrain_1499; macaque brain D708YRU01CEF5V sequence
ctggagctgaaggagaagaagatcaagg

SEQ ID NO: 10618 - DNA, 18 bp, Artificial
  MQbrain_149; macaque brain D4HK4YF01EP3PH sequence
aagagggtggcaaaaggt

SEQ ID NO: 10619 - DNA, 21 bp, Artificial
  MQbrain_14; macaque brain D4HK8WR01CNFF0 sequence
agtggaaggtggtggctgctg

SEQ ID NO: 10620 - DNA, 19 bp, Artificial
  MQbrain_1500; macaque brain D708I2V02JCPH2 sequence
ctcggagcagcctggcctg

SEQ ID NO: 10621 - DNA, 19 bp, Artificial
  MQbrain_1501; macaque brain D708I2V01BO6QR sequence
gaggccagggtgcaggtcg

SEQ ID NO: 10622 - DNA, 21 bp, Artificial
  MQbrain_1502; macaque brain D708YRU01EWSWL sequence
ctgtccccatgctcccctgtg

SEQ ID NO: 10623 - DNA, 22 bp, Artificial
  MQbrain_1503; macaque brain D4HK8WR01DDW89 sequence
gctcagagaggtctggacctgg

SEQ ID NO: 10624 - DNA, 19 bp, Artificial
  MQbrain_1504; macaque brain D708I2V01ASUJ7 sequence
cctgccctgccacccagcc

SEQ ID NO: 10625 - DNA, 20 bp, Artificial
  MQbrain_1505; macaque brain D708YRU02HC453 sequence
agaattgcgcaggccagcgg

SEQ ID NO: 10626 - DNA, 18 bp, Artificial
  MQbrain_1507; macaque brain D708I2V01EZ4G7 sequence
agagaccagaggcggccg

SEQ ID NO: 10627 - DNA, 18 bp, Artificial
  MQbrain_1508; macaque brain D708ZXV02FX16G sequence
gcgattggagggatggtg

SEQ ID NO: 10628 - DNA, 21 bp, Artificial
  MQbrain_1509; macaque brain D708YRU01D6Q57 sequence
gggaaggaggagatgggcgtg

SEQ ID NO: 10629 - DNA, 20 bp, Artificial
  MQbrain_150; macaque brain D708YRU01DMGRU sequence
aggaggagagagtggcctgg

SEQ ID NO: 10630 - DNA, 18 bp, Artificial
  MQbrain_1510; macaque brain D708YRU02HX5XN sequence
tttggagaggaagagggg

SEQ ID NO: 10631 - DNA, 22 bp, Artificial
  MQbrain_1511; macaque brain D4HK8WR02HOLW3 sequence
atcggcagcgggagcggcggcc

SEQ ID NO: 10632 - DNA, 18 bp, Artificial
  MQbrain_1512; macaque brain D4HK8WR02H8FQZ sequence
tccttccttcccatcttg

SEQ ID NO: 10633 - DNA, 20 bp, Artificial
  MQbrain_1513; macaque brain D708I2V01CHNL6 sequence
gaagagtctgaggatggccc

SEQ ID NO: 10634 - DNA, 25 bp, Artificial
  MQbrain_1513; macaque brain D708I2V01E6P8R sequence
gaagagtctgaggatggcccaattt

SEQ ID NO: 10635 - DNA, 18 bp, Artificial
  MQbrain_1514; macaque brain D4HK8WR02IIQMZ sequence
gttcgtgtctgtctggtg

SEQ ID NO: 10636 - DNA, 23 bp, Artificial
  MQbrain_1515; macaque brain D708I2V01ARNNY sequence
tttacactctgtgccaagaaact

SEQ ID NO: 10637 - DNA, 19 bp, Artificial
  MQbrain_1516; macaque brain D708ZXV02FJ0XF sequence
actggaaagtgactctggg

SEQ ID NO: 10638 - DNA, 20 bp, Artificial
  MQbrain_1517; macaque brain D4G3X1F02JFXC7 sequence
tgccaaggaagggtggctcc

SEQ ID NO: 10639 - DNA, 23 bp, Artificial
  MQbrain_1518; macaque brain D708I2V02I1ZVK sequence
ccgggcagctgggccaggctttc

SEQ ID NO: 10640 - DNA, 20 bp, Artificial
  MQbrain_151; macaque brain D708ZXV02HAALU sequence
tggctcctggggtgcagatg

SEQ ID NO: 10641 - DNA, 18 bp, Artificial
  MQbrain_1521; macaque brain D708I2V01DP3S8 sequence
ggccagcagagaggagtt

SEQ ID NO: 10642 - DNA, 20 bp, Artificial
  MQbrain_1523; macaque brain D708I2V02JAOE7 sequence
ggcgagaggggcgagacttg

SEQ ID NO: 10643 - DNA, 18 bp, Artificial
  MQbrain_1524; macaque brain D4HK8WR01ALJS2 sequence
atgactgaggggaaggcc

SEQ ID NO: 10644 - DNA, 22 bp, Artificial
  MQbrain_1525, MQbrain_1592, MQbrain_168, MQbrain_1700, MQbrain_1724, MQbrain_468, MQbrain_555, MQbrain_664, MQbrain_910, MQbrain_972; macaque brain D4G3X1F01DRNKL sequence
aaggctcagctggtggtgattg

SEQ ID NO: 10645 - DNA, 22 bp, Artificial
  MQbrain_1526; macaque brain D708I2V02IVRAX sequence
cttgatgaccagattgagatgt

SEQ ID NO: 10646 - DNA, 21 bp, Artificial
  MQbrain_1527; macaque brain D708YRU02GJXCV sequence
accggccaggccaagtgggtg

SEQ ID NO: 10647 - DNA, 23 bp, Artificial
  MQbrain_1528; macaque brain D4G3X1F01ENDOO sequence
agcccgcagccgccccgcaaccg

SEQ ID NO: 10648 - DNA, 18 bp, Artificial
  MQbrain_1529; macaque brain D708YRU01B7F38 sequence
tgggacctctgggttctg

SEQ ID NO: 10649 - DNA, 18 bp, Artificial
  MQbrain_152; macaque brain D4HK8WR02IX1N9 sequence
aatgaggagccgtgggtg

SEQ ID NO: 10650 - DNA, 18 bp, Artificial
  MQbrain_1530; macaque brain D708ZXV01EC4WT sequence
ggtggaactggcagatgc

SEQ ID NO: 10651 - DNA, 21 bp, Artificial
  MQbrain_1531; macaque brain D708ZXV02G9C8I sequence
gcccagtgcttgcccaggtgg

SEQ ID NO: 10652 - DNA, 26 bp, Artificial
  MQbrain_1532; macaque brain D708YRU01EDYHY sequence
gcagggggtatccgcagcatgtgtcg

SEQ ID NO: 10653 - DNA, 23 bp, Artificial
  MQbrain_1534; macaque brain D708ZXV02GTXY8 sequence
tgctggccggtgctgtgtcctgg

SEQ ID NO: 10654 - DNA, 23 bp, Artificial
  MQbrain_1535; macaque brain D708ZXV02IT7WH sequence
acctgaggcaggtttcctgggtc

SEQ ID NO: 10655 - DNA, 20 bp, Artificial
  MQbrain_1536; macaque brain D708YRU01A7XYW sequence
tgagaccgccccacacgctg

SEQ ID NO: 10656 - DNA, 24 bp, Artificial
  MQbrain_1537; macaque brain D4HK8WR01A778N sequence
tccttgccggctgcctgtgctgtt

SEQ ID NO: 10657 - DNA, 26 bp, Artificial
  MQbrain_1538; macaque brain D4G3X1F02JG1CB sequence
gttgcctggatcagagtccttaaggg

SEQ ID NO: 10658 - DNA, 21 bp, Artificial
  MQbrain_1539; macaque brain D4G3X1F02GWIK8 sequence
tgggcggccttggcccttcgg

SEQ ID NO: 10659 - DNA, 22 bp, Artificial
  MQbrain_1539; macaque brain D4HK4YF02HO0J5, macaque brain D708YRU02H82FI sequence
gtgggcggccttggcccttcgg

SEQ ID NO: 10660 - DNA, 19 bp, Artificial
  MQbrain_1540; macaque brain D708I2V02FQIA9 sequence
ctgtctcctgacagtggtt

SEQ ID NO: 10661 - DNA, 23 bp, Artificial
  MQbrain_1541; macaque brain D708I2V01DVQXD sequence
gcagctcctgagaaagccagccc

SEQ ID NO: 10662 - DNA, 22 bp, Artificial
  MQbrain_1542; macaque brain D708YRU01DG8N2 sequence
aggagaaaacctgtgatcgtct

SEQ ID NO: 10663 - DNA, 19 bp, Artificial
  MQbrain_1543; macaque brain D708I2V01DEUIL sequence
ccatggtgctgccttcctg

SEQ ID NO: 10664 - DNA, 22 bp, Artificial
  MQbrain_1545; macaque brain D708I2V02IWQZA sequence
accttctccctaactctcatgg

SEQ ID NO: 10665 - DNA, 21 bp, Artificial
  MQbrain_1546; macaque brain D708I2V02F1AWK sequence
acttgtctgttggcggctctg

SEQ ID NO: 10666 - DNA, 20 bp, Artificial
  MQbrain_1547, MQbrain_803; macaque brain D708ZXV02JJ9FY sequence
cagttgcttcctgggtgctt

SEQ ID NO: 10667 - DNA, 21 bp, Artificial
  MQbrain_1548; macaque brain D708YRU02F9J5Q sequence
taaggaagggtatggtgaagc

SEQ ID NO: 10668 - DNA, 24 bp, Artificial
  MQbrain_1549; macaque brain D708ZXV01AMHYW sequence
caggactgtcacccgcttccctcc

SEQ ID NO: 10669 - DNA, 19 bp, Artificial
  MQbrain_154; macaque brain D708ZXV01EIWBI sequence
tgacacgcccctctccacc

SEQ ID NO: 10670 - DNA, 22 bp, Artificial
  MQbrain_1550; macaque brain D4HK4YF02FHKON sequence
ccaccagcctggacagctacgg

SEQ ID NO: 10671 - DNA, 19 bp, Artificial
  MQbrain_1551; macaque brain D4G3X1F02IIVYG sequence
ctcggcggttcctgtgtgg

SEQ ID NO: 10672 - DNA, 21 bp, Artificial
  MQbrain_1552; macaque brain D708ZXV02G7PLE sequence
ctgcgggggcatcgctggagc

SEQ ID NO: 10673 - DNA, 20 bp, Artificial
  MQbrain_1553; macaque brain D4G3X1F02H9JKI sequence
agggaacagagggacaatgg

SEQ ID NO: 10674 - DNA, 25 bp, Artificial
  MQbrain_1554; macaque brain D4HK4YF01ELA5B sequence
gaggaagacagttctgttgctagtg

SEQ ID NO: 10675 - DNA, 21 bp, Artificial
  MQbrain_1555; macaque brain D4HK4YF02F5Q7L sequence
agggacacgcgtggggtctgg

SEQ ID NO: 10676 - DNA, 22 bp, Artificial
  MQbrain_1556; macaque brain D708I2V02H4ZOP sequence
aagatgtgggtctccaagaagg

SEQ ID NO: 10677 - DNA, 22 bp, Artificial
  MQbrain_1557; macaque brain D708YRU01EHONS sequence
tttgtgaagggaggaggaaggc

SEQ ID NO: 10678 - DNA, 20 bp, Artificial
  MQbrain_1558; macaque brain D4HK8WR01B1NKL sequence
gagccagtgcagctgccgtg

SEQ ID NO: 10679 - DNA, 23 bp, Artificial
  MQbrain_1558; macaque brain D708YRU02JS2GI sequence
tggagccagtgcagctgccgtgc

SEQ ID NO: 10680 - DNA, 21 bp, Artificial
  MQbrain_1559; macaque brain D708ZXV02I1C0S sequence
tctggaagagctatgggcagt

SEQ ID NO: 10681 - DNA, 20 bp, Artificial
  MQbrain_1560; macaque brain D4HK8WR02HOUES sequence
tgtgggtggcacagcttttt

SEQ ID NO: 10682 - DNA, 22 bp, Artificial
  MQbrain_1561; macaque brain D708YRU01DMF42 sequence
aatgtggtgggagctgatcgcc

SEQ ID NO: 10683 - DNA, 19 bp, Artificial
  MQbrain_1562; macaque brain D708YRU02HB73G sequence
tttgggggagggtggaagg

SEQ ID NO: 10684 - DNA, 21 bp, Artificial
  MQbrain_1563; macaque brain D708YRU02JE9WI sequence
atgactggggacttcattttg

SEQ ID NO: 10685 - DNA, 19 bp, Artificial
  MQbrain_1564; macaque brain D708YRU01EZNC7 sequence
aaagtgctgacagtgacag

SEQ ID NO: 10686 - DNA, 18 bp, Artificial
  MQbrain_1565; macaque brain D708I2V02GOS00 sequence
tgcctggtgcctgggtcc

SEQ ID NO: 10687 - DNA, 18 bp, Artificial
  MQbrain_1567; macaque brain D708YRU02I0YXF sequence
gggagtggcctgggtctc

SEQ ID NO: 10688 - DNA, 18 bp, Artificial
  MQbrain_1568; macaque brain D4HK8WR01D97L5 sequence
attctggctcaggtgatt

SEQ ID NO: 10689 - DNA, 18 bp, Artificial
  MQbrain_1569; macaque brain D708YRU01CM3WL sequence
agccagctgccaggcgtg

SEQ ID NO: 10690 - DNA, 23 bp, Artificial
  MQbrain_156; macaque brain D708ZXV01B7KPR sequence
ggcccccacagctgaggattgtg

SEQ ID NO: 10691 - DNA, 25 bp, Artificial
  MQbrain_1570; macaque brain D708ZXV01BQVY2 sequence
tctgactggtgtctagcagccttgc

SEQ ID NO: 10692 - DNA, 19 bp, Artificial
  MQbrain_1571; macaque brain D708I2V01AI3KC sequence
gcgtggactgccgttgctg

SEQ ID NO: 10693 - DNA, 20 bp, Artificial
  MQbrain_1572; macaque brain D708ZXV02FZ9YB sequence
ttgatgcatctgtggctgtc

SEQ ID NO: 10694 - DNA, 22 bp, Artificial
  MQbrain_1573; macaque brain D708YRU01EVCD8 sequence
agaggaagggaccgtggcattc

SEQ ID NO: 10695 - DNA, 19 bp, Artificial
  MQbrain_1574; macaque brain D708YRU01AXUJQ sequence
aggggcaaggaggaaaagc

SEQ ID NO: 10696 - DNA, 19 bp, Artificial
  MQbrain_1575; macaque brain D4HK8WR02GF1VZ sequence
cctggggtggcggcatggg

SEQ ID NO: 10697 - DNA, 20 bp, Artificial
  MQbrain_1576; macaque brain D4HK8WR01C2HZ0 sequence
acgttgagactgcttttctg

SEQ ID NO: 10698 - DNA, 22 bp, Artificial
  MQbrain_1577; macaque brain D708ZXV02JUH5R sequence
cctgctgggctgatgggaagtg

SEQ ID NO: 10699 - DNA, 18 bp, Artificial
  MQbrain_1578, MQbrain_1580; macaque brain D708I2V02HWGA1 sequence
gacagtggcctgaggcgg

SEQ ID NO: 10700 - DNA, 23 bp, Artificial
  MQbrain_1579; macaque brain D4HK8WR01B2YFC sequence
tgggtcctgtggggcttgcgggg

SEQ ID NO: 10701 - DNA, 18 bp, Artificial
  MQbrain_157; macaque brain D4HK8WR02H750A sequence
ccttcccaggctggagcc

SEQ ID NO: 10702 - DNA, 18 bp, Artificial
  MQbrain_1581; macaque brain D4HK4YF02HQ7DY sequence
ctgacccggcccctcccg

SEQ ID NO: 10703 - DNA, 19 bp, Artificial
  MQbrain_1581; macaque brain D708ZXV02JAYJP sequence
ctgacccggcccctcccgc

SEQ ID NO: 10704 - DNA, 20 bp, Artificial
  MQbrain_1582; macaque brain D4HK8WR02JGY1R sequence
ggtccaaggctcaggcggtg

SEQ ID NO: 10705 - DNA, 23 bp, Artificial
  MQbrain_1583; macaque brain D4G3X1F02JR5JV sequence
ggatggatggatggacaggctgg

SEQ ID NO: 10706 - DNA, 20 bp, Artificial
  MQbrain_1584, MQbrain_1585; macaque brain D708I2V01C0H6C sequence
acactgcgatggtcccttgg

SEQ ID NO: 10707 - DNA, 18 bp, Artificial
  MQbrain_1586; macaque brain D4HK8WR02FF7PU sequence
gaatggtgggccagaagg

SEQ ID NO: 10708 - DNA, 18 bp, Artificial
  MQbrain_1587; macaque brain D4G3X1F01A881M sequence
aggggcgggagcggaatg

SEQ ID NO: 10709 - DNA, 23 bp, Artificial
  MQbrain_1588; macaque brain D4G3X1F02HU2RE sequence
tagagctgcctgtagccccaggg

SEQ ID NO: 10710 - DNA, 19 bp, Artificial
  MQbrain_1589, MQbrain_1664, MQbrain_1831; macaque brain D708ZXV01D2SDZ sequence
tctggcagtggaggaagtc

SEQ ID NO: 10711 - DNA, 21 bp, Artificial
  MQbrain_158; macaque brain D708I2V01CAL1N sequence
agcggtgcgggtggggtggcc

SEQ ID NO: 10712 - DNA, 20 bp, Artificial
  MQbrain_1591; macaque brain D708I2V01A2XLU sequence
gatcctagggtcaggttatt

SEQ ID NO: 10713 - DNA, 18 bp, Artificial
  MQbrain_1593; macaque brain D708ZXV01EDOZN sequence
tggtgaaagctgggaatg

SEQ ID NO: 10714 - DNA, 19 bp, Artificial
  MQbrain_1593; macaque brain D708ZXV02HAWIS sequence
tggtgaaagctgggaatgc

SEQ ID NO: 10715 - DNA, 21 bp, Artificial
  MQbrain_1594, PT_270; chimp brain 38755, macaque brain D708YRU01DX92Z, macaque brain D708ZXV02GF14X sequence
ttcccctaccagccggttcgc

SEQ ID NO: 10716 - DNA, 22 bp, Artificial
  MQbrain_1594, PT_270; chimp brain 60636, macaque brain D4HK4YF02F5Q3J, macaque brain D4HK8WR01EA7GQ, macaque brain D4HK8WR01ENO8S, macaque brain D708YRU02HDQWE, macaque brain D708ZXV02JGIHO, macaque brain D708ZXV02JJU3O sequence
ttcccctaccagccggttcgcg

SEQ ID NO: 10717 - DNA, 19 bp, Artificial
  MQbrain_1594; macaque brain D708I2V01BT2C0 sequence
ttcccctaccagccggttc

SEQ ID NO: 10718 - DNA, 26 bp, Artificial
  MQbrain_1595; macaque brain D4HK4YF02JXKPH sequence
gctgggtgcagctctggctgagtcgg

SEQ ID NO: 10719 - DNA, 24 bp, Artificial
  MQbrain_1596; macaque brain D708YRU02JHKLB sequence
tggcggcgggaaaagcgagcggcg

SEQ ID NO: 10720 - DNA, 22 bp, Artificial
  MQbrain_1597; macaque brain D4G3X1F02FL6MB sequence
taacacagggaaggggaaactg

SEQ ID NO: 10721 - DNA, 21 bp, Artificial
  MQbrain_1598; macaque brain D708ZXV01BRACZ sequence
atgcccttgagtgtctccctg

SEQ ID NO: 10722 - DNA, 18 bp, Artificial
  MQbrain_1599; macaque brain D4HK8WR02IJ4V4 sequence
ctcctggggagggtgagc

SEQ ID NO: 10723 - DNA, 23 bp, Artificial
  MQbrain_159; macaque brain D708ZXV01EMSXJ sequence
tgggagaggtcaaggctggggct

SEQ ID NO: 10724 - DNA, 19 bp, Artificial
  MQbrain_15; macaque brain D708I2V01DX10G sequence
gaatgctggactggaggcc

SEQ ID NO: 10725 - DNA, 22 bp, Artificial
  MQbrain_1600; macaque brain D708I2V02IFAMJ sequence
gcctgtgcacagcttgccactg

SEQ ID NO: 10726 - DNA, 19 bp, Artificial
  MQbrain_1601, MQbrain_1718, MQbrain_1719, MQbrain_386, MQbrain_413, MQbrain_842; macaque brain D4HK8WR01BB97L sequence
cgcggaggcaaggccgagg

SEQ ID NO: 10727 - DNA, 18 bp, Artificial
  MQbrain_1602; macaque brain D4HK8WR01CQA5Z sequence
attcctgggctctgaagg

SEQ ID NO: 10728 - DNA, 28 bp, Artificial
  MQbrain_1603; macaque brain D708I2V02HK98S sequence
ggacatttgtgtccctgggtgtgagatc

SEQ ID NO: 10729 - DNA, 20 bp, Artificial
  MQbrain_1604; macaque brain D708YRU01ELC49 sequence
gagaatggctttggacttgc

SEQ ID NO: 10730 - DNA, 20 bp, Artificial
  MQbrain_1604; macaque brain D708ZXV01CJY4G sequence
ggtggaaaggagaatggctt

SEQ ID NO: 10731 - DNA, 18 bp, Artificial
  MQbrain_1605; macaque brain D708ZXV02JDXY8 sequence
agggagggaaacatggct

SEQ ID NO: 10732 - DNA, 22 bp, Artificial
  MQbrain_1606; macaque brain D708YRU02H9Q7W sequence
gagcctgagagtgcagctgccc

SEQ ID NO: 10733 - DNA, 23 bp, Artificial
  MQbrain_1607; macaque brain D708YRU01BNZ4F sequence
ctccttggacgctctggcccagt

SEQ ID NO: 10734 - DNA, 18 bp, Artificial
  MQbrain_1608, MQbrain_18; macaque brain D4HK4YF02I1TIB sequence
tctggatggctggttttg

SEQ ID NO: 10735 - DNA, 19 bp, Artificial
  MQbrain_1609; macaque brain D708I2V02GJNDI sequence
ctgggcctaggggaagagg

SEQ ID NO: 10736 - DNA, 18 bp, Artificial
  MQbrain_160; macaque brain D708ZXV01ANPA2 sequence
gggggtgtggccagtgcc

SEQ ID NO: 10737 - DNA, 19 bp, Artificial
  MQbrain_1610; macaque brain D708I2V02FXK0Z sequence
catggtggtgacccgtgtc

SEQ ID NO: 10738 - DNA, 20 bp, Artificial
  MQbrain_1611; macaque brain D708ZXV02IQ1G9 sequence
cagcagcagcagcggcctcc

SEQ ID NO: 10739 - DNA, 18 bp, Artificial
  MQbrain_1612; macaque brain D708YRU02F2PFV sequence
gatgagagggaaggcctg

SEQ ID NO: 10740 - DNA, 18 bp, Artificial
  MQbrain_1614; macaque brain D708I2V01DXCGJ sequence
ggatggagaggtcattgg

SEQ ID NO: 10741 - DNA, 18 bp, Artificial
  MQbrain_1615; macaque brain D708I2V02I10F3 sequence
gtggtgggtcctgggctg

SEQ ID NO: 10742 - DNA, 19 bp, Artificial
  MQbrain_1616; macaque brain D708YRU01DHTQ0 sequence
agggaggtggggaagggcc

SEQ ID NO: 10743 - DNA, 22 bp, Artificial
  MQbrain_1617; macaque brain D4HK4YF02JOKJY sequence
ttgcctcgagtccttgtgtctg

SEQ ID NO: 10744 - DNA, 19 bp, Artificial
  MQbrain_1618, MQbrain_1878; macaque brain D4HK8WR02GQBUW sequence
gagccgccgggacgcagcg

SEQ ID NO: 10745 - DNA, 19 bp, Artificial
  MQbrain_1619; macaque brain D4G3X1F01E348U sequence
agggaaaggggagggactg

SEQ ID NO: 10746 - DNA, 21 bp, Artificial
  MQbrain_161; macaque brain D708ZXV02F6QHF sequence
ttgatctgggtgcagccgctc

SEQ ID NO: 10747 - DNA, 19 bp, Artificial
  MQbrain_1620; macaque brain D4HK8WR01BLQMT sequence
atgcctttggccttccatt

SEQ ID NO: 10748 - DNA, 20 bp, Artificial
  MQbrain_1621; macaque brain D708ZXV02JCR8I sequence
aacctctctcttctcccctg

SEQ ID NO: 10749 - DNA, 22 bp, Artificial
  MQbrain_1622; macaque brain D4HK8WR02FJKRD sequence
tgcgctgggtccgcttggagtt

SEQ ID NO: 10750 - DNA, 18 bp, Artificial
  MQbrain_1623; macaque brain D708YRU01EL1J0 sequence
atggcgagagcgagaagg

SEQ ID NO: 10751 - DNA, 19 bp, Artificial
  MQbrain_1624; macaque brain D708I2V02J5VH3 sequence
tgtgcccagtctcctgttc

SEQ ID NO: 10752 - DNA, 24 bp, Artificial
  MQbrain_1625, MQbrain_1798, MQbrain_1802; macaque brain D708ZXV02F8GHO sequence
ttggtggtggtcgtggaggtggtt

SEQ ID NO: 10753 - DNA, 22 bp, Artificial
  MQbrain_1626; macaque brain D708I2V01D3D8A sequence
aaactgagccttgctttgcttt

SEQ ID NO: 10754 - DNA, 21 bp, Artificial
  MQbrain_1626; macaque brain D708YRU01CG8LC, macaque brain D708ZXV02HMFE6 sequence
aactgagccttgctttgcttt

SEQ ID NO: 10755 - DNA, 20 bp, Artificial
  MQbrain_1626; macaque brain D708YRU02GB6FZ, macaque brain D708ZXV01CLF9K sequence
aactgagccttgctttgctt

SEQ ID NO: 10756 - DNA, 19 bp, Artificial
  MQbrain_1627; macaque brain D708YRU02GZ5QR sequence
gggaagagaagggagaggc

SEQ ID NO: 10757 - DNA, 24 bp, Artificial
  MQbrain_1628; macaque brain D708YRU02J4WPY sequence
gaaatggtgacgtccactgctggc

SEQ ID NO: 10758 - DNA, 18 bp, Artificial
  MQbrain_1629; macaque brain D708YRU01BEPY4 sequence
agaggagtgtgaatgtgt

SEQ ID NO: 10759 - DNA, 18 bp, Artificial
  MQbrain_162; macaque brain D708ZXV01BC94A sequence
aggggctagagggaggcg

SEQ ID NO: 10760 - DNA, 20 bp, Artificial
  MQbrain_1630; macaque brain D708YRU02JHM82 sequence
aggactggagaaggcgatgg

SEQ ID NO: 10761 - DNA, 22 bp, Artificial
  MQbrain_1631; macaque brain D708ZXV02FHDPP sequence
cactctgggctgccctgttctt

SEQ ID NO: 10762 - DNA, 20 bp, Artificial
  MQbrain_1632; macaque brain D708I2V02F1ZHU sequence
ctctgctccccatctctgcc

SEQ ID NO: 10763 - DNA, 22 bp, Artificial
  MQbrain_1633; macaque brain D708I2V01BE8RW sequence
acgcccgccctgcacccccagt

SEQ ID NO: 10764 - DNA, 23 bp, Artificial
  MQbrain_1634; macaque brain D708I2V02H2J67 sequence
ctgaggggagctggcagagcctg

SEQ ID NO: 10765 - DNA, 20 bp, Artificial
  MQbrain_1634; macaque brain D708YRU01DN7K2 sequence
aggggagctggcagagcctg

SEQ ID NO: 10766 - DNA, 19 bp, Artificial
  MQbrain_1635; macaque brain D4G3X1F02G3663 sequence
ggaggaggatgaggaggcc

SEQ ID NO: 10767 - DNA, 19 bp, Artificial
  MQbrain_1636; macaque brain D4HK8WR01AYUC3 sequence
tgccaggagtgccctgagg

SEQ ID NO: 10768 - DNA, 18 bp, Artificial
  MQbrain_1637; macaque brain D708I2V01ESNKV sequence
tctttgtggcagctggcc

SEQ ID NO: 10769 - DNA, 18 bp, Artificial
  MQbrain_1638; macaque brain D4HK8WR01B4BH0 sequence
gaccccagagcccagtcc

SEQ ID NO: 10770 - DNA, 21 bp, Artificial
  MQbrain_163; macaque brain D4HK8WR02IIYKS sequence
gtccttctctgatgccttctc

SEQ ID NO: 10771 - DNA, 21 bp, Artificial
  MQbrain_1640; macaque brain D708ZXV01ERC8U sequence
actggcacactggtctggacg

SEQ ID NO: 10772 - DNA, 19 bp, Artificial
  MQbrain_1641; macaque brain D708ZXV01AGUMZ sequence
ggtacggaaggccagggtg

SEQ ID NO: 10773 - DNA, 24 bp, Artificial
  MQbrain_1642; macaque brain D708I2V01DLZSP sequence
ctcttctgtggagtctgcgtgggc

SEQ ID NO: 10774 - DNA, 24 bp, Artificial
  MQbrain_1643; macaque brain D708ZXV01AK7CB sequence
agcatgggaaggcagggggtactg

SEQ ID NO: 10775 - DNA, 24 bp, Artificial
  MQbrain_1644; macaque brain D708YRU01DNNON sequence
ccttggagagggtggaagaactgg

SEQ ID NO: 10776 - DNA, 21 bp, Artificial
  MQbrain_1645; macaque brain D708I2V02J5PZ8 sequence
ggaagctggtagacagggagg

SEQ ID NO: 10777 - DNA, 21 bp, Artificial
  MQbrain_1646; macaque brain D708I2V02G3FDZ sequence
aaggcacaggtgggccaggcc

SEQ ID NO: 10778 - DNA, 26 bp, Artificial
  MQbrain_1647; macaque brain D708I2V02H5RXB sequence
ggcggtgaggggcagcagtgcgggcc

SEQ ID NO: 10779 - DNA, 18 bp, Artificial
  MQbrain_1649; macaque brain D708ZXV01CPG3W sequence
atgagagctttggggagc

SEQ ID NO: 10780 - DNA, 22 bp, Artificial
  MQbrain_164; macaque brain D4HK8WR01DHWF4 sequence
gaacccgtgggacggtcgcctc

SEQ ID NO: 10781 - DNA, 19 bp, Artificial
  MQbrain_1650; macaque brain D4HK4YF02HWGWA sequence
aagacagtgaccccttgtc

SEQ ID NO: 10782 - DNA, 20 bp, Artificial
  MQbrain_1651; macaque brain D708I2V02F7107 sequence
ggccgtggccctgcgctggt

SEQ ID NO: 10783 - DNA, 19 bp, Artificial
  MQbrain_1652; macaque brain D708ZXV02I1KRB sequence
gaaggagtggcctgggagg

SEQ ID NO: 10784 - DNA, 19 bp, Artificial
  MQbrain_1653; macaque brain D4HK4YF01B24Z8 sequence
gatctgtgctggtggcagc

SEQ ID NO: 10785 - DNA, 26 bp, Artificial
  MQbrain_1654; macaque brain D708YRU02FN1LI sequence
actggatgaaggctgggtacctttgg

SEQ ID NO: 10786 - DNA, 21 bp, Artificial
  MQbrain_1655; macaque brain D708ZXV01D0HR1 sequence
tgactcggtcgggttctccgg

SEQ ID NO: 10787 - DNA, 21 bp, Artificial
  MQbrain_1656; macaque brain D708ZXV01DNV7L sequence
tcctgaatgctgggtgccggg

SEQ ID NO: 10788 - DNA, 23 bp, Artificial
  MQbrain_1658; macaque brain D708ZXV02F36EC sequence
agctctttggcccacctgtgtcg

SEQ ID NO: 10789 - DNA, 19 bp, Artificial
  MQbrain_1659; macaque brain D708YRU01C7FQR sequence
agttaggattaggtcgtgg

SEQ ID NO: 10790 - DNA, 18 bp, Artificial
  MQbrain_165; macaque brain D708I2V02HW8NW sequence
gtgacctggggaagaggc

SEQ ID NO: 10791 - DNA, 18 bp, Artificial
  MQbrain_1660; macaque brain D4HK8WR02GM7BV sequence
tttggggaggggtgattt

SEQ ID NO: 10792 - DNA, 23 bp, Artificial
  MQbrain_1661; macaque brain D708ZXV02F0YV0 sequence
ggctgcatggggatgccacgtgg

SEQ ID NO: 10793 - DNA, 25 bp, Artificial
  MQbrain_1662; macaque brain D4HK8WR02GNDI5 sequence
ccctctgagagaagctggctccttg

SEQ ID NO: 10794 - DNA, 20 bp, Artificial
  MQbrain_1663; macaque brain D708YRU02JBC3E sequence
ctcttcctcccctctgcctg

SEQ ID NO: 10795 - DNA, 20 bp, Artificial
  MQbrain_1665; macaque brain D708I2V01D0T8D sequence
aatgtttgctgccagtgagg

SEQ ID NO: 10796 - DNA, 19 bp, Artificial
  MQbrain_1666; macaque brain D708YRU01C2WUB sequence
agagagcggaagaaagagg

SEQ ID NO: 10797 - DNA, 21 bp, Artificial
  MQbrain_1667; macaque brain D708YRU02FTHZZ sequence
aattaaggcagcggctctgct

SEQ ID NO: 10798 - DNA, 19 bp, Artificial
  MQbrain_1668; macaque brain D708ZXV02F83NE sequence
aacggctagcaggggtgtg

SEQ ID NO: 10799 - DNA, 17 bp, Artificial
  MQbrain_1669; macaque brain D708ZXV02IMZLX sequence
gccagggattaccaaaa

SEQ ID NO: 10800 - DNA, 19 bp, Artificial
  MQbrain_166; macaque brain D708ZXV02GOG1D sequence
gacctgcagccatctgtga

SEQ ID NO: 10801 - DNA, 18 bp, Artificial
  MQbrain_1670; macaque brain D708ZXV02IKVG7 sequence
cgggagcggcagagacgg

SEQ ID NO: 10802 - DNA, 24 bp, Artificial
  MQbrain_1671; macaque brain D4HK4YF01EXOEB sequence
ttggtgtgtgctgctgtcctggcc

SEQ ID NO: 10803 - DNA, 22 bp, Artificial
  MQbrain_1672; macaque brain D708YRU02HBWNG sequence
tgatgggtgaatttgtagaagg

SEQ ID NO: 10804 - DNA, 21 bp, Artificial
  MQbrain_1673; macaque brain D708ZXV01AZND6 sequence
acaccagtgaggggggctacc

SEQ ID NO: 10805 - DNA, 25 bp, Artificial
  MQbrain_1674; macaque brain D4HK8WR01EHCV2 sequence
cctctggagctgaaagacacggacg

SEQ ID NO: 10806 - DNA, 18 bp, Artificial
  MQbrain_1675; macaque brain D4HK8WR02G49QF sequence
ctgggggtggaaaggagg

SEQ ID NO: 10807 - DNA, 21 bp, Artificial
  MQbrain_1676; macaque brain D708ZXV01D11VX sequence
ccttgattatttatagtgcgt

SEQ ID NO: 10808 - DNA, 19 bp, Artificial
  MQbrain_1677; macaque brain D708I2V01C0B7A sequence
agggccgggggcaggtggt

SEQ ID NO: 10809 - DNA, 21 bp, Artificial
  MQbrain_1678; macaque brain D4HK8WR01CLNNV, macaque brain D4HK8WR02HKPAF, macaque brain D708YRU01BZZ16 sequence
ggaagctgctggagggcgagg

SEQ ID NO: 10810 - DNA, 22 bp, Artificial
  MQbrain_1678; macaque brain D4HK8WR02H9E0T sequence
aggaagctgctggagggcgagg

SEQ ID NO: 10811 - DNA, 21 bp, Artificial
  MQbrain_1679; macaque brain D708ZXV01ASTDE sequence
gatgcgcctgaagcctgtgtg

SEQ ID NO: 10812 - DNA, 22 bp, Artificial
  MQbrain_1680; macaque brain D4HK8WR02JYTZN sequence
acctggtggtcgaggaagaggt

SEQ ID NO: 10813 - DNA, 18 bp, Artificial
  MQbrain_1681; macaque brain D708I2V01C17VT sequence
ctgccagctgggacaatg

SEQ ID NO: 10814 - DNA, 21 bp, Artificial
  MQbrain_1682; macaque brain D708I2V02GF4RP sequence
ttgtgtgtctcctggggtatt

SEQ ID NO: 10815 - DNA, 24 bp, Artificial
  MQbrain_1683; macaque brain D4HK8WR02I1IEC sequence
agtggaaggagcctgggagagacc

SEQ ID NO: 10816 - DNA, 21 bp, Artificial
  MQbrain_1684; macaque brain D708I2V01EFOIJ sequence
ggcttggactactgggtatgg

SEQ ID NO: 10817 - DNA, 25 bp, Artificial
  MQbrain_1685; macaque brain D4HK8WR02JUG9G sequence
aatgtctagggggactccagcatgg

SEQ ID NO: 10818 - DNA, 24 bp, Artificial
  MQbrain_1686; macaque brain D4HK4YF02HLKG1 sequence
gggctgagtgggtggctggtgccg

SEQ ID NO: 10819 - DNA, 23 bp, Artificial
  MQbrain_1687; macaque brain D708YRU01CYM65 sequence
cctttttgctgtggtcggctcgt

SEQ ID NO: 10820 - DNA, 21 bp, Artificial
  MQbrain_1688; macaque brain D4G3X1F01AXQI3 sequence
agttctgggcagtggcttttc

SEQ ID NO: 10821 - DNA, 21 bp, Artificial
  MQbrain_1689; macaque brain D708YRU02GVBZL sequence
tgaggttggaggtgaggctgg

SEQ ID NO: 10822 - DNA, 22 bp, Artificial
  MQbrain_1690; macaque brain D708YRU02I89V8 sequence
actgatgtgggtggactcttcg

SEQ ID NO: 10823 - DNA, 21 bp, Artificial
  MQbrain_1691; macaque brain D4HK4YF02GYP41 sequence
tgggagggctgcagctctagg

SEQ ID NO: 10824 - DNA, 22 bp, Artificial
  MQbrain_1692; macaque brain D4HK8WR01CLH9R sequence
ggatgtggtagctactgcagtg

SEQ ID NO: 10825 - DNA, 23 bp, Artificial
  MQbrain_1693; macaque brain D708I2V01CRSE1 sequence
aggcccctcaggccgtggacgcc

SEQ ID NO: 10826 - DNA, 21 bp, Artificial
  MQbrain_1695; macaque brain D708YRU01A6EBE sequence
agttctttgccattttgaggg

SEQ ID NO: 10827 - DNA, 18 bp, Artificial
  MQbrain_1696; macaque brain D708I2V01C914W sequence
aggggccagtgggtgctg

SEQ ID NO: 10828 - DNA, 20 bp, Artificial
  MQbrain_1697, MQbrain_959; macaque brain D708I2V01ET4P6 sequence
ctggaggtggggagtggtgg

SEQ ID NO: 10829 - DNA, 19 bp, Artificial
  MQbrain_1698; macaque brain D4G3X1F02JK6T5, macaque brain D708YRU02HDITC sequence
aagttcttctgaagatggc

SEQ ID NO: 10830 - DNA, 19 bp, Artificial
  MQbrain_1699; macaque brain D708ZXV02FIFVE sequence
gcttagagggcagaggttc

SEQ ID NO: 10831 - DNA, 25 bp, Artificial
  MQbrain_169; macaque brain D708ZXV02JZ4OC sequence
tctctttttcagtttgaggaatctg

SEQ ID NO: 10832 - DNA, 22 bp, Artificial
  MQbrain_16; macaque brain D708ZXV02IKDRJ sequence
gctgcggtccccgaggtcctgg

SEQ ID NO: 10833 - DNA, 19 bp, Artificial
  MQbrain_1701; macaque brain D4HK4YF02FTJCM sequence
aaagggtgtcttttccagg

SEQ ID NO: 10834 - DNA, 25 bp, Artificial
  MQbrain_1702; macaque brain D708YRU01C2JTX sequence
actggatggcctgaggaagagtacc

SEQ ID NO: 10835 - DNA, 21 bp, Artificial
  MQbrain_1703; macaque brain D708I2V01ESCPL sequence
gcctagagccccatcgcgtct

SEQ ID NO: 10836 - DNA, 22 bp, Artificial
  MQbrain_1704; macaque brain D708I2V02GCQP3 sequence
ctgagcccagaggtctctcctc

SEQ ID NO: 10837 - DNA, 22 bp, Artificial
  MQbrain_1705; macaque brain D708ZXV02HZDBM sequence
ggagtttcctcggctgtacagc

SEQ ID NO: 10838 - DNA, 18 bp, Artificial
  MQbrain_1706; macaque brain D708ZXV01A3ROH sequence
attccaggatggggagtc

SEQ ID NO: 10839 - DNA, 24 bp, Artificial
  MQbrain_1707; macaque brain D4HK4YF01C4HPT sequence
gctctgtgtgcctggccgggctgg

SEQ ID NO: 10840 - DNA, 23 bp, Artificial
  MQbrain_1709; macaque brain D708YRU02JRR2H sequence
ggtgctggagctgggcgaggagg

SEQ ID NO: 10841 - DNA, 22 bp, Artificial
  MQbrain_170; macaque brain D708I2V02IOFH0 sequence
gcccttggaatgccattgtctg

SEQ ID NO: 10842 - DNA, 25 bp, Artificial
  MQbrain_1710; macaque brain D708YRU02HBMBV sequence
atccccagggtctcatggtgaagtc

SEQ ID NO: 10843 - DNA, 21 bp, Artificial
  MQbrain_1713; macaque brain D708ZXV02JN03P sequence
gtctgtggctacctgggatcc

SEQ ID NO: 10844 - DNA, 21 bp, Artificial
  MQbrain_1714; macaque brain D708YRU02IZ6P0 sequence
aagactagctagacactcagg

SEQ ID NO: 10845 - DNA, 19 bp, Artificial
  MQbrain_1715; macaque brain D708I2V02H491N sequence
aaggaggagcctgaggagc

SEQ ID NO: 10846 - DNA, 22 bp, Artificial
  MQbrain_1716; macaque brain D708YRU01DC96O sequence
atggctttcaggtgctccagct

SEQ ID NO: 10847 - DNA, 18 bp, Artificial
  MQbrain_1717; macaque brain D4HK8WR01CHYTM sequence
gttgggaggaaggaggtc

SEQ ID NO: 10848 - DNA, 26 bp, Artificial
  MQbrain_171; macaque brain D708YRU01ALDOL sequence
atgctgagagagggtagggaaaactg

SEQ ID NO: 10849 - DNA, 18 bp, Artificial
  MQbrain_1720; macaque brain D708I2V02G3K5X sequence
agaggtggagggtgagtg

SEQ ID NO: 10850 - DNA, 19 bp, Artificial
  MQbrain_1721; macaque brain D708ZXV02GD3RD sequence
gagccagctgggcagaatg

SEQ ID NO: 10851 - DNA, 26 bp, Artificial
  MQbrain_1722; macaque brain D708ZXV02F3YV6 sequence
tattcctgggtggtgcagttctagcg

SEQ ID NO: 10852 - DNA, 21 bp, Artificial
  MQbrain_1723; macaque brain D4HK4YF02IGMW7 sequence
agggtggtgcctctgattctg

SEQ ID NO: 10853 - DNA, 21 bp, Artificial
  MQbrain_1725; macaque brain D4HK8WR01ANQ9U sequence
agagtcaggtggcaatttgtg

SEQ ID NO: 10854 - DNA, 21 bp, Artificial
  MQbrain_1726; macaque brain D708YRU02II756 sequence
ttgttgggcgtggcctcctgt

SEQ ID NO: 10855 - DNA, 18 bp, Artificial
  MQbrain_1727; macaque brain D708YRU02JDEC2 sequence
aatgaccagttgagttgg

SEQ ID NO: 10856 - DNA, 26 bp, Artificial
  MQbrain_1728; macaque brain D708YRU02GEBMR sequence
aaggttgagtgaggtcctcttgattg

SEQ ID NO: 10857 - DNA, 24 bp, Artificial
  MQbrain_1729; macaque brain D708YRU02JSKCD sequence
ggtgctgaggagatggtggagatg

SEQ ID NO: 10858 - DNA, 21 bp, Artificial
  MQbrain_1731, MQbrain_1733, MQbrain_1735; macaque brain D708I2V02IL4E6 sequence
cacgccgtttgtgccgtaagg

SEQ ID NO: 10859 - DNA, 21 bp, Artificial
  MQbrain_1731, MQbrain_1733, MQbrain_1735; macaque brain D708I2V02JLB8N sequence
gacggtcccagagcctgcttt

SEQ ID NO: 10860 - DNA, 22 bp, Artificial
  MQbrain_1731, MQbrain_1733, MQbrain_1735; macaque brain D708YRU02ISI1A sequence
atcgacggtcccagagcctgct

SEQ ID NO: 10861 - DNA, 22 bp, Artificial
  MQbrain_1734; macaque brain D4HK8WR02H6LID sequence
aaagaaccccggcgtggtggcc

SEQ ID NO: 10862 - DNA, 18 bp, Artificial
  MQbrain_1736; macaque brain D708I2V01B6Q2P sequence
gactggagacggggagcc

SEQ ID NO: 10863 - DNA, 21 bp, Artificial
  MQbrain_1737, MQbrain_2626,MQbrain_2667,MQbrain_2673, MQbrain_2669; macaque brain D708I2V01BUDHL sequence
ggatcagcaagcaggagtatg

SEQ ID NO: 10864 - DNA, 21 bp, Artificial
  MQbrain_1737, MQbrain_2626,MQbrain_2667,MQbrain_2673, MQbrain_2669; macaque brain D708ZXV02HNUTT sequence
cctggcctcgctgtccacctt

SEQ ID NO: 10865 - DNA, 20 bp, Artificial
  MQbrain_1738; macaque brain D4G3X1F01C1I47 sequence
aaggggagtcgatggaatgg

SEQ ID NO: 10866 - DNA, 21 bp, Artificial
  MQbrain_1738; macaque brain D708YRU01A4DYL sequence
gaaggggagtcgatggaatgg

SEQ ID NO: 10867 - DNA, 22 bp, Artificial
  MQbrain_1738; macaque brain D708ZXV02HN2GJ sequence
attccacccactgccctctctt

SEQ ID NO: 10868 - DNA, 22 bp, Artificial
  MQbrain_173; macaque brain D4G3X1F02GQPHI sequence
tctgtgggaacgctgtgtgatc

SEQ ID NO: 10869 - DNA, 21 bp, Artificial
  MQbrain_1740; macaque brain D708YRU02ICWCC sequence
agccgggcccgcagccgcatc

SEQ ID NO: 10870 - DNA, 22 bp, Artificial
  MQbrain_1740; macaque brain D708ZXV02IQVXY sequence
aggaggtgcccaaactgaaggt

SEQ ID NO: 10871 - DNA, 20 bp, Artificial
  MQbrain_1741; macaque brain D4HK8WR02HVMNF sequence
ccttccagcctgtcctgccc

SEQ ID NO: 10872 - DNA, 25 bp, Artificial
  MQbrain_1744, MQbrain_1745; macaque brain D708YRU01EX9HZ sequence
ttcctttgggtgagggggtccttgg

SEQ ID NO: 10873 - DNA, 19 bp, Artificial
  MQbrain_1746; macaque brain D4HK8WR01C4S7Q sequence
tggagccctggacccaagg

SEQ ID NO: 10874 - DNA, 20 bp, Artificial
  MQbrain_1747; macaque brain D4G3X1F01CTFFK sequence
gccgtctggaaaaacctgcc

SEQ ID NO: 10875 - DNA, 23 bp, Artificial
  MQbrain_1747; macaque brain D708ZXV01DOZE7 sequence
agaaggtggtgaagcaggcgtcg

SEQ ID NO: 10876 - DNA, 22 bp, Artificial
  MQbrain_1748; macaque brain D708YRU01A66KG sequence
tggcaaggcatgtcttactggc

SEQ ID NO: 10877 - DNA, 22 bp, Artificial
  MQbrain_1748; macaque brain D708ZXV02ISFQQ sequence
ttggaggggcggccagagcggc

SEQ ID NO: 10878 - DNA, 19 bp, Artificial
  MQbrain_174; macaque brain D4HK8WR01C1638 sequence
aggatgggcaggtggggcc

SEQ ID NO: 10879 - DNA, 20 bp, Artificial
  MQbrain_1750; macaque brain D708YRU01DLPXG sequence
aatggaggaggggaggaagg

SEQ ID NO: 10880 - DNA, 19 bp, Artificial
  MQbrain_1752; macaque brain D708YRU01C7L4O sequence
aagaggacaggagccattg

SEQ ID NO: 10881 - DNA, 22 bp, Artificial
  MQbrain_1753, MQbrain_1882, MQbrain_1893; macaque brain D4HK4YF02IVKC8 sequence
agagctcatggtcgcattaacc

SEQ ID NO: 10882 - DNA, 19 bp, Artificial
  MQbrain_1753, MQbrain_1882, MQbrain_1893; macaque brain D4HK8WR01BYUHP sequence
aagatgcgccgacgaacct

SEQ ID NO: 10883 - DNA, 20 bp, Artificial
  MQbrain_1754; macaque brain D4HK8WR02GECZ5, macaque brain D708YRU01BOF4B sequence
cggggggcatggccgtgtgg

SEQ ID NO: 10884 - DNA, 18 bp, Artificial
  MQbrain_1754; macaque brain D708YRU02HD20W sequence
cgcatgaccaatgccccc

SEQ ID NO: 10885 - DNA, 21 bp, Artificial
  MQbrain_1755; macaque brain D4HK4YF01EPHQV sequence
cagggactggtggggacgcgg

SEQ ID NO: 10886 - DNA, 22 bp, Artificial
  MQbrain_1756; macaque brain D4HK4YF01CHS73, macaque brain D4HK4YF02G3VHX, macaque brain D4HK4YF02JFNR9, macaque brain D4HK8WR01ARDIP, macaque brain D4HK8WR02GXDHF, macaque brain D708I2V02FQH10, macaque brain D708YRU01EBIVN
acctccatggcccctgctcatt

SEQ ID NO: 10887 - DNA, 26 bp, Artificial
  MQbrain_1756; macaque brain D4HK8WR01BOW2H sequence
gtgagcgggggctctgggtgatgtgg

SEQ ID NO: 10888 - DNA, 20 bp, Artificial
  MQbrain_1757; macaque brain D708ZXV02JLKHE sequence
ctggggaagtgtggctaagc

SEQ ID NO: 10889 - DNA, 20 bp, Artificial
  MQbrain_1759; macaque brain D4HK8WR02HX7KZ sequence
ggttgtgagtggtagggagc

SEQ ID NO: 10890 - DNA, 18 bp, Artificial
  MQbrain_1759; macaque brain D708I2V01CDY7V sequence
aaaggatggcggagaatt

SEQ ID NO: 10891 - DNA, 21 bp, Artificial
  MQbrain_175; macaque brain D4G3X1F01DN5YU sequence
gagaagagggtggaccggatc

SEQ ID NO: 10892 - DNA, 20 bp, Artificial
  MQbrain_1760; macaque brain D708I2V01C0C8D sequence
atctggccaggagtcacagg

SEQ ID NO: 10893 - DNA, 19 bp, Artificial
  MQbrain_1760; macaque brain D708I2V01EZB1F sequence
aacacctgtgacccctagg

SEQ ID NO: 10894 - DNA, 18 bp, Artificial
  MQbrain_1761; macaque brain D708ZXV02HMXL4 sequence
aagtggggccagggcgtg

SEQ ID NO: 10895 - DNA, 20 bp, Artificial
  MQbrain_1762; macaque brain D4HK4YF01DGRTK sequence
cccatccttgcccctggttc

SEQ ID NO: 10896 - DNA, 24 bp, Artificial
  MQbrain_1762; macaque brain D708ZXV01A4HV8 sequence
gctcctgtggccaggcgcaaggct

SEQ ID NO: 10897 - DNA, 19 bp, Artificial
  MQbrain_1763; macaque brain D708ZXV01EPURT sequence
agatagtgatcagggagct

SEQ ID NO: 10898 - DNA, 20 bp, Artificial
  MQbrain_1764; macaque brain D4HK8WR02G8VMQ sequence
ctgtggctgtgtggtttggg

SEQ ID NO: 10899 - DNA, 19 bp, Artificial
  MQbrain_1765; macaque brain D708YRU02I2JPD sequence
aagtgatgagccggagccg

SEQ ID NO: 10900 - DNA, 21 bp, Artificial
  MQbrain_1767; macaque brain D4G3X1F01B78WG sequence
agctggtggtggtgggggatg

SEQ ID NO: 10901 - DNA, 22 bp, Artificial
  MQbrain_1768; macaque brain D708YRU01C0FQ0 sequence
gtgggaaccataagggtctgtg

SEQ ID NO: 10902 - DNA, 18 bp, Artificial
  MQbrain_1768; macaque brain D708ZXV01BXV0F sequence
ccgtctcttctgtttccc

SEQ ID NO: 10903 - DNA, 20 bp, Artificial
  MQbrain_176; macaque brain D4HK4YF02I2W0T sequence
tggccaaactttccggaggg

SEQ ID NO: 10904 - DNA, 20 bp, Artificial
  MQbrain_1770; macaque brain D708YRU02IS3WN sequence
agacctgcctgggcttttgg

SEQ ID NO: 10905 - DNA, 23 bp, Artificial
  MQbrain_1771; macaque brain D708ZXV02HL834 sequence
ggcctggtgggcagggggcagtc

SEQ ID NO: 10906 - DNA, 21 bp, Artificial
  MQbrain_1771; macaque brain D708ZXV02JNPX4 sequence
acgtgcagacaggaggaagct

SEQ ID NO: 10907 - DNA, 19 bp, Artificial
  MQbrain_1772; macaque brain D708ZXV01DJ46F sequence
atgacgctggccgtgcccg

SEQ ID NO: 10908 - DNA, 21 bp, Artificial
  MQbrain_1773; macaque brain D708I2V02HOO0M sequence
ctactgccacctctcactctc

SEQ ID NO: 10909 - DNA, 21 bp, Artificial
  MQbrain_1774; macaque brain D4HK8WR02FPXEP sequence
tttggaggtgtctgtgtgggg

SEQ ID NO: 10910 - DNA, 21 bp, Artificial
  MQbrain_1774; macaque brain D708ZXV02JI70Z sequence
ctgtgtttggaggtgtctgtg

SEQ ID NO: 10911 - DNA, 23 bp, Artificial
  MQbrain_1776; macaque brain D4G3X1F01CT969, macaque brain D708I2V01BIYHD sequence
ggtgtggctgtgtgctgagggtc

SEQ ID NO: 10912 - DNA, 21 bp, Artificial
  MQbrain_1776; macaque brain D4G3X1F02FJGAQ sequence
ggtgtggctgtgtgctgaggg

SEQ ID NO: 10913 - DNA, 21 bp, Artificial
  MQbrain_1776; macaque brain D4G3X1F02G30E8 sequence
tgtggctgtgtgctgagggtc

SEQ ID NO: 10914 - DNA, 22 bp, Artificial
  MQbrain_1776; macaque brain D708I2V01BONN8, macaque brain D708ZXV02JAYEX sequence
ggtgtggctgtgtgctgagggt

SEQ ID NO: 10915 - DNA, 18 bp, Artificial
  MQbrain_1776; macaque brain D708ZXV02I6KCL sequence
ctctcaggatgccgctgc

SEQ ID NO: 10916 - DNA, 24 bp, Artificial
  MQbrain_1776; macaque brain D708ZXV02ID4I4 sequence
ggtgtggctgtgtgctgagggtct

SEQ ID NO: 10917 - DNA, 21 bp, Artificial
  MQbrain_1777; macaque brain D708I2V01DENSF sequence
tggggagattggatggggatg

SEQ ID NO: 10918 - DNA, 21 bp, Artificial
  MQbrain_1777; macaque brain D708ZXV02IC5AI sequence
aggcactgccgggccccgggt

SEQ ID NO: 10919 - DNA, 21 bp, Artificial
  MQbrain_1778; macaque brain D708I2V02IOBLT sequence
cgctgtgtggctgaggtactg

SEQ ID NO: 10920 - DNA, 23 bp, Artificial
  MQbrain_1779; macaque brain D4HK8WR01C6NJL sequence
agacctgggtgggccttcagggg

SEQ ID NO: 10921 - DNA, 19 bp, Artificial
  MQbrain_177; macaque brain D708I2V02GE23G sequence
tttctctggaaccggctcg

SEQ ID NO: 10922 - DNA, 24 bp, Artificial
  MQbrain_1780; macaque brain D708YRU02H9STQ sequence
ggagaaggtctgtggtgcagtgtg

SEQ ID NO: 10923 - DNA, 22 bp, Artificial
  MQbrain_1780; macaque brain D708ZXV01DD2Y0 sequence
gctgggtggagaagctatgggg

SEQ ID NO: 10924 - DNA, 22 bp, Artificial
  MQbrain_1781; macaque brain D708I2V01A741T sequence
gagctgggcagcaaggctaagt

SEQ ID NO: 10925 - DNA, 23 bp, Artificial
  MQbrain_1782, MQbrain_1795; macaque brain D4HK4YF01EGWO3 sequence
gagcagctgtctgggaagtaggg

SEQ ID NO: 10926 - DNA, 24 bp, Artificial
  MQbrain_1783; macaque brain D708YRU01BI19G sequence
ctgtctggagaaacagccaaaggg

SEQ ID NO: 10927 - DNA, 20 bp, Artificial
  MQbrain_1783; macaque brain D708YRU01DS1U7 sequence
tctggagaaacagccaaagg

SEQ ID NO: 10928 - DNA, 19 bp, Artificial
  MQbrain_1784; macaque brain D4HK8WR01BSE9W sequence
gctgccatttgttactatc

SEQ ID NO: 10929 - DNA, 18 bp, Artificial
  MQbrain_1784; macaque brain D708YRU02HEU0V sequence
gactcgactcgtgtgcgg

SEQ ID NO: 10930 - DNA, 20 bp, Artificial
  MQbrain_1786; macaque brain D708I2V01DSPJZ sequence
cttcagctacacccgccatg

SEQ ID NO: 10931 - DNA, 18 bp, Artificial
  MQbrain_1786; macaque brain D708YRU01C9E2L sequence
ggggtgtgcgggcagatc

SEQ ID NO: 10932 - DNA, 23 bp, Artificial
  MQbrain_1787; macaque brain D4HK4YF02F37XV sequence
attgacatcctcccccaacactc

SEQ ID NO: 10933 - DNA, 23 bp, Artificial
  MQbrain_1787; macaque brain D4HK8WR02FG88P sequence
ttgacatcctcccccaacactcc

SEQ ID NO: 10934 - DNA, 18 bp, Artificial
  MQbrain_1787; macaque brain D708YRU01AU6RU sequence
tgttgggtgagggtgttg

SEQ ID NO: 10935 - DNA, 24 bp, Artificial
  MQbrain_1787; macaque brain D708ZXV01C3DR1 sequence
tgttgggtgagggtgttgagtgtg

SEQ ID NO: 10936 - DNA, 21 bp, Artificial
  MQbrain_1789; macaque brain D708YRU01B5DNR sequence
aggccatagcaagcaagagtg

SEQ ID NO: 10937 - DNA, 20 bp, Artificial
  MQbrain_1789; macaque brain D708ZXV01AZGU2 sequence
atggagcagcagttctaccg

SEQ ID NO: 10938 - DNA, 25 bp, Artificial
  MQbrain_178; macaque brain D4HK4YF02F4DUU sequence
ctctggccacctccttgcctacctg

SEQ ID NO: 10939 - DNA, 25 bp, Artificial
  MQbrain_1790; macaque brain D708I2V02GB7G9 sequence
ccatgagtgggggctggccaggggg

SEQ ID NO: 10940 - DNA, 23 bp, Artificial
  MQbrain_1791; macaque brain D4HK8WR02FNKQW sequence
cggagcagttcactgccatgttc

SEQ ID NO: 10941 - DNA, 18 bp, Artificial
  MQbrain_1792; macaque brain D4HK4YF02GJKRN sequence
cctgggcggccttcactt

SEQ ID NO: 10942 - DNA, 23 bp, Artificial
  MQbrain_1792; macaque brain D4HK8WR01A47HH sequence
ctgcttctgagttgcccaggagg

SEQ ID NO: 10943 - DNA, 21 bp, Artificial
  MQbrain_1793; macaque brain D708I2V01E1KTE sequence
gcggttcgaacagctctgttt

SEQ ID NO: 10944 - DNA, 21 bp, Artificial
  MQbrain_1794; macaque brain D4HK8WR02HI274 sequence
tatgggataggtggtgcttgg

SEQ ID NO: 10945 - DNA, 20 bp, Artificial
  MQbrain_1794; macaque brain D708I2V01D1QH7 sequence
aggcaccctggtttgtttgg

SEQ ID NO: 10946 - DNA, 18 bp, Artificial
  MQbrain_1795; macaque brain D4HK8WR01EC4TP sequence
tggaggccccaagccctg

SEQ ID NO: 10947 - DNA, 18 bp, Artificial
  MQbrain_1796; macaque brain D4G3X1F01C94KG sequence
gccactgggtggaagggc

SEQ ID NO: 10948 - DNA, 24 bp, Artificial
  MQbrain_1799, MQbrain_992; macaque brain D4HK8WR02JX12D sequence
gtgaccctgtgaactcgccttttc

SEQ ID NO: 10949 - DNA, 25 bp, Artificial
  MQbrain_179; macaque brain D708YRU01A1PN8 sequence
acacagagctctggcagcccctggg

SEQ ID NO: 10950 - DNA, 20 bp, Artificial
  MQbrain_17; macaque brain D4HK8WR01CWV8A sequence
attcggctacgatcaccagg

SEQ ID NO: 10951 - DNA, 21 bp, Artificial
  MQbrain_17; macaque brain D708I2V02JWPDG sequence
ttcggctacgatcaccagggt

SEQ ID NO: 10952 - DNA, 21 bp, Artificial
  MQbrain_1801; macaque brain D4HK8WR02JUXRX sequence
acggttgacttgccttgctgg

SEQ ID NO: 10953 - DNA, 22 bp, Artificial
  MQbrain_1801; macaque brain D708YRU02I7IWW sequence
ctgttgctggtggccggttctg

SEQ ID NO: 10954 - DNA, 21 bp, Artificial
  MQbrain_1803; macaque brain D4HK8WR02HGZK1 sequence
gggaagggtggagatcaggtc

SEQ ID NO: 10955 - DNA, 19 bp, Artificial
  MQbrain_1804; macaque brain D4HK8WR01ANBLO sequence
cgtcgctttcctggccgcc

SEQ ID NO: 10956 - DNA, 25 bp, Artificial
  MQbrain_1805; macaque brain D4HK8WR01ATK7I sequence
aggcagcaactccactgtcacagcc

SEQ ID NO: 10957 - DNA, 18 bp, Artificial
  MQbrain_1807; macaque brain D708I2V02IW7OZ sequence
gctttgggagtcaaggtg

SEQ ID NO: 10958 - DNA, 21 bp, Artificial
  MQbrain_1807; macaque brain D708ZXV02FH1PN sequence
ggacctaggtaggaagtatct

SEQ ID NO: 10959 - DNA, 25 bp, Artificial
  MQbrain_1808; macaque brain D4G3X1F01BFNWK sequence
tgctgtggattggggccatcctctg

SEQ ID NO: 10960 - DNA, 18 bp, Artificial
  MQbrain_1808; macaque brain D4HK4YF02I22PT, macaque brain D708I2V02G3PCI sequence
aggctgccatggaggatg

SEQ ID NO: 10961 - DNA, 22 bp, Artificial
  MQbrain_1808; macaque brain D4HK8WR02GL7WP, macaque brain D708YRU01EVUQE sequence
aggctgccatggaggatgaacc

SEQ ID NO: 10962 - DNA, 20 bp, Artificial
  MQbrain_1808; macaque brain D4HK8WR02GPKLF sequence
gctgccatggaggatgaacc

SEQ ID NO: 10963 - DNA, 22 bp, Artificial
  MQbrain_1808; macaque brain D708YRU02HMCBI sequence
gctgtggattggggccatcctc

SEQ ID NO: 10964 - DNA, 25 bp, Artificial
  MQbrain_1808; macaque brain D708ZXV01AQQQH sequence
aggctgccatggaggatgaaccatc

SEQ ID NO: 10965 - DNA, 18 bp, Artificial
  MQbrain_1809; macaque brain D4G3X1F02F9RZI sequence
gaaggccctgggaatgtc

SEQ ID NO: 10966 - DNA, 20 bp, Artificial
  MQbrain_1809; macaque brain D708I2V02HUZKP sequence
gtgctctgcaggcagctttg

SEQ ID NO: 10967 - DNA, 24 bp, Artificial
  MQbrain_180; macaque brain D708I2V02G4DV0 sequence
gcctgggctgggtcaggagcttcc

SEQ ID NO: 10968 - DNA, 18 bp, Artificial
  MQbrain_1810; macaque brain D708I2V01CKXON sequence
gcccctgaggaagctgtc

SEQ ID NO: 10969 - DNA, 26 bp, Artificial
  MQbrain_1810; macaque brain D708ZXV01BEIP4 sequence
gccttggaggagacgcagggaagccc

SEQ ID NO: 10970 - DNA, 25 bp, Artificial
  MQbrain_1811; macaque brain D4HK4YF02JEHN1 sequence
gctgagctccaggggtgcgaccagg

SEQ ID NO: 10971 - DNA, 18 bp, Artificial
  MQbrain_1811; macaque brain D708I2V01BS455 sequence
cccgtgagttcagaaggc

SEQ ID NO: 10972 - DNA, 19 bp, Artificial
  MQbrain_1811; macaque brain D708I2V01C3WLB sequence
gagctccaggggtgcgacc

SEQ ID NO: 10973 - DNA, 20 bp, Artificial
  MQbrain_1812; macaque brain D708YRU01A1C9R sequence
gggggtgacaccaggaaagg

SEQ ID NO: 10974 - DNA, 19 bp, Artificial
  MQbrain_1814; macaque brain D4HK4YF01DCUVE sequence
cggccttgttctctctccc

SEQ ID NO: 10975 - DNA, 20 bp, Artificial
  MQbrain_1814; macaque brain D4HK8WR02FPF9W sequence
aacggccttgttctctctcc

SEQ ID NO: 10976 - DNA, 20 bp, Artificial
  MQbrain_1814; macaque brain D708YRU01BNK69 sequence
agagagagggaggccgttgc

SEQ ID NO: 10977 - DNA, 18 bp, Artificial
  MQbrain_1814; macaque brain D708ZXV02HQT5O sequence
aagagagagggaggccgt

SEQ ID NO: 10978 - DNA, 22 bp, Artificial
  MQbrain_1815; macaque brain D708ZXV01C4WJ4 sequence
gtgggcaacctgtcggtcatgt

SEQ ID NO: 10979 - DNA, 24 bp, Artificial
  MQbrain_1819; macaque brain D4HK8WR02HI2N2 sequence
ctgacaaggcgtcggcgtcggccc

SEQ ID NO: 10980 - DNA, 22 bp, Artificial
  MQbrain_181; macaque brain D708ZXV02FWDUP sequence
atggtggaggaaggggaacctg

SEQ ID NO: 10981 - DNA, 20 bp, Artificial
  MQbrain_1820; macaque brain D4HK8WR02F0R13 sequence
gcgcatgtgaggccctgggc

SEQ ID NO: 10982 - DNA, 18 bp, Artificial
  MQbrain_1821; macaque brain D708I2V01C37OU sequence
tgcagcccgagctgactg

SEQ ID NO: 10983 - DNA, 19 bp, Artificial
  MQbrain_1823; macaque brain D708I2V01A8B4A sequence
ccttccagagcctgagatc

SEQ ID NO: 10984 - DNA, 20 bp, Artificial
  MQbrain_1823; macaque brain D708I2V02G59TQ sequence
tccttccagagcctgagatc

SEQ ID NO: 10985 - DNA, 21 bp, Artificial
  MQbrain_1824; macaque brain D708I2V01CJH4B sequence
tttgacagtctttctctgccc

SEQ ID NO: 10986 - DNA, 20 bp, Artificial
  MQbrain_1825; macaque brain D708YRU02INX3N sequence
tgatgagaggaagcggcctt

SEQ ID NO: 10987 - DNA, 26 bp, Artificial
  MQbrain_1826; macaque brain D708ZXV01AIMT2 sequence
ttggattgcttgcagaagaatgaagt

SEQ ID NO: 10988 - DNA, 22 bp, Artificial
  MQbrain_1826; macaque brain D708ZXV02JMG7Q sequence
ttggattgcttgcagaagaatg

SEQ ID NO: 10989 - DNA, 20 bp, Artificial
  MQbrain_1827; macaque brain D4HK4YF01C3739 sequence
tgccggggagattgttgggg

SEQ ID NO: 10990 - DNA, 21 bp, Artificial
  MQbrain_1827; macaque brain D708YRU01AEHQQ sequence
cgagaggtggaggagctgagg

SEQ ID NO: 10991 - DNA, 21 bp, Artificial
  MQbrain_1828; macaque brain D4G3X1F02GF63B sequence
aacgggccagggcctgtgggg

SEQ ID NO: 10992 - DNA, 25 bp, Artificial
  MQbrain_1829; macaque brain D708I2V01B1P9I sequence
ggtttcctgcgtcttcttgcctgtc

SEQ ID NO: 10993 - DNA, 24 bp, Artificial
  MQbrain_1829; macaque brain D708I2V01DQF3V sequence
ggcagctctgctgaatgcagcctc

SEQ ID NO: 10994 - DNA, 21 bp, Artificial
  MQbrain_182; macaque brain D708I2V01DE8SP sequence
tgaatgacgtctgcaccaatg

SEQ ID NO: 10995 - DNA, 23 bp, Artificial
  MQbrain_1831; macaque brain D708I2V02G7UAG sequence
gatgactgaccaagaggctattc

SEQ ID NO: 10996 - DNA, 22 bp, Artificial
  MQbrain_1832; macaque brain D708YRU01BG7LR sequence
tctgcctctgtcttcttccctt

SEQ ID NO: 10997 - DNA, 20 bp, Artificial
  MQbrain_1832; macaque brain D708YRU01CSEB9 sequence
gtgtgctgagggagggaagc

SEQ ID NO: 10998 - DNA, 23 bp, Artificial
  MQbrain_1833; macaque brain D708I2V02JDSNY sequence
tgtcgcggtaggaagcaggggcc

SEQ ID NO: 10999 - DNA, 23 bp, Artificial
  MQbrain_1834; macaque brain D4HK4YF02IEE1D sequence
agaggggtgggtcagagcagtgg

SEQ ID NO: 11000 - DNA, 20 bp, Artificial
  MQbrain_1836; macaque brain D4HK8WR02FMEM5 sequence
cacggccaccaggcagtacg

SEQ ID NO: 11001 - DNA, 25 bp, Artificial
  MQbrain_1836; macaque brain D708I2V01BOFLN sequence
tgcctgggtggcctgttcgtgccgg

SEQ ID NO: 11002 - DNA, 19 bp, Artificial
  MQbrain_1837; macaque brain D4G3X1F01A3FGZ, macaque brain D4G3X1F01D6WTC, macaque brain D4HK8WR01BFATN, macaque brain D708I2V01C4O1C, macaque brain D708I2V01CGVV1, macaque brain D708I2V01CT5BN, macaque brain D708YRU01CFRFN,
gggacagtgccaggtgggg

SEQ ID NO: 11003 - DNA, 18 bp, Artificial
  MQbrain_1837; macaque brain D4G3X1F01BPXJT, macaque brain D708YRU01DN6MP sequence
tgccaggtggggagtttg

SEQ ID NO: 11004 - DNA, 19 bp, Artificial
  MQbrain_1837; macaque brain D4G3X1F01CMWD3, macaque brain D4HK8WR01C8PH2, macaque brain D4HK8WR02J4TLR, macaque brain D708YRU01AI10A, macaque brain D708YRU01BZNU8, macaque brain D708YRU02ISIFR, macaque brain D708ZXV02I5B8F
gtgccaggtggggagtttg

SEQ ID NO: 11005 - DNA, 20 bp, Artificial
  MQbrain_1837; macaque brain D4G3X1F01CQ017, macaque brain D4HK4YF01BUDY2, macaque brain D708I2V01AKANG, macaque brain D708I2V02IAJ9G, macaque brain D708YRU01D2JTA, macaque brain D708ZXV01DLSYA sequence
agtgccaggtggggagtttg

SEQ ID NO: 11006 - DNA, 22 bp, Artificial
  MQbrain_1837; macaque brain D4G3X1F01DA0JW, macaque brain D4HK8WR01AT9MW, macaque brain D708I2V01BM592, macaque brain D708I2V01DXGSR, macaque brain D708ZXV01DSG9D sequence
ggacagtgccaggtggggagtt

SEQ ID NO: 11007 - DNA, 18 bp, Artificial
  MQbrain_1837; macaque brain D4G3X1F01EEO15, macaque brain D4HK8WR01BIGS3, macaque brain D4HK8WR01E0ZDY, macaque brain D708I2V02GGUXK, macaque brain D708I2V02GJCB5, macaque brain D708YRU01EBZ4B, macaque brain D708ZXV01DS3QW
ggacagtgccaggtgggg

SEQ ID NO: 11008 - DNA, 24 bp, Artificial
  MQbrain_1837; macaque brain D4G3X1F02F16MP, macaque brain D4HK4YF01DHFEU, macaque brain D708YRU02GCVSV sequence
gggacagtgccaggtggggagttt

SEQ ID NO: 11009 - DNA, 21 bp, Artificial
  MQbrain_1837; macaque brain D4G3X1F02HNPVD, macaque brain D4HK8WR02J153Z sequence
gacagtgccaggtggggagtt

SEQ ID NO: 11010 - DNA, 23 bp, Artificial
  MQbrain_1837; macaque brain D4G3X1F02IF6S1, macaque brain D708I2V01BEOIC, macaque brain D708YRU02JXJTG, macaque brain D708ZXV02IY4MF sequence
ggacagtgccaggtggggagttt

SEQ ID NO: 11011 - DNA, 24 bp, Artificial
  MQbrain_1837; macaque brain D4HK4YF01AIQR4, macaque brain D4HK8WR02FX7SF, macaque brain D4HK8WR02JJS6L, macaque brain D708YRU01DEQNE sequence
ggacagtgccaggtggggagtttg

SEQ ID NO: 11012 - DNA, 23 bp, Artificial
  MQbrain_1837; macaque brain D4HK4YF01DNZWQ, macaque brain D708I2V02H70TH, macaque brain D708YRU02H8G04 sequence
gacagtgccaggtggggagtttg

SEQ ID NO: 11013 - DNA, 25 bp, Artificial
  MQbrain_1837; macaque brain D4HK4YF02IO3LR, macaque brain D708I2V02GSGU0, macaque brain D708YRU01CE65J, macaque brain D708YRU01D59T3 sequence
gggacagtgccaggtggggagtttg

SEQ ID NO: 11014 - DNA, 22 bp, Artificial
  MQbrain_1837; macaque brain D4HK8WR01A83R7, macaque brain D708YRU02GRTBB, macaque brain D708YRU02HXIX5, macaque brain D708ZXV02IUNLE sequence
acagtgccaggtggggagtttg

SEQ ID NO: 11015 - DNA, 21 bp, Artificial
  MQbrain_1837; macaque brain D4HK8WR01B5DIR, macaque brain D708I2V01EBO72, macaque brain D708YRU01AISBX, macaque brain D708YRU01ECVEO sequence
cagtgccaggtggggagtttg

SEQ ID NO: 11016 - DNA, 19 bp, Artificial
  MQbrain_1837; macaque brain D4HK8WR01C64HX, macaque brain D708YRU01D9ZB5, macaque brain D708YRU02GEPKP sequence
agtgccaggtggggagttt

SEQ ID NO: 11017 - DNA, 20 bp, Artificial
  MQbrain_1837; macaque brain D4HK8WR01C9JSC, macaque brain D708YRU02I4KFI sequence
cagtgccaggtggggagttt

SEQ ID NO: 11018 - DNA, 22 bp, Artificial
  MQbrain_1837; macaque brain D4HK8WR01ERH69 sequence
gacagtgccaggtggggagttt

SEQ ID NO: 11019 - DNA, 19 bp, Artificial
  MQbrain_1837; macaque brain D708I2V01B6TKU, macaque brain D708YRU01DZD2B sequence
acagtgccaggtggggagt

SEQ ID NO: 11020 - DNA, 23 bp, Artificial
  MQbrain_1837; macaque brain D708I2V01BXV09 sequence
gggacagtgccaggtggggagtt

SEQ ID NO: 11021 - DNA, 18 bp, Artificial
  MQbrain_1837; macaque brain D708I2V01CV73Q, macaque brain D708I2V01E3Z8N, macaque brain D708I2V02I8XIR, macaque brain D708YRU01A1LSI, macaque brain D708YRU01ARLG5, macaque brain D708YRU01EMSL4, macaque brain D708YRU02I9PZQ,
gggacagtgccaggtggg

SEQ ID NO: 11022 - DNA, 21 bp, Artificial
  MQbrain_1837; macaque brain D708I2V01EINHH, macaque brain D708YRU01D8RNO, macaque brain D708YRU02H4LPF, macaque brain D708ZXV01CFPM9, macaque brain D708ZXV02JL1B5 sequence
ggacagtgccaggtggggagt

SEQ ID NO: 11023 - DNA, 20 bp, Artificial
  MQbrain_1837; macaque brain D708I2V01EW6KV sequence
gccaggtggggagtttgact

SEQ ID NO: 11024 - DNA, 18 bp, Artificial
  MQbrain_1837; macaque brain D708I2V02G1840 sequence
gccaggtggggagtttga

SEQ ID NO: 11025 - DNA, 21 bp, Artificial
  MQbrain_1837; macaque brain D708I2V02ISRU9 sequence
acagtgccaggtggggagttt

SEQ ID NO: 11026 - DNA, 20 bp, Artificial
  MQbrain_1837; macaque brain D708YRU01AJXPR sequence
gacagtgccaggtggggagt

SEQ ID NO: 11027 - DNA, 25 bp, Artificial
  MQbrain_1837; macaque brain D708YRU01AXYP0 sequence
acagtgccaggtggggagtttgact

SEQ ID NO: 11028 - DNA, 18 bp, Artificial
  MQbrain_1837; macaque brain D708YRU01DWCRZ sequence
gtgccaggtggggagttt

SEQ ID NO: 11029 - DNA, 21 bp, Artificial
  MQbrain_1837; macaque brain D708YRU02GS8ZX sequence
tgccaggtggggagtttgact

SEQ ID NO: 11030 - DNA, 18 bp, Artificial
  MQbrain_1837; macaque brain D708YRU02JE8PW sequence
agtgccaggtggggagtt

SEQ ID NO: 11031 - DNA, 22 bp, Artificial
  MQbrain_1837; macaque brain D708YRU02JKABK sequence
gtgccaggtggggagtttgact

SEQ ID NO: 11032 - DNA, 23 bp, Artificial
  MQbrain_1837; macaque brain D708YRU02JNR20 sequence
agtgccaggtggggagtttgact

SEQ ID NO: 11033 - DNA, 19 bp, Artificial
  MQbrain_1837; macaque brain D708ZXV01C77AS sequence
ccaggtggggagtttgact

SEQ ID NO: 11034 - DNA, 22 bp, Artificial
  MQbrain_1837; macaque brain D708ZXV01DFS4Q sequence
gggacagtgccaggtggggagt

SEQ ID NO: 11035 - DNA, 21 bp, Artificial
  MQbrain_1838; macaque brain D708I2V02HDE2U sequence
ggctgggggaagaggggtttg

SEQ ID NO: 11036 - DNA, 21 bp, Artificial
  MQbrain_1839; macaque brain D4G3X1F01EJN25 sequence
aggagaaggaggagaaggacg

SEQ ID NO: 11037 - DNA, 24 bp, Artificial
  MQbrain_1839; macaque brain D708YRU01BIALK sequence
ctgaccagccacgagaggaccctg

SEQ ID NO: 11038 - DNA, 21 bp, Artificial
  MQbrain_183; macaque brain D708ZXV01DC60D sequence
aaacagctgagtctgaaggtg

SEQ ID NO: 11039 - DNA, 28 bp, Artificial
  MQbrain_1841; macaque brain D708I2V02FWORC sequence
gtttcccgaggtggctttagaggcaact

SEQ ID NO: 11040 - DNA, 20 bp, Artificial
  MQbrain_1842; macaque brain D4G3X1F01BX96Y sequence
gtggggacggggcggctggg

SEQ ID NO: 11041 - DNA, 19 bp, Artificial
  MQbrain_1842; macaque brain D708ZXV01C2XK2 sequence
tctaaccgcaccgtccccc

SEQ ID NO: 11042 - DNA, 20 bp, Artificial
  MQbrain_1842; macaque brain D708ZXV02H0PQ4 sequence
ctctaaccgcaccgtccccc

SEQ ID NO: 11043 - DNA, 23 bp, Artificial
  MQbrain_1843; macaque brain D708I2V01EWD0N sequence
agcacgcagggagccgaggaggt

SEQ ID NO: 11044 - DNA, 23 bp, Artificial
  MQbrain_1843; macaque brain D708ZXV01CPDL0 sequence
cgcagggagccgaggaggtgctc

SEQ ID NO: 11045 - DNA, 18 bp, Artificial
  MQbrain_1844; macaque brain D708ZXV01CA2UC sequence
tggagcagctggtggagg

SEQ ID NO: 11046 - DNA, 18 bp, Artificial
  MQbrain_1845, MQbrain_1846; macaque brain D708ZXV01EJF34 sequence
gctggggaagggacaggc

SEQ ID NO: 11047 - DNA, 24 bp, Artificial
  MQbrain_1847; macaque brain D4HK4YF02IUVJD sequence
accctcttggctggggccttgttc

SEQ ID NO: 11048 - DNA, 19 bp, Artificial
  MQbrain_1848; macaque brain D708I2V01BSC6K sequence
tggggtgtgggttggatgc

SEQ ID NO: 11049 - DNA, 20 bp, Artificial
  MQbrain_1849; macaque brain D4HK8WR01CQEIT sequence
tcactgtggctgccagtgtc

SEQ ID NO: 11050 - DNA, 22 bp, Artificial
  MQbrain_1850; macaque brain D4G3X1F01DKHG2, macaque brain D4HK8WR01CE7FS sequence
ttggaggttaattagcagcatg

SEQ ID NO: 11051 - DNA, 18 bp, Artificial
  MQbrain_1850; macaque brain D4HK8WR02GOGM4, macaque brain D708ZXV02J1Z10 sequence
ttgctgccagtcaccttc

SEQ ID NO: 11052 - DNA, 18 bp, Artificial
  MQbrain_1850; macaque brain D4HK8WR02JKWMP, macaque brain D708YRU02F00HY sequence
atttggaggttaattagc

SEQ ID NO: 11053 - DNA, 20 bp, Artificial
  MQbrain_1850; macaque brain D708YRU01AJZB5 sequence
tttggaggttaattagcagc

SEQ ID NO: 11054 - DNA, 21 bp, Artificial
  MQbrain_1850; macaque brain D708YRU01C5MEH sequence
atttggaggttaattagcagc

SEQ ID NO: 11055 - DNA, 23 bp, Artificial
  MQbrain_1850; macaque brain D708ZXV02GT3EP sequence
tttggaggttaattagcagcatg

SEQ ID NO: 11056 - DNA, 19 bp, Artificial
  MQbrain_1851; macaque brain D708I2V01AHC2E sequence
aagagcctggaagaaaccc

SEQ ID NO: 11057 - DNA, 22 bp, Artificial
  MQbrain_1853; macaque brain D708ZXV01ECM05 sequence
taagctgtgcagagccttgagg

SEQ ID NO: 11058 - DNA, 18 bp, Artificial
  MQbrain_1855; macaque brain D708YRU01CT4YB sequence
ttttagtgcattagtggg

SEQ ID NO: 11059 - DNA, 21 bp, Artificial
  MQbrain_1856; macaque brain D4G3X1F02G73J8 sequence
cactgtttcctttctgagtgg

SEQ ID NO: 11060 - DNA, 20 bp, Artificial
  MQbrain_1856; macaque brain D4G3X1F02IO8T6, macaque brain D4HK8WR01DJTDL sequence
tattcagaaaggtgccagtc

SEQ ID NO: 11061 - DNA, 19 bp, Artificial
  MQbrain_1857; macaque brain D708ZXV02G65KT sequence
aactgttccctttctgagt

SEQ ID NO: 11062 - DNA, 20 bp, Artificial
  MQbrain_1857; macaque brain D708ZXV02GIFLJ sequence
tacttggaaaggcaccagtt

SEQ ID NO: 11063 - DNA, 18 bp, Artificial
  MQbrain_1858; macaque brain D708YRU01BQD6N sequence
ggcagtgagcagccagcc

SEQ ID NO: 11064 - DNA, 22 bp, Artificial
  MQbrain_1858; macaque brain D708ZXV02HY7Z0 sequence
tggcatggcgcctcctctgccc

SEQ ID NO: 11065 - DNA, 23 bp, Artificial
  MQbrain_1859, MQbrain_1860, MQbrain_1891; macaque brain D708YRU01ES9MW sequence
ttgggggtagttggaagggactg

SEQ ID NO: 11066 - DNA, 18 bp, Artificial
  MQbrain_185; macaque brain D4HK8WR01DCEUC sequence
aattgacttgtttggagg

SEQ ID NO: 11067 - DNA, 22 bp, Artificial
  MQbrain_1861; macaque brain D4G3X1F01CZLPK, macaque brain D4HK8WR01EWEMR sequence
agtgtacttcctgaggcctctg

SEQ ID NO: 11068 - DNA, 20 bp, Artificial
  MQbrain_1861; macaque brain D4G3X1F02GLOVP, macaque brain D708I2V01CSNJM, macaque brain D708YRU02HBZM0, macaque brain D708ZXV01DTY4L, macaque brain D708ZXV02JLCCZ sequence
tggcctctgggtgtgtaccc

SEQ ID NO: 11069 - DNA, 19 bp, Artificial
  MQbrain_1861; macaque brain D4HK4YF01EBD1S, macaque brain D708I2V02G4EOZ, macaque brain D708YRU02H9YWT, macaque brain D708ZXV02FN5H5 sequence
tggcctctgggtgtgtacc

SEQ ID NO: 11070 - DNA, 19 bp, Artificial
  MQbrain_1861; macaque brain D4HK4YF02JMZ3O sequence
ggcctctgggtgtgtaccc

SEQ ID NO: 11071 - DNA, 23 bp, Artificial
  MQbrain_1861; macaque brain D4HK8WR02FOGOX, macaque brain D4HK8WR02GGZGN, macaque brain D708YRU01DHAVW sequence
agtgtacttcctgaggcctctgg

SEQ ID NO: 11072 - DNA, 21 bp, Artificial
  MQbrain_1861; macaque brain D708I2V01C0ZWW sequence
agtgtacttcctgaggcctct

SEQ ID NO: 11073 - DNA, 22 bp, Artificial
  MQbrain_1861; macaque brain D708I2V02HHAA2, macaque brain D708ZXV02IZI86 sequence
tgtggcctctgggtgtgtaccc

SEQ ID NO: 11074 - DNA, 21 bp, Artificial
  MQbrain_1861; macaque brain D708I2V02HQ2RK, macaque brain D708ZXV02JK51D sequence
tggcctctgggtgtgtaccct

SEQ ID NO: 11075 - DNA, 18 bp, Artificial
  MQbrain_1861; macaque brain D708YRU01CVTIO, macaque brain D708YRU02GGS0F, macaque brain D708YRU02ILRVW, macaque brain D708ZXV01A1QOB sequence
tgtggcctctgggtgtgt

SEQ ID NO: 11076 - DNA, 23 bp, Artificial
  MQbrain_1861; macaque brain D708YRU01DKBRT sequence
tgtggcctctgggtgtgtaccct

SEQ ID NO: 11077 - DNA, 21 bp, Artificial
  MQbrain_1861; macaque brain D708YRU02HTHVT sequence
gtggcctctgggtgtgtaccc

SEQ ID NO: 11078 - DNA, 24 bp, Artificial
  MQbrain_1862; macaque brain D708ZXV01BAMDS sequence
gagagagtggagaagctggtgccc

SEQ ID NO: 11079 - DNA, 19 bp, Artificial
  MQbrain_1863, MQbrain_1864, MQbrain_39, MQbrain_40; macaque brain D708YRU02F64H3 sequence
gttgggtgacgttccctgg

SEQ ID NO: 11080 - DNA, 19 bp, Artificial
  MQbrain_1865; macaque brain D708ZXV01DV3YE sequence
ggagcagaaaacagcaggc

SEQ ID NO: 11081 - DNA, 25 bp, Artificial
  MQbrain_1865; macaque brain D708ZXV01EJB0D sequence
tttgcctcagacaggtatctcttcg

SEQ ID NO: 11082 - DNA, 18 bp, Artificial
  MQbrain_1866; macaque brain D4HK8WR01EAMOI, macaque brain D4HK8WR02IGYVY sequence
attgggagtggtaggatg

SEQ ID NO: 11083 - DNA, 24 bp, Artificial
  MQbrain_1867; macaque brain D708I2V02I2YXH sequence
aggacgtgagtagggctagggagg

SEQ ID NO: 11084 - DNA, 24 bp, Artificial
  MQbrain_1868; macaque brain D708YRU02JSE5B sequence
tgcccggggagagtcagggttctc

SEQ ID NO: 11085 - DNA, 22 bp, Artificial
  MQbrain_1869; macaque brain D708YRU01BQQ9V sequence
agagggccctgaagtggatgtg

SEQ ID NO: 11086 - DNA, 19 bp, Artificial
  MQbrain_1869; macaque brain D708YRU02FVIZL sequence
gtctcaggacccaaggtgg

SEQ ID NO: 11087 - DNA, 22 bp, Artificial
  MQbrain_186; macaque brain D4HK8WR02G3ASN sequence
agtagcaggaagaaggagatcg

SEQ ID NO: 11088 - DNA, 20 bp, Artificial
  MQbrain_1870; macaque brain D4HK8WR02HTBO1 sequence
ggtgctggaggagtggcctg

SEQ ID NO: 11089 - DNA, 18 bp, Artificial
  MQbrain_1872, MQbrain_227, MQbrain_895, MQbrain_970; macaque brain D4HK8WR02J48PM sequence
tttgtggatggcctgatg

SEQ ID NO: 11090 - DNA, 19 bp, Artificial
  MQbrain_1873; macaque brain D4HK8WR02JJROS sequence
accgcgagcgaaaagggcg

SEQ ID NO: 11091 - DNA, 22 bp, Artificial
  MQbrain_1873; macaque brain D708I2V01DDR0M, macaque brain D708I2V02HKBP7, macaque brain D708YRU01DCMQJ, macaque brain D708ZXV02GMR34 sequence
accgcgagcgaaaagggcgagg

SEQ ID NO: 11092 - DNA, 21 bp, Artificial
  MQbrain_1873; macaque brain D708ZXV01A7OD1 sequence
tcgcgcttctctctcgcagtc

SEQ ID NO: 11093 - DNA, 22 bp, Artificial
  MQbrain_1873; macaque brain D708ZXV02J4ZD9 sequence
tcgcgcttctctctcgcagtct

SEQ ID NO: 11094 - DNA, 22 bp, Artificial
  MQbrain_1874; macaque brain D708I2V01CHOA9 sequence
tggggagtttgtgggggaaggt

SEQ ID NO: 11095 - DNA, 23 bp, Artificial
  MQbrain_1875; macaque brain D708I2V01AW4G1 sequence
cccttctccaggccacggatttc

SEQ ID NO: 11096 - DNA, 22 bp, Artificial
  MQbrain_1876; macaque brain D708I2V01AX33X sequence
tgggggagtagcggggcctggg

SEQ ID NO: 11097 - DNA, 24 bp, Artificial
  MQbrain_1876; macaque brain D708I2V01DKOR5 sequence
gggggagtagcggggcctgggctg

SEQ ID NO: 11098 - DNA, 21 bp, Artificial
  MQbrain_1877; macaque brain D708I2V02JNZ58 sequence
cttggccctgaggactttgcc

SEQ ID NO: 11099 - DNA, 20 bp, Artificial
  MQbrain_1878; macaque brain D708I2V01BT5YI sequence
gctcaagcctgccgggcctc

SEQ ID NO: 11100 - DNA, 23 bp, Artificial
  MQbrain_1879; macaque brain D4G3X1F01EC15J sequence
tcgctcgggcctagccgtcctcg

SEQ ID NO: 11101 - DNA, 20 bp, Artificial
  MQbrain_187; macaque brain D4HK4YF02FKE3Z sequence
ggtactacaactcccaaggt

SEQ ID NO: 11102 - DNA, 19 bp, Artificial
  MQbrain_1880; macaque brain D4HK8WR01CV8JH sequence
tcacaggaaggctcttgtc

SEQ ID NO: 11103 - DNA, 18 bp, Artificial
  MQbrain_1881; macaque brain D4HK4YF02FRZ1J sequence
aaggagaatggcccagtc

SEQ ID NO: 11104 - DNA, 23 bp, Artificial
  MQbrain_1883; macaque brain D708YRU02IGDML sequence
gcttgtgtgttggcaggctaccg

SEQ ID NO: 11105 - DNA, 19 bp, Artificial
  MQbrain_1885; macaque brain D4HK4YF01D1JVR sequence
tgtcatactgttgggtttt

SEQ ID NO: 11106 - DNA, 19 bp, Artificial
  MQbrain_1887; macaque brain D4HK4YF02HFV9A sequence
ggccgtggctctggcagtg

SEQ ID NO: 11107 - DNA, 18 bp, Artificial
  MQbrain_1888; macaque brain D708YRU01EBQAQ sequence
agagctgtggggtctgtg

SEQ ID NO: 11108 - DNA, 18 bp, Artificial
  MQbrain_1889; macaque brain D4HK8WR02I4LO1 sequence
gagtcaggggtagagcgg

SEQ ID NO: 11109 - DNA, 18 bp, Artificial
  MQbrain_188; macaque brain D708ZXV01BCB6Q sequence
ggtctgcagccctctggt

SEQ ID NO: 11110 - DNA, 18 bp, Artificial
  MQbrain_1890; macaque brain D4HK8WR01D78B9 sequence
gcggtgaaggagaagatc

SEQ ID NO: 11111 - DNA, 22 bp, Artificial
  MQbrain_1890; macaque brain D708ZXV01BJEAK sequence
tttgtggtggagaggggcttcg

SEQ ID NO: 11112 - DNA, 18 bp, Artificial
  MQbrain_1892; macaque brain D708I2V02FU30Z sequence
ggaaacaagctggagctc

SEQ ID NO: 11113 - DNA, 18 bp, Artificial
  MQbrain_1894; macaque brain D708I2V01ATU6N sequence
gcccagccatctgcaccc

SEQ ID NO: 11114 - DNA, 23 bp, Artificial
  MQbrain_1894; macaque brain D708I2V02JZKEE sequence
tggccagggccaaatagctatgc

SEQ ID NO: 11115 - DNA, 24 bp, Artificial
  MQbrain_1894; macaque brain D708ZXV02HQKX3 sequence
tggcccagccatctgcacccactt

SEQ ID NO: 11116 - DNA, 21 bp, Artificial
  MQbrain_1895; macaque brain D708I2V01EPEUQ, macaque brain D708I2V02JY8HQ sequence
ctgaaagagcagttggtgttt

SEQ ID NO: 11117 - DNA, 20 bp, Artificial
  MQbrain_1895; macaque brain D708I2V02GZJHU, macaque brain D708YRU01A9YAU, macaque brain D708YRU01AUMKR, macaque brain D708YRU02HMCU9, macaque brain D708ZXV02IMFTI sequence
aacagcaatcgctcttttgg

SEQ ID NO: 11118 - DNA, 22 bp, Artificial
  MQbrain_1895; macaque brain D708YRU01BJLOK sequence
tctgaaagagcagttggtgttt

SEQ ID NO: 11119 - DNA, 24 bp, Artificial
  MQbrain_1896; macaque brain D708YRU02I0CQV sequence
atgagctacccaggggtgaggatg

SEQ ID NO: 11120 - DNA, 21 bp, Artificial
  MQbrain_1897; macaque brain D708ZXV01BZBCA sequence
gcacgggaaacggggccaacg

SEQ ID NO: 11121 - DNA, 23 bp, Artificial
  MQbrain_189; macaque brain D4HK8WR01EA0NE sequence
gtgaagattttgtcttggtttcc

SEQ ID NO: 11122 - DNA, 22 bp, Artificial
  MQbrain_1901; macaque brain D4G3X1F02GWGCP, macaque brain D4HK4YF01EHBX5, macaque brain D4HK8WR01BLA8R, macaque brain D4HK8WR01E1Q4E, macaque brain D4HK8WR02HI7RZ, macaque brain D708I2V02HA1KS, macaque brain D708YRU02F87K9,
tgatatgtttgatattgggttg

SEQ ID NO: 11123 - DNA, 21 bp, Artificial
  MQbrain_1901; macaque brain D708YRU02F5T0T, macaque brain D708YRU02FS6F8 sequence
tgatatgtttgatattgggtt

SEQ ID NO: 11124 - DNA, 23 bp, Artificial
  MQbrain_1901; macaque brain D708YRU02I8GCA sequence
tgatatgtttgatattgggttgt

SEQ ID NO: 11125 - DNA, 19 bp, Artificial
  MQbrain_190; macaque brain D708ZXV02JUNUE sequence
tcgtcaaatgttgagggct

SEQ ID NO: 11126 - DNA, 20 bp, Artificial
  MQbrain_1914, MQbrain_1924,MQbrain_2000; macaque brain D4G3X1F02FNNOW, macaque brain D708I2V02G2NZP, macaque brain D708YRU01D677T, macaque brain D708ZXV01B0F4V sequence
gaaaagctgggttgagaggg

SEQ ID NO: 11127 - DNA, 20 bp, Artificial
  MQbrain_1914, MQbrain_1924,MQbrain_2000; macaque brain D4G3X1F02I9PBG, macaque brain D4HK4YF01CGK4M, macaque brain D4HK8WR01BLVL9, macaque brain D708I2V01D4MNV, macaque brain D708YRU01AXTKG, macaque brain D708YRU01D6VI8, macaque brain D708YRU02GZAIV
gaaaagctgggttgagaggg

SEQ ID NO: 11128 - DNA, 20 bp, Artificial
  MQbrain_1914, MQbrain_1924,MQbrain_2000; macaque brain D708I2V01B9WBW, macaque brain D708YRU02FV3D0, macaque brain D708YRU02GAF3A, macaque brain D708ZXV01BDUM8, macaque brain D708ZXV02FK0YT, macaque brain D708ZXV02H954Q sequence
gaaaagctgggttgagaggg

SEQ ID NO: 11129 - DNA, 20 bp, Artificial
  MQbrain_1914; macaque brain D4HK8WR01CSRC7 sequence
gaaaagctgggttgagaggg

SEQ ID NO: 11130 - DNA, 20 bp, Artificial
  MQbrain_1914; macaque brain D708I2V01D6X65 sequence
gaaaagctgggttgagaggg

SEQ ID NO: 11131 - DNA, 20 bp, Artificial
  MQbrain_1914; macaque brain D708I2V02JMP0B sequence
gaaaagctgggttgagaggg

SEQ ID NO: 11132 - DNA, 20 bp, Artificial
  MQbrain_1914; macaque brain D708ZXV01DA7PC sequence
gaaaagctgggttgagaggg

SEQ ID NO: 11133 - DNA, 20 bp, Artificial
  MQbrain_1917; macaque brain D708YRU01DXOK2, macaque brain D708ZXV02GCMEM, macaque brain D708ZXV02ILBWB sequence
aaaagctgggttgagagggt

SEQ ID NO: 11134 - DNA, 26 bp, Artificial
  MQbrain_191; macaque brain D708YRU02I4VJY sequence
gatgccaaggctgaaggagtctcgct

SEQ ID NO: 11135 - DNA, 19 bp, Artificial
  MQbrain_1924,MQbrain_2000; macaque brain D4G3X1F01ANP2J sequence
aaaagctgggttgagaggc

SEQ ID NO: 11136 - DNA, 20 bp, Artificial
  MQbrain_1924,MQbrain_2000; macaque brain D4G3X1F01BWVRM sequence
gaaaagctgggttgagaggg

SEQ ID NO: 11137 - DNA, 20 bp, Artificial
  MQbrain_1924,MQbrain_2000; macaque brain D4G3X1F01D0QP2, macaque brain D4HK4YF01BM5IV, macaque brain D4HK4YF02GG904 sequence
gaaaagctgggttgagaggg

SEQ ID NO: 11138 - DNA, 20 bp, Artificial
  MQbrain_1924,MQbrain_2000; macaque brain D4G3X1F02F9DUF sequence
gaaaagctgggttgagaggg

SEQ ID NO: 11139 - DNA, 20 bp, Artificial
  MQbrain_1924,MQbrain_2000; macaque brain D4HK8WR01AYD73 sequence
gaaaagctgggttgagaggg

SEQ ID NO: 11140 - DNA, 20 bp, Artificial
  MQbrain_1924,MQbrain_2000; macaque brain D4HK8WR01BAFFW, macaque brain D4HK8WR02GD1KH, macaque brain D4HK8WR02GKF7U, macaque brain D708I2V02HVG1C sequence
gaaaagctgggttgagaggg

SEQ ID NO: 11141 - DNA, 20 bp, Artificial
  MQbrain_1924,MQbrain_2000; macaque brain D4HK8WR01CEPA2 sequence
gaaaagctgggttgagaggg

SEQ ID NO: 11142 - DNA, 20 bp, Artificial
  MQbrain_1924,MQbrain_2000; macaque brain D4HK8WR01DSG44, macaque brain D708YRU01DXOK2, macaque brain D708YRU02JG4AU, macaque brain D708ZXV02IELJL sequence
gaaaagctgggttgagaggg

SEQ ID NO: 11143 - DNA, 20 bp, Artificial
  MQbrain_1924,MQbrain_2000; macaque brain D4HK8WR02H8GPA sequence
gaaaagctgggttgagaggg

SEQ ID NO: 11144 - DNA, 20 bp, Artificial
  MQbrain_1924,MQbrain_2000; macaque brain D4HK8WR02JSIVD sequence
gaaaagctgggttgagaggg

SEQ ID NO: 11145 - DNA, 20 bp, Artificial
  MQbrain_1924,MQbrain_2000; macaque brain D708I2V01AU14Y sequence
gaaaagctgggttgagaggg

SEQ ID NO: 11146 - DNA, 20 bp, Artificial
  MQbrain_1924,MQbrain_2000; macaque brain D708I2V01CHSO3 sequence
gaaaagctgggttgagaggg

SEQ ID NO: 11147 - DNA, 20 bp, Artificial
  MQbrain_1924,MQbrain_2000; macaque brain D708I2V01ECP4I sequence
gaaaagctgggttgagaggg

SEQ ID NO: 11148 - DNA, 20 bp, Artificial
  MQbrain_1924,MQbrain_2000; macaque brain D708I2V01EMHNS sequence
gaaaagctgggttgagaggg

SEQ ID NO: 11149 - DNA, 20 bp, Artificial
  MQbrain_1924,MQbrain_2000; macaque brain D708YRU01AK84Z sequence
gaaaagctgggttgagaggg

SEQ ID NO: 11150 - DNA, 20 bp, Artificial
  MQbrain_1924,MQbrain_2000; macaque brain D708YRU01DE92N sequence
gaaaagctgggttgagaggg

SEQ ID NO: 11151 - DNA, 20 bp, Artificial
  MQbrain_1924,MQbrain_2000; macaque brain D708YRU02GGYAN sequence
gaaaagctgggttgagaggg

SEQ ID NO: 11152 - DNA, 20 bp, Artificial
  MQbrain_1924,MQbrain_2000; macaque brain D708YRU02HU4DM sequence
gaaaagctgggttgagaggg

SEQ ID NO: 11153 - DNA, 20 bp, Artificial
  MQbrain_1924,MQbrain_2000; macaque brain D708YRU02IQ8RB sequence
gaaaagctgggttgagaggg

SEQ ID NO: 11154 - DNA, 20 bp, Artificial
  MQbrain_1924,MQbrain_2000; macaque brain D708ZXV01CA24K sequence
gaaaagctgggttgagaggg

SEQ ID NO: 11155 - DNA, 20 bp, Artificial
  MQbrain_1924,MQbrain_2000; macaque brain D708ZXV02F6SBB sequence
gaaaagctgggttgagaggg

SEQ ID NO: 11156 - DNA, 20 bp, Artificial
  MQbrain_1924,MQbrain_2000; macaque brain D708ZXV02GAB0T sequence
gaaaagctgggttgagaggg

SEQ ID NO: 11157 - DNA, 20 bp, Artificial
  MQbrain_1924,MQbrain_2000; macaque brain D708ZXV02GB4MC, macaque brain D708ZXV02HAGE6 sequence
gaaaagctgggttgagaggg

SEQ ID NO: 11158 - DNA, 20 bp, Artificial
  MQbrain_1924,MQbrain_2000; macaque brain D708ZXV02HN140, macaque brain D708ZXV02ILBWB sequence
gaaaagctgggttgagaggg

SEQ ID NO: 11159 - DNA, 20 bp, Artificial
  MQbrain_1924,MQbrain_2000; macaque brain D708ZXV02JYPCU sequence
gaaaagctgggttgagaggg

SEQ ID NO: 11160 - DNA, 18 bp, Artificial
  MQbrain_192; macaque brain D708ZXV01CFH2X sequence
atggagacctgggatggg

SEQ ID NO: 11161 - DNA, 20 bp, Artificial
  MQbrain_193; macaque brain D708ZXV01D254I sequence
ctgtgtcctgggagagcttc

SEQ ID NO: 11162 - DNA, 19 bp, Artificial
  MQbrain_1946; macaque brain D4HK8WR01BOUF1, macaque brain D4HK8WR02FPLD0, macaque brain D708ZXV01AZ2UN sequence
tttggcaatggtagaactc

SEQ ID NO: 11163 - DNA, 25 bp, Artificial
  MQbrain_1946; macaque brain D4HK8WR01CGBHJ sequence
tttggcaatggtagaactcacactg

SEQ ID NO: 11164 - DNA, 26 bp, Artificial
  MQbrain_1946; macaque brain D4HK8WR02GVIYH sequence
tttggcaatggtagaactcacactgg

SEQ ID NO: 11165 - DNA, 21 bp, Artificial
  MQbrain_194; macaque brain D4HK8WR02GXMU3 sequence
ttgagtcccagggcctgaagg

SEQ ID NO: 11166 - DNA, 25 bp, Artificial
  MQbrain_195; macaque brain D708ZXV01DR4TE sequence
gatcagatgggattgctgttatact

SEQ ID NO: 11167 - DNA, 22 bp, Artificial
  MQbrain_196; macaque brain D4HK4YF01EL3ZT sequence
tttggggtgattgcaggatagc

SEQ ID NO: 11168 - DNA, 23 bp, Artificial
  MQbrain_197; macaque brain D708I2V01DRHGV sequence
aaagagaaggggggacgaaaatg

SEQ ID NO: 11169 - DNA, 21 bp, Artificial
  MQbrain_199; macaque brain D708I2V01B638X sequence
aggagtaggggaagggaaggg

SEQ ID NO: 11170 - DNA, 21 bp, Artificial
  MQbrain_19; macaque brain D708ZXV02IFGK8 sequence
ctgcgtctggagccaggtcgg

SEQ ID NO: 11171 - DNA, 19 bp, Artificial
  MQbrain_200; macaque brain D4HK8WR01CPJ94 sequence
ggtggtgtgtgtctcggtg

SEQ ID NO: 11172 - DNA, 19 bp, Artificial
  MQbrain_201; macaque brain D708I2V02GM9EV sequence
aattctagggtgggttggg

SEQ ID NO: 11173 - DNA, 22 bp, Artificial
  MQbrain_202; macaque brain D4HK4YF01CACYN sequence
acgtctcatagaagccactgcc

SEQ ID NO: 11174 - DNA, 21 bp, Artificial
  MQbrain_203; macaque brain D708YRU01EI88Y sequence
atggggggagaatgggacttg

SEQ ID NO: 11175 - DNA, 23 bp, Artificial
  MQbrain_204; macaque brain D708YRU02F8TYK sequence
ggccttccagctgctgctgcgcg

SEQ ID NO: 11176 - DNA, 20 bp, Artificial
  MQbrain_2050; macaque brain D4G3X1F01BQ83Q, macaque brain D4HK4YF02F425N sequence
taattttatgtataagctgg

SEQ ID NO: 11177 - DNA, 22 bp, Artificial
  MQbrain_2050; macaque brain D708YRU02H8ARL sequence
taattttatgtataagctggtc

SEQ ID NO: 11178 - DNA, 21 bp, Artificial
  MQbrain_2050; macaque brain D708YRU02HO54X sequence
taattttatgtataagctggt

SEQ ID NO: 11179 - DNA, 23 bp, Artificial
  MQbrain_2050; macaque brain D708YRU02JHY75 sequence
taattttatgtataagctggtct

SEQ ID NO: 11180 - DNA, 20 bp, Artificial
  MQbrain_2050; macaque brain D708ZXV01C2KLU sequence
gagcttattcataaaagtgc

SEQ ID NO: 11181 - DNA, 20 bp, Artificial
  MQbrain_205; macaque brain D708YRU01B79ZW sequence
gaaggagacggggtacactc

SEQ ID NO: 11182 - DNA, 23 bp, Artificial
  MQbrain_2075; macaque brain D4G3X1F02I4L16, macaque brain D708I2V02JGCYM sequence
tgggcctgatgtggtgctggggc

SEQ ID NO: 11183 - DNA, 20 bp, Artificial
  MQbrain_2075; macaque brain D4G3X1F02IDEMO sequence
tgggcctgatgtggtgctgg

SEQ ID NO: 11184 - DNA, 22 bp, Artificial
  MQbrain_2075; macaque brain D4HK4YF02FN6NC, macaque brain D708ZXV01BOTUK sequence
ccagtaccacgtgtcagggcca

SEQ ID NO: 11185 - DNA, 19 bp, Artificial
  MQbrain_2075; macaque brain D4HK4YF02JDEWM, macaque brain D4HK8WR02HJ8I2, macaque brain D708YRU02IIC4C sequence
gggcctgatgtggtgctgg

SEQ ID NO: 11186 - DNA, 20 bp, Artificial
  MQbrain_2075; macaque brain D4HK8WR01A47RS, macaque brain D4HK8WR01AQVXS, macaque brain D708YRU02GQB0K, macaque brain D708YRU02IF5LZ, macaque brain D708ZXV01CGI1T sequence
gggcctgatgtggtgctggg

SEQ ID NO: 11187 - DNA, 22 bp, Artificial
  MQbrain_2075; macaque brain D708I2V01A24S7, macaque brain D708ZXV01DHT7K, macaque brain D708ZXV02GU41P, macaque brain D708ZXV02I60K5 sequence
gggcctgatgtggtgctggggc

SEQ ID NO: 11188 - DNA, 21 bp, Artificial
  MQbrain_2075; macaque brain D708YRU01CID4R sequence
ccagtaccacgtgtcagggcc

SEQ ID NO: 11189 - DNA, 19 bp, Artificial
  MQbrain_2075; macaque brain D708ZXV02GFV8H sequence
ccagtaccacgtgtcaggg

SEQ ID NO: 11190 - DNA, 18 bp, Artificial
  MQbrain_2075; macaque brain D708ZXV02GTR74 sequence
ggcctgatgtggtgctgg

SEQ ID NO: 11191 - DNA, 22 bp, Artificial
  MQbrain_207; macaque brain D708YRU02F3A2G sequence
gagcgcctggctacagccctgc

SEQ ID NO: 11192 - DNA, 20 bp, Artificial
  MQbrain_2087; macaque brain D4G3X1F01CLDXJ, macaque brain D4G3X1F02HS0FM, macaque brain D4HK8WR01CXVER, macaque brain D4HK8WR01DEPQA, macaque brain D4HK8WR02G5TEG, macaque brain D4HK8WR02IKYOA, macaque brain D708ZXV01B7UTL, macaque brain
aaacattcgcggtgcacttc

SEQ ID NO: 11193 - DNA, 20 bp, Artificial
  MQbrain_2087; macaque brain D708I2V01BFZDJ, macaque brain D708YRU01BNLKX, macaque brain D708YRU02G76TH sequence
aagttgcccgtgtctttttc

SEQ ID NO: 11194 - DNA, 21 bp, Artificial
  MQbrain_2087; macaque brain D708I2V01BMW9K, macaque brain D708I2V02FINLD, macaque brain D708YRU01CYHML, macaque brain D708YRU02J0E8I, macaque brain D708ZXV01BYOEG, macaque brain D708ZXV01CVHXD, macaque brain D708ZXV02FJSJ0, macaque brain
aagttgcccgtgtctttttcg

SEQ ID NO: 11195 - DNA, 19 bp, Artificial
  MQbrain_2087; macaque brain D708YRU01E41KA sequence
aagttgcccgtgtcttttt

SEQ ID NO: 11196 - DNA, 22 bp, Artificial
  MQbrain_2087; macaque brain D708YRU02JG1TZ, macaque brain D708ZXV02J35U7 sequence
gaagttgcccgtgtctttttcg

SEQ ID NO: 11197 - DNA, 20 bp, Artificial
  MQbrain_2087; macaque brain D708ZXV01DI3R1, macaque brain D708ZXV01DNVRQ sequence
gaagttgcccgtgtcttttt

SEQ ID NO: 11198 - DNA, 18 bp, Artificial
  MQbrain_2087; macaque brain D708ZXV01DSRMM sequence
cattcgcggtgcacttct

SEQ ID NO: 11199 - DNA, 18 bp, Artificial
  MQbrain_2087; macaque brain D708ZXV02JYPFB sequence
attcgcggtgcacttctt

SEQ ID NO: 11200 - DNA, 22 bp, Artificial
  MQbrain_208; macaque brain D4HK8WR01DJBX1 sequence
atttctgactctacctctcccc

SEQ ID NO: 11201 - DNA, 20 bp, Artificial
  MQbrain_209; macaque brain D4HK8WR02HNG5A sequence
gcttgtgctggccgcggtgg

SEQ ID NO: 11202 - DNA, 25 bp, Artificial
  MQbrain_209; macaque brain D708YRU02GQU7Q sequence
gctgcttgtgctggccgcggtggtg

SEQ ID NO: 11203 - DNA, 18 bp, Artificial
  MQbrain_20; macaque brain D708I2V01D95TO sequence
gcaaaggccaaatgctgg

SEQ ID NO: 11204 - DNA, 26 bp, Artificial
  MQbrain_210; macaque brain D4HK4YF01EHLBD sequence
ttcccacctcctgacacccttctccc

SEQ ID NO: 11205 - DNA, 21 bp, Artificial
  MQbrain_2112; macaque brain D4G3X1F01DA638, macaque brain D708I2V01E379S sequence
tgcacccaggcaaggattctg

SEQ ID NO: 11206 - DNA, 26 bp, Artificial
  MQbrain_2112; macaque brain D4G3X1F02I6S35 sequence
taatccttgctacctgggtgagagtg

SEQ ID NO: 11207 - DNA, 21 bp, Artificial
  MQbrain_2112; macaque brain D708I2V01BWPXZ, macaque brain D708YRU01BUNWX sequence
agtgcacccaggcaaggattc

SEQ ID NO: 11208 - DNA, 25 bp, Artificial
  MQbrain_2112; macaque brain D708I2V02JABGR, macaque brain D708YRU02HJEOC sequence
taatccttgctacctgggtgagagt

SEQ ID NO: 11209 - DNA, 18 bp, Artificial
  MQbrain_211; macaque brain D708I2V01E0SFC sequence
gctacagccaggacccgg

SEQ ID NO: 11210 - DNA, 18 bp, Artificial
  MQbrain_213; macaque brain D4HK4YF01AR18V sequence
tctcctgagtccttcctg

SEQ ID NO: 11211 - DNA, 19 bp, Artificial
  MQbrain_213; macaque brain D708ZXV01ED6RZ sequence
tctcctgagtccttcctgt

SEQ ID NO: 11212 - DNA, 22 bp, Artificial
  MQbrain_214; macaque brain D4HK8WR01B3SZH sequence
tcctggggcaggcagccagatc

SEQ ID NO: 11213 - DNA, 23 bp, Artificial
  MQbrain_2154; macaque brain D4HK4YF01AVH4C sequence
agtgcaatattgcttatagggtt

SEQ ID NO: 11214 - DNA, 21 bp, Artificial
  MQbrain_2154; macaque brain D708YRU02HMW0W sequence
tagtgcaatattgcttatagg

SEQ ID NO: 11215 - DNA, 20 bp, Artificial
  MQbrain_215; macaque brain D708ZXV02HD68T sequence
ttttgaggcggtgtctgcgg

SEQ ID NO: 11216 - DNA, 20 bp, Artificial
  MQbrain_216; macaque brain D708YRU02IN8NN sequence
ctggagtggctgcgaagggg

SEQ ID NO: 11217 - DNA, 23 bp, Artificial
  MQbrain_217; macaque brain D708ZXV02J49XO sequence
aatggttggagtctgttccatgg

SEQ ID NO: 11218 - DNA, 20 bp, Artificial
  MQbrain_218; macaque brain D4HK4YF02IJB7H sequence
agaagaaagggaagaaaggc

SEQ ID NO: 11219 - DNA, 23 bp, Artificial
  MQbrain_219; macaque brain D4HK8WR02IB65Z sequence
tggaatgtggaggaggcccgtgg

SEQ ID NO: 11220 - DNA, 20 bp, Artificial
  MQbrain_21; macaque brain D4HK8WR01BWQJE sequence
ttgcttggggtacagagtgg

SEQ ID NO: 11221 - DNA, 22 bp, Artificial
  MQbrain_220; macaque brain D4G3X1F01C4EUL sequence
aaattatggttgtggactgtgg

SEQ ID NO: 11222 - DNA, 22 bp, Artificial
  MQbrain_221; macaque brain D708I2V01D2SF5 sequence
ggggcagctggatggccaaact

SEQ ID NO: 11223 - DNA, 22 bp, Artificial
  MQbrain_223; macaque brain D708YRU02H4XXU sequence
cttgaggaaggggttggtgttc

SEQ ID NO: 11224 - DNA, 22 bp, Artificial
  MQbrain_224; macaque brain D708ZXV01D642K sequence
gaaggctgtgcccagaccaagc

SEQ ID NO: 11225 - DNA, 18 bp, Artificial
  MQbrain_225; macaque brain D4HK8WR02JSIEZ sequence
tatgggtgggattcttgg

SEQ ID NO: 11226 - DNA, 20 bp, Artificial
  MQbrain_226, MQbrain_838; macaque brain D4G3X1F02JFAJP sequence
aggtctgtgtgccattgccc

SEQ ID NO: 11227 - DNA, 19 bp, Artificial
  MQbrain_2270; macaque brain D4G3X1F01BE8ZK sequence
gtctggctgttgtggtgtg

SEQ ID NO: 11228 - DNA, 18 bp, Artificial
  MQbrain_2270; macaque brain D4HK4YF01DABUS, macaque brain D4HK8WR02F83O8 sequence
tctggctgttgtggtgtg

SEQ ID NO: 11229 - DNA, 19 bp, Artificial
  MQbrain_228; macaque brain D4HK8WR01ASG2D sequence
gcgaacgggttgcgtgctc

SEQ ID NO: 11230 - DNA, 21 bp, Artificial
  MQbrain_229; macaque brain D708I2V02ITUI6 sequence
aggcttggggtgggggtgagc

SEQ ID NO: 11231 - DNA, 21 bp, Artificial
  MQbrain_22; macaque brain D708I2V01AK1TK sequence
gaggaagagagaacctggtgg

SEQ ID NO: 11232 - DNA, 22 bp, Artificial
  MQbrain_230; macaque brain D708YRU01CM2DY, macaque brain D708ZXV01BM7OQ sequence
ctttccccagagtagaaggctc

SEQ ID NO: 11233 - DNA, 20 bp, Artificial
  MQbrain_230; macaque brain D708YRU01EUOU6 sequence
ctttccccagagtagaaggc

SEQ ID NO: 11234 - DNA, 21 bp, Artificial
  MQbrain_230; macaque brain D708ZXV01BIY6L sequence
ctttccccagagtagaaggct

SEQ ID NO: 11235 - DNA, 18 bp, Artificial
  MQbrain_231; macaque brain D4HK8WR02JUH1X sequence
gactcactgagggacacc

SEQ ID NO: 11236 - DNA, 20 bp, Artificial
  MQbrain_232; macaque brain D708I2V02IWFK4 sequence
gaagggtcgctggagctagg

SEQ ID NO: 11237 - DNA, 21 bp, Artificial
  MQbrain_233; macaque brain D4G3X1F02HPF0X sequence
tgagcatgtgggaagggctgg

SEQ ID NO: 11238 - DNA, 22 bp, Artificial
  MQbrain_234; macaque brain D708ZXV01ALCQV sequence
tcgggaagccatggagcagatc

SEQ ID NO: 11239 - DNA, 20 bp, Artificial
  MQbrain_235; macaque brain D708I2V01EZ0VJ sequence
tctgtggtgtcaggcattgg

SEQ ID NO: 11240 - DNA, 22 bp, Artificial
  MQbrain_236, MQbrain_237; macaque brain D708I2V02IVZ1J sequence
cccttgttggggacatcctgtg

SEQ ID NO: 11241 - DNA, 21 bp, Artificial
  MQbrain_2370, MQbrain_2689; macaque brain D708ZXV01DVXHQ sequence
gagtgcaggaggcatgccagg

SEQ ID NO: 11242 - DNA, 18 bp, Artificial
  MQbrain_2380; macaque brain D708YRU02H2MI0 sequence
aagagaccttgcctgtgg

SEQ ID NO: 11243 - DNA, 24 bp, Artificial
  MQbrain_238; macaque brain D4HK8WR02GCEB4 sequence
ggcggctgaggagggcccggcctg

SEQ ID NO: 11244 - DNA, 24 bp, Artificial
  MQbrain_2396; macaque brain D708ZXV02IP1FO sequence
atggcggcaggggtggctccggtg

SEQ ID NO: 11245 - DNA, 25 bp, Artificial
  MQbrain_239; macaque brain D708I2V01AQYF0 sequence
tttgtgggcaggagaggacctcagc

SEQ ID NO: 11246 - DNA, 21 bp, Artificial
  MQbrain_23; macaque brain D708YRU02HHYQZ sequence
ggtgtggtgtggtgtggatgt

SEQ ID NO: 11247 - DNA, 19 bp, Artificial
  MQbrain_24, MQbrain_25; macaque brain D708ZXV01A5FES sequence
aatggaacctttgtgaagc

SEQ ID NO: 11248 - DNA, 22 bp, Artificial
  MQbrain_2404; macaque brain D4HK8WR01CVI32 sequence
gatggagggagcccctgagagg

SEQ ID NO: 11249 - DNA, 18 bp, Artificial
  MQbrain_240; macaque brain D708ZXV01CV3QO sequence
atggagcagggcacatct

SEQ ID NO: 11250 - DNA, 22 bp, Artificial
  MQbrain_2412; macaque brain D708ZXV02FJIEV sequence
gtgtaggaggccaagacttggc

SEQ ID NO: 11251 - DNA, 19 bp, Artificial
  MQbrain_241; macaque brain D4G3X1F02GYZM0 sequence
aggcctgggtctgtccttg

SEQ ID NO: 11252 - DNA, 21 bp, Artificial
  MQbrain_2434; macaque brain D708I2V02GRVZ6 sequence
tcctgtaactgggccagtttc

SEQ ID NO: 11253 - DNA, 22 bp, Artificial
  MQbrain_2434; macaque brain D708ZXV01AMNGX sequence
tcctgtaactgggccagtttct

SEQ ID NO: 11254 - DNA, 23 bp, Artificial
  MQbrain_2438; macaque brain D708I2V01A84KC sequence
tatcgaggcgattctgatctggg

SEQ ID NO: 11255 - DNA, 22 bp, Artificial
  MQbrain_243; macaque brain D708ZXV02H6HU6 sequence
tctgacagtggctttgcctggc

SEQ ID NO: 11256 - DNA, 18 bp, Artificial
  MQbrain_2441, MQbrain_2610, MQbrain_966,MQbrain_2660; macaque brain D4HK8WR01BW1WD sequence
aagtgtgacgtggacatc

SEQ ID NO: 11257 - DNA, 21 bp, Artificial
  MQbrain_2441, MQbrain_2610, MQbrain_966,MQbrain_2660; macaque brain D708ZXV02IQQ8A sequence
tgaagtgtgacgtggacatcc

SEQ ID NO: 11258 - DNA, 22 bp, Artificial
  MQbrain_2445,MQbrain_2568; macaque brain D4G3X1F01C7D5F, macaque brain D4HK8WR02I20YZ sequence
ccgtcctaaggttgttgagttg

SEQ ID NO: 11259 - DNA, 21 bp, Artificial
  MQbrain_2445,MQbrain_2568; macaque brain D4G3X1F01EK1FG, macaque brain D4G3X1F02HMCWZ, macaque brain D4HK4YF01EA0NB, macaque brain D4HK8WR01CKYED, macaque brain D4HK8WR02GJR6B, macaque brain D4HK8WR02IRZDG, macaque brain D708I2V02HU6TC, macaque brain
ccgtcctaaggttgttgagtt

SEQ ID NO: 11260 - DNA, 20 bp, Artificial
  MQbrain_2445,MQbrain_2568; macaque brain D708I2V01D88C6, macaque brain D708I2V01EIOGZ, macaque brain D708YRU01BJS0B, macaque brain D708YRU01C0JW6, macaque brain D708YRU01CLZD1, macaque brain D708YRU01D8ZWV, macaque brain D708YRU02HX27R, macaque brain
ccgtcctaaggttgttgagt

SEQ ID NO: 11261 - DNA, 20 bp, Artificial
  MQbrain_2445,MQbrain_2568; macaque brain D708YRU01BVJ12 sequence
cgtcctaaggttgttgagtt

SEQ ID NO: 11262 - DNA, 19 bp, Artificial
  MQbrain_2447; macaque brain D708I2V01DPBAX sequence
gatgaggacaaggacttgg

SEQ ID NO: 11263 - DNA, 18 bp, Artificial
  MQbrain_2447; macaque brain D708YRU01D1WEJ sequence
tgggggaggacgatgagg

SEQ ID NO: 11264 - DNA, 18 bp, Artificial
  MQbrain_2449; macaque brain D708ZXV02HRM2D sequence
ctgattggctggtggtgg

SEQ ID NO: 11265 - DNA, 19 bp, Artificial
  MQbrain_244; macaque brain D708YRU02JYX9T sequence
ccttctgttcccaggtctc

SEQ ID NO: 11266 - DNA, 19 bp, Artificial
  MQbrain_245; macaque brain D708I2V02IHY13 sequence
ggacctgggaaggaaaggc

SEQ ID NO: 11267 - DNA, 18 bp, Artificial
  MQbrain_246; macaque brain D708YRU01APGNL sequence
ttggaggggaaggggctg

SEQ ID NO: 11268 - DNA, 20 bp, Artificial
  MQbrain_2475, MQbrain_2626,MQbrain_2667,MQbrain_2673, MQbrain_2669; macaque brain D708ZXV01CGJO4 sequence
gatgtggatcagcaagcagg

SEQ ID NO: 11269 - DNA, 22 bp, Artificial
  MQbrain_247; macaque brain D708YRU01DSHY5 sequence
ttggagggtgggagctgaggtg

SEQ ID NO: 11270 - DNA, 22 bp, Artificial
  MQbrain_248; macaque brain D708ZXV02JZNYD sequence
aggatgcctggagctggggagg

SEQ ID NO: 11271 - DNA, 22 bp, Artificial
  MQbrain_2492; macaque brain D708I2V02IN7SM sequence
tttggggaggggcatgccatcc

SEQ ID NO: 11272 - DNA, 18 bp, Artificial
  MQbrain_249; macaque brain D708I2V01DDWJO sequence
aggcagaagagagtcctg

SEQ ID NO: 11273 - DNA, 24 bp, Artificial
  MQbrain_250; macaque brain D4HK4YF01BIRVF sequence
aggagacaggaggcccaggctttc

SEQ ID NO: 11274 - DNA, 22 bp, Artificial
  MQbrain_251; macaque brain D708I2V01EVNUS sequence
gagaatgggctgctgcctcggg

SEQ ID NO: 11275 - DNA, 22 bp, Artificial
  MQbrain_2520; macaque brain D4HK8WR02HB0OC, macaque brain D708YRU02FRE5S sequence
atgtcactcggctcggcccact

SEQ ID NO: 11276 - DNA, 19 bp, Artificial
  MQbrain_2520; macaque brain D708YRU02HXI85 sequence
atgtcactcggctcggccc

SEQ ID NO: 11277 - DNA, 23 bp, Artificial
  MQbrain_2520; macaque brain D708ZXV01BIXUO sequence
tatgtcactcggctcggcccact

SEQ ID NO: 11278 - DNA, 19 bp, Artificial
  MQbrain_2521; macaque brain D4G3X1F01AQ6H0, macaque brain D4G3X1F01C6QWN, macaque brain D4G3X1F02JOXVC, macaque brain D4HK4YF01A11B4, macaque brain D708I2V01EIAC6, macaque brain D708YRU02H4OW5, macaque brain D708ZXV01BD0F1 sequence
tggtgggcacagaatccgg

SEQ ID NO: 11279 - DNA, 22 bp, Artificial
  MQbrain_2521; macaque brain D708I2V02G4TAG, macaque brain D708YRU02GB5F2, macaque brain D708ZXV01DGWB6, macaque brain D708ZXV02FPXCX sequence
tggtgggcacagaatccggact

SEQ ID NO: 11280 - DNA, 18 bp, Artificial
  MQbrain_252; macaque brain D708ZXV02JCTGQ sequence
agtggatggacgtgctgg

SEQ ID NO: 11281 - DNA, 21 bp, Artificial
  MQbrain_253; macaque brain D4HK8WR02HSTT3 sequence
tggagagccagatggctatgg

SEQ ID NO: 11282 - DNA, 21 bp, Artificial
  MQbrain_254; macaque brain D4HK8WR02J27PK sequence
gggctctgggaagaaggtttg

SEQ ID NO: 11283 - DNA, 22 bp, Artificial
  MQbrain_255; macaque brain D708ZXV02G5Z33 sequence
ctttttggagaaaggccatgtg

SEQ ID NO: 11284 - DNA, 21 bp, Artificial
  MQbrain_2566; macaque brain D708YRU02HZSJ2 sequence
ctccgtttgcctgttttgctg

SEQ ID NO: 11285 - DNA, 18 bp, Artificial
  MQbrain_2569; macaque brain D4HK8WR01BL78H sequence
agccagggactgagaagg

SEQ ID NO: 11286 - DNA, 23 bp, Artificial
  MQbrain_256; macaque brain D708I2V01E595L sequence
ctagggtgagtgggctcagcacc

SEQ ID NO: 11287 - DNA, 22 bp, Artificial
  MQbrain_2574, PT_282; chimp brain 103792, macaque brain D708YRU01D7UDO sequence
tgagtaccgccatgtctgttgg

SEQ ID NO: 11288 - DNA, 20 bp, Artificial
  MQbrain_2579; macaque brain D708I2V02I22F2 sequence
ttgtggggagaatgaggtgg

SEQ ID NO: 11289 - DNA, 21 bp, Artificial
  MQbrain_257; macaque brain D708YRU01C9H22 sequence
tcgggaggagaggtggacagg

SEQ ID NO: 11290 - DNA, 24 bp, Artificial
  MQbrain_258; macaque brain D708ZXV02HGMFH sequence
gctcgtcctaggtctaagatgatg

SEQ ID NO: 11291 - DNA, 21 bp, Artificial
  MQbrain_2596; macaque brain D4HK4YF01D6FGG sequence
ctgacctcgcggccagggctg

SEQ ID NO: 11292 - DNA, 22 bp, Artificial
  MQbrain_259; macaque brain D708I2V02JZ7J5 sequence
agggtcggcatgtcaagactgg

SEQ ID NO: 11293 - DNA, 18 bp, Artificial
  MQbrain_2602, PT_311; chimp brain 28185, macaque brain D708YRU01EL5RS, macaque brain D708YRU02I1604, macaque brain D708ZXV01E0CEC, macaque brain D708ZXV02GMBE2, macaque brain D708ZXV02H1VX8 sequence
cggctctgggtctgtggg

SEQ ID NO: 11294 - DNA, 18 bp, Artificial
  MQbrain_2602; macaque brain D708YRU01CQ5PK, macaque brain D708YRU01ENQD9 sequence
ggctctgggtctgtgggg

SEQ ID NO: 11295 - DNA, 26 bp, Artificial
  MQbrain_2609; macaque brain D4G3X1F01A5ERS sequence
agccggggaagacttgaaagaaaggg

SEQ ID NO: 11296 - DNA, 21 bp, Artificial
  MQbrain_260; macaque brain D708ZXV02JS416 sequence
gagagctgtgggcagcaggcc

SEQ ID NO: 11297 - DNA, 19 bp, Artificial
  MQbrain_2614; macaque brain D4G3X1F02JK0G2 sequence
ctgagacctctgggttctg

SEQ ID NO: 11298 - DNA, 23 bp, Artificial
  MQbrain_2614; macaque brain D4HK4YF02F8176 sequence
tgagacctctgggttctgagctg

SEQ ID NO: 11299 - DNA, 21 bp, Artificial
  MQbrain_2614; macaque brain D4HK8WR02IR0OD sequence
gggatctccggggtcttggtt

SEQ ID NO: 11300 - DNA, 21 bp, Artificial
  MQbrain_2614; macaque brain D708YRU01CJHDH sequence
gagacctctgggttctgagct

SEQ ID NO: 11301 - DNA, 23 bp, Artificial
  MQbrain_2614; macaque brain D708ZXV02I4XZW sequence
ctgagacctctgggttctgagct

SEQ ID NO: 11302 - DNA, 23 bp, Artificial
  MQbrain_2616; macaque brain D708ZXV01ASMXV sequence
tctcacccggcccctcatgcccc

SEQ ID NO: 11303 - DNA, 21 bp, Artificial
  MQbrain_2617; macaque brain D708I2V01D89X6 sequence
agatgacctggtcaccgtgtg

SEQ ID NO: 11304 - DNA, 22 bp, Artificial
  MQbrain_2618, PT_338; chimp brain 159176, macaque brain D708I2V02H0G42 sequence
catttccctgccattcccttgg

SEQ ID NO: 11305 - DNA, 21 bp, Artificial
  MQbrain_2618, PT_338; chimp brain 67942, macaque brain D4G3X1F02IP3VG, macaque brain D708YRU01BE73H, macaque brain D708ZXV01ADL3W sequence
ccagggctggcagtgagatgg

SEQ ID NO: 11306 - DNA, 22 bp, Artificial
  MQbrain_2618, PT_338; chimp brain 70612, macaque brain D708I2V01A86VZ, macaque brain D708I2V01B3LLT, macaque brain D708I2V01E1JNO, macaque brain D708I2V01EIJXN, macaque brain D708I2V02HUXDW, macaque brain D708YRU01DI4NP, macaque brain D708YRU01DOIH9, macaque brain
cagggctggcagtgagatgggt

SEQ ID NO: 11307 - DNA, 21 bp, Artificial
  MQbrain_2618; macaque brain D4G3X1F01A8G7M, macaque brain D4HK4YF02FL8PM, macaque brain D4HK8WR01B5ZD0, macaque brain D4HK8WR01ELCWO, macaque brain D708I2V01CIEL3, macaque brain D708I2V01CLJ4O, macaque brain D708YRU02FSKIA, macaque brain
cagggctggcagtgagatggg

SEQ ID NO: 11308 - DNA, 19 bp, Artificial
  MQbrain_2618; macaque brain D4G3X1F01AQNX0, macaque brain D708YRU02GO8P9, macaque brain D708YRU02JU1ND, macaque brain D708ZXV01B6CDB, macaque brain D708ZXV02FUG7C sequence
cagggctggcagtgagatg

SEQ ID NO: 11309 - DNA, 20 bp, Artificial
  MQbrain_2618; macaque brain D4HK4YF01EQK3T, macaque brain D4HK8WR01C05DR, macaque brain D708I2V01BS4GW, macaque brain D708I2V02H8RKC, macaque brain D708I2V02JBQ2I, macaque brain D708YRU01E7V3K, macaque brain D708YRU02GAATU, macaque brain
cagggctggcagtgagatgg

SEQ ID NO: 11310 - DNA, 20 bp, Artificial
  MQbrain_2618; macaque brain D4HK4YF02GMI1T sequence
agggctggcagtgagatggg

SEQ ID NO: 11311 - DNA, 21 bp, Artificial
  MQbrain_2618; macaque brain D708I2V02GGD98, macaque brain D708YRU01DUZEY, macaque brain D708ZXV01E3U8C sequence
agggctggcagtgagatgggt

SEQ ID NO: 11312 - DNA, 18 bp, Artificial
  MQbrain_2618; macaque brain D708YRU01CP5DC sequence
ctcccagggctggcagtg

SEQ ID NO: 11313 - DNA, 20 bp, Artificial
  MQbrain_2618; macaque brain D708YRU01D1772 sequence
ccagggctggcagtgagatg

SEQ ID NO: 11314 - DNA, 21 bp, Artificial
  MQbrain_2618; macaque brain D708YRU01D17CT sequence
catttccctgccattcccttg

SEQ ID NO: 11315 - DNA, 22 bp, Artificial
  MQbrain_2618; macaque brain D708YRU01EFZXZ, macaque brain D708ZXV02GQ1SB, macaque brain D708ZXV02I0230 sequence
ccagggctggcagtgagatggg

SEQ ID NO: 11316 - DNA, 22 bp, Artificial
  MQbrain_2618; macaque brain D708YRU02HMHFC sequence
ccatttccctgccattcccttg

SEQ ID NO: 11317 - DNA, 22 bp, Artificial
  MQbrain_2619; macaque brain D4HK4YF02JN50K sequence
tggccaccacacccaccccttg

SEQ ID NO: 11318 - DNA, 20 bp, Artificial
  MQbrain_261; macaque brain D708I2V02J1KAT sequence
gaaggtcccaccatccccgc

SEQ ID NO: 11319 - DNA, 24 bp, Artificial
  MQbrain_2626,MQbrain_2667,MQbrain_2673, MQbrain_2669; macaque brain D708I2V01DYVN8 sequence
ggagtatgacgagtctggcccttc

SEQ ID NO: 11320 - DNA, 23 bp, Artificial
  MQbrain_2626,MQbrain_2667,MQbrain_2673, MQbrain_2669; macaque brain D708YRU01B4XFR sequence
gcaagcaggagtatgacgagtct

SEQ ID NO: 11321 - DNA, 29 bp, Artificial
  MQbrain_2626,MQbrain_2667,MQbrain_2673, MQbrain_2669; macaque brain D708YRU02IIWGV sequence
gatgtggatcagcaagcaggagtatgacg

SEQ ID NO: 11322 - DNA, 23 bp, Artificial
  MQbrain_2629; macaque brain D708ZXV01COF16 sequence
gatggtgctgtgttgtggaaagg

SEQ ID NO: 11323 - DNA, 18 bp, Artificial
  MQbrain_262; macaque brain D708I2V02I8I0S sequence
ctaggagccatcccgggg

SEQ ID NO: 11324 - DNA, 24 bp, Artificial
  MQbrain_2630; macaque brain D4HK8WR01B4U13 sequence
ctgggcttgcaccctccttgagcc

SEQ ID NO: 11325 - DNA, 25 bp, Artificial
  MQbrain_2632; macaque brain D4HK8WR01B35Y3 sequence
ctgctgaacagacgaggcgtgggcc

SEQ ID NO: 11326 - DNA, 20 bp, Artificial
  MQbrain_2633; macaque brain D4G3X1F02IYQ6Y sequence
cgggagccggggtctgcagg

SEQ ID NO: 11327 - DNA, 22 bp, Artificial
  MQbrain_2633; macaque brain D4G3X1F02JNVLP sequence
cgggagccggggtctgcaggtt

SEQ ID NO: 11328 - DNA, 20 bp, Artificial
  MQbrain_2633; macaque brain D4HK8WR01A42HM sequence
tgctcgccctgtctcccacc

SEQ ID NO: 11329 - DNA, 21 bp, Artificial
  MQbrain_263; macaque brain D708ZXV02F9YCO sequence
ttctggtctgaggttctctgc

SEQ ID NO: 11330 - DNA, 22 bp, Artificial
  MQbrain_2641; macaque brain D4G3X1F01D2C3N, macaque brain D4HK8WR01D9KZ2, macaque brain D4HK8WR02HHIY5, macaque brain D4HK8WR02HXBBI, macaque brain D4HK8WR02IAABB, macaque brain D708I2V02HE5PA, macaque brain D708YRU01BDRVM, macaque brain
tttgtgacctggtccactaccc

SEQ ID NO: 11331 - DNA, 21 bp, Artificial
  MQbrain_2641; macaque brain D4G3X1F02GGN00, macaque brain D4HK4YF01ANSQW, macaque brain D4HK4YF01B7ITQ, macaque brain D4HK4YF01BA5SF, macaque brain D4HK4YF02H7RLX, macaque brain D4HK8WR02GYOPG, macaque brain D4HK8WR02JP466, macaque brain
tttgtgacctggtccactacc

SEQ ID NO: 11332 - DNA, 23 bp, Artificial
  MQbrain_2641; macaque brain D4HK4YF02FTITS, macaque brain D708I2V02GY6RL, macaque brain D708YRU02FRWSK, macaque brain D708YRU02HOHA9 sequence
tttgtgacctggtccactacccc

SEQ ID NO: 11333 - DNA, 21 bp, Artificial
  MQbrain_2641; macaque brain D4HK4YF02JEHYS sequence
ttgtgacctggtccactaccc

SEQ ID NO: 11334 - DNA, 20 bp, Artificial
  MQbrain_2641; macaque brain D4HK8WR02HYRO1, macaque brain D708ZXV02GKBMZ sequence
ttgtgacctggtccactacc

SEQ ID NO: 11335 - DNA, 20 bp, Artificial
  MQbrain_2642; macaque brain D4G3X1F01B9FT0, macaque brain D4HK4YF01ACXLX sequence
aatggctgtccgtagtatgg

SEQ ID NO: 11336 - DNA, 21 bp, Artificial
  MQbrain_2642; macaque brain D708I2V01D9GBJ sequence
aatggctgtccgtagtatggt

SEQ ID NO: 11337 - DNA, 22 bp, Artificial
  MQbrain_2642; macaque brain D708YRU02IS694 sequence
gaatggctgtccgtagtatggt

SEQ ID NO: 11338 - DNA, 22 bp, Artificial
  MQbrain_2642; macaque brain D708ZXV02FRMJS sequence
aatggctgtccgtagtatggtc

SEQ ID NO: 11339 - DNA, 23 bp, Artificial
  MQbrain_2643; macaque brain D708ZXV02IMXY1 sequence
tgtctttgagtgacctagtctgg

SEQ ID NO: 11340 - DNA, 20 bp, Artificial
  MQbrain_2644; macaque brain D4HK8WR02JU2Y1, macaque brain D708I2V01BGRWF, macaque brain D708YRU02G3ME5, macaque brain D708YRU02J1SHV sequence
acgggtggcgcaatgggatc

SEQ ID NO: 11341 - DNA, 21 bp, Artificial
  MQbrain_2644; macaque brain D708I2V01B6PD1 sequence
gatcccacagcctcacccatc

SEQ ID NO: 11342 - DNA, 22 bp, Artificial
  MQbrain_2644; macaque brain D708I2V01BSHBA, macaque brain D708YRU02F5WI5 sequence
tgatcccacagcctcacccatc

SEQ ID NO: 11343 - DNA, 19 bp, Artificial
  MQbrain_2644; macaque brain D708YRU01CSEGN, macaque brain D708ZXV01BNN0K sequence
cgggtggcgcaatgggatc

SEQ ID NO: 11344 - DNA, 19 bp, Artificial
  MQbrain_2644; macaque brain D708ZXV01AQLJ2 sequence
gggtggcgcaatgggatca

SEQ ID NO: 11345 - DNA, 21 bp, Artificial
  MQbrain_2644; macaque brain D708ZXV02ID3AO sequence
tctgatcccacagcctcaccc

SEQ ID NO: 11346 - DNA, 23 bp, Artificial
  MQbrain_2645; macaque brain D4HK8WR01BVEYY sequence
ctggggagctgaggctctggggg

SEQ ID NO: 11347 - DNA, 26 bp, Artificial
  MQbrain_2646; macaque brain D4HK8WR01CSGVL sequence
aggtgccattctgagggccaggagtt

SEQ ID NO: 11348 - DNA, 25 bp, Artificial
  MQbrain_2646; macaque brain D708I2V02GMPS4 sequence
aggtgccattctgagggccaggagt

SEQ ID NO: 11349 - DNA, 20 bp, Artificial
  MQbrain_2646; macaque brain D708ZXV01CCGM0 sequence
tctggctgctatggccccct

SEQ ID NO: 11350 - DNA, 24 bp, Artificial
  MQbrain_264; macaque brain D708I2V01BYMYY sequence
acaggatggggaggactggagagc

SEQ ID NO: 11351 - DNA, 22 bp, Artificial
  MQbrain_2650; macaque brain D708I2V01B0XTY, macaque brain D708I2V02GMJ76, macaque brain D708YRU01DVU2G, macaque brain D708ZXV01CD0O9 sequence
catctgggcaactgactgaact

SEQ ID NO: 11352 - DNA, 24 bp, Artificial
  MQbrain_2650; macaque brain D708ZXV01B3L9H sequence
ttcattcggctgtccagatgtatc

SEQ ID NO: 11353 - DNA, 21 bp, Artificial
  MQbrain_2651; macaque brain D708YRU02G8KNF sequence
tgctcataccccatggtttct

SEQ ID NO: 11354 - DNA, 22 bp, Artificial
  MQbrain_2651; macaque brain D708ZXV01BAVSK sequence
gctcataccccatggtttctga

SEQ ID NO: 11355 - DNA, 18 bp, Artificial
  MQbrain_2652; macaque brain D708YRU01DG4DP sequence
ctgggccttggggactgg

SEQ ID NO: 11356 - DNA, 18 bp, Artificial
  MQbrain_2653; macaque brain D708I2V02HN2DH, macaque brain D708YRU01DY0Z1 sequence
cagccactgcctgtctcc

SEQ ID NO: 11357 - DNA, 21 bp, Artificial
  MQbrain_2653; macaque brain D708ZXV01DOB0H sequence
caggagaaggaggtggcctgg

SEQ ID NO: 11358 - DNA, 20 bp, Artificial
  MQbrain_2656; macaque brain D4HK8WR01D8ORX sequence
ggatttctttgtgaatcacc

SEQ ID NO: 11359 - DNA, 19 bp, Artificial
  MQbrain_2656; macaque brain D708YRU02GP826 sequence
gtggtttacaaagtaattc

SEQ ID NO: 11360 - DNA, 19 bp, Artificial
  MQbrain_2657; macaque brain D4HK8WR01BEWKC sequence
gacgttggctctggtggtg

SEQ ID NO: 11361 - DNA, 22 bp, Artificial
  MQbrain_2658; macaque brain D708YRU02IW1YR sequence
tcagacagctcctctgattagt

SEQ ID NO: 11362 - DNA, 21 bp, Artificial
  MQbrain_265; macaque brain D708I2V02IX11P sequence
ctcctcagctcaccacccttc

SEQ ID NO: 11363 - DNA, 22 bp, Artificial
  MQbrain_2661; macaque brain D4HK4YF02FSHO8 sequence
tagccttcagatcttggtgttt

SEQ ID NO: 11364 - DNA, 22 bp, Artificial
  MQbrain_2662,MQbrain_2674,MQbrain_2676; macaque brain D708I2V02GA8HU sequence
agagaaagaaggttaagctggc

SEQ ID NO: 11365 - DNA, 23 bp, Artificial
  MQbrain_2662,MQbrain_2674,MQbrain_2676; macaque brain D708YRU02FSWIA sequence
ttcgtggtggtgctaagaaaagg

SEQ ID NO: 11366 - DNA, 25 bp, Artificial
  MQbrain_2662,MQbrain_2674,MQbrain_2676; macaque brain D708ZXV02HM132 sequence
tgtgttgagacttcgtggtggtgct

SEQ ID NO: 11367 - DNA, 24 bp, Artificial
  MQbrain_2663, MQbrain_2664; macaque brain D708I2V02FZQUZ sequence
cgctgccctcccccaggctccttc

SEQ ID NO: 11368 - DNA, 19 bp, Artificial
  MQbrain_2665; macaque brain D4G3X1F01DBADS sequence
tggtaagcagactggtggg

SEQ ID NO: 11369 - DNA, 18 bp, Artificial
  MQbrain_2665; macaque brain D708I2V02F03BV sequence
ctgggcagactggtaagc

SEQ ID NO: 11370 - DNA, 20 bp, Artificial
  MQbrain_2666; macaque brain D4HK8WR02G6CO3 sequence
accctgcagtgactgtggcc

SEQ ID NO: 11371 - DNA, 19 bp, Artificial
  MQbrain_2666; macaque brain D708I2V02H2XTU sequence
gactgtggccatggtgtgc

SEQ ID NO: 11372 - DNA, 23 bp, Artificial
  MQbrain_2666; macaque brain D708I2V02IW5WK sequence
tgactgtggccatggtgtgcacc

SEQ ID NO: 11373 - DNA, 21 bp, Artificial
  MQbrain_2666; macaque brain D708YRU01ER3GM sequence
actgtggccatggtgtgcacc

SEQ ID NO: 11374 - DNA, 24 bp, Artificial
  MQbrain_2666; macaque brain D708ZXV02JJTOU sequence
atggtgcaatgctttggccacatc

SEQ ID NO: 11375 - DNA, 20 bp, Artificial
  MQbrain_2668; macaque brain D708ZXV02GBX5L sequence
ttaatgtccaatgtcctttg

SEQ ID NO: 11376 - DNA, 18 bp, Artificial
  MQbrain_2668; macaque brain D708ZXV02IDLOZ sequence
aagactgggatggacctc

SEQ ID NO: 11377 - DNA, 19 bp, Artificial
  MQbrain_266; macaque brain D708I2V02GC07H sequence
cggggggctggttagattg

SEQ ID NO: 11378 - DNA, 19 bp, Artificial
  MQbrain_2670; macaque brain D4HK4YF02JPJLP sequence
tctgtcgaaatgcaccatg

SEQ ID NO: 11379 - DNA, 20 bp, Artificial
  MQbrain_2671; macaque brain D708I2V01AUF40, macaque brain D708YRU01DW6JL sequence
gcgctttgctcagccagtgt

SEQ ID NO: 11380 - DNA, 26 bp, Artificial
  MQbrain_2671; macaque brain D708I2V02JT6OR sequence
actctagctgccaaaggcgcttctcc

SEQ ID NO: 11381 - DNA, 19 bp, Artificial
  MQbrain_2671; macaque brain D708YRU01DW8KC, macaque brain D708YRU02G7U44 sequence
ccatgggtcagctatgtgg

SEQ ID NO: 11382 - DNA, 26 bp, Artificial
  MQbrain_2672; macaque brain D4G3X1F01EC3PU, macaque brain D708YRU01AF7MP sequence
aggaagccctggaggggctggaggtg

SEQ ID NO: 11383 - DNA, 20 bp, Artificial
  MQbrain_2672; macaque brain D4G3X1F02HXKZ2 sequence
actggcaggccaggaagagg

SEQ ID NO: 11384 - DNA, 24 bp, Artificial
  MQbrain_2675; macaque brain D4HK8WR01D3WEG sequence
tccatgtgaagttgtctcgggctc

SEQ ID NO: 11385 - DNA, 20 bp, Artificial
  MQbrain_2679; macaque brain D708I2V01DGXOI, macaque brain D708YRU01BJL8Q sequence
aaagctgggttgagagggca

SEQ ID NO: 11386 - DNA, 21 bp, Artificial
  MQbrain_2679; macaque brain D708I2V02GLW91, macaque brain D708I2V02JLRMQ, macaque brain D708YRU01BS2X8, macaque brain D708ZXV02H4ZJH sequence
gaaaagctgggttgagagggc

SEQ ID NO: 11387 - DNA, 21 bp, Artificial
  MQbrain_2679; macaque brain D708YRU02IBOSO sequence
agctgggttgagagggcaaaa

SEQ ID NO: 11388 - DNA, 21 bp, Artificial
  MQbrain_267; macaque brain D708I2V01BJJ2P sequence
cccggaggagaggctgggcgg

SEQ ID NO: 11389 - DNA, 18 bp, Artificial
  MQbrain_268; macaque brain D4HK4YF01ECJ3Y sequence
cgcttgctgcccaacacc

SEQ ID NO: 11390 - DNA, 21 bp, Artificial
  MQbrain_2699; macaque brain D4G3X1F02I6ZPL, macaque brain D4HK4YF01AUY9K, macaque brain D4HK4YF01DAH1O, macaque brain D708I2V01EOCDD, macaque brain D708I2V02HWZDZ, macaque brain
tgcaacgaacttgagccattg

SEQ ID NO: 11391 - DNA, 22 bp, Artificial
  MQbrain_2699; macaque brain D708YRU01EG8AU, macaque brain D708YRU02JXLDB sequence
ttgcaacgaacttgagccattg

SEQ ID NO: 11392 - DNA, 20 bp, Artificial
  MQbrain_2699; macaque brain D708YRU02HKWUD sequence
gcaacgaacttgagccattg

SEQ ID NO: 11393 - DNA, 18 bp, Artificial
  MQbrain_2699; macaque brain D708ZXV02HAQB7 sequence
acgaacttgagccattga

SEQ ID NO: 11394 - DNA, 22 bp, Artificial
  MQbrain_269; macaque brain D4HK4YF02JXKBZ sequence
aaagagcagagagcagggcccg

SEQ ID NO: 11395 - DNA, 25 bp, Artificial
  MQbrain_26; macaque brain D708I2V01EJ4OH sequence
ggctgatgacaggcccggaagcatg

SEQ ID NO: 11396 - DNA, 28 bp, Artificial
  MQbrain_2700; macaque brain D708ZXV01APWI6 sequence
gttggaggatgaaagtacggagtgatcc

SEQ ID NO: 11397 - DNA, 22 bp, Artificial
  MQbrain_270; macaque brain D4G3X1F02FX8X5 sequence
ggctggggcacgggggatcctg

SEQ ID NO: 11398 - DNA, 25 bp, Artificial
  MQbrain_271; macaque brain D4G3X1F02HVZAN sequence
ggatggtgaagggggacctagtacc

SEQ ID NO: 11399 - DNA, 20 bp, Artificial
  MQbrain_271; macaque brain D708I2V02GDB48 sequence
aggatggtgaagggggacct

SEQ ID NO: 11400 - DNA, 23 bp, Artificial
  MQbrain_271; macaque brain D708I2V02JUOE2 sequence
aggatggtgaagggggacctagt

SEQ ID NO: 11401 - DNA, 20 bp, Artificial
  MQbrain_272; macaque brain D4HK8WR01D0Y08 sequence
ctcggcagccaggaggcccc

SEQ ID NO: 11402 - DNA, 21 bp, Artificial
  MQbrain_273; macaque brain D4HK8WR01DRR5U sequence
tgcctttcagacagtgtcccg

SEQ ID NO: 11403 - DNA, 25 bp, Artificial
  MQbrain_274; macaque brain D4HK8WR01BQ1LA sequence
ttgagcgccaggcagctgccactcc

SEQ ID NO: 11404 - DNA, 19 bp, Artificial
  MQbrain_275; macaque brain D708ZXV02IZADD sequence
aggagacgggcagcagagc

SEQ ID NO: 11405 - DNA, 21 bp, Artificial
  MQbrain_276; macaque brain D708I2V02G3L6E sequence
aacgctggtgtgacgttgctg

SEQ ID NO: 11406 - DNA, 19 bp, Artificial
  MQbrain_277; macaque brain D708I2V02GXZBD sequence
gagaacggagctggctggg

SEQ ID NO: 11407 - DNA, 20 bp, Artificial
  MQbrain_278; macaque brain D708I2V02I9UL2 sequence
ggtctgattggcactcttct

SEQ ID NO: 11408 - DNA, 22 bp, Artificial
  MQbrain_279; macaque brain D708YRU01A5JRS sequence
tcccggcccggagtcgccaagg

SEQ ID NO: 11409 - DNA, 24 bp, Artificial
  MQbrain_27; macaque brain D708YRU02GTQ8P sequence
actggaggggaagcgagcggtgtt

SEQ ID NO: 11410 - DNA, 26 bp, Artificial
  MQbrain_280; macaque brain D708ZXV02FG9XW sequence
tgggctgctgaggggctagtgcagtg

SEQ ID NO: 11411 - DNA, 18 bp, Artificial
  MQbrain_281; macaque brain D4G3X1F01CA3UF sequence
ctgcctccctgacattcc

SEQ ID NO: 11412 - DNA, 20 bp, Artificial
  MQbrain_282; macaque brain D708ZXV01AQQ3U sequence
aagtgaaggcgaagccagtg

SEQ ID NO: 11413 - DNA, 21 bp, Artificial
  MQbrain_283; macaque brain D708ZXV01CWTCI sequence
tgtgcagttggtggtctttct

SEQ ID NO: 11414 - DNA, 20 bp, Artificial
  MQbrain_283; macaque brain D708ZXV02FO0MZ sequence
tgtgcagttggtggtctttc

SEQ ID NO: 11415 - DNA, 21 bp, Artificial
  MQbrain_284; macaque brain D708YRU02IW316 sequence
gaccagggatgcagccgcggg

SEQ ID NO: 11416 - DNA, 18 bp, Artificial
  MQbrain_285; macaque brain D4HK8WR02GU3YE sequence
agatgcccaacgtcttcc

SEQ ID NO: 11417 - DNA, 18 bp, Artificial
  MQbrain_286; macaque brain D4HK8WR02JGN7D sequence
cccccagtcccatgatcg

SEQ ID NO: 11418 - DNA, 25 bp, Artificial
  MQbrain_287; macaque brain D4HK8WR01DBJIR sequence
ctctccctgagccatgccaggcatg

SEQ ID NO: 11419 - DNA, 23 bp, Artificial
  MQbrain_288; macaque brain D708I2V01BUEVK sequence
aagtgggaactgggcactgcagt

SEQ ID NO: 11420 - DNA, 21 bp, Artificial
  MQbrain_289; macaque brain D708I2V01EQ4CX sequence
ccctgagtcgctgttgctggt

SEQ ID NO: 11421 - DNA, 23 bp, Artificial
  MQbrain_28; macaque brain D4HK8WR01BLSG8 sequence
agcctcaggagtgtatgggattg

SEQ ID NO: 11422 - DNA, 23 bp, Artificial
  MQbrain_290; macaque brain D708I2V02IL3IM sequence
cagagtacatgagaggccaaagc

SEQ ID NO: 11423 - DNA, 18 bp, Artificial
  MQbrain_291; macaque brain D708ZXV01CTWJZ sequence
gaaatggccttggcatgg

SEQ ID NO: 11424 - DNA, 24 bp, Artificial
  MQbrain_292; macaque brain D708YRU01CL8P6 sequence
ctgttgcgggcagcccaggagttc

SEQ ID NO: 11425 - DNA, 18 bp, Artificial
  MQbrain_293; macaque brain D4HK4YF01C2P3O sequence
gtgtcccaggatggtgtc

SEQ ID NO: 11426 - DNA, 23 bp, Artificial
  MQbrain_294; macaque brain D708YRU01D9Q3S sequence
cggagcctgggttagcggcggtg

SEQ ID NO: 11427 - DNA, 18 bp, Artificial
  MQbrain_295; macaque brain D4HK8WR02IEZ9F sequence
atgagggggccatggccg

SEQ ID NO: 11428 - DNA, 22 bp, Artificial
  MQbrain_296; macaque brain D708ZXV01D1ATI sequence
gccaatggccatgtgtctcagg

SEQ ID NO: 11429 - DNA, 20 bp, Artificial
  MQbrain_297; macaque brain D708YRU02HN8F4 sequence
ctgcagccacgcatctcccg

SEQ ID NO: 11430 - DNA, 19 bp, Artificial
  MQbrain_298; macaque brain D708YRU01CIWWH sequence
gctggccagaatggaaatt

SEQ ID NO: 11431 - DNA, 21 bp, Artificial
  MQbrain_29; macaque brain D4HK4YF01DXN7B sequence
gagccgctcgtctccctgccc

SEQ ID NO: 11432 - DNA, 18 bp, Artificial
  MQbrain_301; macaque brain D4G3X1F01A4M0G sequence
gcgggaggccatggggtg

SEQ ID NO: 11433 - DNA, 20 bp, Artificial
  MQbrain_302; macaque brain D708YRU01CY8WN sequence
ttagggttggagggaggctc

SEQ ID NO: 11434 - DNA, 20 bp, Artificial
  MQbrain_303; macaque brain D4G3X1F01ASP09 sequence
gtggaggggtccggcaggtc

SEQ ID NO: 11435 - DNA, 19 bp, Artificial
  MQbrain_304; macaque brain D708ZXV02JKCKL sequence
ggctggtccttgctgggtg

SEQ ID NO: 11436 - DNA, 21 bp, Artificial
  MQbrain_305; macaque brain D708I2V02HG7PX sequence
aggccaaagctatgtgacttc

SEQ ID NO: 11437 - DNA, 19 bp, Artificial
  MQbrain_306; macaque brain D708I2V02HONKK sequence
ttgctgccgtggctgactt

SEQ ID NO: 11438 - DNA, 20 bp, Artificial
  MQbrain_307; macaque brain D708ZXV02GJQ7R sequence
cttgacccctggccaggctg

SEQ ID NO: 11439 - DNA, 18 bp, Artificial
  MQbrain_308; macaque brain D708YRU02GHBK7 sequence
ggaaatgagaaggatggg

SEQ ID NO: 11440 - DNA, 19 bp, Artificial
  MQbrain_309; macaque brain D708I2V01D8D9D sequence
tgctgtagctgtggttgtg

SEQ ID NO: 11441 - DNA, 18 bp, Artificial
  MQbrain_30; macaque brain D708YRU01EVZ58 sequence
ctgggcagctgggtgggc

SEQ ID NO: 11442 - DNA, 19 bp, Artificial
  MQbrain_310; macaque brain D4HK8WR02HORI9 sequence
gggccccagtgactgcctc

SEQ ID NO: 11443 - DNA, 20 bp, Artificial
  MQbrain_311; macaque brain D4HK8WR01DXAQT sequence
ctcctctcagcctcaacctg

SEQ ID NO: 11444 - DNA, 18 bp, Artificial
  MQbrain_312, MQbrain_712; macaque brain D708YRU01D5IL0 sequence
gggagaggggagcaggtg

SEQ ID NO: 11445 - DNA, 20 bp, Artificial
  MQbrain_313; macaque brain D708I2V01C1RL6 sequence
ctgtctgtgtctcttcctcc

SEQ ID NO: 11446 - DNA, 20 bp, Artificial
  MQbrain_314; macaque brain D708YRU02H5S1O sequence
acttggtgtccttggctgtg

SEQ ID NO: 11447 - DNA, 19 bp, Artificial
  MQbrain_315; macaque brain D708I2V01A4300 sequence
ctgggctggcctggcaagg

SEQ ID NO: 11448 - DNA, 26 bp, Artificial
  MQbrain_316; macaque brain D708ZXV02ITR66 sequence
ggaattctctgagtacatgcattttc

SEQ ID NO: 11449 - DNA, 19 bp, Artificial
  MQbrain_318; macaque brain D708ZXV01EH3O9 sequence
aacgccaagggggttcggg

SEQ ID NO: 11450 - DNA, 20 bp, Artificial
  MQbrain_319; macaque brain D4HK8WR02GU4EM sequence
agaggaggggagatggttgg

SEQ ID NO: 11451 - DNA, 21 bp, Artificial
  MQbrain_31; macaque brain D708YRU02G31NS sequence
attgcagagctgtgcccaggg

SEQ ID NO: 11452 - DNA, 19 bp, Artificial
  MQbrain_320; macaque brain D708YRU02HJPAI sequence
accctctgccaggcctggt

SEQ ID NO: 11453 - DNA, 20 bp, Artificial
  MQbrain_321; macaque brain D708YRU02IMZ3U sequence
cagggatgggatgaggctgg

SEQ ID NO: 11454 - DNA, 20 bp, Artificial
  MQbrain_322; macaque brain D4HK8WR01DLVF2 sequence
gggcagggtgaccccaggtc

SEQ ID NO: 11455 - DNA, 19 bp, Artificial
  MQbrain_323; macaque brain D708YRU01C4OEJ sequence
ttgggggggagtgaaaagg

SEQ ID NO: 11456 - DNA, 22 bp, Artificial
  MQbrain_324; macaque brain D708ZXV01AZCV1 sequence
gatgaaagcagccaaagtgggg

SEQ ID NO: 11457 - DNA, 21 bp, Artificial
  MQbrain_325; macaque brain D708I2V02H31XC sequence
tccctccaagacccatcctgc

SEQ ID NO: 11458 - DNA, 18 bp, Artificial
  MQbrain_326; macaque brain D4HK8WR01BDGZV sequence
gaagttgggagggagagc

SEQ ID NO: 11459 - DNA, 23 bp, Artificial
  MQbrain_327; macaque brain D4HK8WR02GSA9P sequence
aaacgctgctggcgtggggattg

SEQ ID NO: 11460 - DNA, 18 bp, Artificial
  MQbrain_328; macaque brain D708I2V02JUXCK sequence
gaagaattggagggacgg

SEQ ID NO: 11461 - DNA, 19 bp, Artificial
  MQbrain_329; macaque brain D4HK8WR02HO7IX sequence
gacttcttgctccccttcc

SEQ ID NO: 11462 - DNA, 25 bp, Artificial
  MQbrain_32; macaque brain D708ZXV02I2WJX sequence
ggagccagggcaggaagacctcccc

SEQ ID NO: 11463 - DNA, 18 bp, Artificial
  MQbrain_330; macaque brain D708YRU01BAOWS sequence
agggcctgggtggcaggg

SEQ ID NO: 11464 - DNA, 20 bp, Artificial
  MQbrain_331; macaque brain D708I2V01A52O6 sequence
tttggccagctgcccctctg

SEQ ID NO: 11465 - DNA, 19 bp, Artificial
  MQbrain_332; macaque brain D4HK8WR02J5SIH sequence
ggacgctggggacggtggg

SEQ ID NO: 11466 - DNA, 25 bp, Artificial
  MQbrain_333; macaque brain D708YRU01BVYJ8 sequence
ggacttttgagtgggggtaagtttg

SEQ ID NO: 11467 - DNA, 22 bp, Artificial
  MQbrain_334; macaque brain D708I2V02JUWWB sequence
tttctgagcttagctactgttt

SEQ ID NO: 11468 - DNA, 21 bp, Artificial
  MQbrain_335; macaque brain D708YRU02IJXG9 sequence
ctgtccgggttgtgtctgctc

SEQ ID NO: 11469 - DNA, 22 bp, Artificial
  MQbrain_336; macaque brain D708ZXV02I5IIU sequence
ttgggaaggggcttaggaaggg

SEQ ID NO: 11470 - DNA, 18 bp, Artificial
  MQbrain_337; macaque brain D4HK8WR01CKVGO sequence
atccccagccgctgagtg

SEQ ID NO: 11471 - DNA, 22 bp, Artificial
  MQbrain_338; macaque brain D708I2V01CKA45 sequence
gggaggaagatgactgggaatc

SEQ ID NO: 11472 - DNA, 19 bp, Artificial
  MQbrain_339; macaque brain D708I2V02FN3T4 sequence
tttggaagccactggcagg

SEQ ID NO: 11473 - DNA, 19 bp, Artificial
  MQbrain_33; macaque brain D708ZXV01CIVJZ sequence
ggccggaagctgggcgggt

SEQ ID NO: 11474 - DNA, 19 bp, Artificial
  MQbrain_340; macaque brain D708ZXV01DURQN sequence
gctggcgtgcggcggcgtt

SEQ ID NO: 11475 - DNA, 19 bp, Artificial
  MQbrain_342; macaque brain D708ZXV01DKCQY sequence
aggcggtccctgggatggg

SEQ ID NO: 11476 - DNA, 22 bp, Artificial
  MQbrain_343, MQbrain_349, MQbrain_350; macaque brain D4HK8WR02HB4HE sequence
gatgcagagtctgaacctggtc

SEQ ID NO: 11477 - DNA, 21 bp, Artificial
  MQbrain_344; macaque brain D708ZXV02GZMIU sequence
tgagggcctgggtgctggtgg

SEQ ID NO: 11478 - DNA, 21 bp, Artificial
  MQbrain_345; macaque brain D708I2V01DNSYX sequence
ggcgtctgagcagggtgaagg

SEQ ID NO: 11479 - DNA, 21 bp, Artificial
  MQbrain_346; macaque brain D708YRU01DB69D sequence
ccttcctcttccagccaagcc

SEQ ID NO: 11480 - DNA, 26 bp, Artificial
  MQbrain_347; macaque brain D708ZXV01BFAOU sequence
aggggcgcagatcctgaggccgagct

SEQ ID NO: 11481 - DNA, 18 bp, Artificial
  MQbrain_348; macaque brain D708I2V02FRIVE sequence
ctggcctctattactgtg

SEQ ID NO: 11482 - DNA, 22 bp, Artificial
  MQbrain_34; macaque brain D708YRU02IWEVW sequence
tctttcctggaggcactgagtc

SEQ ID NO: 11483 - DNA, 20 bp, Artificial
  MQbrain_351; macaque brain D4HK4YF01CJHPJ sequence
gtggagaggaggctgatgcc

SEQ ID NO: 11484 - DNA, 20 bp, Artificial
  MQbrain_352; macaque brain D4HK8WR02GLIBV sequence
tgagagggagaggggaatgc

SEQ ID NO: 11485 - DNA, 24 bp, Artificial
  MQbrain_353; macaque brain D4G3X1F01BQQIM sequence
tctgagagcagctggggctggtgg

SEQ ID NO: 11486 - DNA, 22 bp, Artificial
  MQbrain_354; macaque brain D4HK4YF01DLBSZ sequence
tgacgccggagctgcctgggcc

SEQ ID NO: 11487 - DNA, 25 bp, Artificial
  MQbrain_355; macaque brain D708YRU02GYMW8 sequence
gctgccagggacagtgtgtgcgagg

SEQ ID NO: 11488 - DNA, 24 bp, Artificial
  MQbrain_356; macaque brain D4HK8WR02F00JQ sequence
acctatggagaagcgagggtgagg

SEQ ID NO: 11489 - DNA, 20 bp, Artificial
  MQbrain_357, MQbrain_667; macaque brain D708I2V01D99RS sequence
aaaggctaaggactagatgc

SEQ ID NO: 11490 - DNA, 21 bp, Artificial
  MQbrain_358; macaque brain D708YRU02JBBJC sequence
catgctcttggctatactgtg

SEQ ID NO: 11491 - DNA, 19 bp, Artificial
  MQbrain_359; macaque brain D708I2V01BIL9Q sequence
actggtgggtggtgatgct

SEQ ID NO: 11492 - DNA, 20 bp, Artificial
  MQbrain_35; macaque brain D4HK8WR01DMUBT sequence
cctggagaggacgtggcccc

SEQ ID NO: 11493 - DNA, 18 bp, Artificial
  MQbrain_360; macaque brain D708I2V01EVHPF sequence
aatgagagccagagaacc

SEQ ID NO: 11494 - DNA, 19 bp, Artificial
  MQbrain_361; macaque brain D4HK8WR01BE5T6 sequence
ggacacagtgacttcaggc

SEQ ID NO: 11495 - DNA, 18 bp, Artificial
  MQbrain_362; macaque brain D708I2V02JAI0L sequence
ggaggagtggcctgtcct

SEQ ID NO: 11496 - DNA, 23 bp, Artificial
  MQbrain_363; macaque brain D708YRU02I4QK2 sequence
tgcagaggaaagtcttgaaatgc

SEQ ID NO: 11497 - DNA, 19 bp, Artificial
  MQbrain_364; macaque brain D708YRU01D64HQ sequence
gaaacctgaaagagcctgc

SEQ ID NO: 11498 - DNA, 21 bp, Artificial
  MQbrain_366; macaque brain D708YRU02IZC2N, macaque brain D708ZXV01C9HIX sequence
ttcttgcgcattctgaggctg

SEQ ID NO: 11499 - DNA, 20 bp, Artificial
  MQbrain_367; macaque brain D4HK8WR02G54BQ sequence
ctgattgagtgggtctgttc

SEQ ID NO: 11500 - DNA, 21 bp, Artificial
  MQbrain_368, MQbrain_677, MQbrain_856; macaque brain D4HK4YF02H8JBU sequence
tcatggtgtgggcgcaggcgg

SEQ ID NO: 11501 - DNA, 21 bp, Artificial
  MQbrain_369; macaque brain D708I2V02GZW0T sequence
atgctgagtggagacagagcc

SEQ ID NO: 11502 - DNA, 21 bp, Artificial
  MQbrain_36; macaque brain D708ZXV01CKFT6 sequence
gacctcctgggggcaaggtgg

SEQ ID NO: 11503 - DNA, 23 bp, Artificial
  MQbrain_370; macaque brain D708ZXV02G32ZO sequence
gaaaggactggagactgacattg

SEQ ID NO: 11504 - DNA, 18 bp, Artificial
  MQbrain_371; macaque brain D4HK8WR01ARWDY sequence
aggtgggagtgaggaccc

SEQ ID NO: 11505 - DNA, 25 bp, Artificial
  MQbrain_372; macaque brain D708I2V02H7ELL sequence
tcactgtggaggagctgacggcttg

SEQ ID NO: 11506 - DNA, 21 bp, Artificial
  MQbrain_373; macaque brain D708ZXV01E2DFH sequence
cggagacactgggccgcctgc

SEQ ID NO: 11507 - DNA, 20 bp, Artificial
  MQbrain_374; macaque brain D4HK8WR01AOVF4 sequence
gaggcctggggttgtgcagc

SEQ ID NO: 11508 - DNA, 20 bp, Artificial
  MQbrain_375; macaque brain D708ZXV01AF5GR sequence
acctcccctgggcttgccca

SEQ ID NO: 11509 - DNA, 26 bp, Artificial
  MQbrain_376; macaque brain D4G3X1F02ICV49 sequence
tgtgaaggagagtcatgggtctgtgg

SEQ ID NO: 11510 - DNA, 19 bp, Artificial
  MQbrain_377; macaque brain D708YRU01EYU45 sequence
cagtgggagttctgcagcg

SEQ ID NO: 11511 - DNA, 23 bp, Artificial
  MQbrain_378; macaque brain D708ZXV02JPBKM sequence
agtaggggatactccaggcgctc

SEQ ID NO: 11512 - DNA, 22 bp, Artificial
  MQbrain_379; macaque brain D708YRU01D960P sequence
cccgtggaggagaggggatggc

SEQ ID NO: 11513 - DNA, 20 bp, Artificial
  MQbrain_37; macaque brain D708I2V01A6XOO sequence
agggtgaggacagccaggct

SEQ ID NO: 11514 - DNA, 19 bp, Artificial
  MQbrain_380; macaque brain D708YRU02F1BAA sequence
gtggccacggtgggcagcc

SEQ ID NO: 11515 - DNA, 18 bp, Artificial
  MQbrain_381; macaque brain D708YRU01EDNUS sequence
ctcctcggtctccctccc

SEQ ID NO: 11516 - DNA, 25 bp, Artificial
  MQbrain_382; macaque brain D708ZXV02F0H1H sequence
ctgcgcaagtacgcgggccaggcgg

SEQ ID NO: 11517 - DNA, 25 bp, Artificial
  MQbrain_383; macaque brain D708YRU02FQL7B sequence
gtccctgctgcagcagcccaggagg

SEQ ID NO: 11518 - DNA, 23 bp, Artificial
  MQbrain_384; macaque brain D4HK4YF02I4HRJ sequence
agaggctgcagccccgtgtctgg

SEQ ID NO: 11519 - DNA, 20 bp, Artificial
  MQbrain_385; macaque brain D708I2V01AR9HG sequence
cctggagctgcactgccttg

SEQ ID NO: 11520 - DNA, 25 bp, Artificial
  MQbrain_388; macaque brain D4HK4YF02ITT21 sequence
caatgggaaggagcctgagctgctg

SEQ ID NO: 11521 - DNA, 16 bp, Artificial
  MQbrain_389; macaque brain D708I2V02IJDLR sequence
tgtacagggactatga

SEQ ID NO: 11522 - DNA, 26 bp, Artificial
  MQbrain_38; macaque brain D4HK4YF01DC3LH sequence
ggactgctgtgctgtgggtgtctgtg

SEQ ID NO: 11523 - DNA, 19 bp, Artificial
  MQbrain_390; macaque brain D708I2V01BXYAG sequence
tggacgccaggggaaatgg

SEQ ID NO: 11524 - DNA, 23 bp, Artificial
  MQbrain_391; macaque brain D708I2V01BLN4G sequence
cagaactggagcactggaacagc

SEQ ID NO: 11525 - DNA, 21 bp, Artificial
  MQbrain_393; macaque brain D4HK4YF02IM4JI sequence
attgatgatcacagagctggg

SEQ ID NO: 11526 - DNA, 21 bp, Artificial
  MQbrain_394; macaque brain D708YRU01DHHV1 sequence
gaaggaaaagaggtcaacatg

SEQ ID NO: 11527 - DNA, 20 bp, Artificial
  MQbrain_395; macaque brain D708I2V02HT1XK sequence
aacggctgttcctgggattt

SEQ ID NO: 11528 - DNA, 18 bp, Artificial
  MQbrain_396; macaque brain D708I2V01AV8GA sequence
acgaagggaagatggctg

SEQ ID NO: 11529 - DNA, 19 bp, Artificial
  MQbrain_397; macaque brain D4HK8WR02GNLT3 sequence
tcagaccccagccacctgc

SEQ ID NO: 11530 - DNA, 20 bp, Artificial
  MQbrain_398; macaque brain D708I2V02HS7XS sequence
gctacagcaacagggtggtg

SEQ ID NO: 11531 - DNA, 19 bp, Artificial
  MQbrain_399; macaque brain D708ZXV01ENADJ sequence
tgaggttggggagcggctg

SEQ ID NO: 11532 - DNA, 25 bp, Artificial
  MQbrain_3; macaque brain D708ZXV01AHFYC sequence
gagagcagtgcttttggcggggagg

SEQ ID NO: 11533 - DNA, 19 bp, Artificial
  MQbrain_400; macaque brain D708I2V01CKUFP sequence
gcttgagttgaaattgctt

SEQ ID NO: 11534 - DNA, 19 bp, Artificial
  MQbrain_401; macaque brain D708YRU01A8JDK sequence
gggacggagcctgaggctg

SEQ ID NO: 11535 - DNA, 23 bp, Artificial
  MQbrain_402; macaque brain D4HK8WR01C1UZO sequence
gaatggacagcaggctgctctcg

SEQ ID NO: 11536 - DNA, 20 bp, Artificial
  MQbrain_405; macaque brain D708I2V02F22OV sequence
ggccggaaggagggcagagc

SEQ ID NO: 11537 - DNA, 19 bp, Artificial
  MQbrain_406; macaque brain D4HK8WR01BE85Y sequence
ggggaaggaggagctgggg

SEQ ID NO: 11538 - DNA, 21 bp, Artificial
  MQbrain_407; macaque brain D4G3X1F01D3BU3 sequence
atatggaggtctctgtctggc

SEQ ID NO: 11539 - DNA, 20 bp, Artificial
  MQbrain_407; macaque brain D4G3X1F01ECSFS sequence
atatggaggtctctgtctgg

SEQ ID NO: 11540 - DNA, 22 bp, Artificial
  MQbrain_407; macaque brain D4HK8WR01C2UP3 sequence
tatggaggtctctgtctggctt

SEQ ID NO: 11541 - DNA, 21 bp, Artificial
  MQbrain_407; macaque brain D708YRU01BP207, macaque brain D708ZXV02HT0RF sequence
atggaggtctctgtctggctt

SEQ ID NO: 11542 - DNA, 23 bp, Artificial
  MQbrain_407; macaque brain D708YRU02FQYAG sequence
atatggaggtctctgtctggctt

SEQ ID NO: 11543 - DNA, 20 bp, Artificial
  MQbrain_409; macaque brain D708YRU02JF80V sequence
gtggagagcatcctggtgtg

SEQ ID NO: 11544 - DNA, 23 bp, Artificial
  MQbrain_411; macaque brain D708ZXV02H0LLG sequence
gactcgggtgctcatgatcagtg

SEQ ID NO: 11545 - DNA, 29 bp, Artificial
  MQbrain_412; macaque brain D708ZXV02GA34W sequence
ggtaaatctacctggttctggcatgcttc

SEQ ID NO: 11546 - DNA, 18 bp, Artificial
  MQbrain_415; macaque brain D708YRU02HQXGH sequence
ctgagaaagactgctgtg

SEQ ID NO: 11547 - DNA, 20 bp, Artificial
  MQbrain_416; macaque brain D708I2V02HJYS2 sequence
tggaagaggagtggcctctc

SEQ ID NO: 11548 - DNA, 23 bp, Artificial
  MQbrain_417; macaque brain D708YRU01CCA41 sequence
tctgccccgaaggaaacaaacgc

SEQ ID NO: 11549 - DNA, 22 bp, Artificial
  MQbrain_418; macaque brain D708I2V01BQH74 sequence
ctctggcctctttgctgtcttt

SEQ ID NO: 11550 - DNA, 21 bp, Artificial
  MQbrain_419; macaque brain D708YRU02F98YR sequence
tcttggggttttgccagagtc

SEQ ID NO: 11551 - DNA, 24 bp, Artificial
  MQbrain_41; macaque brain D708YRU02GUG8Z sequence
gtggtgggaagctgccaagctgtt

SEQ ID NO: 11552 - DNA, 23 bp, Artificial
  MQbrain_420; macaque brain D708I2V01EYJPJ sequence
actcagccttctggacagccagg

SEQ ID NO: 11553 - DNA, 21 bp, Artificial
  MQbrain_421; macaque brain D708ZXV01ENM16 sequence
agggagaaggggacagaagct

SEQ ID NO: 11554 - DNA, 19 bp, Artificial
  MQbrain_422; macaque brain D708YRU02F28R1 sequence
tagccagcctcaagtagcc

SEQ ID NO: 11555 - DNA, 19 bp, Artificial
  MQbrain_423; macaque brain D4HK4YF01BYOUK sequence
ggaaggagggtgctgaccc

SEQ ID NO: 11556 - DNA, 18 bp, Artificial
  MQbrain_424; macaque brain D4HK8WR02IB904 sequence
aaacgagttggaggctgg

SEQ ID NO: 11557 - DNA, 27 bp, Artificial
  MQbrain_425; macaque brain D4HK8WR02JUW81 sequence
tcctaaatcgctgaggctcccagagtg

SEQ ID NO: 11558 - DNA, 19 bp, Artificial
  MQbrain_426, MQbrain_700; macaque brain D708ZXV01B7W4W sequence
ggagacttcctgtgggttg

SEQ ID NO: 11559 - DNA, 19 bp, Artificial
  MQbrain_427; macaque brain D708I2V02FHRK2 sequence
ctttgggtccaggaatggc

SEQ ID NO: 11560 - DNA, 19 bp, Artificial
  MQbrain_428; macaque brain D708YRU02IVEYZ sequence
tcttccagctctttgtccc

SEQ ID NO: 11561 - DNA, 23 bp, Artificial
  MQbrain_429; macaque brain D708YRU01CCOAW sequence
ggtttgggagcgacggagcctgg

SEQ ID NO: 11562 - DNA, 21 bp, Artificial
  MQbrain_42; macaque brain D4HK8WR01DPAN3 sequence
tgcggcaaggtggggctgggc

SEQ ID NO: 11563 - DNA, 24 bp, Artificial
  MQbrain_430; macaque brain D4G3X1F01DF8I2 sequence
cacaggacaggtttgtgaaagatg

SEQ ID NO: 11564 - DNA, 18 bp, Artificial
  MQbrain_431; macaque brain D708YRU02F1WF8 sequence
gctctggggcggtggggg

SEQ ID NO: 11565 - DNA, 20 bp, Artificial
  MQbrain_432; macaque brain D708ZXV01ELUZC sequence
atctagaagtggcctagctt

SEQ ID NO: 11566 - DNA, 18 bp, Artificial
  MQbrain_433; macaque brain D4G3X1F02FRHVJ, macaque brain D4HK8WR02HDLB0 sequence
aggactgctggaggaccg

SEQ ID NO: 11567 - DNA, 19 bp, Artificial
  MQbrain_433; macaque brain D4HK8WR02FVZ4B sequence
aggactgctggaggaccgc

SEQ ID NO: 11568 - DNA, 19 bp, Artificial
  MQbrain_434; macaque brain D4HK8WR01AKXZ6 sequence
aggcgaaggtcccggagcg

SEQ ID NO: 11569 - DNA, 22 bp, Artificial
  MQbrain_435; macaque brain D4HK8WR02F6W1A sequence
ttgaagtgatccgtggacaatg

SEQ ID NO: 11570 - DNA, 22 bp, Artificial
  MQbrain_436; macaque brain D708YRU02GOQQN sequence
gaaagactgggaaggcgacagt

SEQ ID NO: 11571 - DNA, 26 bp, Artificial
  MQbrain_437; macaque brain D708ZXV02GOVIQ sequence
cccagtgagcctcctgccccacaggc

SEQ ID NO: 11572 - DNA, 22 bp, Artificial
  MQbrain_438; macaque brain D4HK8WR01DFZIX sequence
cttgttctgccttggttgagcg

SEQ ID NO: 11573 - DNA, 21 bp, Artificial
  MQbrain_43; macaque brain D708ZXV01DJYMD sequence
ttgcctggtgcctgccctgtc

SEQ ID NO: 11574 - DNA, 18 bp, Artificial
  MQbrain_440; macaque brain D708I2V01C44NC sequence
aggagcagctcgctggcc

SEQ ID NO: 11575 - DNA, 24 bp, Artificial
  MQbrain_441; macaque brain D708YRU02F8BV3 sequence
ccctttctcctagtgcacgccttt

SEQ ID NO: 11576 - DNA, 18 bp, Artificial
  MQbrain_442; macaque brain D708I2V01DMSU5 sequence
tggtgtggaatggctgtg

SEQ ID NO: 11577 - DNA, 18 bp, Artificial
  MQbrain_443; macaque brain D708I2V01CNDH7 sequence
gcggccgggagcggagtt

SEQ ID NO: 11578 - DNA, 22 bp, Artificial
  MQbrain_444; macaque brain D4HK4YF02GHI5A sequence
actacaacatccagaaagagtc

SEQ ID NO: 11579 - DNA, 23 bp, Artificial
  MQbrain_445; macaque brain D708YRU02IMXEH sequence
agtttggcccctagccatgtgtt

SEQ ID NO: 11580 - DNA, 20 bp, Artificial
  MQbrain_446; macaque brain D4HK4YF02I01DA sequence
ccttctgagagggggcctgg

SEQ ID NO: 11581 - DNA, 22 bp, Artificial
  MQbrain_447; macaque brain D4HK4YF02F601S sequence
tcatcgggaggcctgtggagtg

SEQ ID NO: 11582 - DNA, 23 bp, Artificial
  MQbrain_448; macaque brain D708YRU02GFW9F sequence
ggaagtgtggtggtggaggtggc

SEQ ID NO: 11583 - DNA, 18 bp, Artificial
  MQbrain_449; macaque brain D4HK4YF02I56DO sequence
ggaagaggaaggtgtagg

SEQ ID NO: 11584 - DNA, 22 bp, Artificial
  MQbrain_44; macaque brain D708ZXV01D76QJ sequence
ggtgaggctcactggccaaggc

SEQ ID NO: 11585 - DNA, 22 bp, Artificial
  MQbrain_450; macaque brain D708I2V01AQ45W sequence
ctgcgctcgcctattccccgcg

SEQ ID NO: 11586 - DNA, 19 bp, Artificial
  MQbrain_451; macaque brain D708YRU02FT2J8 sequence
ttcttgatggctttctgtt

SEQ ID NO: 11587 - DNA, 20 bp, Artificial
  MQbrain_452; macaque brain D708YRU01DSGOU sequence
aagttggggtgtgtttgggg

SEQ ID NO: 11588 - DNA, 21 bp, Artificial
  MQbrain_453; macaque brain D708YRU01ECH11 sequence
gctcccctgacggcccagtgg

SEQ ID NO: 11589 - DNA, 21 bp, Artificial
  MQbrain_454; macaque brain D708I2V01CUUAF sequence
aaatctatgtgaatgttttgc

SEQ ID NO: 11590 - DNA, 20 bp, Artificial
  MQbrain_455; macaque brain D708I2V02J462C sequence
gaaggaaatgggggagtctg

SEQ ID NO: 11591 - DNA, 22 bp, Artificial
  MQbrain_456; macaque brain D4HK8WR02HDTCB sequence
agatggagttttcagagatgtc

SEQ ID NO: 11592 - DNA, 21 bp, Artificial
  MQbrain_457; macaque brain D4HK8WR02FRXYM sequence
gtgtggtgcagatggagggtg

SEQ ID NO: 11593 - DNA, 23 bp, Artificial
  MQbrain_458; macaque brain D708I2V02GXRBX sequence
ttggataagagagaggatggagc

SEQ ID NO: 11594 - DNA, 22 bp, Artificial
  MQbrain_45; macaque brain D708ZXV02JWGT1 sequence
tctgagggacttctggggatgg

SEQ ID NO: 11595 - DNA, 18 bp, Artificial
  MQbrain_461; macaque brain D708I2V02F33Y3, macaque brain D708YRU01E34E0, macaque brain D708YRU02GY05X sequence
ttgggtgagggtctgcct

SEQ ID NO: 11596 - DNA, 27 bp, Artificial
  MQbrain_462; macaque brain D708I2V02IVJIY sequence
tttgagcagctgaggttagcagatggg

SEQ ID NO: 11597 - DNA, 19 bp, Artificial
  MQbrain_463; macaque brain D4HK8WR01CF609 sequence
tgtgggtgctgtctgaagt

SEQ ID NO: 11598 - DNA, 20 bp, Artificial
  MQbrain_464; macaque brain D708ZXV02HH0J8 sequence
gcttcctgatttcagccctt

SEQ ID NO: 11599 - DNA, 19 bp, Artificial
  MQbrain_465; macaque brain D708I2V02HUGWG sequence
ccccagagcagcctctacg

SEQ ID NO: 11600 - DNA, 18 bp, Artificial
  MQbrain_466; macaque brain D708I2V01EBYBQ sequence
tgctctgggtgctgaatg

SEQ ID NO: 11601 - DNA, 23 bp, Artificial
  MQbrain_467; macaque brain D4HK8WR01DYFE7 sequence
ttttcctctgtgggcctgtcttt

SEQ ID NO: 11602 - DNA, 20 bp, Artificial
  MQbrain_469; macaque brain D4HK8WR01A9MCN sequence
agaaacggccgcctctgagg

SEQ ID NO: 11603 - DNA, 22 bp, Artificial
  MQbrain_46; macaque brain D708YRU01AJ19W sequence
tctgtccctcttggctgccagc

SEQ ID NO: 11604 - DNA, 19 bp, Artificial
  MQbrain_470; macaque brain D708I2V02F934A sequence
ggttggaatggccacgggc

SEQ ID NO: 11605 - DNA, 21 bp, Artificial
  MQbrain_471; macaque brain D708I2V02GXSK0 sequence
ctcgaggtgcccagagaagcc

SEQ ID NO: 11606 - DNA, 21 bp, Artificial
  MQbrain_472; macaque brain D708I2V02JWHZJ sequence
ctcacgccttgaaggtcttcc

SEQ ID NO: 11607 - DNA, 19 bp, Artificial
  MQbrain_473; macaque brain D708I2V01DT3G8 sequence
tctgggtctgcctggtctg

SEQ ID NO: 11608 - DNA, 22 bp, Artificial
  MQbrain_473; macaque brain D708YRU02I6H7M, macaque brain D708ZXV02G9U94 sequence
tctgggtctgcctggtctgagg

SEQ ID NO: 11609 - DNA, 21 bp, Artificial
  MQbrain_474; macaque brain D708I2V01CRH9W sequence
tgcttggggcagcggctcggg

SEQ ID NO: 11610 - DNA, 20 bp, Artificial
  MQbrain_475, MQbrain_476; macaque brain D4G3X1F01D67DG sequence
tgtggagggcccactgtgtc

SEQ ID NO: 11611 - DNA, 20 bp, Artificial
  MQbrain_477; macaque brain D708I2V02GJ7N3 sequence
aggggctgggcaggggtgcc

SEQ ID NO: 11612 - DNA, 19 bp, Artificial
  MQbrain_478; macaque brain D708ZXV01B648M sequence
ttcgggggtgacgctgccc

SEQ ID NO: 11613 - DNA, 20 bp, Artificial
  MQbrain_479; macaque brain D708ZXV01AFD9M sequence
agcagctggtgcggcaggtg

SEQ ID NO: 11614 - DNA, 22 bp, Artificial
  MQbrain_47; macaque brain D4HK8WR01BN5S3 sequence
acttggggaaagatggaaaagg

SEQ ID NO: 11615 - DNA, 24 bp, Artificial
  MQbrain_480; macaque brain D708YRU02FWG5H sequence
ctttcaggacccagcggggatctc

SEQ ID NO: 11616 - DNA, 18 bp, Artificial
  MQbrain_481; macaque brain D4HK8WR02HLL83 sequence
gcccttcccagcccagtc

SEQ ID NO: 11617 - DNA, 18 bp, Artificial
  MQbrain_482; macaque brain D4HK8WR02GQ735 sequence
agagcctaggaggagagg

SEQ ID NO: 11618 - DNA, 22 bp, Artificial
  MQbrain_483; macaque brain D708I2V02HUE4P sequence
cagaagcttcaggccaaggacg

SEQ ID NO: 11619 - DNA, 25 bp, Artificial
  MQbrain_485; macaque brain D708ZXV01EAIKR sequence
ggaggagaagagtgaccgtctgctc

SEQ ID NO: 11620 - DNA, 19 bp, Artificial
  MQbrain_486; macaque brain D708ZXV02GNQWX sequence
tcctggcccatgacacctc

SEQ ID NO: 11621 - DNA, 25 bp, Artificial
  MQbrain_488; macaque brain D708YRU01C3NMA sequence
ctgagctgaaagaggtcctctttgg

SEQ ID NO: 11622 - DNA, 24 bp, Artificial
  MQbrain_489; macaque brain D4HK8WR02IAPFJ sequence
ccctctgccccctccgagagccgg

SEQ ID NO: 11623 - DNA, 20 bp, Artificial
  MQbrain_48; macaque brain D4HK4YF02ISK2C sequence
ctggcttcctctcccatccc

SEQ ID NO: 11624 - DNA, 21 bp, Artificial
  MQbrain_490; macaque brain D708ZXV01E0VXZ sequence
aagagggaatggctgcctggg

SEQ ID NO: 11625 - DNA, 20 bp, Artificial
  MQbrain_491; macaque brain D708ZXV02HBDKK sequence
cagatcccagcccactcacc

SEQ ID NO: 11626 - DNA, 23 bp, Artificial
  MQbrain_492; macaque brain D708YRU02F9N7L sequence
aatgccaggggagagctgattgg

SEQ ID NO: 11627 - DNA, 18 bp, Artificial
  MQbrain_493; macaque brain D4HK8WR01C33DW sequence
tggagaaaggtagggtgc

SEQ ID NO: 11628 - DNA, 19 bp, Artificial
  MQbrain_493; macaque brain D708I2V02I4NLJ sequence
tggagaaaggtagggtgct

SEQ ID NO: 11629 - DNA, 19 bp, Artificial
  MQbrain_494; macaque brain D708YRU01APD0C sequence
gaaggctgggcacgacgct

SEQ ID NO: 11630 - DNA, 21 bp, Artificial
  MQbrain_495; macaque brain D708ZXV01CE7UX sequence
gaagccgtggtctggggcagg

SEQ ID NO: 11631 - DNA, 22 bp, Artificial
  MQbrain_496; macaque brain D708YRU02JSQXM sequence
aacttgggtgagatgggcagcg

SEQ ID NO: 11632 - DNA, 24 bp, Artificial
  MQbrain_497; macaque brain D708YRU01A34Y4 sequence
tggtgggtgaggctctgtggttgg

SEQ ID NO: 11633 - DNA, 18 bp, Artificial
  MQbrain_498; macaque brain D708I2V02ITHT9 sequence
acctcagccttggattcc

SEQ ID NO: 11634 - DNA, 24 bp, Artificial
  MQbrain_499; macaque brain D708ZXV02JAQDT sequence
ggtggcggtggcggtgccagcttt

SEQ ID NO: 11635 - DNA, 24 bp, Artificial
  MQbrain_49; macaque brain D708YRU01BDRGR sequence
gggacaggcctcaggtggcaatgc

SEQ ID NO: 11636 - DNA, 22 bp, Artificial
  MQbrain_4; macaque brain D4HK8WR01ANZMZ sequence
ggcctgtggggcagctgtctgc

SEQ ID NO: 11637 - DNA, 26 bp, Artificial
  MQbrain_500; macaque brain D708YRU02JR0JA sequence
tgagtaggggcaccgcggagtgaggc

SEQ ID NO: 11638 - DNA, 21 bp, Artificial
  MQbrain_501; macaque brain D708I2V01EL1QS sequence
gttgcctggtgcggggcaggg

SEQ ID NO: 11639 - DNA, 20 bp, Artificial
  MQbrain_502; macaque brain D708I2V02JY8IB sequence
cgctggtgctggcccagagg

SEQ ID NO: 11640 - DNA, 23 bp, Artificial
  MQbrain_503; macaque brain D4HK8WR02HRJMM sequence
acccacaggtgacctttaggctg

SEQ ID NO: 11641 - DNA, 23 bp, Artificial
  MQbrain_504; macaque brain D708ZXV02HASKB sequence
acggggcatggggctgccttggg

SEQ ID NO: 11642 - DNA, 24 bp, Artificial
  MQbrain_505; macaque brain D4HK8WR02GMW88 sequence
agctgggatggatggcagccactc

SEQ ID NO: 11643 - DNA, 21 bp, Artificial
  MQbrain_506; macaque brain D708I2V01DX6RU sequence
tggcagctgtgggcatcttgg

SEQ ID NO: 11644 - DNA, 26 bp, Artificial
  MQbrain_507; macaque brain D708YRU01ASZA1 sequence
attgggaaaggcgactgggatctgtc

SEQ ID NO: 11645 - DNA, 19 bp, Artificial
  MQbrain_508; macaque brain D4HK4YF02HH5UH, macaque brain D708YRU02HYEYF sequence
ctcactctcggtccctccc

SEQ ID NO: 11646 - DNA, 23 bp, Artificial
  MQbrain_509; macaque brain D708I2V02HGCLM sequence
gaagagcctggttcttaagattg

SEQ ID NO: 11647 - DNA, 22 bp, Artificial
  MQbrain_50; macaque brain D4HK4YF02H69RT sequence
acggggcaagccaagggtgctc

SEQ ID NO: 11648 - DNA, 25 bp, Artificial
  MQbrain_510; macaque brain D4HK8WR02IEIAB sequence
ggccctgagtctgcgctgggctccc

SEQ ID NO: 11649 - DNA, 26 bp, Artificial
  MQbrain_511; macaque brain D4HK4YF02IF7V0 sequence
gaagaggaggcggcggcgcgaggccg

SEQ ID NO: 11650 - DNA, 24 bp, Artificial
  MQbrain_512; macaque brain D4G3X1F02JSORO sequence
gaacaggtgtggggaagaggtggg

SEQ ID NO: 11651 - DNA, 21 bp, Artificial
  MQbrain_513; macaque brain D708I2V01ENNEY sequence
gacctgggactccgtgctttc

SEQ ID NO: 11652 - DNA, 18 bp, Artificial
  MQbrain_514; macaque brain D708I2V01BV37P sequence
agccgggccctgctgtcg

SEQ ID NO: 11653 - DNA, 24 bp, Artificial
  MQbrain_515; macaque brain D708ZXV01DLNGN sequence
ctctggccatgaaaatgttctgtt

SEQ ID NO: 11654 - DNA, 19 bp, Artificial
  MQbrain_516; macaque brain D708ZXV02FHWO5 sequence
ggccacgctgctgacagtg

SEQ ID NO: 11655 - DNA, 18 bp, Artificial
  MQbrain_517; macaque brain D708I2V02JA21H sequence
atcccaccaggacggccc

SEQ ID NO: 11656 - DNA, 20 bp, Artificial
  MQbrain_518; macaque brain D708YRU01AOGSS sequence
ttccccattctgcctggcct

SEQ ID NO: 11657 - DNA, 23 bp, Artificial
  MQbrain_519; macaque brain D708YRU01DYPCT sequence
tctgtgtgtacccttgcgtgtgt

SEQ ID NO: 11658 - DNA, 22 bp, Artificial
  MQbrain_51; macaque brain D708I2V02I2VWO sequence
tgggggccagggttggcggtgg

SEQ ID NO: 11659 - DNA, 19 bp, Artificial
  MQbrain_520; macaque brain D708ZXV02GP7AS sequence
cctcttccctgtccctggt

SEQ ID NO: 11660 - DNA, 19 bp, Artificial
  MQbrain_521; macaque brain D708I2V01A4DA8 sequence
gtggccgagagctcacttt

SEQ ID NO: 11661 - DNA, 18 bp, Artificial
  MQbrain_522; macaque brain D4HK4YF01EYLWE sequence
aagaagcagtggtgtgcc

SEQ ID NO: 11662 - DNA, 19 bp, Artificial
  MQbrain_523; macaque brain D708I2V02H4I04 sequence
gagagatgagcaggagcgt

SEQ ID NO: 11663 - DNA, 23 bp, Artificial
  MQbrain_524; macaque brain D4HK4YF01ETLRN sequence
caggacagggtggagaggccatg

SEQ ID NO: 11664 - DNA, 21 bp, Artificial
  MQbrain_525; macaque brain D4HK4YF02FLKQE sequence
gctctgggtgttctggccgtg

SEQ ID NO: 11665 - DNA, 21 bp, Artificial
  MQbrain_526; macaque brain D708I2V02J3YFV sequence
ttccttatgtggtgcaaggtt

SEQ ID NO: 11666 - DNA, 19 bp, Artificial
  MQbrain_528; macaque brain D708ZXV02H0H7U sequence
agacttgtcctgggaggct

SEQ ID NO: 11667 - DNA, 21 bp, Artificial
  MQbrain_529; macaque brain D708ZXV02HOXCI sequence
acctgggccaggcagggtgtg

SEQ ID NO: 11668 - DNA, 24 bp, Artificial
  MQbrain_52; macaque brain D4HK8WR02H1W1I sequence
tgccagcagtgggtgggcagcctg

SEQ ID NO: 11669 - DNA, 18 bp, Artificial
  MQbrain_530; macaque brain D4HK8WR01C9RD6 sequence
ctgaggaggtaggatctg

SEQ ID NO: 11670 - DNA, 21 bp, Artificial
  MQbrain_531; macaque brain D708ZXV01A6UYN sequence
ggggctggctgtgggcaatgg

SEQ ID NO: 11671 - DNA, 23 bp, Artificial
  MQbrain_532; macaque brain D4G3X1F01DSCJS sequence
cggtgaggtgggggcagcggccc

SEQ ID NO: 11672 - DNA, 23 bp, Artificial
  MQbrain_533; macaque brain D708I2V02HHJN1 sequence
cgcagtggagcggaggcgaaggg

SEQ ID NO: 11673 - DNA, 19 bp, Artificial
  MQbrain_535; macaque brain D708YRU01B2YX2 sequence
cgcggctgacgggacacgg

SEQ ID NO: 11674 - DNA, 18 bp, Artificial
  MQbrain_536; macaque brain D708I2V02HMW2S sequence
ggcgaggaaagcagtgtc

SEQ ID NO: 11675 - DNA, 21 bp, Artificial
  MQbrain_537; macaque brain D708ZXV02H3JL9 sequence
tcatgggagagagccagcgtg

SEQ ID NO: 11676 - DNA, 22 bp, Artificial
  MQbrain_538; macaque brain D4G3X1F02HHGDB sequence
ggctcccctttcttccctcttg

SEQ ID NO: 11677 - DNA, 25 bp, Artificial
  MQbrain_539; macaque brain D708ZXV02FEFLW sequence
acccagctggggtgggtgaggcctg

SEQ ID NO: 11678 - DNA, 19 bp, Artificial
  MQbrain_53; macaque brain D708I2V01EJY3P sequence
cccaggtggacgcagaggc

SEQ ID NO: 11679 - DNA, 19 bp, Artificial
  MQbrain_540; macaque brain D708I2V02I7IX8 sequence
gggctgcggagaatgtgtg

SEQ ID NO: 11680 - DNA, 23 bp, Artificial
  MQbrain_541; macaque brain D708YRU01E75ME sequence
ggagtgggagtgcctgcagcctg

SEQ ID NO: 11681 - DNA, 25 bp, Artificial
  MQbrain_542; macaque brain D708I2V02HRW4O sequence
gaaagcattcctgagggcctggact

SEQ ID NO: 11682 - DNA, 23 bp, Artificial
  MQbrain_543; macaque brain D4G3X1F01DENR0, macaque brain D4HK4YF01BPISQ sequence
ttgtggggttggagagctggctg

SEQ ID NO: 11683 - DNA, 19 bp, Artificial
  MQbrain_544; macaque brain D708YRU02FJDCU sequence
gctgtggagaagggagagg

SEQ ID NO: 11684 - DNA, 19 bp, Artificial
  MQbrain_545; macaque brain D4HK4YF02H05QH sequence
tgggagatctggggacttt

SEQ ID NO: 11685 - DNA, 19 bp, Artificial
  MQbrain_546; macaque brain D4HK8WR02INT28 sequence
acccccagctgctcctagg

SEQ ID NO: 11686 - DNA, 18 bp, Artificial
  MQbrain_547; macaque brain D4HK8WR02JBUEH sequence
cggaagggaggagtggtg

SEQ ID NO: 11687 - DNA, 22 bp, Artificial
  MQbrain_548; macaque brain D708YRU01BCBKK sequence
aatgccctgggtgacctcgtcc

SEQ ID NO: 11688 - DNA, 23 bp, Artificial
  MQbrain_549; macaque brain D4HK8WR02HO3O9 sequence
tctgacctccaggcttcaaggtc

SEQ ID NO: 11689 - DNA, 19 bp, Artificial
  MQbrain_54; macaque brain D708I2V02FSHIY sequence
atcggtggggccgtggctc

SEQ ID NO: 11690 - DNA, 26 bp, Artificial
  MQbrain_550; macaque brain D4HK4YF01EXLI2 sequence
atgggggcagtgagggagacagcccc

SEQ ID NO: 11691 - DNA, 19 bp, Artificial
  MQbrain_551; macaque brain D4G3X1F01DB7PK sequence
gtggaggcgtgggaatttt

SEQ ID NO: 11692 - DNA, 18 bp, Artificial
  MQbrain_551; macaque brain D4G3X1F02HH8F5 sequence
gtggaggcgtgggaattt

SEQ ID NO: 11693 - DNA, 18 bp, Artificial
  MQbrain_551; macaque brain D708YRU01DA1UY sequence
tggaggcgtgggaatttt

SEQ ID NO: 11694 - DNA, 19 bp, Artificial
  MQbrain_552; macaque brain D4HK4YF01BH5B1 sequence
tgagcaaggagcagccctc

SEQ ID NO: 11695 - DNA, 21 bp, Artificial
  MQbrain_553; macaque brain D4G3X1F01ENIDD sequence
tggagtcggggtggaggactg

SEQ ID NO: 11696 - DNA, 26 bp, Artificial
  MQbrain_554; macaque brain D4HK4YF02FP5JV sequence
tctggcaggatgtctccgttttcccc

SEQ ID NO: 11697 - DNA, 18 bp, Artificial
  MQbrain_556; macaque brain D708YRU02GX31N sequence
gggagcaagtgcagcggc

SEQ ID NO: 11698 - DNA, 24 bp, Artificial
  MQbrain_557; macaque brain D4HK8WR02H19EE sequence
agcccttggtggggagagcccggg

SEQ ID NO: 11699 - DNA, 20 bp, Artificial
  MQbrain_558; macaque brain D4HK4YF01BT7LM sequence
tgaagctggtggccgccatc

SEQ ID NO: 11700 - DNA, 18 bp, Artificial
  MQbrain_558; macaque brain D4HK8WR01DFWYZ sequence
aagctggtggccgccatc

SEQ ID NO: 11701 - DNA, 21 bp, Artificial
  MQbrain_559; macaque brain D708ZXV01BKVAN sequence
acccagccgcctcctcactcc

SEQ ID NO: 11702 - DNA, 21 bp, Artificial
  MQbrain_55; macaque brain D4HK4YF02I6CV1 sequence
ctccctgtgggccagggttgg

SEQ ID NO: 11703 - DNA, 18 bp, Artificial
  MQbrain_560; macaque brain D4HK8WR01DUKLJ sequence
ggaacaccgagggcaggg

SEQ ID NO: 11704 - DNA, 21 bp, Artificial
  MQbrain_562; macaque brain D708ZXV01B59LK sequence
gccgctggtcgggggtcaagg

SEQ ID NO: 11705 - DNA, 22 bp, Artificial
  MQbrain_563; macaque brain D4HK8WR01BBFFB sequence
cagagtctgcagcctgttctgg

SEQ ID NO: 11706 - DNA, 19 bp, Artificial
  MQbrain_564; macaque brain D708I2V02HLU0X sequence
gtctgggggagctcaagtc

SEQ ID NO: 11707 - DNA, 19 bp, Artificial
  MQbrain_565; macaque brain D708I2V01EIJRC sequence
gtggggctgctgctggagc

SEQ ID NO: 11708 - DNA, 21 bp, Artificial
  MQbrain_566; macaque brain D4HK4YF01CU5YM sequence
gagaagtggcggggctcggcg

SEQ ID NO: 11709 - DNA, 21 bp, Artificial
  MQbrain_567; macaque brain D4HK8WR02IIYYI sequence
gagggtgggccctgagccatg

SEQ ID NO: 11710 - DNA, 22 bp, Artificial
  MQbrain_568; macaque brain D4G3X1F01CLNVM, macaque brain D4HK8WR01CXAT4 sequence
tttgacacccgggggtctgagg

SEQ ID NO: 11711 - DNA, 21 bp, Artificial
  MQbrain_568; macaque brain D4HK8WR01AOYCF sequence
ttgacacccgggggtctgagg

SEQ ID NO: 11712 - DNA, 20 bp, Artificial
  MQbrain_568; macaque brain D4HK8WR02IVJK5 sequence
tgacacccgggggtctgagg

SEQ ID NO: 11713 - DNA, 25 bp, Artificial
  MQbrain_568; macaque brain D708ZXV01CWY69 sequence
tttgacacccgggggtctgaggggc

SEQ ID NO: 11714 - DNA, 19 bp, Artificial
  MQbrain_568; macaque brain D708ZXV02JM5A4 sequence
acacccgggggtctgaggg

SEQ ID NO: 11715 - DNA, 22 bp, Artificial
  MQbrain_569; macaque brain D4HK4YF01DQYXD sequence
tctggcctcattctctcctgtg

SEQ ID NO: 11716 - DNA, 21 bp, Artificial
  MQbrain_56; macaque brain D708ZXV02HSDQX sequence
agagctggtgaggggacttcc

SEQ ID NO: 11717 - DNA, 19 bp, Artificial
  MQbrain_570; macaque brain D708ZXV02HTAWO sequence
aggtgcagagggaggaacc

SEQ ID NO: 11718 - DNA, 21 bp, Artificial
  MQbrain_571; macaque brain D708ZXV01DMB1I sequence
gactcggccgccgctgtggtg

SEQ ID NO: 11719 - DNA, 18 bp, Artificial
  MQbrain_572; macaque brain D708YRU02F9S0Y sequence
actgtggagagtgaagtg

SEQ ID NO: 11720 - DNA, 21 bp, Artificial
  MQbrain_573; macaque brain D708YRU02HDJH0 sequence
ccttggtggtgggcttggttc

SEQ ID NO: 11721 - DNA, 28 bp, Artificial
  MQbrain_574; macaque brain D708ZXV01DZ9YZ sequence
gatttcagccctggaactgtctcccatt

SEQ ID NO: 11722 - DNA, 22 bp, Artificial
  MQbrain_575; macaque brain D4HK8WR02GBH5A sequence
tgggcctggaggcagccacggc

SEQ ID NO: 11723 - DNA, 22 bp, Artificial
  MQbrain_576; macaque brain D4HK8WR02FNHO1 sequence
ggcgtttgacatgagtggggtc

SEQ ID NO: 11724 - DNA, 19 bp, Artificial
  MQbrain_577; macaque brain D708ZXV01BKB7R sequence
aggatgagtttggagagtt

SEQ ID NO: 11725 - DNA, 19 bp, Artificial
  MQbrain_578; macaque brain D708ZXV01BBCGY sequence
aaggcacctaccaggggtt

SEQ ID NO: 11726 - DNA, 22 bp, Artificial
  MQbrain_57; macaque brain D708I2V01D94TY sequence
agatgtggatgtgaacctgccc

SEQ ID NO: 11727 - DNA, 20 bp, Artificial
  MQbrain_580; macaque brain D4HK8WR02GRSYE sequence
gtggagaagaggatttggcc

SEQ ID NO: 11728 - DNA, 22 bp, Artificial
  MQbrain_580; macaque brain D708I2V01A9WCD sequence
ggagaagaggatttggccagtg

SEQ ID NO: 11729 - DNA, 18 bp, Artificial
  MQbrain_581; macaque brain D708I2V02F76OU sequence
gtatcaaggctctggatg

SEQ ID NO: 11730 - DNA, 21 bp, Artificial
  MQbrain_582; macaque brain D708YRU02JI08Z sequence
gaagagggtttgaatagagtc

SEQ ID NO: 11731 - DNA, 21 bp, Artificial
  MQbrain_583; macaque brain D708ZXV01CE1BN sequence
ttggatggaagtgccaaaggc

SEQ ID NO: 11732 - DNA, 19 bp, Artificial
  MQbrain_584; macaque brain D4HK8WR02F1TI9 sequence
ggtttctctgggtgaattc

SEQ ID NO: 11733 - DNA, 19 bp, Artificial
  MQbrain_585; macaque brain D4HK8WR02IRZZE sequence
agatggagaggcagtgccc

SEQ ID NO: 11734 - DNA, 19 bp, Artificial
  MQbrain_586; macaque brain D708ZXV02H0LSM sequence
tccctcggatggtggcctt

SEQ ID NO: 11735 - DNA, 27 bp, Artificial
  MQbrain_587; macaque brain D708I2V02HJ23E sequence
ctgtccttcacagacaagtgacacacc

SEQ ID NO: 11736 - DNA, 18 bp, Artificial
  MQbrain_589; macaque brain D708ZXV01D1S2I sequence
tctcttaaggacatgtcg

SEQ ID NO: 11737 - DNA, 22 bp, Artificial
  MQbrain_58; macaque brain D708YRU01AER1T sequence
atgacagtgggaataaggttgg

SEQ ID NO: 11738 - DNA, 24 bp, Artificial
  MQbrain_590; macaque brain D4G3X1F01CZHT0 sequence
aggagagccagtggaggctgctgg

SEQ ID NO: 11739 - DNA, 24 bp, Artificial
  MQbrain_592; macaque brain D708YRU01AS6F5 sequence
gtccgtgaggtttgggcaggtgtt

SEQ ID NO: 11740 - DNA, 21 bp, Artificial
  MQbrain_593; macaque brain D708YRU02HOBCB sequence
gatgagatctccgacgatgcc

SEQ ID NO: 11741 - DNA, 27 bp, Artificial
  MQbrain_594; macaque brain D708ZXV02H1AG1 sequence
tgccagctgtgagggcctctgtggtgg

SEQ ID NO: 11742 - DNA, 20 bp, Artificial
  MQbrain_595; macaque brain D4HK8WR01DBFLQ sequence
aatgtgtgaggggacacagg

SEQ ID NO: 11743 - DNA, 21 bp, Artificial
  MQbrain_596; macaque brain D708I2V02H5OYP sequence
acttggatgcctgcagccagc

SEQ ID NO: 11744 - DNA, 18 bp, Artificial
  MQbrain_597; macaque brain D708I2V01DABMG sequence
ctgatggaccgtgcctgt

SEQ ID NO: 11745 - DNA, 21 bp, Artificial
  MQbrain_598; macaque brain D4HK4YF02IXQCT sequence
ccctcaaggatggcgagtgtg

SEQ ID NO: 11746 - DNA, 21 bp, Artificial
  MQbrain_599; macaque brain D708I2V02GJNU8 sequence
ggacggacggacgccgagcgc

SEQ ID NO: 11747 - DNA, 21 bp, Artificial
  MQbrain_59; macaque brain D708YRU02F7OVS sequence
ttgaggaccagggtggagctg

SEQ ID NO: 11748 - DNA, 19 bp, Artificial
  MQbrain_5; macaque brain D708YRU02FP3GH sequence
ggagggctgaagtgggtgt

SEQ ID NO: 11749 - DNA, 22 bp, Artificial
  MQbrain_600; macaque brain D708YRU01AI4B6 sequence
ctgctgcgcaggccacggccgg

SEQ ID NO: 11750 - DNA, 18 bp, Artificial
  MQbrain_602; macaque brain D4HK8WR02IHZ8R sequence
atcagcctgggccagagc

SEQ ID NO: 11751 - DNA, 21 bp, Artificial
  MQbrain_603; macaque brain D708ZXV02J18AK sequence
ttcctttgagagctacctgtg

SEQ ID NO: 11752 - DNA, 18 bp, Artificial
  MQbrain_604; macaque brain D708I2V01B0CCU sequence
tgtgctgggtgggccttt

SEQ ID NO: 11753 - DNA, 24 bp, Artificial
  MQbrain_605; macaque brain D4HK4YF01DM3IB sequence
tgtaggggtggcaagatgaaggtg

SEQ ID NO: 11754 - DNA, 19 bp, Artificial
  MQbrain_606; macaque brain D4HK8WR02IPR6R sequence
cgggcacctcctacctggg

SEQ ID NO: 11755 - DNA, 27 bp, Artificial
  MQbrain_607; macaque brain D708ZXV01DGHTP sequence
agcccaggaggggctgccctgtcttct

SEQ ID NO: 11756 - DNA, 20 bp, Artificial
  MQbrain_608; macaque brain D708YRU01AUI0X sequence
ctgtacagaccctggctttt

SEQ ID NO: 11757 - DNA, 19 bp, Artificial
  MQbrain_609; macaque brain D4HK8WR02JPOMN sequence
aaactcagggctgcgggtg

SEQ ID NO: 11758 - DNA, 19 bp, Artificial
  MQbrain_60; macaque brain D708ZXV02HZL2Q sequence
ggatggtgcagcctggctc

SEQ ID NO: 11759 - DNA, 23 bp, Artificial
  MQbrain_610; macaque brain D708YRU01A54GA sequence
gacaaggagtggctgagcagggg

SEQ ID NO: 11760 - DNA, 22 bp, Artificial
  MQbrain_611; macaque brain D708I2V01BK881 sequence
ggatggggagttggccagcttc

SEQ ID NO: 11761 - DNA, 21 bp, Artificial
  MQbrain_612; macaque brain D708ZXV01BCWFB sequence
cagcccacccctcctttctgc

SEQ ID NO: 11762 - DNA, 19 bp, Artificial
  MQbrain_613; macaque brain D708I2V01E2EZA sequence
acagctgggaggctgctgg

SEQ ID NO: 11763 - DNA, 22 bp, Artificial
  MQbrain_614; macaque brain D708I2V02JZMZI sequence
gaagggaagactgccttggagc

SEQ ID NO: 11764 - DNA, 24 bp, Artificial
  MQbrain_615; macaque brain D708YRU02HC7GV sequence
gaaggccttggtgtggtgatgatg

SEQ ID NO: 11765 - DNA, 21 bp, Artificial
  MQbrain_616; macaque brain D708I2V02IXKH5 sequence
aagagtgagttgacaggagtg

SEQ ID NO: 11766 - DNA, 22 bp, Artificial
  MQbrain_617; macaque brain D708YRU02F2KR1 sequence
aatgggagaggagtctggaggg

SEQ ID NO: 11767 - DNA, 21 bp, Artificial
  MQbrain_618; macaque brain D708I2V01D27U1 sequence
atggaacggcctgtgagatgt

SEQ ID NO: 11768 - DNA, 22 bp, Artificial
  MQbrain_619; macaque brain D708YRU02H90G7 sequence
cctggcgtggtggtcgaagatg

SEQ ID NO: 11769 - DNA, 22 bp, Artificial
  MQbrain_61; macaque brain D708I2V02IX7P1 sequence
tggttgggctgagggactgctg

SEQ ID NO: 11770 - DNA, 18 bp, Artificial
  MQbrain_620; macaque brain D708I2V02FNIA9 sequence
agcagtgaggatgatgtc

SEQ ID NO: 11771 - DNA, 23 bp, Artificial
  MQbrain_621; macaque brain D4HK4YF02GZPY1 sequence
cgttcacctccccttatcccttg

SEQ ID NO: 11772 - DNA, 22 bp, Artificial
  MQbrain_621; macaque brain D708YRU02J4KLY sequence
cgttcacctccccttatccctt

SEQ ID NO: 11773 - DNA, 22 bp, Artificial
  MQbrain_622; macaque brain D4G3X1F02J6T6D sequence
ctggagcgccgggccacctttg

SEQ ID NO: 11774 - DNA, 21 bp, Artificial
  MQbrain_623; macaque brain D4G3X1F02GKG74 sequence
agagatgggtgccctatggtc

SEQ ID NO: 11775 - DNA, 21 bp, Artificial
  MQbrain_624; macaque brain D4HK8WR01DBBGL sequence
ggtggagtgaggagggagtgg

SEQ ID NO: 11776 - DNA, 21 bp, Artificial
  MQbrain_625; macaque brain D708I2V02G2AC9 sequence
ttgctttcctgggtgatagtc

SEQ ID NO: 11777 - DNA, 19 bp, Artificial
  MQbrain_625; macaque brain D708ZXV02IULPZ sequence
ctgggtgatagtcaagggc

SEQ ID NO: 11778 - DNA, 19 bp, Artificial
  MQbrain_626; macaque brain D4HK8WR01A1RNE sequence
gtggggggatgggagatgg

SEQ ID NO: 11779 - DNA, 18 bp, Artificial
  MQbrain_627, MQbrain_748; macaque brain D708ZXV01CKL2T sequence
agactcccaggccagccc

SEQ ID NO: 11780 - DNA, 21 bp, Artificial
  MQbrain_628; macaque brain D708I2V02I22F5 sequence
gggaggagccggccatctctg

SEQ ID NO: 11781 - DNA, 19 bp, Artificial
  MQbrain_629; macaque brain D4G3X1F01B6J38, macaque brain D4G3X1F02FZJ5H, macaque brain D4HK4YF01A0DB6, macaque brain D4HK4YF02G12H8, macaque brain D4HK8WR01A9T7Y, macaque brain D4HK8WR02H1GU6, macaque brain D4HK8WR02I07HN, macaque brain D4HK8WR02J19V0, macaque brain
tcaccagccctgtgttccc

SEQ ID NO: 11782 - DNA, 20 bp, Artificial
  MQbrain_629; macaque brain D4HK4YF02G5R9Z, macaque brain D4HK4YF02GEX82, macaque brain D4HK4YF02HFGVM, macaque brain D4HK8WR02FZSAS, macaque brain D4HK8WR02HJRH3, macaque brain D4HK8WR02ILWMQ,
tcaccagccctgtgttccct

SEQ ID NO: 11783 - DNA, 25 bp, Artificial
  MQbrain_62; macaque brain D708ZXV01ARVQ6 sequence
cctctcacgcactcataagcctgtc

SEQ ID NO: 11784 - DNA, 20 bp, Artificial
  MQbrain_630; macaque brain D708ZXV01BWT4D sequence
cctacttcctggcggcagct

SEQ ID NO: 11785 - DNA, 18 bp, Artificial
  MQbrain_631; macaque brain D708I2V02H49MO sequence
atggtgatggtggctgtg

SEQ ID NO: 11786 - DNA, 23 bp, Artificial
  MQbrain_632; macaque brain D708ZXV02G70UO sequence
ttgtggaaagcggcttggcttgg

SEQ ID NO: 11787 - DNA, 20 bp, Artificial
  MQbrain_633; macaque brain D708I2V02FZZVP sequence
gggcagggctggccttggtg

SEQ ID NO: 11788 - DNA, 23 bp, Artificial
  MQbrain_634; macaque brain D4HK8WR01A2OH4 sequence
tcttctgctgcctgccttcctgg

SEQ ID NO: 11789 - DNA, 20 bp, Artificial
  MQbrain_635; macaque brain D4HK8WR02FJBKK sequence
aagttgggagatgggaaagg

SEQ ID NO: 11790 - DNA, 19 bp, Artificial
  MQbrain_636; macaque brain D708I2V01AI7RO sequence
caaggcctggggctggggg

SEQ ID NO: 11791 - DNA, 23 bp, Artificial
  MQbrain_637; macaque brain D4HK8WR01B0MNW sequence
gctgagtggggccctggcctatg

SEQ ID NO: 11792 - DNA, 20 bp, Artificial
  MQbrain_638; macaque brain D4HK4YF02FSFN8 sequence
aggggtgggcaggcagagtg

SEQ ID NO: 11793 - DNA, 19 bp, Artificial
  MQbrain_639; macaque brain D4HK8WR01EB8G4 sequence
ctgggacagctgcttctgg

SEQ ID NO: 11794 - DNA, 19 bp, Artificial
  MQbrain_63; macaque brain D708YRU02HGWX0 sequence
tgccatgcctcctgccctc

SEQ ID NO: 11795 - DNA, 20 bp, Artificial
  MQbrain_642; macaque brain D708ZXV02FSYQ1 sequence
tgatggagaaggagaaggcc

SEQ ID NO: 11796 - DNA, 19 bp, Artificial
  MQbrain_643; macaque brain D4HK8WR02HLWC1 sequence
cttgcttccggctggtgtc

SEQ ID NO: 11797 - DNA, 25 bp, Artificial
  MQbrain_644; macaque brain D708I2V01D5CFE sequence
tgacttggggtgcagagggctgctt

SEQ ID NO: 11798 - DNA, 19 bp, Artificial
  MQbrain_645; macaque brain D708I2V01A3U47 sequence
gcggcgacagctctggggt

SEQ ID NO: 11799 - DNA, 20 bp, Artificial
  MQbrain_646; macaque brain D708YRU01AGVJ7 sequence
gggggctggggagagcaggc

SEQ ID NO: 11800 - DNA, 18 bp, Artificial
  MQbrain_647; macaque brain D4HK8WR02G960F sequence
tgcctgcagggtgatgcg

SEQ ID NO: 11801 - DNA, 18 bp, Artificial
  MQbrain_648; macaque brain D4HK8WR02I2JVR sequence
gaaggcacttgagtcagg

SEQ ID NO: 11802 - DNA, 25 bp, Artificial
  MQbrain_649; macaque brain D708I2V01A2OJJ sequence
aggtgaagatgagacatagggttcc

SEQ ID NO: 11803 - DNA, 22 bp, Artificial
  MQbrain_64; macaque brain D708YRU02IAQMQ sequence
agaaggtggagtggcccacagg

SEQ ID NO: 11804 - DNA, 20 bp, Artificial
  MQbrain_651; macaque brain D708ZXV02JHF50 sequence
cagcaagagggtgaaaagcc

SEQ ID NO: 11805 - DNA, 20 bp, Artificial
  MQbrain_653; macaque brain D4HK8WR02HSN5Z sequence
ttctggagagtctaggtttg

SEQ ID NO: 11806 - DNA, 24 bp, Artificial
  MQbrain_654; macaque brain D708YRU01A8R9K sequence
ggttctgaagagaaggtgatgctt

SEQ ID NO: 11807 - DNA, 18 bp, Artificial
  MQbrain_655; macaque brain D708YRU01DFE9X sequence
cggagtcggagggcgggg

SEQ ID NO: 11808 - DNA, 20 bp, Artificial
  MQbrain_656; macaque brain D4HK8WR02HFHRJ sequence
ggctggcagtgccccgggtg

SEQ ID NO: 11809 - DNA, 20 bp, Artificial
  MQbrain_658; macaque brain D4G3X1F01DRHZS sequence
agtgtctgagcttggatgtc

SEQ ID NO: 11810 - DNA, 18 bp, Artificial
  MQbrain_658; macaque brain D708I2V01C59SO sequence
gtgtctgagcttggatgt

SEQ ID NO: 11811 - DNA, 19 bp, Artificial
  MQbrain_659; macaque brain D708YRU01DWLBD sequence
gggagctggagctgtggtc

SEQ ID NO: 11812 - DNA, 21 bp, Artificial
  MQbrain_65; macaque brain D708ZXV01DFKYI sequence
aggctctgcttggtaaacgtg

SEQ ID NO: 11813 - DNA, 19 bp, Artificial
  MQbrain_660; macaque brain D708I2V02GRX1H sequence
acttggggctggctgttgg

SEQ ID NO: 11814 - DNA, 19 bp, Artificial
  MQbrain_661; macaque brain D708I2V01EQQS8 sequence
tgagtagtggcgcgcggcg

SEQ ID NO: 11815 - DNA, 18 bp, Artificial
  MQbrain_663; macaque brain D4HK8WR01A9Y0Y sequence
ttggaggaccgcacggtg

SEQ ID NO: 11816 - DNA, 18 bp, Artificial
  MQbrain_665; macaque brain D708ZXV02GX2U5 sequence
taagccacaggctcagcc

SEQ ID NO: 11817 - DNA, 18 bp, Artificial
  MQbrain_666; macaque brain D708I2V02JE6KD sequence
gcgacagcggccgggatg

SEQ ID NO: 11818 - DNA, 21 bp, Artificial
  MQbrain_668; macaque brain D708ZXV02H9BCZ sequence
agtagaagctttggggtggtc

SEQ ID NO: 11819 - DNA, 20 bp, Artificial
  MQbrain_669; macaque brain D4G3X1F02HMATG sequence
gccgtgtctcccagaccatg

SEQ ID NO: 11820 - DNA, 23 bp, Artificial
  MQbrain_66; macaque brain D708ZXV02F6VU6 sequence
atggtgtggatggtgtgggactc

SEQ ID NO: 11821 - DNA, 27 bp, Artificial
  MQbrain_670; macaque brain D708YRU02GXL3W sequence
tagatcccaggtggttagagaagcttg

SEQ ID NO: 11822 - DNA, 20 bp, Artificial
  MQbrain_671; macaque brain D4HK8WR02H00SL, macaque brain D708I2V01APPJD, macaque brain D708YRU01BZ997, macaque brain D708YRU02JLYZB sequence
tgcagcctgggtggagcctg

SEQ ID NO: 11823 - DNA, 23 bp, Artificial
  MQbrain_671; macaque brain D708ZXV02F4YHV sequence
tgcagcctgggtggagcctgact

SEQ ID NO: 11824 - DNA, 19 bp, Artificial
  MQbrain_672; macaque brain D708YRU01CVF5R sequence
ctgggtggggcctgtggct

SEQ ID NO: 11825 - DNA, 22 bp, Artificial
  MQbrain_673; macaque brain D708I2V02JZVVA sequence
ggctggaagggagaaacagggc

SEQ ID NO: 11826 - DNA, 21 bp, Artificial
  MQbrain_674; macaque brain D708I2V01A9SIL sequence
gctggacggtgtcaagtgcgt

SEQ ID NO: 11827 - DNA, 21 bp, Artificial
  MQbrain_675; macaque brain D708I2V01DZ6YP sequence
actgacaggtttcagcagagt

SEQ ID NO: 11828 - DNA, 21 bp, Artificial
  MQbrain_676; macaque brain D4G3X1F01DSVC4 sequence
atggcggcctgaggcccaggg

SEQ ID NO: 11829 - DNA, 22 bp, Artificial
  MQbrain_678; macaque brain D708I2V01E3IJM sequence
tgacacggcgggggtggggtct

SEQ ID NO: 11830 - DNA, 21 bp, Artificial
  MQbrain_679; macaque brain D708I2V01D8IN8 sequence
agcacctctgcaagccaggtg

SEQ ID NO: 11831 - DNA, 19 bp, Artificial
  MQbrain_67; macaque brain D708YRU01EBX6S sequence
aattgggagttgctggagt

SEQ ID NO: 11832 - DNA, 21 bp, Artificial
  MQbrain_680; macaque brain D708I2V01BX1WG sequence
gctcctccagccaacctgact

SEQ ID NO: 11833 - DNA, 23 bp, Artificial
  MQbrain_681; macaque brain D708YRU01DW5FK sequence
ccccgttgggctgagcgccgagt

SEQ ID NO: 11834 - DNA, 24 bp, Artificial
  MQbrain_682; macaque brain D708ZXV02GP7WR sequence
tgttcgtaagagtacctgaggtgg

SEQ ID NO: 11835 - DNA, 21 bp, Artificial
  MQbrain_683; macaque brain D4HK8WR02IF9MC, macaque brain D708ZXV02H2VKR sequence
ctggggccacggaccgcgttg

SEQ ID NO: 11836 - DNA, 22 bp, Artificial
  MQbrain_683; macaque brain D4HK8WR02IMM99, macaque brain D708I2V02FYOD7, macaque brain D708YRU02F3IEM, macaque brain D708ZXV02I0XO6 sequence
ctggggccacggaccgcgttgc

SEQ ID NO: 11837 - DNA, 22 bp, Artificial
  MQbrain_683; macaque brain D708I2V01AX9K1 sequence
gctggggccacggaccgcgttg

SEQ ID NO: 11838 - DNA, 21 bp, Artificial
  MQbrain_683; macaque brain D708YRU01BTZSO sequence
tggggccacggaccgcgttgc

SEQ ID NO: 11839 - DNA, 20 bp, Artificial
  MQbrain_683; macaque brain D708YRU01DDD22 sequence
tggggccacggaccgcgttg

SEQ ID NO: 11840 - DNA, 19 bp, Artificial
  MQbrain_684; macaque brain D708YRU01CK5LD sequence
tgctcaggtaacaggaagg

SEQ ID NO: 11841 - DNA, 22 bp, Artificial
  MQbrain_685; macaque brain D4HK8WR01ECN20 sequence
tgaggagctctggccatggatg

SEQ ID NO: 11842 - DNA, 21 bp, Artificial
  MQbrain_686; macaque brain D708YRU01EBZG1 sequence
acgggggcctggtggagaagg

SEQ ID NO: 11843 - DNA, 19 bp, Artificial
  MQbrain_687; macaque brain D708ZXV02IPTEA sequence
ctggccaccgtggaaaagc

SEQ ID NO: 11844 - DNA, 21 bp, Artificial
  MQbrain_689; macaque brain D4HK8WR02GJICP sequence
ctgaagtggctttctgcagtg

SEQ ID NO: 11845 - DNA, 20 bp, Artificial
  MQbrain_68; macaque brain D4G3X1F02HASU9, macaque brain D4HK4YF02I6JEQ, macaque brain D4HK8WR02F94AP, macaque brain D4HK8WR02JTY88 sequence
gtccctgagtgtatgtggtg

SEQ ID NO: 11846 - DNA, 18 bp, Artificial
  MQbrain_690; macaque brain D4HK8WR02GKSZB sequence
ctttcctgcccagaacct

SEQ ID NO: 11847 - DNA, 19 bp, Artificial
  MQbrain_691; macaque brain D708I2V02IRYU5 sequence
ggccaaggagacaggactt

SEQ ID NO: 11848 - DNA, 21 bp, Artificial
  MQbrain_692; macaque brain D4HK8WR02JYUDO sequence
ctgggggaaaagctgacttgg

SEQ ID NO: 11849 - DNA, 23 bp, Artificial
  MQbrain_693; macaque brain D708YRU01BWAC0 sequence
agggcagctccatgggccagatg

SEQ ID NO: 11850 - DNA, 22 bp, Artificial
  MQbrain_694; macaque brain D708YRU01DEJRC sequence
gccagcagtgggcctgggtagc

SEQ ID NO: 11851 - DNA, 26 bp, Artificial
  MQbrain_695; macaque brain D4HK8WR02FGG1O sequence
gctggggacgactgaccacaggctgg

SEQ ID NO: 11852 - DNA, 22 bp, Artificial
  MQbrain_696; macaque brain D708I2V02IKZZZ sequence
tgctgaggtgtcagctgctctg

SEQ ID NO: 11853 - DNA, 24 bp, Artificial
  MQbrain_697; macaque brain D708I2V01BL0JJ sequence
gctgagtgccctgtccttgcatgc

SEQ ID NO: 11854 - DNA, 21 bp, Artificial
  MQbrain_698; macaque brain D708I2V02I7477 sequence
ttgccctgggccctcacctgg

SEQ ID NO: 11855 - DNA, 20 bp, Artificial
  MQbrain_699; macaque brain D708I2V01B77RV sequence
tcctgggtagacgccacctc

SEQ ID NO: 11856 - DNA, 22 bp, Artificial
  MQbrain_69; macaque brain D4HK8WR01AXI8O sequence
atcctcgtgttgtcgctaagtc

SEQ ID NO: 11857 - DNA, 23 bp, Artificial
  MQbrain_69; macaque brain D708YRU01COID1, macaque brain D708YRU02GRBHY sequence
gatcctcgtgttgtcgctaagtc

SEQ ID NO: 11858 - DNA, 19 bp, Artificial
  MQbrain_6; macaque brain D4HK4YF02HAY2G sequence
ggtggatccagtggcgctg

SEQ ID NO: 11859 - DNA, 19 bp, Artificial
  MQbrain_702; macaque brain D4HK8WR01ENGF1 sequence
gaatgtgacctccttgctg

SEQ ID NO: 11860 - DNA, 25 bp, Artificial
  MQbrain_703; macaque brain D708I2V01BXLAO sequence
gtgtcccaggctgctgagctctagc

SEQ ID NO: 11861 - DNA, 20 bp, Artificial
  MQbrain_704; macaque brain D4HK8WR02I9EXC sequence
tggaggttggcagagggctg

SEQ ID NO: 11862 - DNA, 19 bp, Artificial
  MQbrain_705; macaque brain D708YRU02HLL2O sequence
atgggtggcaggaacttgt

SEQ ID NO: 11863 - DNA, 20 bp, Artificial
  MQbrain_706; macaque brain D708I2V01C6V3J sequence
ttgggcagcctcccagcagc

SEQ ID NO: 11864 - DNA, 19 bp, Artificial
  MQbrain_707; macaque brain D708I2V02F1QC0 sequence
ctggaggggagggggctgg

SEQ ID NO: 11865 - DNA, 27 bp, Artificial
  MQbrain_708; macaque brain D708ZXV02GNQJ3 sequence
ggcctgggcctggggaagctgacgccg

SEQ ID NO: 11866 - DNA, 20 bp, Artificial
  MQbrain_709; macaque brain D708ZXV01D443H sequence
cttggggaatcccaccagct

SEQ ID NO: 11867 - DNA, 21 bp, Artificial
  MQbrain_70; macaque brain D708ZXV02HTKYV sequence
cgctgttctcctcactcatct

SEQ ID NO: 11868 - DNA, 21 bp, Artificial
  MQbrain_710; macaque brain D4HK8WR02IY7SI sequence
agcctgctgtgggcagtgggg

SEQ ID NO: 11869 - DNA, 19 bp, Artificial
  MQbrain_711; macaque brain D708I2V01A2SV1 sequence
tgttgacctccaggagtcc

SEQ ID NO: 11870 - DNA, 23 bp, Artificial
  MQbrain_713; macaque brain D708ZXV01B4LPU sequence
tgttggagcctgacagtgcctgg

SEQ ID NO: 11871 - DNA, 20 bp, Artificial
  MQbrain_714; macaque brain D4HK8WR01CVTCO sequence
ctgggtacagaaagggactg

SEQ ID NO: 11872 - DNA, 23 bp, Artificial
  MQbrain_715; macaque brain D708YRU02JDVLB sequence
tgggcagggtggcagaggacacg

SEQ ID NO: 11873 - DNA, 23 bp, Artificial
  MQbrain_716; macaque brain D708ZXV02HT7ZN sequence
ctgtggggctgtgggggaccggg

SEQ ID NO: 11874 - DNA, 26 bp, Artificial
  MQbrain_717; macaque brain D708ZXV01CD5JU sequence
actggcaacagcaccccattgggttc

SEQ ID NO: 11875 - DNA, 23 bp, Artificial
  MQbrain_718; macaque brain D4G3X1F02IELUZ sequence
actgaggaggggctgagacactg

SEQ ID NO: 11876 - DNA, 19 bp, Artificial
  MQbrain_719; macaque brain D708YRU01ANTM5 sequence
atgtgtctgggagctcctc

SEQ ID NO: 11877 - DNA, 22 bp, Artificial
  MQbrain_71; macaque brain D708YRU02IT4X1 sequence
cttgccagtctctgtgcctgct

SEQ ID NO: 11878 - DNA, 24 bp, Artificial
  MQbrain_720; macaque brain D4G3X1F01DXZ4F sequence
gatgcctgtgccagttctctagtc

SEQ ID NO: 11879 - DNA, 20 bp, Artificial
  MQbrain_721; macaque brain D708ZXV02GP3O0 sequence
ctcctgtgagagtctgaagg

SEQ ID NO: 11880 - DNA, 23 bp, Artificial
  MQbrain_722; macaque brain D708YRU02IHK47 sequence
ttcctctcaaaggccatggttgc

SEQ ID NO: 11881 - DNA, 19 bp, Artificial
  MQbrain_723; macaque brain D708YRU01C5U9M sequence
ctggtgtgggcgagtgtcg

SEQ ID NO: 11882 - DNA, 19 bp, Artificial
  MQbrain_724; macaque brain D4HK8WR01C8V9C sequence
agggtgtggggtgtgcatg

SEQ ID NO: 11883 - DNA, 18 bp, Artificial
  MQbrain_725; macaque brain D708I2V02G4OU1 sequence
gagaccagtggaggcgtt

SEQ ID NO: 11884 - DNA, 18 bp, Artificial
  MQbrain_726; macaque brain D708ZXV02JVPZ5 sequence
gttggctggagagagtgg

SEQ ID NO: 11885 - DNA, 21 bp, Artificial
  MQbrain_727; macaque brain D708ZXV01BW5L1 sequence
cgctggcttccacggtgatgg

SEQ ID NO: 11886 - DNA, 21 bp, Artificial
  MQbrain_728; macaque brain D708YRU01BCPBN sequence
ggactgcgggcagcctggcgg

SEQ ID NO: 11887 - DNA, 20 bp, Artificial
  MQbrain_729; macaque brain D4HK8WR02IIL2H sequence
tggctgaatgaacgaggatg

SEQ ID NO: 11888 - DNA, 21 bp, Artificial
  MQbrain_72; macaque brain D708I2V02I6JAT sequence
ttccgggtgctggctctgttg

SEQ ID NO: 11889 - DNA, 23 bp, Artificial
  MQbrain_730; macaque brain D4HK8WR01DQBA1, macaque brain D708I2V01CIBDZ sequence
gaggagccactccaggactcagg

SEQ ID NO: 11890 - DNA, 24 bp, Artificial
  MQbrain_731; macaque brain D708I2V01DFJEE sequence
gggtggggttctcctagtggcctg

SEQ ID NO: 11891 - DNA, 20 bp, Artificial
  MQbrain_732, MQbrain_733; macaque brain D4HK4YF01B6QQS sequence
tgtgggcatccagctctgcc

SEQ ID NO: 11892 - DNA, 23 bp, Artificial
  MQbrain_734; macaque brain D708YRU02GCCCS sequence
agcgggcgggcagaggaggcggc

SEQ ID NO: 11893 - DNA, 23 bp, Artificial
  MQbrain_735; macaque brain D708I2V01CB76Z sequence
tgctgaggacggggtggtgagtg

SEQ ID NO: 11894 - DNA, 20 bp, Artificial
  MQbrain_736; macaque brain D708I2V01BAFBE sequence
ttttggcaggggctgggagc

SEQ ID NO: 11895 - DNA, 24 bp, Artificial
  MQbrain_737; macaque brain D4HK8WR01BJ2RA sequence
tccgcaggctctcctcagctgccc

SEQ ID NO: 11896 - DNA, 21 bp, Artificial
  MQbrain_738; macaque brain D708I2V01DKHYJ sequence
gacggatgggggtgaggtggt

SEQ ID NO: 11897 - DNA, 20 bp, Artificial
  MQbrain_738; macaque brain D708I2V02GGDVQ sequence
gacggatgggggtgaggtgg

SEQ ID NO: 11898 - DNA, 22 bp, Artificial
  MQbrain_739; macaque brain D4HK8WR02ILW76 sequence
tgcaggaagtggagcccctggg

SEQ ID NO: 11899 - DNA, 24 bp, Artificial
  MQbrain_73; macaque brain D708ZXV02JD7CY sequence
aaatgtcttgtcccagccactgcc

SEQ ID NO: 11900 - DNA, 20 bp, Artificial
  MQbrain_740; macaque brain D708YRU01DLJK7 sequence
gtctaaatgagtttggagtg

SEQ ID NO: 11901 - DNA, 27 bp, Artificial
  MQbrain_741; macaque brain D4HK4YF02IILEE sequence
agagagtcaatgagtggaagacccctg

SEQ ID NO: 11902 - DNA, 22 bp, Artificial
  MQbrain_742; macaque brain D708YRU02FMFTK sequence
cggcggcggcccagcctcttct

SEQ ID NO: 11903 - DNA, 21 bp, Artificial
  MQbrain_742; macaque brain D708ZXV02FRTWX sequence
ggcggcggcccagcctcttct

SEQ ID NO: 11904 - DNA, 19 bp, Artificial
  MQbrain_743; macaque brain D708ZXV02H4QM7 sequence
actgggaggggcagggagt

SEQ ID NO: 11905 - DNA, 23 bp, Artificial
  MQbrain_744; macaque brain D708ZXV01A0YR8 sequence
cgttacagcagcctagagaattc

SEQ ID NO: 11906 - DNA, 22 bp, Artificial
  MQbrain_745; macaque brain D708YRU01C6DLT sequence
aaggaggcggcaagaagaactg

SEQ ID NO: 11907 - DNA, 20 bp, Artificial
  MQbrain_746; macaque brain D708I2V01C7IY5 sequence
gagtggccacctgctgatgc

SEQ ID NO: 11908 - DNA, 21 bp, Artificial
  MQbrain_747; macaque brain D4HK8WR01CLJQK sequence
gtcttctgaaagctggtgttg

SEQ ID NO: 11909 - DNA, 22 bp, Artificial
  MQbrain_749; macaque brain D4G3X1F01BL694 sequence
cttgaaggagcctgaggctggg

SEQ ID NO: 11910 - DNA, 18 bp, Artificial
  MQbrain_74; macaque brain D708I2V01EEPUN sequence
tcgtggtggtgcagtggg

SEQ ID NO: 11911 - DNA, 20 bp, Artificial
  MQbrain_750; macaque brain D708YRU01BZ0EL sequence
ggttgttcctggaggccatg

SEQ ID NO: 11912 - DNA, 23 bp, Artificial
  MQbrain_751; macaque brain D4HK8WR01AMO31 sequence
gacgacattctgagggacagcgg

SEQ ID NO: 11913 - DNA, 22 bp, Artificial
  MQbrain_752; macaque brain D708YRU01BFH9U sequence
cttgctgtggggccgtgcaggg

SEQ ID NO: 11914 - DNA, 19 bp, Artificial
  MQbrain_753; macaque brain D4HK8WR01ASLS3 sequence
aggccagggcttagggtgg

SEQ ID NO: 11915 - DNA, 16 bp, Artificial
  MQbrain_754; macaque brain D708YRU01BDUZP sequence
ggatggagtggcggtg

SEQ ID NO: 11916 - DNA, 21 bp, Artificial
  MQbrain_755; macaque brain D4HK8WR02G8EDT sequence
gattggcaggagaagcagccc

SEQ ID NO: 11917 - DNA, 22 bp, Artificial
  MQbrain_756; macaque brain D708YRU01BTS7B sequence
tgctgggtgccctctgtgtgtt

SEQ ID NO: 11918 - DNA, 20 bp, Artificial
  MQbrain_757; macaque brain D708I2V02I91ZA sequence
gtgttcagctggtgccaggg

SEQ ID NO: 11919 - DNA, 19 bp, Artificial
  MQbrain_758; macaque brain D708ZXV01CCHGO sequence
gaactggagggaagccacc

SEQ ID NO: 11920 - DNA, 20 bp, Artificial
  MQbrain_759; macaque brain D708I2V02JOZH3 sequence
ggtgtgtccagagccagctg

SEQ ID NO: 11921 - DNA, 22 bp, Artificial
  MQbrain_75; macaque brain D708ZXV01ESPJV sequence
ctgtctgtttgggaaatggttg

SEQ ID NO: 11922 - DNA, 18 bp, Artificial
  MQbrain_760; macaque brain D4HK4YF02I6LLC sequence
tggaggctcgagggcgtt

SEQ ID NO: 11923 - DNA, 21 bp, Artificial
  MQbrain_761; macaque brain D4G3X1F02HS8DF, macaque brain D4G3X1F02JCY42, macaque brain D4HK8WR01AKKE4 sequence
tcctgcattggcagccagtgg

SEQ ID NO: 11924 - DNA, 21 bp, Artificial
  MQbrain_762; macaque brain D708I2V01CE1G3 sequence
cagagccaccaacctttcttt

SEQ ID NO: 11925 - DNA, 18 bp, Artificial
  MQbrain_764; macaque brain D4G3X1F02GA63E sequence
tctcctttccaggacggc

SEQ ID NO: 11926 - DNA, 19 bp, Artificial
  MQbrain_765, MQbrain_766; macaque brain D708I2V01CHZSJ sequence
tccctccttccttcttgct

SEQ ID NO: 11927 - DNA, 21 bp, Artificial
  MQbrain_767; macaque brain D708I2V01BSMTZ sequence
gccaatcccagagaggcctgg

SEQ ID NO: 11928 - DNA, 19 bp, Artificial
  MQbrain_768; macaque brain D4G3X1F02FQLQP sequence
ttggtgccaagctgtgttg

SEQ ID NO: 11929 - DNA, 23 bp, Artificial
  MQbrain_769; macaque brain D708I2V02G78S9 sequence
gcttctcatttgacagtaactcg

SEQ ID NO: 11930 - DNA, 21 bp, Artificial
  MQbrain_76; macaque brain D708ZXV01CYC16 sequence
tggatttgggtggaaagggct

SEQ ID NO: 11931 - DNA, 21 bp, Artificial
  MQbrain_770; macaque brain D708YRU01EXIMZ sequence
ctgggctggggatccacaggg

SEQ ID NO: 11932 - DNA, 21 bp, Artificial
  MQbrain_771; macaque brain D708I2V01B5O33 sequence
ttgtgctgagagtgaaggttc

SEQ ID NO: 11933 - DNA, 21 bp, Artificial
  MQbrain_772; macaque brain D708I2V01BCTLO sequence
agactaccagggaatgccttg

SEQ ID NO: 11934 - DNA, 19 bp, Artificial
  MQbrain_774; macaque brain D4HK8WR02IPRO3 sequence
ccccaaggaccagttgttt

SEQ ID NO: 11935 - DNA, 21 bp, Artificial
  MQbrain_775; macaque brain D4HK8WR01AURI6 sequence
gggcctgggtttccttgtttg

SEQ ID NO: 11936 - DNA, 19 bp, Artificial
  MQbrain_776; macaque brain D4G3X1F01AZHD5 sequence
ctctgtccagccgcccgcg

SEQ ID NO: 11937 - DNA, 20 bp, Artificial
  MQbrain_777; macaque brain D708I2V02JT3HQ sequence
aacgatggtgctgactggtt

SEQ ID NO: 11938 - DNA, 20 bp, Artificial
  MQbrain_778; macaque brain D4HK4YF02FI48M sequence
ccctgaggacgacctggctg

SEQ ID NO: 11939 - DNA, 19 bp, Artificial
  MQbrain_778; macaque brain D708I2V02GW0E5 sequence
cctgaggacgacctggctg

SEQ ID NO: 11940 - DNA, 23 bp, Artificial
  MQbrain_779; macaque brain D4G3X1F02GBUTB sequence
aaaaaggccaggccctgtctttt

SEQ ID NO: 11941 - DNA, 19 bp, Artificial
  MQbrain_77; macaque brain D708YRU01DXPOG sequence
ggaatttccagccaggccg

SEQ ID NO: 11942 - DNA, 25 bp, Artificial
  MQbrain_780; macaque brain D708ZXV01EJFWV sequence
gagccagtgacaattccagcacccg

SEQ ID NO: 11943 - DNA, 26 bp, Artificial
  MQbrain_781; macaque brain D708I2V02JLB64 sequence
tcttggttccagcaggagggtgggct

SEQ ID NO: 11944 - DNA, 22 bp, Artificial
  MQbrain_782; macaque brain D708YRU01CECTQ sequence
ctggtgaaggagatcggccggg

SEQ ID NO: 11945 - DNA, 24 bp, Artificial
  MQbrain_783; macaque brain D708YRU02GYE7U sequence
tctccacagcccggcctgatctgg

SEQ ID NO: 11946 - DNA, 25 bp, Artificial
  MQbrain_784; macaque brain D708I2V01DTYGR sequence
ctctgggggccaaggccaccccctc

SEQ ID NO: 11947 - DNA, 19 bp, Artificial
  MQbrain_785; macaque brain D4HK8WR02GA752 sequence
cctacctctgccagctccc

SEQ ID NO: 11948 - DNA, 18 bp, Artificial
  MQbrain_786; macaque brain D708ZXV01ANEGV sequence
atttgtgtgtgcccatgt

SEQ ID NO: 11949 - DNA, 19 bp, Artificial
  MQbrain_787; macaque brain D708I2V02HU542 sequence
gtcctctaagccagctggg

SEQ ID NO: 11950 - DNA, 23 bp, Artificial
  MQbrain_788; macaque brain D4HK8WR02F68I0 sequence
gggagtgtgcatgtgcgtgtgtc

SEQ ID NO: 11951 - DNA, 23 bp, Artificial
  MQbrain_789; macaque brain D708ZXV02JLZAJ sequence
ttgggagtggtgggcctggcctc

SEQ ID NO: 11952 - DNA, 21 bp, Artificial
  MQbrain_78; macaque brain D708ZXV02H42KY sequence
gatctggttcttggtgtctgc

SEQ ID NO: 11953 - DNA, 19 bp, Artificial
  MQbrain_790; macaque brain D708ZXV02FJP5P sequence
ccaactccgggtgctctgc

SEQ ID NO: 11954 - DNA, 20 bp, Artificial
  MQbrain_791; macaque brain D708YRU02J0OIC sequence
tgtggacagtatctggaagt

SEQ ID NO: 11955 - DNA, 27 bp, Artificial
  MQbrain_792; macaque brain D4HK8WR01BRQOY sequence
gaaggccgagggcccacaactccattt

SEQ ID NO: 11956 - DNA, 19 bp, Artificial
  MQbrain_793; macaque brain D708ZXV01DBDPZ sequence
ctggagtgagggtgggcgg

SEQ ID NO: 11957 - DNA, 21 bp, Artificial
  MQbrain_794; macaque brain D4HK8WR01BA972 sequence
ctggctcctatggcctgggtg

SEQ ID NO: 11958 - DNA, 20 bp, Artificial
  MQbrain_795; macaque brain D708I2V01A0FUM sequence
gctcaaccctcaaggcctct

SEQ ID NO: 11959 - DNA, 24 bp, Artificial
  MQbrain_796; macaque brain D4HK8WR02ISUWU sequence
gggcccgcagttgccagggcactg

SEQ ID NO: 11960 - DNA, 18 bp, Artificial
  MQbrain_797; macaque brain D708I2V02JA76H sequence
tgctggcccagccctctg

SEQ ID NO: 11961 - DNA, 21 bp, Artificial
  MQbrain_79; macaque brain D4G3X1F02JT0AW sequence
aaggagcctggtgaacttgtg

SEQ ID NO: 11962 - DNA, 18 bp, Artificial
  MQbrain_7; macaque brain D708ZXV02IZMAU sequence
gaggctcgaggaggtgtg

SEQ ID NO: 11963 - DNA, 19 bp, Artificial
  MQbrain_801; macaque brain D708I2V01DGBJA sequence
aagaggcaggggaggctcc

SEQ ID NO: 11964 - DNA, 24 bp, Artificial
  MQbrain_802; macaque brain D708ZXV01E2QP6 sequence
ggagctgcaggatcccaggggagg

SEQ ID NO: 11965 - DNA, 21 bp, Artificial
  MQbrain_804; macaque brain D708ZXV01EVMGA sequence
tttgcagtgggtcagctttgg

SEQ ID NO: 11966 - DNA, 22 bp, Artificial
  MQbrain_805; macaque brain D708I2V02JN33X sequence
cttgtttttgcccatccacctg

SEQ ID NO: 11967 - DNA, 19 bp, Artificial
  MQbrain_806; macaque brain D708I2V02I0I0X sequence
gtggtcatgctgggtgggt

SEQ ID NO: 11968 - DNA, 23 bp, Artificial
  MQbrain_807; macaque brain D708ZXV01D044Z sequence
tgctggtgaactctggggtgctg

SEQ ID NO: 11969 - DNA, 19 bp, Artificial
  MQbrain_80; macaque brain D708I2V02G8JBF sequence
aatgatgctggggaccagg

SEQ ID NO: 11970 - DNA, 18 bp, Artificial
  MQbrain_810; macaque brain D708I2V02HKLEG sequence
ctggggatggaaggaggc

SEQ ID NO: 11971 - DNA, 18 bp, Artificial
  MQbrain_811; macaque brain D708YRU02JZYXJ sequence
cctgggggaggtctcatc

SEQ ID NO: 11972 - DNA, 24 bp, Artificial
  MQbrain_812; macaque brain D708ZXV02HHT7X sequence
agttgatactagtgcagctcctcc

SEQ ID NO: 11973 - DNA, 18 bp, Artificial
  MQbrain_813; macaque brain D4HK8WR02GW4G5 sequence
ctgccctgctttgctgtc

SEQ ID NO: 11974 - DNA, 27 bp, Artificial
  MQbrain_814; macaque brain D708ZXV02G3F1K sequence
atctgccagggtctgctctgggtgggc

SEQ ID NO: 11975 - DNA, 19 bp, Artificial
  MQbrain_815; macaque brain D708YRU02GSJ7L sequence
agggtgtgtggggagcagg

SEQ ID NO: 11976 - DNA, 19 bp, Artificial
  MQbrain_816; macaque brain D4HK8WR01DJLMI sequence
gatgtacccaggtgctctc

SEQ ID NO: 11977 - DNA, 20 bp, Artificial
  MQbrain_817; macaque brain D4HK8WR02HKO4R sequence
agatctcaaagcaaggtgtc

SEQ ID NO: 11978 - DNA, 19 bp, Artificial
  MQbrain_818; macaque brain D708YRU01DEFK5 sequence
tgaggatgaggggcagacc

SEQ ID NO: 11979 - DNA, 23 bp, Artificial
  MQbrain_819; macaque brain D708I2V02HCQKR sequence
ccaagtgggtgcggcagaatggc

SEQ ID NO: 11980 - DNA, 22 bp, Artificial
  MQbrain_81; macaque brain D708I2V02I9MB1 sequence
gccttgtgggtgggtttggact

SEQ ID NO: 11981 - DNA, 19 bp, Artificial
  MQbrain_820; macaque brain D708ZXV02G58AF sequence
gttgctggtttctgccctt

SEQ ID NO: 11982 - DNA, 23 bp, Artificial
  MQbrain_821; macaque brain D708ZXV01BTM2Q sequence
aggcttggagtgcagaggagtgc

SEQ ID NO: 11983 - DNA, 20 bp, Artificial
  MQbrain_822, MQbrain_823; macaque brain D4HK8WR01BWW8R sequence
ctgactcgcctggcagcctc

SEQ ID NO: 11984 - DNA, 20 bp, Artificial
  MQbrain_824; macaque brain D4HK4YF01AQ51D sequence
gtctacgaagggcagggttc

SEQ ID NO: 11985 - DNA, 20 bp, Artificial
  MQbrain_825; macaque brain D708ZXV01C9BDT sequence
gcttctgtggctgctctggc

SEQ ID NO: 11986 - DNA, 18 bp, Artificial
  MQbrain_826; macaque brain D4HK4YF02JU980 sequence
gctctgccattggggttg

SEQ ID NO: 11987 - DNA, 19 bp, Artificial
  MQbrain_827; macaque brain D708ZXV02IIGQX sequence
gggccagacgcagccacgc

SEQ ID NO: 11988 - DNA, 22 bp, Artificial
  MQbrain_828; macaque brain D708ZXV01EWV4Z sequence
gcgggtagctgcactgggcgcg

SEQ ID NO: 11989 - DNA, 19 bp, Artificial
  MQbrain_829; macaque brain D4HK8WR01BGX07 sequence
tggccgctggggacccgcg

SEQ ID NO: 11990 - DNA, 20 bp, Artificial
  MQbrain_82; macaque brain D708YRU02FN6C5 sequence
gctcacctggtgttggcctc

SEQ ID NO: 11991 - DNA, 20 bp, Artificial
  MQbrain_830; macaque brain D4HK8WR01D3BXF sequence
ctggggcccttctggagagg

SEQ ID NO: 11992 - DNA, 21 bp, Artificial
  MQbrain_831; macaque brain D4HK8WR01CVKQ3 sequence
atgtttttgtgcctgccctcc

SEQ ID NO: 11993 - DNA, 21 bp, Artificial
  MQbrain_833; macaque brain D708ZXV01C8WPG sequence
atggtagaatgacaagccacg

SEQ ID NO: 11994 - DNA, 18 bp, Artificial
  MQbrain_834; macaque brain D708I2V02HFJ7C sequence
ctgggagctggaggacgt

SEQ ID NO: 11995 - DNA, 21 bp, Artificial
  MQbrain_835; macaque brain D708I2V02J4GD2 sequence
tggtgggcagccctggcctcc

SEQ ID NO: 11996 - DNA, 22 bp, Artificial
  MQbrain_836; macaque brain D4HK8WR02FYE6U sequence
ggacagtttcccaggggagttc

(The sequence listing continues in the following parts.)

The invention claimed is:

1. An isolated nucleic acid molecule wherein said nucleic acid molecule is a miRNA, a pre-miRNA or a DNA molecule encoding said pre-miRNA, which has a length of 18-26 nucleotides in the case of miRNA or 60-118 nucleotides in the case of pre-miRNA or its coding sequence, wherein:
   (a) the sequence of the nucleic acid molecule comprises SEQ ID NO:1862, SEQ ID NO:9023 or SEQ ID NO:9024 or its corresponding ribonucleotide sequence or (ii) SEQ ID NO: 9023 or SEQ ID NO: 9024 or its corresponding ribonucleotide sequence, or,
   b) the sequence of the nucleic acid molecule is at least 80% identical to the miRNA or at least 70% identical to the pre-miRNA sequence of (a).

2. The nucleic acid molecule according to claim 1, wherein the nucleic acid molecule is at least 90% identical in sequence to the miRNA or pre-miRNA of (a).

3. The nucleic acid molecule of 1 which is a miRNA molecule or an analogue thereof.

4. The nucleic acid molecule of claim 3, the length of which is from 18 to 26 nucleotides.

5. The nucleic acid molecule of claim 1, wherein the nucleic acid molecule is the pre-miRNA or the DNA molecule coding therefor.

6. The nucleic acid molecule according to claim 5, the length of which is 60-118 nucleotides.

7. The nucleic acid molecule of claim 1, that is single-stranded.

8. The nucleic acid molecule of claim 1, that is at least partially double-stranded.

9. The nucleic acid molecule claim 1, that s RNA, DNA, a nucleic acid analogue molecules or a combination thereof.

10. The nucleic acid molecule of claim 9, that comprises at least one modified nucleotide analogue.

11. A recombinant expression vector, comprising a nucleic acid molecule according to claim 1.

12. A composition comprising as an active agent, a nucleic acid molecule according to claim 1.

13. The nucleic acid molecule of claim 1 that comprises SEQ ID NO:9024.

14. A composition comprising as an active agent, the nucleic acid molecule according to claim 13.

* * * * *